United States Patent 11,242,544 (MICROBIOMES AND METHODS FOR PRODUCING MEDIUM-CHAIN FATTY ACIDS FROM ORGANIC SUBSTRATES) - sequence listing, part 3

SEQ ID NO: 55 - DNA, 42887 bp, Unknown
  Metagenome-assembled genome
ttcgacctgcgcggaagccaggacttttgcaggcgtcagtctcgccgagaaagagccgtgatagtcgatgtcacgagccgtgtgtattcggctcgatgtcggcaagggctgtgaggtagcgtgcagctggggcagcggattcatgagggaacgagcttctggccgagctcgctgctctctgcgacagcgaagccagccaagctgccagggagaggggtcctgggccgtcgatgccgtgaggcaggcatagatgtatcctggaaggcggtactaggcccgctgttgaagcaagcgatcactgcctccgggcccctcgagattcccttcgtgcgagaggacgcacgaaggtggtaggggacgagatactaatggagggatcgggtagcgctcgcttccagcgacggaatctggaccacacttctgggcgcagcaatgcgtgcgagaggccaaggacagactcccagagaagaacgatgcgaggcggagaatgcgcggtcaggactcttggcggaatcggcagcacacctgtgaagcagatcgctccaggcgccttgtcgacattgcggagaccttcgctgccgaccgcagtcatggcgtgtcccgttccgtcatcgccgtcgacgaggatgagcgacactgcttgccggcaatcggacgcgtgctcctgcgatcgtcaggcggatggggctcgtgccatcttatgcaaggaagcgaacgggaagctcacgcggcctcgagccttcgaccgccaccggtcgcgagggcatggtgccagtcctcgtcgaggatctggtaaggtcgaatcgaaggggggaaggatgcgggtggaaggcggctcagaagctcgtcttgcaggggaacctcggctgaaaaagcttaatgggcaggattctcggaagccggacgctacggcctcctggggggggcgcggcgtcttctgacgggcgtgcctccttgcggagcgcacaggagccctgtggcgcgttcctgcaacgggggacaactgcggggcgctcgcgccttcggcctcaggggacagagcgtcagccgtgccggttcagttccaggccctctgcttcggcagcgcgttcaagggccgctttttcggatgcgggtccctcttcggcctcaggctcgtccggaagtggcacggatctcatcgagcgtaaaagcatggggatggccggcatcctcgacccaggggtctcatctgcctttggctcttcttcctcggctgccacggtctcgggcttggcttcgggcgctgcctgagctgcggtctgctgcttcgggctgcgtttctgctgatggagtttcaggcacagctgcagcatcttgcctctggagcctttgccttgtcctgaggcttctgtgtctcttccggcttgccttcttcttcttcttcctggatatggcgtggggcttcacggccttgagctggagcccttcgttttcttccagggctttcctgccttgcccgatcccttttcatggaccggtgcggcaagcgcctcgtcccactgccgttctggacaatgcgtgacgtagctcctgcctccctgtaagtcggtgagcgtcacgaagtcggagcagggcttgccatcacatcgcggaatgtctcgaagccgaggtttctggctctatgccttcgccttgaagagctcctcgatcttggcaggaattctggtgccctgtcccatattcctttgcatgagcgtgatagatatagagctggtgcccaagcctgaatctttgccatcttcatcatcccaacaatgtcccgcaagggaccgccgcgaattgcgaaacgtaaatagacatacccaaaagtgttgtctgcacatgcatccattccctgtcatgtatggatcatcgaagacaatgccctttccagcatgcatcgtgcatgtaacagagtacgcctacgacgtttccgtacagagataggggcctaatctgcgtaaaggaagatggaaggagctgataggaatggatcagacgcggaagagattctgaaggtcttctcgaagcgcctcggggcggccaggacctggattgtgcgggagggaccgagcatctctctgagggactgcctcaaggggcagtgctcggagagacgtttgggcacgtgcccatagcctgtctcgatgtgtaaggcagagtgcaaggctcacggcagaaggaaagctcctcgtcgtcgacaatacgatgtgcgagctctatggctgcctgcgtgcgggtcgtcggtgactctcttgcagtcgagtcgctcgatgcagtgctgggatggctcggaaggcggtcttatcgccgtaagcgtgcgaaggatatgccgcagggtttgcggaatctcgccgcatcgttcgacgagagcccgaggtctcgggcaggatgctcgatgagctcgcgcgggcactcggagcttcgatgagaggaggacgtgctgcttcggacaacgcaacaggtggcagcaagctatctacgtctgccatccgctgtgaagaggtccgctacccgcgactgccaaaggagatccgacgcagccgattgcggcgcgcacgctccagcggggctttgggccctgcgtcgatttccgtctcagaaagcctcgactgcgatgtgaagggacgcatcctctgcgctccaggcaatgcctgggtgccaggaggcatcgcctcgaggctctttgtcgtgaaccatgaggagggtgccatctggacgaggcttgatgcgggcatgggcaagccggaactctgatcgaggcactcgagcaggcgctcaagtgattccatccaaatgaaaagggccgcctgtggcggccctttctgtgtgccagggggatacctatttcgctttgagggctgcggtaggtcacgaagcggaaagggccttcctgtgtcatatccgtatcggtctcgtcgatgactgtcccacgccgggtcgtcatcgggttcgggaagaaggcgtcggcttcgcgcacgcagtctgccttcgtgacgatggcctccgtgcaataggggagcagctcttcgtagacgctggcacctcctatgacccagaccttgtccgggttcatcatgatcacgacggcgtggagaagctcgtcgatggagcaaccttctcggcttcctccggatcgagcgtcgttccgccatgcgtgaggacgatgttgcggcggttcttgagggggccggcctcccgggaagctctcgatgcgtgcgcggcccataacgacggtgcccctgtcgtgcaggcgacgaagtggtgcatgtcggccttgttgcggacaagcagctgcccttgtttccgatgccccagtcagagcaacagcgactattgctctcaatgcgcgctcctagatagcgatagggatgttcttgattgaggaccatgctggtagtcctcgacaatcaggtcgtccgtcgtgaaggcataaagtcatgcacgctcggggttgagcgtgaccttcggtgccggataggtcggcgggagatgagctcctctcatcggcaacatgcctgtcatagatatgggctcggcgatacatgaaaaccccactccacacccctgactaatacaccccacccaccgccccttatgccccccctctcaaaacaaactgacctctccatatcccacattccacgtccccaccaccccccaacgccacctaacccgacaaccccccaaatcttacccgtacaaaccccaacaccaacaaacaacccagccccaccccacctccaacaccatatgctccaccaccctttccacccagccccttccccccacccacacaaaaaataataccagtaacccgccacacaagatgcgacccgctatagagtcgccacccctataccccacacacaccccaccctgaccaacaccaatccaacagctgtgccgagcacaaggatcagagcaagaccaaagtacctgtggccctagtagaagccccctcctcccccaccccccctacccaattcagacttataccaattctcccaatcacacccatgcccacaaaaaaacacacccctacacactcaaacacctaccccttaccccacccagaaccctcccccattgacccaacagtcccccatcccaccccccgcacacttcaaccaccacgcaccccgcacacacgtacaacccaaaaacccgaccaacatctcatcacccagccattagggcaccttacaccgaacaagaaccccgcatcaagccggccctcgacacccaccgtcctcaaagatcattaccatgacccaaataaacacgacagaaactacaaaacaaccaaagccttaccaacccataccaaaaccccaaacaaacccccgtcacgtccccatccgccgctacaaccccccacagcaaatatccccccccccacataagcccctacagatgcccacccccaccccccccacatagctgcacaacccacaaccccgccctgccccccaaaccactcacccccacccaccccaccccactcaaaaccccctacccaacgacatcaccccataaaatcgcccccacccccaccaaccaaacccatcactaacgtcactaagacctctaccaagtcacaaccccgaacccgctcccctaccaagaacccaaccgacccaacttcccctcccccgccgcgcctcaccacaccatcaatacccctccaaacacacggcacaaacctaccctccaccctcacacctaaaaccgcggacccccacaccaccagacctcaaaccaatgcaaccccctcccaccacacaacccctaacaccacgacccatcccaccgttcttccccacacaccctaactcctctcccacccacacacccaccgaacacccacaccgaccccacaatacacccgaacccccccaatccccaccctccgaccccccccccccccctgcacatcctcaccgccacactcctaataatccccttccgcgccgaccaaacatcaactacccaccacaccaaccaccccctccttacccacacaacccttatgcgtacaccctaaccccacaacctggccctataactaaccgccgctcccaacataacctctacactatatacgaccactactccgatttcctaccgcccaagtacccccaccaacttaaccgctcaataacggccttaccttggctttgtggtcgtcggaagagcctccctgcctccatatagcaaacctgccgccaccatcatgagcaaggatggatactggcagacattccgttgttcgcgccaggaatcctggctgcgctgcacgagcaccatgttgagcgtcgggcggtcgggagccctgtcctgcgtcacgttgtagatccgttatggcgagggaggggtagagatgcatctcgtgcaggtcctggaagttgtacatgtttgtcatgatccgccgggagtacggattggcttcaggtcatagaggacacggtccatttggtcgaactgccttgggatactccgagaccggccgatctgatagccataggccttgcgatcgagccttcctcgtccgcccactcgtcccagatgtgcgagtgcaggtcatggatgttgttcgacttttctggtagatccagaggatctcgtccatcgcgctcttgagcgccgtgcgcctgagcgtgagtgcgggaattcctttctcaggtcgtagcggtgcagacgccagagcgcttgatcgtgtaggcaggagtgccgtcctccagtgggggcgcaccttctgtccttcggtcgtcgtgccattgtccaggatagcgcggcacatcgcgatgaagaggtcatcggccttgctcatggggaggctcctttctcaaatgaagctatctagcggatcggataccattattcatcggagccggagttcgagcccaggccgttgctgccgggccatctcccaagccgtattcgtcgttgtagccgtagccattgccgaggcgcggaagaggagctgctgtacgacttcatagctcgaaagatagcggtagatgaggcctgagaggccagcagcgcgcgtcgtcgctgctgcatgaggcagaggacgacggcatgcgatgatcagagctaccggacctgactttgcattctggggtcattcgtcgagctggaccggggactatagacgcgccggtgtctcagtgccggccatcgtatcatccataaggtctccttagaactgttctgcctggatgatgtcttcccacgcaaggccgatggcattcacgagggagcggtcggcctcgagccagtccacagaaagaagatcttcgtgggcaagccatctgcccgcctcgtggaccttgagctcgggctctgtgccggcagggaccggtgcgacatagacatccatggaaagatggaaatcggggtagtcatactctatggtatcgagataccagagcgtcgtgagcttgaggccaagctcctcttcaatctcgcggcggcaggcgtcctctgcggtctcgccgggctcgaccttgccgccgggaagctcccagccgtccttctgggcaccagcggcacgctgtgcggcaaagatgcgcgcgccatcggtgatgagggcagcggcgacatgcttcgtttctgccatcagagctcctctccggcaaagcgcacgaccgcatagctctctccgtcaggagcggcgaggtccacggcgtggccatcttctgtctcgtgcacgataggcacgatcgtgtcgccgagctgggcggcgcgcttgtactggacatcgatcgtgtgcggcaggcaggcagcgggacgcgcctggacggcgaggagcacatagttcgcattgttcatgtggtggttcgtgtcgaggaactgctctgtcacctcgaagggatgcatcttcgtgccaggtccttctgccttgaccttgcggaggagcggtccgatctcaagcctcggctccgcctcgtccatataggcatactcggattccgggacattgatgacacgctgggcggcaagatcgaacatgaaccagagggaatctgccttcacgcaagaagtgccgtctgcgcgcttcatctcgaagcagcgctttgcctggaggcctctcagatggtaggcccaggtcgagacctcaatcttctcgcagaagtgaggcaggctctcgatctcgatgtgccaggtgccgacaatccagccgagatgattgctccgaagatggccaaggccgatgccgagatgctccgactggaacgtggagcagtcctggaagtagttcatgagggcatagagcgtgagcgtgccctctccatcggattcgctgtagcggaccctgctatcgaatgaatacatgtgggctccttgtctggacttccagaccatggtgccacaaaaagatgctggctcccttgagcgcctgcacttagtgcgaaaagggcagcactcagtgcaggacaagccttctcagctggccggcatgttcggcgatgcactcacgtggcgtcgtcttgtcgagatgggcaatggtgaagaggaggtctgctgcatagagcgcaaggcagagtgccgctgctgccatgcagagcctctggtctgccgtgctgagcgtgcccaggatcgagggctgcaggatcttcacgtcgatgacagcaaagaggccgaagaccgagcttgcctgcggacagacaaggcccctgaagttcccgggaaacatcgaatagtcccaccatcttctgttgaagcggcgctcgagcatggctcctgaagtgtattcgagcacggtcgagaggatgcatccgagaaggaagaggagaagggtatcctcgacccagccgagagcgagccagacgacaatggcagagacgccgtagatcgggcaggtcggcccatagagcatgccgcggcgttcgagatggcgagaggcaagcgagcagtagatggtctcccagacccagcctccggctgcgatgatggcgccagaaagcaggaggtgggcagtggcttcagcaagggacactacaggcaatgtgtgctcctctcgagggattgggtcttctttgccaggacctcggcgacgcagcttgccttgtcggcaagcgtcacgacccagccttcgcgggtcctgggcggaatcggcacgaatgggaacatgtgatggacgatcacatcccgctcgattggcgtgagatcgaagtcgcgctctgcattgtgcagcgcatggaagggatgcgtgaacccatgccagcggtcgggtgccgttgcgctctcgtgccagtcgtagaggaaatagtcatgcagaagcgcacccgtgacgaggtcttccatatggaaggagaaggggagcgcatgggcgatgcggaaggctatggaggcgacagagaggcagtgctctgagcaggtcgtatccccatgctggatgaaggcatccatctgatggaaggcggcagtcgccgctaccggctctgccagctcttcgaagcttctcccgtccttcatgtgcatcctccattcgcaaccgaaagagaattattcccaaaatgggaaataattgcaaatcgggaaacagcctctctcatgctatgctcagatagtcgaagggaagctatgggcaaagagcgcagaggcgaagatagaagggtcatcaagacacgccgcgcgatacgcacggcgctcctggagctcctgtcgtccgatgatgcgggagatatcacagcccgcgatgtggctgagcgtgccctcatcagcaagaagacgttcctggcacattatggaagcgtctcttctgccatagatgagatggaagaagaggccgtcgaggctatcgccgatgtgctcgacgaagcggaagcagtggcagacggagagggctatgcacatgccgcagaatgcatcgcagagctcgccgaagaccgtgcgtcgaccgtaggcgccctcctgcatacgagggtcaaggacgatcttgtggccaggatcgagcgcctggtgcatgatcgggtcgtctctgctgcagggcctgacgcagggtcgctcatccccgatttcgtggcaggaggcatcgtctctgccttcaggcgctgggtccaggatggaaggcaactttgcgcaagcgagctggtccataaggtatcggcactcctggggatgctcgggcacggtagcggccagagcgaagagccgacagatatcgtataggacatcagggcccggagcgtggctccaggccctgattcattgcgggatgtctttgccgctacgcttctggataggcgatctcgtcggtacctgagaagcggggcgcctccgagtcctctgcatgatagcggctcatggagtccacgatcatgcggttcgcagcaggatagatgctcgtctcataggacgtgaccgtgccttcgatcacgtcgccgtccacctggagcggaatcggctcggaagagacgacgcggatatccttgccggtgaaggtctggatctgggggcgtccgatgctcttgccgcttctgtcgaggatgccggcaaagattggcttcagcacatgcacggcgtcgcttgtctcaagcacgatcacatcgagcaggccatcgtccatgcggcagtccggcactatctcgatatcgccctgcatcattgcattgttcgcgaccatgcaggtgatgccatcgcattcatgcacgacgccgtcagcgaagatcgtgaagtgcgagacgacaggccgggggttctcgagggcggctgcaaagtaggcaatctcgcccatggacttcttgttcgggatggcggatgacatgagctgggcatcgaagcccatgccgcacatgaggccaaagccgcgggagtgctcggttccctcagcgtcgtgccagtgcacctcggcgatatcggtgagagccgtgtgcccgaccctgcaggcacgcgcaagcgcggcaggctccatggcattgccgacatttgcacagaagaggtttgccgtgccggaggggaagacgcaggtcgcgacatcgcggtagcgcagggcatggaggaggcctgtgacggtgccgtcgccgcctgaaagcacgcacacgtcgtagtcctccgcattgcggacgagctcttcgggcgtctcgccgtctgcaatctcatggaacgtgcaggtgtctccctgatgcacgagagagcgctcgaactcgaagattgcgtcggagccgaagcccgacttgggattgtggattatgagagttcgcatatatcctcccggggcgggccagatgggcagcccggccgctatgatggttgaggagtgctggcgctgccagctttcttgcaagtatacccagggaacaccccgaaggagtcgcgtgtatctcacagatgaagccgatgtccgtgcctttgcagagcgtgcagccgcctcgagcgtgctcgcggtagatacggaattcctgcgcgagaagacctactatccgcgcctgtgccttctgcagcttgccacggcagaagagtccgctatcgtcgatccaatccttgtgaaggacctttcctgcatagccgatctcttccgggatacgcgcatcacgaaggtgttccatgcctgcggacaggacctcgaggtcatctatgctgccatgggctgcgtgcccgatccgatcttcgatacgcaggtggcagcggcttttctggggcacaggcagcagatcggctatggctcgcttgtcgaggcctactgcggggtgcaccttgcgaaggcagagtcgctcacggactggtcgaagcgcccgctcgatgcagcgcagctccgctatgcggaagaggatgtgagctacctcccgggcatctatgagcgcatgctctcagagctcgtcgagaagggaaggcttggctgggtgcttccggagttccagagcatgctcgatccttcgaagatcgtgacaaggcctgaggaggcctacctccatctcaagcgatccacctcgctcacgaaatcgcagcttgcgattgcacgcgagatctgcgcctggcgcgagcgcgaggcagcacgcctcgatgtgccgaagcgctgggtgctctcagacgagatcgtcgtcgagtgctgcagaaggcagccgacggtgccagctcggcttctgcgcatccgtggcacggagcagctcacgcaggcctcgatcgcagcggtctgcaatgcagtgaagcgcggtctttctgccgacatctccgatatcaaggtcacccacaggcatgcccgtccctctgccgagaccgagtcggtcgtcgacctcatgtatgccctgctgcgcatcaaggcggaccggtacgggatcgcctcgcaggtcatagcaacgcgtgacgacctgctcgagttcctgaggcaccctgagacgtcgccgctctccgcctcctggaagaaggaggtcatcggagacgacctcacaaggcttctccagggcgagattggcctcacggtgaaagatgggggaatagagcttctgtagcgtgcctgtgcgcctgcgtcagattcctgtcggatactgggtagaagatggacacgtacacaggacacaaggagtcgattcatgccgtactactatttctatgggttcgacccggcgtatcttctgctgatcgtcgtctcgaccatcctgggcatggcagcccagggatatatcaggagcacataccgcaagtggtccaatgtcccggcatcgagcggcatgacgggcgcgcaggttgcacgccgcatgctcgatgagggcggtgcctcctctgtcggcatcaccgagatcggtggcaccttgacggacaacttcgacccgagggacaacaagctccatctctcgcaggagaacttctctgagggctctgtcgcctcggtcgctgttgcctgccacgaggcaggacacgcctgccagaaggccaagggctatgtgcccatgaaagtgaggacggcgctcgtgccggtcgtgaacttcgcgacgaacgcctggaccgtcgtgttgcttctgggcatcttcatgggcctcaccggctttgtccgtctggcgctcatcctctttgccttttccgtcatcttcgagctcgtgaccctgccggtcgagatcgatgcctcgaggcgtgctgtgaaataccttgcagccaatggcggaggcatcgacgagaagggtgcgaagcaggtcctgactgcggctgccctgacgtacgtcgcagcagcacttgtctcgatcctgcagcttgtctatctgatgggacgctacaatgaccggaactagcgagctttcagacgaggcgctgagcgtctccgaggcggttgctgccgcaaagggtgcggtggcatcggtcggcaccttcctcgtcacgggcgaggtctcgggcttccgtggccccaatgccaggagcggacactgctacttcgaggtcaaggacgatgtgtcctcgatgtcggtgattgtctggcggggcgtctatgccgcctccggcatccagctcaaggacggcatggagctcctcatgaagggcaagttcgatgtctaccagggctcgggcaggctctccttcatcgcgagcaagatcatggtgtcaggagaagggcttctgcgccagcaggtcgcagcgcttgcgagaaagctcgagcgcgaaggcctcatggacccctcccgcaagcgtcccatcccgcgcttctgtacgcgtgtcgctgtcgtgacctccctttccggttctgtcatcgaagatgtgcgcaggacgctcaagcgcaggaacccgcttgtcgagctccagatggtcggcgcctcggtccagggaccggaagcgccgagaaccatggtgagagccttgaagatcgctgcagcggcaaagcctgatgcaatccttcttgtccgtggcggcggctccttcgaggacctcatggcgttcaacgacgaagggcttgcgcgtgccgtggcagcctgccccgtgccggtgattacgggaatcggacatgagcctgacacttcgatctgcgacatggtggcagacaggagatgctcgacgccgaccgctgcggccgagtcggtggcaccggctctggatgagatcgtgacgaccctgaacgagcgccaggtacgtcttggacgtgccttcgggacaacgctcgagcgcgaaggggagaagctttcccatgcagagcagctcatgagctctgctgtgacaggaaggctcggtcgcgagcaggtgcacctcgagtctctggcaaagcaccgctgcttcacggacccgatgtccttcatcgaggacagaagatctcagcttgagctttccgagcagcgcctccacgacgcgattccgcatgcgctcgagcggcaggagaatgacctcagccacatggttgtgcgtctcacgggtgccgctaccaggatgctcgttccttacgaggcagaggtgaagcgtgctgcagcgacgctcgatgcgctctcgcccctgaaggtcctgggccgtggctacgcaatcgcaaaggacaaggacggccatgtcgtgagcgatgcagaaaagctttcgcctggagacgagctcaacgtgatgctcggacatggtacggtgacgacagaagtgaagggcgtcgatgtttcggcgcagacaagataggagatttccatggctgaagagctgccgaaggtagaggacatgagcttcaaggaggcttccgtcgagcttgagcgcatcgtgcgctctctcgaagcaggagacctcgagctcgaggattcgcttgcccagtatgcacgcggcgtcgagctcctgaagagcctgcgcgacaggcttgcacatgccgagcagaaggtgcaggtgctcctcgatgcctcgaaggaagaggtggcaccggatacgaccgctgctccctctacggcatacctggacgagtaggtgaggattgctgtctgtgccgaagctgtggcatccaagctcggctttgcggcgcagctgagagagtagactggacccaacatccgcgaatggaaggagcaggtgctatgagcgactgcattttctgcaagattgcaaacggcgagattccgaccgatatggtctacgaggacgacctcgtggtggcattcaaggacgtgaatccgctcacgccggtccatgtgctcgtcgtgccgaagaagcactacgcgaacatcgtggacaatgtgccggctgaggtccttgctgcgatggcccacgcaatcgacgtcgtgacgaagcagtatggcctcgacaagaccggcttccgctgcatcacgaataccggcgacgatgcaggacagtccgtgcatcacttccacatccacatcctgggtggcaggaagctcgacccggaggccggcgagggcaagaagtagcgagcctgaggcgagaggcgctgcgtaagcagcgcctcttttgctctgcgggatatgcattgaatcccttgctgagaatgcatttttttatgaagcgatggcgctcatgcgaataatgcgccaccttgccgagatgggcactgggatgggatatctgcggcaagtagagtatcattgacatgtctgtgttgggagggcaccctccctgagagaggagactcatgattgtacttgtcatcaacgctggcagctcttcgctgaagtatcagctgctcgacacgaagacccgcgaagtatatgccaagggcaactgcgagcgcatcggtatcgatggctccttcatcggccacgaggagcgtggcggcgagaagcagaagctcgaggttgcacttcccgaccacaagacggctgtgaagcatgtcttcgatatcctcgccgaggcaggcttcgatacggacaagatccagggcatcggccaccgcgtcgttcaaggcggctggtacttccccgagtccaaggtcgtcaccgacgagaccctctcctgggtccgcgaggtcgcaccgctcgcaccgctccacaactacgcagaggctgacgtaatcgaaatctgccgcgagatgttcccttccatcggcaatgtgatcgtcgccgatacgtccttccactacaacatgcctgagaaggcatggcgctacgccctgccgcgcgacgtcgtggacaagctgcacatccgcaagtacggcgcacacggcacttcgcatcgctacatctggaaggagacctccgagttcctgaagggcgacgtgcacaagctcgtctcctgccacctcggctctggcgcctccctttccgctatcgaggatggccacgacatggacaccacgatgggccttacgccgcttgatggcctcatcatgggcacccgctgcggcacgatcgacccggctacggtctgctaccttcagcgcgtcggtggctactcggtcgacgaggtcgacacgatgatgaacaagcagtccggcctgcttgcactctctggtgtctcttccgactcccgcgatatcgaggctggtgccgagaagggcgacaagaactgccagatggcgctcgagatgttctactaccgcacgagccagctcatcgccgagatggcacagtccatgcacggcttcgacacgatggtcttcacggccggcatcggcgagaactcggcagagatgcgctacggagtggcacacgagctcgagtggctggcgtaagatcgaccccgaagaaacgcagtgcctcccgaccgcgtatcatctcgacggacactcttctgtcaaggtcctcgtcgttcctacgaacgaggagctcatgatcgccctcgacgtcgaggcgctcctcggctaatcgcccaggcccatatggtcctgaacaaggcggagcttcctccgggaggctccgcctttcttatggctcttggctcggatgctggaagccaatgttcatagaaggggcgatagcccctccattggccggctgccgaagcatcagaggctacagatagatagagagactgaacctgtatatgggctgaatgcacgttttccatatcgcagccgcgcacttctcttttccacagccgtatccacctctgcaaggaggcggcggcatgaagaaggaaacgcgtgaccccttcatcctgcttgtggctatcagcttgagcttgtctgtgactgcggcttctgattctgagctggcacaggacaccccgctggatctctagatgtccgtccttggaggcatgtgggcttttcggaagcatccttacagtctcttcatcttccgtcgctgtggaagaggcttccaaagaaagactgatgctgccggctccgcatgatttgcgctggattgtgtccagaggcggggtttcggcaacaatgtggagggctggtccgagaagacggaccagccctccatctcatgcgtctcttgcagatgagcgctttgtcccattcctgcgtttcggcgctcgcccaggcctatctcctagaacggacggatcgtgaaggtgcgggaaagctcttctcccggctcgaggaagagcatgccgcgcttcttctcgaactcgtcggtctcgtccttggcagcagcgacgccgacccagggctcgacggcgacgaagggtgcgtcgttctcggcagaccagacgccgagataggggaagccgtcgaaggagagctcgacaccgtggccgctcttctttccgaagagctggacacggttttccggtacctcgtggagcgtgagcgtgagatagcgctcgaagaggtcatgtgtgagcggaagcgtatcggaagtgccgagcgaggacatctggctgaagtcctcaaggccctctgcgtcgatggctgcggtctcgatatcccaaggtgcagcgaagcggagctcatagtcctcgaaggactcatctgtgccggctaccggcacattgaaggcaggatgtccgccgagcgtgaagggaagcgtcaccttgcccggattcttcacggtataggtctgggagagcttcttgccgtctgctgcataggtcatctcgagcacccaatcgtacgggaagctcttcttcgtctcatcggtcgactccacatggaacgtgacggacgagctgtccttctttgccactgaatgctccatgtttctggcaaggccatggcgggagagatggatgtcgccctgctcgctcgtggcaaacccgttcctgagcacgccgacgatagggaagaggatgggggcgcatctcggccaccacttcggatccctctgccagaggtactcggtgccatcgagtgccaggctcatgagctgtgcgccgtgggaatcgattgcagcagaaaggggaccggacgagatcttttctatggtgctcatgggcagctccttaaggatatgcacgaaatgcagaacgcaaccatcatagcgccgaagcatgctcacgggtcctcgtcccggctggcggcacagcagacggatggatgggctgcggacagggaaggcgccctgtgtccaaatggacggaaatgaagcgaattgacgcatatgcggtacccagcagggaacaagaagcgaggcgggcagaacgattcctgattggatgcatgacggaaacgcttccggcatgttaacgattcaatgcagttttttgtagtccgctagaattttatgtgctggtttcaaggatggtctatctgcgtgcaaggtgcgcgcacccgttaggaggatgtatcgtgatcgaagaagagcttgcacacgctggcattgcagcgcatgagggcaaggtgctggtcgacgccgctcctgccgtgcttgtagaagaggctctgaagaagggcgagggcgagctgacctcgaccggcgcattcgcagtctacaccggcaagtatacgggacgctctccgaaggaccgcttcattgtcgatacgcctgatgtgcatgacaagattgcctggggcaccgtgaatgtgccgatgagcgtcgagggctaccagcacatcaaggagaagatctgctcctaccttgcgaagcacgacctctatgtgatccatgcctacgctggcgcgaacagggcacactcccgcaagttcgaggttgtctgcgagctggcaagccaggcactcttctcgaagcagctcctcgtgcgtccgaccgatgaagagcttgcatcgtatggcatgcctgacttcacggtccttgcagctcctggctgcaagtgcgacccggcggtcgatggcacgcactccgaggcctgcatcctcatcaacttccaggagcatgagatcttggtcctcggatcgcgctactcgggcgagatcaagaagtcggtcttctcgacgatgaactaccttacggtcgaggaggacaacatccttcctatgcactcgtctgtgaacaaggatcccgagaccggcgagacagcagtcttcttcggcctttccggcaccggcaagacgacgctttctgccgacccgaagcgcatccttgtcggcgacgacgagcatgcctggggcgacgatggcgtcttcaacttcgagggcggctgctacgcaaagtgcatccgcatctctccggagaccgagcctgacatcttcaatgccatcaagttcggctctgtctgcgagaatgtcgtcctcgacgacaagcgcgtggccgactacgacgatgccaagtacacggagaacacccgcgtcgcctacccgatcgagaatatcccgaattccgatccttcgggctgcggcaaggtcccctctgtcgtcatcttcctgacggccgatgccttcggcgtgcttccgccgatctcccgtcttgaccgcaatggcgccatgtaccacttcatctccggcttcacctcgaaggtcgccggcacggagcgcggcatcacggagccgcagccgacgttctcgacgctcttcggcgagccgttcatgccgctgaacccgctcacctatgcccagatgttcggcgagcgcatggagcgctatggcacccgcgtctacctcgtgaacactggctggaccggtggcccttacggcaccggcaagcgcatgaagcttgcctatacccgcgccatggtcacagcagccctcaatggctctatcgagaatgccgagttcgtgcacgacaaggtcttcaacgtcgatgtgccgcagacaatcgaggatgtcccgtccgagctcctgaatccgcgtgacacgtgggccgattcttgtgcctacgatgcagcagcaaggaagcttgcctccatgttcgaggagaactgcgccaagaagtatccggacatggcacccgagatcaaggctgctggtccctgctctacggcagaatagggaagagctcagagcctattcgagagggtcccttcgggggccctctttctctatgcagagaagatgctggcatgaaaaaggaggctccggaaaaccggagcctccataggtgcgtgtggagagaagctactctgccatctgtgcctggacagcggtgattgcgacgacgcccacgatatcctgtgcggagcagccgcgggacagatcgttcaccggctttgcgatgccctggaggatcgggccataggcctcggcgccagcgaagcgctggacaagcttgtagccgatgttgccggcctcgagatccgggaagacgaggacattggcatgtcctgcaacctcggagcccggtgccttgagctcagccacggacgggacgagggcagcgtcgagctgcaggtcgccgtcgagggcaagctcggggttcttctcctgggcaagcttcgttgcctcctggaccttcgtcgggatgtcgccctttgcggagcccttcgtggagaaggagagcatagcgaccttcgggtcggagctcatgtacttcttccaggactcggcagaggcaagagcgatctcggagagctcttctgcggtcggtgcgatgttgaggccgcagtcagcgaagagcagcgtgccgttgtcgccgtactcggccttgtccgtgcacatgatgaagaaggcagagacgagcttggtgcccggagcggtcttcaggatctggagtgccggacgaagggtgttggccgtggagtggcaggcgccggacacgaggccgtcagcgtctcctgccttcaccatcatcgtgccgaagtaggtggcgtcgtccatctgcttcctggcgtcttcgatggtgacgcccttcttcttgcggagctcggcaaagagctcggcgtaggcttcatgcttctctgcagtcttggggtcgatgacctcgacaccctcgacagagatcttggcagggtcgccgaggataacgagcttggcgaggccctccttcacgatctcctttgcagcctcgatggtgcgcggatcttcgccctcgggcaggacgatcgtcttgaggtcagacttggccttctgcttcatgcggtctagaaagctgctcatcattgctccttctgagaggccagccgcatatgggctgtttgtatgcttctcgccaaacgtttcggtcatggacgctttcattatagggtcgcgtgctagaatcttcaaagaattaagctccattgggcgcagcgcgttgatggggctgcgcttttttctatagggcaagcaagtggcgcaagcgccagtcagtgaggttgtatgaatatcgcacatggtctgccggataatttcaatgctgacagctacgacgtcctcgtcgtcggtgcgggttatgcaggagcagtatgtgcccgccgcctggcagaggccctgaacttcaaggtctgcatcgttgagcgccgtgaccacatcgcgggcaacgcctacgactatgaggacgaggcaggcatcctcgtccacaagtatggtccgcatatctaccatacgtacaacgaccgcgtgcatgacttcctgtcccgcttcactgagtggacggactatcagcacaaggtgcttgcaaacatccatggcacgctcatgccggtgccgttcaaccaccagtcgctgaagcttgccttcggcgaggagaagggcgagcacctctaccgcaagctcgtcgcaacgttcggccaggacaagaaggtccccatcctcgagctccgcgagaagaacgatcctgagctcgctgaggttgcagactacgtctacgagaacgtcttcctgcactacacgatgaagcagtggggcaagactcccgaccagatcgatcctgctgtcatgggccgcgtgccggtcttcgtcggcgacgacgaccgctacttcccgcaggcaccgcaccagggcatgccgaaggatggctacacgaagctcttcgagaacatgctgaaccacgacctgatcgatgtcttcctcgatgtcgatgtccgctccatcatgcagctcaccgacacctctgtcatggtgtgcggcaagccttatggcggcgaggtcatctacaccggcgctctcgacgagctcttcggcttcgacgagggtccgcttccgtaccgcacggtcgacatggtcttcgagacgcttcccgaggatcagttccagccggtcggcaccgtgaactacacggtttccgagaacttcacgcgcatcacggagttcaagaacatgacaggccaggtcgttcccggcaagaccacgatcatgcgcgagtactcccgcacgtatcttccgggcgtcggcgagaccccgtactatgtcatcaacgagcctgagaacatcgagctctatcacggctaccgcgaccgtgtcgcgaagctcgtgaacttccatccggtgggcaggcttgcagagtaccgctactacgatatggacggcgtaacggcatcagctctcgagctttccgacgagatcattgcccatcattagggggaatatgcgcaagacgataaccttcggcattccctgctacaactccgccgagtacatggaccactgcatctcgtccatcctcgatggatcgggacgggccgaggatgtccagattgtgatcgtggacgatggctccgtgaaggacaacacggctgagaaggccgatgaatggcaggagcgctatcctgacatcatcaaggctgtccatcagccgaatggcggccacggcatcgcggtcctttctggcctcaagaacgctgatggcgtctattacaaggtcgtcgactccgatgactggctggatgcagacgcgctccaggcgcttctggcaaagctccgcgagttcatcgagaccgatacccgggtcgacctcgtgatcacgaactatgtatatgagcatgtcgaggacggcaagcagaatgtcgtggactacggcttcgcgctgccgaagggcaagatcatgggctgggaccagatcggccacttcaacatgagccagaacctcctcatgcactcgctctgctaccgcacggacatcctgcgccggggcggcatccccatgcctgcgcatacattctacgtggacaacatctatgcctatgtgccgctgccacgctgcgagaccctctattacctcgacgtggacctctaccgctacttcatcggccgcgaggaccagtccgtgaacgagtcggtcatgacgagcaggatagaccagcagctcaggatcacccgcatcatgatgcattcctaccacctgtacgacgacatcaagtcgcgcaagctcaggaactacatgctgaactacttcacgctcatgatggcggtatgctcgatcttctcgaagctctccgacaagccgggtgccgaggacaacctcaaggccatctggtgcgagctccagcactacgacgagaagatgtacgcgagggcgcgccgcggccttgtgggcatcgcgacgaacttcccgaccgagaccggcaagaaggtcacgatcggcatctaccacatcgcccagaagctcgtgaagttcaactgagcatctgaacaagaacacgtaagaaggcgccagtcccttggaccggcgccttcttctatctctggaatttcttgtctcagatctcggcatcgaagctcgatgcagccttgaggccgaaggcaggcctggcttcgcgtgcggcatccgcaatcgcgcgctcgatggcccgcacggcaagcgtgccgacgaggtcgacgggtgcctccagggagccggaagccatcacgaagatcgtgtcgccgtcgtttgtcgtgtgcgtcggccgtatcgcatgggcgtagccgtctgctgccatctgcgcgacctttgtcgcctctgccttcgtgaggcgagcgttcgtgacgatgcaggagatcgtcgtattcgtgcgggcaagcggcatcacgagcgatgtgctggcagcgatgagcgcatcctcttcgttgatgatgtgcgtgccgtcctctgagaggagtcctgagaggggttttcctgtctcggggtcacatatgttgccgacagcattgacggcgctcagagcgcctacgagaagctctccggcagactcaacatcctcgccgaggccgctcttcatggagcgctcaggcccttcgagcttgccgaccgtgcagccgcatccggcacccacattgccacgggcgagcggctcatccttctcctcgaaggcattggcgacagattgggcgccctcttccatgccggggcgcaccgtagcagagccgcaggcaaggtcgaagaggcagacagaggagacgatagggacgatgccgacaccgacatcgaggcccacacccctgcgctcaagctcctcagcagcgccagaagcggctgcaaggccgtatgcggagcctccggagagcatgacgcaatggaggacattcacggtctcctcaggcctgagaaggtctgtctcgcgtgttgcaggtgctcctccacgcacgtccacagcgcctgtcgcacctttcgggcagacgatggcagtgcatcctgttcctgcctctgccagcgttgcgtgccctgcaagaaagcccgggatgtcacggatggatctatgcatgctcgtttcctcctctgaggatatcttcgacgagagctgtgccataagagggtgccatgagctcgcggacgacgcgggtgagcggaagtcccatgatcgtgtagaagtcgccttcgatatgcttcacgagcaggcgccctctgccctggatcccataggctcctgccttgtcggacggctctcctgacgccacataggcagcaatctcctcatcgctcagctcatagaacgtgaccttggccgtatcgacaagcgaatgcacagagccatccttcacgaagtcatcgccgtcgagacaaagtgttcgcaccggaaaactctggagcatctcttccgcgtgagcggtgtctctgggctttcccagcacctctcccgactcgagccagacatcgtgtcggcagcaaggatggcaggggagaggcatcgtctgcatggcggtgagctaaccgcttctgccttcgtcttttgcaagacgctctaaccaaggcttcggagcctcgccggcatgcctcgtctcgtcgatgtctgccggctcgacggtgggtgcaaatcctgcctgtatgaggatctcgagccttctcggcgactgcgatgcaagtatcaagacaagacctctttccagaaaaagggggaggcaaaagccccctgccctctgtccagatatggcatatgctactcgacggtaatttgcgccgacggggcagttgtctgctgcccctgtgcggagtcctcgttctcctcggggacctcgtcgacgatagcctcagcggtgccctcgtcgccgattgcgaaaacctcggggcaggtgctctcgcagagaccgcagccgatgcactcttcgctgaaagatgccttcatgatgtcatcctctcacttgttctgacataaggtggcccgagcccctgctcaggcacgtaccttttgtacactttcttgcccagaaacgccgtgtcttgcaaacctttttggcagtcggtggtcaatgcagtccatcttctcccgaaaacgtctctctgagccccggaaggaccgaaggctcagagagaaggctgctgctgtggatgacgatctaatcgctgggcaggacgcacgcgcttgagcaaggtcaacggtactcgaacgtggacagctcttggggaagagattcgacgggctgcatctcttgacgactgtcaacgtgccttctcctcgaacgggcgatatcgcgtgcgcgcggcaagcgttgccgggatcgcatgagacatcaggcgatggcacgtgccgctgctcggagagctgaggtgccgacatctgctgctagtcctgacgccggcgggtcgacgacgatgatgtcagcgtcggtatcaggaaactcgccgtcctgcatcgccggcagattgcatcgactgttctgagacgagtcatccttgaggttgcggcctgagtcgccgtacgcccggtgccataggatatccacgcagagacgaaggaggtgggggcgctccgacaagcgggcaatgtgaagtggcccggcgcgcgtagaggatcacatcggcctcatcgtcatcgtcaggctcgagccagttcgggactgttggcgcacgacgcgtctctgcgccctcgtgtgacctggagaggaaggagggcccgaatgcgacattgtgttgggacaaggcgctcagaccagaagccatctccatgcccaggcactcgacacctgcaatctgccgtgccttctgcgtcccttggacatgaactcgcacgagcgaggggacttggagcgctttcggtgatgactttgcggggcaagcgcgcgggaagcggaggaggcgtccagaggcgacctccgttgcatgcgtggcagggcgggaggtgcgatgccgatgtcggtcgaacgtgaagtccgtggaagttcgcaagattaggtcacggagccataatactgccttcacgagcttctctgagcctttttgagagcggacaggtcgggaccttgatgacagagccatcggagagcatggcatgccgacgatggtgcgctcttgccctgacgggcaaaggaagctcgaccttgtggcggtagccccaaggatctcctggcgcggcgcagggaagaacagcttctctgctcggtccttggggatgtgcccgatgcgggcagcgcatccacgatgagcccttttggcctcgagctgggcctcgtacctgatttgccccattggtcagccgccgcagattgccgacaaggggttcagggtgccttcacacggtcagcgagtcctcaaggatacggaccgtcttcgccttcgcgaagcgcgcccttctcagattctgcttcacggtatcgccggggaatggcgccctggacgaagatggcacggccatctcgtctctggctatggcgtgccgtccttaggtgagccggtcgattcttgagctgtatggtctctcgatgctgctttctgccatgtgctagcggtcacccccaaaagggtcctgtaaggcctcgccgaagaggtgccctgcacgggcaaaggcgcgaaggctgaggcgtaggagcctggtaggggcgcgcgctggcttcggtgcaggtgccgctgcaggcgctggagcggcttgggtggcagccgctggtgccgctgcaggagctcggccttcgtgcaggttccggtgcgaggtgtggggataggctcgggtgccgcttgcaggagctgggtgcaggagcagcatgcttcggagcgggtgcaggtgctgctgcctctgcctcctcgcagcgcctcttcttcggcagcgagctttgggtctgcatcagacacgaacggctcgagcaggtcggaatctcagtaccggcgtggattcgaggccggatgcgaactctccagcaagcttcatgagctcatcctgactgttgatggcagcttcgccctctgccctcggaatcggctcccaggtgccatccacggttagttggcgtgccttcacattgtcggcaacgctgcagttcatgtacttgatcacaagctggcggcagacagggtccttcaccggatggcaatctcgacggcggcgctccgtgtttcttgtcatcatgtcggcactcgagaggtagaccgtgtcgatcttggcgccgaaggcgtagacacgggcatgctcgaggaagcggccgacgatctggtgacgataggccctcggtcttgccgggcacgtttgcctttcagtcgagcaatgccgcgggacgatcagatgacatggacgcctcctcgcaggcctcggagatcttgtcgatcacgtcacggtcggtagcgagttcatcttgagggaggcctgggcaggctccgcctgcgcgggcacgtgccaatctcgcggtcgaggccccactgtgatctggggcttgaggcccgcatcggggcgacacgaagatacttgtgcggccggcaaggtttccggcgagaggtttcctgaagaaggcgttgccgtcctcgccgatgcccggatgtgccgttcatgagcatgagtcggaggtatagtacgtgcggtcttctcattgaagttgccggtgccaaggcacgtgatgcgcgtgaacttgccgccgtcgtggtgggtgattctggcactcttcgaatggaccttgtagccctcctggccatagagacggtgcaggccggcatctttcgaggcgctctggcccaggcgatgttgttcgcctcgtcgaagcggcacggagctccatcaagaccgtgacaatcctttccattctcgcagcagcgatgaggctctcgcagagggcgggagtgcttcgcgacacggtagagcgtgatcttgatcgtgatgcgagtcatcgtcgagtccctcgcgcagaaggtcgagaagcggatccatcgactcatacggatagaagagcaggcgtcgtggtcctcgatctgctccctcatcgggacgcccttcttcaccatcggcgacagctgcggctcgaacgggctgtagaggactgtgcacactcggactttcggggatcatgtctcgacgagcgcgaagatgtagccctggtcgagcgggagagcgcacatggaagacgcgctcgggtgtgaggccagctccttgcggatgagcttctcatggttcttggagagcgtgccctcgacttcgagggcggatcggcgaaggcgcatgcgcttcttcagcaccttcttcatgtggaggcggtagtcctcctcttcctcgacgccctcgccgtcagagacgatgtcggcgttcctggtgacgcggatcgtgggcggtgcccgccggcacataggagccgaagcagctgccgagctcctggatgatgagtcctcgccagacatagcgcatatggcggtcatcgcccggaagcatcacgatggcggtcgagcgaaggcggcacctcgatcatgccgagacgccggactcctccgggccgtcaagcgaggtgaggtacgtagagacgccgttcctgaggttcggaacgggtgctcggatctatgaccagaggcgagatgacaggggcgacctgcgtctcgaagctcttgtgaagagacaccatatccggcgtcggtcaggtcctgggctacacattgattaggccatggctgccacgcctcctcgtcgagctcctcgaggcaccggttgcttcgctttcgagatactcgggcagaagcgagagcagcgtggccactgcggggaggcgtcatgttgctcttgttgtcggatgtgctggctgcttcaaggccgagaggtccgtcaagccgccgacacggatcatgaaccactcgtcgaggttcgagggaagatcgagacgaacttgaagcgctcgaagagcggcacacgggtcgaaggcctcatcgaggacgcggttgtcgaagcgcagccagctcactctcgcggttctgggtgtaggagtagtcgcgcttgcgcttgccttcgccgtcgatctcgggtctcgttgtcggcgaacttggcagcgcggtgctcgagatcggtgctgacggaatccgttcaggtgcagcgtcgggcacggtcttcgtcgcggcgtccagatggtggcacgtttgctgcatctgctgtatccatgatcttgccttcctttcgaaggtgcctgagaagatgtagatagtaaagagaggtagctagtattctagcagtctgcccgtggacttgaatgtaaagcctgatggttacgccgatatcgtgtgcccgaacatgtttcggacgtctgccagtgcctattctgctgagatcccaggcatgcaggcccaggtggctgatgtcggagcaaactacagtacggcgtgaacccagcggcaggagctttgtgacggttctcgtgcttgcagcgtccggtgataggagaatcgagtagcgtcgcctctgatctcctcggcagatgctcaaggcgcaataagcgactcaggggagccggcaccgcccggggggggggctgtgctcgtgttggtgggggttggtggggtctgtgcggggggggtgggggggggcgtcgcggggcaagaatcagtgtcggtgctcctcttcgagaatagtgggttttctggacgcgcaccacgcgctcgttgcgaggggttcggctggccacgtattgtcggggtcgagcaagtaagcgtcaacctatgcgcgtgaggcgggccggcgcctcacagtgttagagtagtttcgcatgcggaggctgacgcccgggtcttgggctctgtgtgggttgttgagttacggggggggtatcggaaggggatccgtggttggtgcggagttcgcgttcggcgtggagctctctgagcccccggtgtgccagtatggcgggcggcccggtcgtgcatggcctcaggaccgaggtgccacccggacggcagagggatggagtcgcaggacatccttcccgatggtgggctttgaggatggtcgggattatcgcacctggctctgtgtcgtgacggcaagcgtggtccacgttcaggttgtgtgtgtggggggtgttggtagcgatgcgcgttagaaaggcaacaactgtcggtttttttcaactccctgtggtgttcgtgtttgggggttctggtggttgttgtggtagtggcttgcgtcactctcgtatctcgttggttggtttgggttggttgggtgtggttgtgtgtgtggtgtgtggttgggttggtgtagttggtgtgttgggggtgggggggggtgttgttggtggttgtttgttgttgggtggtggttgtggttgggtgtggtgttgggtggcgatctacgtatgttgggttttgtggtctgtgcctgcggacgtaatgtgtttgttgggtttggagttggggtctgtgggtatggtgtttgggcgcgtgtgtgtgtgtctttctttgtgtggggtgttttttgtctttcgtgttgtggtggtggtgggtgtggtgtgtgtgtttgtttgggtggtgtgtaagatcgtgtgccgtgggtgttgggttgtggggtgggttgtgtgtctgtctttttactaggcttctgttcagttgtgtttctcggtcttttcacttgtgtccgtatgttcgcttgatggtagtggtcatgaaggactgcgttgttcttgtcctatgtcttattcttgtgtcgttgactgtctggtgtttgttggtcgggtttgtgtcttttggttttttgtggttgttttgtccctgacggtttgtgcttggtctgtgggggtgcgtgtgggatgatcgatctcagtgtgtgggggttcgttggtttttccctatcatgtggtcgcgtgtgtatgttgaggtagtgtctgtgttaaatttgttgttttgttgcgtgtttgttgtgtagccgtgtgtggctggtcgtttgtttgggggtgcgatgttggtgtgtgttggtcttggtgtcttcctccgatgggctttgttctcattcagtcctgtggtagtagtgtccaggggttttgtatgttgtctgtttgttgttgagaattatgtcttcgagattggtatggcctcttgctagcttggttgattggtgggtcacatttgagcgttgggggtctttcggttgtgtcccgcggtgtggccggtcgtcgtgttttgctttaagtctcgataactgcgtgtcttttgtcatacttttgctatggttttgcctgtcatttatttgtgggcccgttctctcgttggttaattaatcgcctattgtaagttctttgttctttctgtttcttttgtctttttatcatttggggttgtggggggggtggtttgttggttttgggtgtggggtttggggggggggggttgtgttgtgttgtattttttttggtgtttggtttggttggttttgtttttttgggttgggtggttttgtggtggtggtttgtttgtttgttgtgttttgttttgtttgtttgttttgtgtgtgtgtgttttgtttggtgtgtgttgtttgttgttgtgtgtggttggtggttggttgtggtgtgtagtgggttgttgggggttgtgtgtggtttgtgtgggggggtgtgtgttggttgtttgtggggttgtgtgtgggtgtgtgtgttgtttgggtggtttgtggtttgggtgtgtggggatttgggggtttgtggtggggttgtgttttttttttggtggtggttttgttgtgtttggtgttgggtgttgtgttggttggttttgcgtggggggtgggtggtgttggttgtgggggtgtgtgtttggggttgggtggtggtgttgttgtgggggtgttttgtggttggtggtgggttgtttggtgtgggttgtggtttgtttgttgttgttttggttgttgtgtgtggtggtgtggtttttgtggtggggtggtgtggtggtggttgtggtgggttttgttgtttggtggtgggtgtttgttgggggtgttttggtttgtgtttgttgtcacagtttattgtctgagcctctttctgttctattgtttcggttgtgtggtgctttttgctctgctggttgtgcgtttaagttttgctgtggtgggtttttttttcattgtggtcgggtgctcgtgttgttgttttcggccagttgtctctctttgttctgctgctggttctttttttcttggtccgattgttttcttcttgtgttgtccttctgtgtcttctccggtgtgtgtttgtggttcagcacatcctttttttaggttattctattgtttcgttgggcgttttgttgtgttgtctcctttgttgtgtcgtcttttgtctttgtggtggggttctgttgtgtttttttgtgtgcactggtcgcgttgttttttttcttgttagtttgtgtcggttttagttttctgtttttgctgtctcgctgtttttttgtgttgggttgtgttgttgctgttattttttgcgtgtttgtctttcatctttggtttcctgttggtgttctgctgtggttccctgttgtcatttatgcctgcttttgttgtccgtgggtcggggagtgtcttggatcgcgttgggttttttttgtctgttgtcgctttcttgtgttgttggtcctttgttttttgtttggttcttcagtgggtttggttgttggtgtgtttggtggttttgtagtggtttttctttcttgtgtgtggcttggtggtttgcggtgtggcggggtggttggttgcgttgttggtttgcttgtttggtcttgctctttttccttccgtctgtctttgcagttgtggggcttttctaccttgtatattttttttgtttttcctggtttttactgtggatggctcattttcgtgtatttctttgcctgtcattgtgccgtgtgtctgttgttgtggcttgtgtggggggttggtgtgtgtggggggtggggtgttctggttcggtattgttatttgtttgttggttgggtgtgtggtccattctgctcggtggtcgggtgtgtgtggggttctttgtttgtggtccggggttggtgctcttttagttgggttcttctgtttttgttttttcttttgtgttgtttttttgtgtgggcgtgtcctatctctcggtttggtgtttggtctttatgtctgggttgtggttgtttggtgtgtggggtgttgctttggtcttctgtcctcttttggtgtgtgttttttcttcgttgtgtctttgttcatgttttgtttggttttgtgcggctttctgttttgtgcttaatatgtattgttggttttgcgtgggcttgcctgtgtgtgtttgttcgctttgtgtttttttggggttcgtgtgggtgttgttgttatttgttccttgtgttggtgtttttgtttgtgttttgtggttggttcggtggtttttggttttttgttgcttgtttggggcttcgttcttgttggcttcttgtttatcttttgtgtctttgttttgcgtggctgtggtgtgggggtgtgtgtggtgcgtttttgtttatgttgtttgttgcttctgtttttattttgtcggattgttgtgttttggttgttttttttgtttttgcagttcgtctttatggcgtgttgtggtttgtgttttggtttcttcctgggctgtcgtgatgtctgttggtcttggtggttcttctagtgggtggttttgggggttgttggttttgttttgtcatgtggttgtggtgcgtttgttcttttgtgttttcggtgttgttgtgtggttctagtgtgttgtttcttcgtgtttgcggtttttgtgtttattgtttgtcctttgggttggtcggggttgctggcggtgtttttgtgggggtttgtgttgggtgtgtctgtggttgttcgtttgtgtttcggtcttgtgcatgtttggctcttgggtgtgggtttttttttggttgtgggtgttgttggtgtggtctgttgtttgttggtgtggtgtgggttgttggtcgctttgtttgtgtgtggtgctttctgctgtttcttttttggtccgtttttttttgtgtgttttttctttcatagttctcttttttctggtctgtgttgttactttttggctttttaggtttgttggttgttctggttctttgtggtttgtggtgtgtgtgtgtttgttgtgcgttgtgtggttgtgtatttgtttttttttgttgcttgcgttgtgtgtttcttcctcgggtgggggggggtgggggggggggggcggtcgcagtcgatctgggggccgaatagtagggccgggagtaagttcattagcgggtatgattccggtcggacgttgcgccccgtgagcctgtatgccagtcgggggggtctttcctgactctatgtccgccgctgagcttgtttggacgcctccagcgccgcttctcagctgccttcagttgggcatatgcgcttccctccctgtcaacggcttgtgttccggttgggatatcctatcgcgaacgaattgacgcgcacgtactacaatggagcatacgtgttcgcgacgctgctttgccgaaggcatggagaagaataggggcccggaattgcctgcgtttccgtgccacgatcgggagatacggggtgcatggcccattcagatgctttcgatcgcagactacccatccgcagcagtaatcttggtcatgcgcgtgccacttcctcgggtcgtggcgcaggaagtggccgagcgacctcatccgccgaggcagtggagtgcggctgcccgagtatgaggcggccgggctcgtccttcctcctatgtctcgtgttcagacaagatcggatacgcaccgggtaatcatcgaagatcgctgctgcagggaacgggggtggggaaaaaaaacgggttgccgtgccggaagtgctgtcgcgaggcaggaatatggaattcgtcggaagtcggtcccgcgaaagctcgtgccaggaactctcggaatccgtggagccttgtcccatatgaagactcttggttcaagccttccattgcgagggtcccgtctgccttgtgccgtgccttgtctttgacgggaaaggctaccgcagatcgtctatgtggtgcaggtaatacgaccgccttcctgcatttctatatggggggaagctaatggatgctaggccctaccgggaagctgaatgcggaacagcccggatcggtgacaagcgtctccactggatatcgtggaccccgctgactgcaaggattcgcgctcacctgcatggagcgggcaagggccacgcttctcccccatactaggaaagcaaggaagcgttcttagtaacctgcccccctaggccggtatggcgttaggccttctccgtcaaagacaaggcctcggcacagggcagacgaccccttgccatggcaggcttgacagagactctcttcagctgggccactgtcttccagattcgcgagagttccttgcaccgagctcttcgagcgaccacgatctcgagattccatcttcctgccgggcaggcacttcggcaacggcaacccgtttccctgacagccatctttcgatgatactgtgcgtagcgatctcgtctgcaaacgagacatatgaaaggacgagcccggccgcctcatagcgcggcagcgcctccactgtcctcgcggatgagtcgtttcgtcattcctgcgcacgaccgaggaagtggcacgcgcatgatcagatactgctggcggatggcggtcttgtcttcatcgaagccacatgactgggcatgcaaccgtactcctccccggatgcgatggtttccggaccggcaggcatgtccgcacccttctcttctggccttcgcaaagccgaagccgaacgttctgctaccatgtgtcgtacgtgcgtaattccgttggtaggcatatcaaaccgtccccccgttaaaagcacaagcttgaacagagagccattaggccaagaaggcacgctacgaagcggcgcttgagcgaactcaacaagctgccaggcgtacatcgagtccggcagaccgaggcttaccatgctcacgtcgcctctgtccgccggatcgtctgcacctcggccactatttcgcacgatccgcgtagcgtgttgcgccggcatgaacctcggcgtcacgacgaacatcgtgattgcctacggtaaccaggtcatcaccgaccgcgatcacgaccgagcatatcctcgacatgtataccaggggtccatggactagtctcgggcctgcgtcatgctaccccgaaagaccattatacttcagcccactcgcggtcccctgccgagaaccaggctcagctgcccttcctctcgcttgtctccaagtccggactcgagcgccccgcagtcaattgccgagcaggagcatcgggcctagcgctcaccgtccgatccttctgacctacccggtccaccaggcgctgcgacatcctcttcctgctcttctgcaagggcaacatcgtgcccgtgggccgcgaccagctgccgcacatcgagatcacggacaagatcggccgccgcttcaacgagcgcttcaacgcgaaggtcttcccggaggtagcaggactcctcacctcgacgccgcttcttcccggccttgatggccgcaagatgagcaagtcctacggcaacgctatctctctgtgcatgaccgaggaggagacagcgaagctcatcaagaagtcgaagacagactccgagcgaaacatcacgtttgaccccgagaacaggccgggcgtctcggcgctcctgacgacggcaggcatctgcacgggccgcgaccccaaggagattgcagacgagatcggcatgggcggcgcaggccagctcaagcgatacacgaccgaggctgtgaacacctacttcgccccgatccgcgagaagcgccacaagtacgagaatgacctcccctacatccaggatgtgctgcatgaggggaaccgcaaggcacaggaagtggccgagaagaccttggaagaggtccgcgaggctatgggcatggtgtactagcacctgaaaggaaagatagatattcaagacgaagcggagcctctgcaacctgcaggggctccgcttcctgtcaatgctctctgagacgtacaggattactcggggtccttgagcgttgcatacatgacggccttgatcgtatgcattcggttctctgcctcgtcgaagacgcgcgagcgcgggccctcgaagacgtcgtttgtgacctcaagctcgggcaggccatacttctcgaagatcttctctccgatcgtggtcttccggtcatggaagctcggcaggcagtgcatgaagatcgcatcgggggctgcgacctcgaacatcttctcgttcacctggtagggacgcatgagctcgatcctcttgccccagagctcgtcgggctcgcccatggagacccagatgtccgtatagatgacagaagcatcctttgcaccttcagcgacatcggacgtgaaggcgagatgagcgcctgtctcggcggcaatcttctcgcaggtggcaacaaggcccttttccggcatattctccttcggtccgcaggcacagaagtcgatgccgagctttgcgcagacgaccatgagggagttggcgacgttgttcctggcatcgcccatgaacgtgagcttgcgtccgtgcaggtcgcgtccgaactcctcacgcatcgtgaggatgtctgcaatcatctgcgtcgggtggaactcggtcgtgaggccattccagacagggacgcccgcatacttggcgagggtctcgacgcgctcctgcgcgaatccgcggtactcgataccgtcaaacatgcggcccaagacccgggccgtatcctcgatggactccttcttgcccatctgcgaggagccgggatcgagataggtgacgttcatgccgagatcgtggccgccgacctcgaacgagcagcgtgtgcgcgtcgatgtcttctcgaagaggagcacgatgttcttgccctcgaggtagcggtgcggctcccctgcatgcttcttgcgcttgagctctgccgagagatcgaggagatactcgatctcttcaggagtgaaatcgagaagcttcagaaagctcctgccgctgaggttcacgctcatgtatttgcctccgactcatcatatggcctgcagtgtggattaagcgtagcgcatgcagacgtcgaacatgtttcgggcacacgatatcggcgtaaccatcaggctttacattcagctgagatgccagctgctagaatatatctgctacctcttttacctatctctgccccttcgaaaggaaggcaagatcatggatacagcagatgcaggcaacgctgccaatctggacgccgcgacgaagaccgtgcccgacgctgcacctgaaacggattccgtcagcaccgatctcgagcaccgcgctgccaagttcgccgacaacgagaccgagatcgacggcgaaggcaagcgcaagcgcgactactcctacacccagaaccgcgaggtgagctggctgcgcttcgacaaccgcgtcctcgatgaggccttcgacccgtccgtgccgctcttcgagcgcttcaagttcgtctcgatcttctcctcgaacctcgacgagtggttcatgatccgtgtcggcggcttgacggacctctcggccttgaagaagcagccatccgacaacaagagcaacatgacgccctccgagcagctggccacgctgctctcgcttctgcccgagtatctcgagaagcatgaccgtgccttcgaggagctcgaggaggcgctggcagcccatggcctcatccatgtgtctgcccaggacctgaccgacgccgatatggtgtctcttcacaagagcttcgagacgcaggtcgcccctgtcatctcgcctctggtcatagatccgaggcacccgttcccgaacctcaggaacggcgtcctctacgtcctcacctcgcttgacggcccggaggagtccggcgtcctcggcatgatcgaggtgccgccttcgctcgaccgcatcgtgatgcttccgggcgatgaccgccatatgcgctatgtcctgctcgaggacctcatcatccaggagctcggcagctgcttcggctcctatgtgccggcgggcaccgccacgatccgcgtcaccaggaacgccgacatcgatcctgacggcgagggcgtcgaggaagaggaggactaccgcctccacatgaagaaggtgctgaagaagcgcatgcgccttcagccgatccgcctcgaagtcgagggcacgctctccaagaaccatgagaagctcatccgcaaggagcttggcctcacacccgagcgcgtcttccatgtgcgctcctcgctcgaccagggctacatcttcgcgctcgaggacatgatcccgaagtccgagcgtgcacagctcctctacagcccgttcgagccgcagctgtcgccgatggtgaagaagggcgtcccgatgagggagcagatcgaggaccacgacgtcctgctcttctatccgtatgagtcgatggatccgcttctcgaccttctgcgcgaggcatcgaccgatgactcctgcatcacgatcaagatcacgctctaccgtgtcgcgaagcactcccgcctctgcgagagcctcatcgctgctgccgagaatggaaaggatgtcacggtcttgatggagctccgtgcccgcttcgacgaggcgaacaacatcgcctgggcagagcgcctcgaagatgccggctgcaccgtcatctatggccaggagggctacaaggtccattcgaagatctgccagatcacctaccacgacggcggcaagttcacgcgcatcacgtgccttggcaccggcaacttcaatgagaagaccgcacgtctctactccgacttcatgctcatgacggcacatccgggcatcggcgaggacggcaacgccttcttcaggaacctctcgctcggaaaccttgccggccgctacaagtatcttcgtgtcgccccgatcgggctcaagccccagatcatgggcggcctcgaccgcgagattgcacgtgcccgcgcaggcgagcctgcccaggccttcctcaagatgaactcgctcaccgaccgtgacgtgatcgacaagatctccgaggcctgcgaggcaggcgtccatgtcatcctgatcgtccgcggcatctgctgcatcaaggcaaacgtgcccggcaagaccgatggcctcatcgtccaccagatcgtcggccgcttcctcgagcatgcccgtgtctacgccttcggcgccaagatcgacacggtctacctctcgagtgccgacatgatgacaagaaacacggagcgccgcgtcgagattgcctatccggtgaaggaccctgtctgccgccagcttgtgatcaagtacatgaacctgcagcttgccgacaatgtgaaggcacgccaactaaccgtggatggcacctgggagccgattccgagggcagagggcgaagctgccatcaacagtcaggatgagctcatgaagcttgcctggagacgttcgcatcccggcctcgaatccacgccggtacctgagattccgaccctgctcgagccgttcgtgtctgatgcagacgcaaagctcgctgccgaagaagaggcgcgcgaggaggcagaggcagcagcacctgcacccgctccgaagcatgctgctcctgcacctgctcctgcagcggcacccgagcctatccccacacctgcaccggaacctgcaccgaaggccgcagctcctgcagcggcaccagcggctgcacccaagcccgctccagcgcctgcagcggcacctgcaccgaagccagcgccgcgcccctaccaggctcctacgcctcagccttcgcgccttgcccgtgcagggcacctcttcggcgaggccttcaggaccctctttgggggtgaccgctagcacatggcagaagcagcatcgaagaccatacagctcaagatcgaccggctcacctatggaccggacgccatagccagagacgaagatggccgtgccatcttcgtccagggcgccattcccggcgataccgtcgaagcagaaatctatgaagaagggcagcgcttcgcgaaggcgaagacggtccgtatccttgaggcatcgcttgaccgtgtgaaggcaccctgcccctttgtcggcatctgcggcggctgcccctggggcaatatcaggtacgaggcccagctcgaggccaaaagggctcatgtcgtggatgcgcttgcccgcatcgggcacatcccccaggaccgagcagagaagcttgtccttccctgcgccgcgccaggagatccttggggctaccgcaacaaggtcgagcttgcctttgcccgtcagggcaagcgcaccatcgtcggcatgcatgctctcgatggctctgtcatcaaggtcccgacctgtccgcttctccagaaaggctcagagaagctcgtgaaggcagtatctggctccgtgacctatcttgcgaacttccacggactcacgttcgaccgcatcggcatccgcacctccgcccgcacgcatgcaacggaggtcgccctctggacgcctccttccgccttcccgcgcgctgccgccgcaaaggtcatcaccgaaggcgccaaggtcacctcgctcgtgcgagtcatgtccaagggaccgcagaaggcacggaagattgcaggtgtcgagtgcctggcaggagatggcttctggtctgagcgccttgtccacaacacaatgcgcatctcggccccttccttcttccaggtcaacacgaagggcgcagagacgctcgtgcgcacagtcctcgactggctcgagcctgacgaggacgatgaggcgatggacctctactgcggcgccggcacgttcacattgccgcttgccgagcgcacctccttcgtctctgccgtggaatcctatggcccggccgtccgcgacctcagccgcaacctcaaggatgcccgtctcgagaatgtcgatgcaatcggcggcgatgcaggacgcgagtttcctgataccgacgctgacatcatcgtcgtcgacccgccgcgtgcaggacttgccgcagatgtcgtgcaccagctctccgagcagccggcacgtgccatcgcctatgtctcatgcgatccggcaacgcttgcccgcgatatcgcccgcttcgaggaggaaggcacgttcgaggtcaagaagatgcagcccgtcgatctcttcccccagagcttccacgtcgagaccgtgacattgctcaagcgcgtgcgtcctgcccagcgatagatcgtcatccacagcagcagcctttctctctgagccttcggtcctttccgggggctcagagagacgttttcggcagaagatggactgcattgaccaccgactgccaaaaaggtttgcaagacactggcgtttctgggcaagaaagtgtacaaaaggtacgtgcctgagcgaggggctcgggccaccttatgtcagaacaagtgagaggatgacatcatgaaggcatctgtcagcgaagagtgcatcggctgcggtctctgcgagagcacctgtcccgaggttttcgcaatcggcgacgagggcaccgctgaggctatcgtcgacgaggttcccgaggagaacgaggactccgcacaggaggcggcagacaactgccccgtcggcgcaattaccgtcgagtagcatctgccatatctggcacagagggcgggggcttttgcctccgccttttttctggaaagaggtcttgtcttgatacttgcgtcgcagtcgccgagaaggctcgagatcctcatgcaggcaggatttgcacccaccgtcgagccggcagacatcgacgagacgaggcatgccggcgaggcccccgaagccttggtcgagcgtcttgcaaagacgaaggcagaagcggtagctcaccgccatgcagacgatgcctcctcccctgccatccttgctgccgacacgatcgtctggcttgagtcgggagaggtgctgggaaagcccagagataccgctcacgcggaagagatgctccatgagctttccggtgcgacacactttgtctcgaccggagctgccttcgtgaaggatggctctgtgcattcgcttgtcgatacggccaaggtcacgttctatgagctgagcgatgaggagattgctgcctatgtggcgtcaggagagccgtccgac

SEQ ID NO: 56 - DNA, 51383 bp, Unknown
  Metagenome-assembled genome
cccagaagttaagcccccgagcgccgatggtactgcggagagagtccgtgggagagcaggacgccgctggccagcagagggcattcgtgccggagagggaggggagcgcatccgcgcttccctcccttgttatacagagaccatgagtcatactcgcagagcatgctgtagtttcttgtttgcattgctcagctgcttctatattaatctggcgataggcgcgtatctgtggctttttctgcatgctatttcctatgagttgcaagaaacaatcgttatatgcagcatgatagatatccgagttgatgctggtcacatggatctcatgaatgggcagctagctgaatcaatatgaagcatggctgcgaccagcacgaaaacatctatacgttaataatctgacagagcaaatgaccttcagaccctgctcctgtcccatcgaatcttgctgaaccttaaagttcaagaaatgaacattcagaaagcgttcaacaagcaatcagaggggacaggcatggaatccggagatgtgcagcaatcggaaacagaatctgcaagcgatgcagaagagctcgaaggcatgctcgacgcgcatcgcgagcgcgtggcaaatgcaatagcatccgctcttcggcatagcgatgccctctgcattcgggcaaacccgggatgtggtctgacgcctgccctgaagctcctcaaggataccggtcccgatcaaggcttccatgtcatctataggacgtttcaggggcgcagctccaggtcctgtgcaggagagatcaccaaagaggaccagaagatgccagtgggcggactagctgccaccaccgtcctgatccttgactgccttcctgccttcacagagacagaatccatacgctttggaaaggcatttcgcctctttatcaggcatggcggaaagatcgtctgcgcattcagggaagaaggagcagaaccttcaggcctcggcgcggacgtttcctgggaagatgcccgtgatgcctgcttcgctgcatatgagcggaagagctggaagggcggcatcgccttcgatgaggcgctcaggatatcggcaggcacgccttccctcatgcgggcgctctggacctttcatgcagaacccgatgggctgctctctgacagcgatgcgctgtgctttgcgcatgaggccgatgccgctgtcatgacagaagcatcggcgctctcaaaggaagcacgcgaagcgttttcctgtatgctgctcttcgggaccggcacgctcaaggagctcgagggcatcctcggcgacgatgcaggggctgctgctgtacgggtctcttcatacattccgcttgtcgcgctcgaaggtgacggctggacctgcggatgcacgcaggacatccgcgtccttgcccatatggaccgcttccttggcacgctcgatgtgatggatcagcaggaggggctgctctgcatcctggcgctcgagaagcgctcgctcttccagcgtgcggccatccttgctgcacacatgaagcttggaaggcaggcagcagcgcatatcgtgctcgaaggtgcgcgctatctcgatgcaggagaagcaaaggccgtcgagaaagcgcttcgggaggctggagccacgcgcaacaagaaggaagggctctcggctgcatgcgggctcaagcttgtctcagaaccgcgcacaaaggctctccagacctggcggcagagggtgggtgtgcagaagaggacaaaggatacgtcgctttctgcctatgaagggatatggcggatccggcagagcctcggagatagggcgggcaggctccaggagctggcagacggaagcgatgacggctttgcgctacactgcgctctctggaaggcactcctcgaaggagaggcacctgatatcccttcagccgcgcttcccagggaaacgggacttctgtctgaggtggctgaggcagatgtagcgttcttccgggaagtgctgctggggaagcgaagcatctggccccgtgttgcggacagcaggctggatataggtgcgctctgggtacggacgcttcaggctgctgctcttgcgatgggtcctagagcgtctgggcccggcgagctcggacgcctcgcctcgtactggagcgagagggaagatgcgctgccgcagctcgtttcgggcgttgcgggaggggcagctgcgctcaggcagggatctgcagcgcatgcccatgtctttctggcacacgcagaacgtgccgcagaggagctttcgagcacgccgcttctcgacgagatacatctcctccaggcgacagagatcggcggcatgaccgcacgcggcgtcgcgcgaaggctcggcaaggcgaagagcgctgaaggaaggctcatggcccgtgccgtgcgatgtgcagcgcagggcacgaagctcgaagaccaggaactgccgctccagctccgctgggttctggcgcttcttctgggcatgccccagagcttctcgtcccagatcggcgatgctgtgccagaaggctggaagcgcgatgtggcgctgtggcaggaggaagcgcattcgaagaagagggaggagaggcgggaagagcctctgagggtcgagcctgtgcctcttgcaggcgatgtgccaggccttctcgagataagcctcctcggccgcttcgaggtgaaggtcgacggcgagcccatcctcctgaaccggtggccaaggcgctcttcgaaggcactcctccagatgcttgcagccaagcgggggcacacgatgaggagagcagatgtgctggcggcgctctggccggaatcgaactacgtcgaggggcgcccgaagatctattcagccgtgagcacgctgcgcgaggtcgtacaccagaaaggaacaggtgcccgcttcatcgtcggaggagacggcctcatctcgctcaatcccgcttctgtcatctgcgatgtggatgccttcgaggccctcgtgaaggaggtgcttgcggaagccacgggcaccgagcgtgcgctcgaggcggcagacgagattctggatatctatcagggagagatgatcgtcgcatcgcaggacagctcggggatgatggtgagaagggcagaggagctcaggcaggagtatgtcgatgcgctctcgaaggcagcgcagatcgccctcgacgagagctccctgagtgccgctgcactctatgcgcgctccgcttgccgggagcttccgacccgtgaggatgccgccatcgtgctcatcagggtctatctcaggcaggggcgcacggcagatgcctgggaagcctaccagagcttctcgcagcagctcatggacgactccggcatctacccttccggccgcatgcgtgccctcatggacgatgccctgcgggaggcaggggcacaaggtgcaggcagacatccatctctggaaagcgactgaaaggcagtgcacttttgatgatatggtggatggcgggaaagagttgtcctgatatcggatacagtgttggtcgtgtgcatgctgcgcatacgccgccggtggcgaatgcgctttacccttaaggaatgctatggccaacttcttctccaggctgctctccatgggagcggacaagcagctcaaggagttccggcagattgccggacatatcgacgagctcgagccgaactacgctcccgacaagatggatgacgcagagcttgcgcatcagacggtgctcttccgtgagcgccttgcgaacggcgaaacgctcgacgaccttctgcctgaggccttcgcaacggtccgcgaggcatcgaagcgcacgctcggcatgcgccacttcgatgtccagctcatcggcggcatcgcgctgcaccgcggcatgattgcagagatgaagaccggcgaaggcaagacgcttgtctcgacgcttgccggctacctcaatgcacttgacggtcagggcgtccacatcgtcacggtcaatgactacctcgccaagcgcgactccgagtggatgggccagatctaccgcttcctcggcatgaatgtcggcctcatccagaacggcatgcgcctcaacatgaagacgcctgcctatgcagcagatgtcacgtacggcacgaattccgagttcggcttcgactacctgcgcgacaacatggtcacgcgccccgagatgcgcgtgcagcgcggccatcacttcgcaatcgtcgacgaggtcgactccatcctcatcgacgaggcaaggacgccgctcatcatctccggtgccggcacgaagtctgcaagcacctacaaggacttcgcccgtgcagtccgtggccttacgcgcgatgtggactacgagatggacgaggcaaagcatacgattgccgcaaccgataaaggcctgcgcaagatcgagcatgccctcggcatcgccgacatctactccgatgtctccggccagctcgtgaaccatctccagcaggctctcaaggccgagtacatgttccaccgcgaccagcagtacgtcgtgcttgacggcgaggtcaagatcgtcgacgagttcacgggccgcatcatggagggcaggcgctactcggagggcctccaccaggccatcgaggcaaaggaaggcgtcgcgatccgcgaagagaaccagacgctcgccacgatcacgctccagaactacttccgcctctacgacaagctctccggcatgaccggtaccgccatgaccgaggatgccgagttccgcgagatctataacctgcccgtgcaggtcatcccacccaacaagcccgtcatccgcaaggaccacgacgacctcgtctaccgcacaatcgaggcaaagttcaatgccgttgcagacgacgtcgtcgagcgccatgccaagggccagccagtccttgtcggcacggtctcgatcgagaactccgagaagctcatgcgcattctcgagaagcgcggcatccatccgcagatcctgaacgcaaagtaccacgagcgcgaggctgccatcatcgcacaggcaggccgcttcggcgccgtcacgatcgccacgaacatggctggccgtggtacggatatcctgctcggcggcaacccgcagttcatggcgctggacctcatgcgcgacgacggcatcgatccgcagccggagaagagcatgaatccggaagatccggcatcggtcgcagatgcgaagcagaagcgcgcctacgtcgactccataatgccgaagtaccgtgccaaggcagatgccatctgtgcagcagagaaggagaaggtgctcgaaacgggcggcctctgcgtcatcggcaccgagcgccatgaatcccgccgtatcgacaaccagctccgcggccgttccggccgtcagggcgacccgggcgagacgcagttctacctctcgctcgaagacgatctcatgcgcctcttcggcggcgaccgcatggaccgcatcgctgccatgatgaagaaggcagatatgccggatgacatgccgattcaggcgaagatggtcacgaaggcggtcgaaggtgcccagcgcaaggtcgaggagatcaacttcgcgatgcgcaagaacgtcctcgactacgatgatgtcatgaacaagcagcgccaggtcatctacgaggagcgcaacaagatcctcgatggcaaggacctgacggcgcatgtcgctgaggtcatgcacgacacggtcgagcgcgaggttgcaaacttctgccctgccgatacagaagcagaggactgggatctcgagggcctcggcaagtggcttgccgacctcacaggcaccaaggagctccccgagctcacacacgatatggaagaggcggatatcgtcgagacgatcgacgacttcgtcgatggccgctacgccgagaaggcagagttcatccgcggaatcggacgtggcctccagcagcaggatgcgaaggcggcactggataacggcgagcctgcaccttccgagcacgacccgatgaacgacctctccatgcgcgtcatgctccgtgtcatcgacacgaggtggatggcatacctgcaggagatggactacctcaagaccggcatcggccttcgtggctatggccagagggacccgcttgtcgaatacaagaccgaggcctattctgccttcaccgagctcgtcaacaccatgtacgaggacttcctgcgcatcatcctgaggatccaggtcgtggcgcagccgcagcctgcccaggagggcgcagagctcaagggtgcccgctattcgggtccggcagatgtcgacggtgaccatcaccggaacatctcctcttcgggcatcgcccagaggaggaccgcgcgtgagtccgtgccggcagatgagaagccgaagacctaccgcaaggcagaggaccccgatccttacgcgaatgtcggcaggaacgacccctgcccctgcggcagcggcaagaagttcaagaactgccatggtaggaaccgctaatggcagacgaggctccgatcaccgctgaggggcttgatgccctcgagaagcgcctgcacgaggtggagggctatctccatgtcgcgcagaagcgcgagcttgtcgaggcgctccagcacaagagcgccgagcctggcttctgggacgatgcagcagctgcccagaagacgatggctgagctctcatctgcacaggaggatgtcaagggcatcgatgcggcgacagagaagctcggcgatgcacgtgccgcgctcgagcttgctgacgagacggacgacgatgagctccgccaggaggcgacgtctgctgcagaagagctgaaatccgagctttccgagctcgagctctcgagctggttcacggacgatctcgatcacggcgatgcaatcgtcacgatcatgccaggccagggtggcctcgaagcgcaggactggtgcgagatgctcttcaagatgtatctgcgctactgcgaccgccgcggctggaaggtcacggtcaacgatgcgccccaggccgaggtcatcggcatcgaccgcgcgacgttcaccgtgagtggcaagaacgcctacgggatgctgcgtgccgaacagggcgtgcaccgtctcgtgcgcatctcgccgacagacgagaagaagaggcgccagacgacctttgcgggcgtcgaggtgctgccggtccttcctgacgatatcgaggtgaacatcgatccgggagacctgcgcatcgatgtctaccacgccacgggacacggtggccagggcgtcaacacgacggactctgcggtccgcatcacgcatatcccgaccggcacggtcgtcacgtgccagaacgagcgcagccagctccagaacaaggccttcgcgatgaagatcctgaagagccgcctctacgagctcgagctccagaagcgggagcagcagatcgacgagctcaggggcccgaagcacgatatcggcttcggcaaccagatcaggagctatgtgctctatccctatcagctcgtgaaggatctgcgcacgggcgtcgagacaggaaacgtttcatcggtgctcgatgatggagacctcgatcccttcatcatcggctatcaccgctgggtgacaggggaggaacagaaggtatgagcaggcgcgagaagatggcagagatcgtacgcgatgtcgttctgattgctgtggggtcctccatcttcgcgtttggcttcgactccttccagctgccgaatggccttgctgcaggcggcgtcacaggcatagcgacaatcgtgtttgcgctcggacagagggctggcatctatatcccggtcggtgtccagaccattgcgatgaacatccttctgctctcgctcgtcgtgaagcagggctcgaagcgctatcttgcaaagaccgtggcaggaatcctgctctccggcttcttcacggacctcctgcagcccatcgtgcccgtgctcggcgaaggggagctcctgctctgcgctctctggggcggtgtcgtcacgggcgtgggcctgggccttgtcttcatggcgggcggcaacaccggcggcactgacatcatcgtccagctcatctcgaagaagacggacatcgcgataggcacgatgatgatcgtcgtggatggtgcgatcgtcgcggcctctgcgcctgtcttctctgtcgagaacgcgctctatgcggccatctcgatgttcatctgcggcaaggcaatcgatgcggtcgtcgatggtccgcgctccgcccgtgcggcctatatcatctcgaaccgctatgaggcgatctcgaaggctatcctcttcgagctcaaccgtggctgcaccgagatttctgccaagggatcctatagcggcgagacgcggcccatgctcatgtgcgtcatggggcgctcggaaacgacgaagctcaaggatatcgtggcagagctcgatcccgatgccattgtcgtgattgcagaggtccacgaggtattcggcgagggattccgcagcctcgaagcctgagtgtgttaaaggtctgtttccggtacgcaggagagcatgggttttacccatgctctccttgcttatggacacatcctgcgcatcctgcgtatatgatgaaagggactgcccaacgggcagaggaagcctaaagacgggagcgctatgacgaaggaatgcgagagcagggcgccgctctgctcgacgcacgagatagagctcgtggcgaatgcagtccgccacgatatcgtacagatgctgaccgaggccgggtcgggacatccgggaggatcgctctccgcaacggatatcctctcggtcctctatttctcgggcctcatgagctatgacccgaaggacccgaagtgggacgtccgcgacttcttcatcctttcgaagggccacgcagcccctgccctttacggcatcatccaccagcttggctggatcacggatgacgagatgctctcgatcaggaagcttggaagcatcctgcagggacatcccgattcgaagctctgcccgggcatcgaggtctgcacaggatctctcggccagggcatgtcggtcgcatcgggcgctgcccttggcttcaggcttgacgccgagaagaagggtgcccctcttcgccatgtcttcgcgctcaccggcgacggcgagctccaggagggccagaactgggaggcagcgatgtttgctgcccacaggaagctcggaaacctctgcgtcttcgtcgacctcaatggccttcagatcgatggtccggtcgacacagtctgcacgctcggcgatgtgccggcgaagttccgtgccttcggctggcatgtgcaggaggcggacggacacgatatcgaggcgctcgaggcagctgtgaagaacgcgcttgccgtcgaggaccagccttctgtcatcatctgccacacgatcaagggcaagggcgtctcctacatggagaaccaggtaggctggcatggcaatgcgccgagcgccgagcagggggcccaggccctggctgagctcgaggctgcacgcgccgagcttctgaaggaggccgcaaatgactagaagagcgacccgcgaggcattcggagagacgctcatcgagcttgtgaaggaaggcctcgatgtgatggcggtcgacgccgacctggcaggctcgacaaagacggcccagctcggtgcctacgatcctgaccgccttgtcgatgtgggcatcgccgagcaggacatgatcgatgtggcagcaggcctcgcgcttaccggccgcacggtcttcaccggctcctttgccgtcttcggcaccggacgctgctacgaccagatcaggaacacggtctgcgattcgaacctcgacgtgaagatctgcccgacgcacgccggcatcacggtcggcgaggatggtgcgacgcaccagatgctcgaggacatcacgctcatgcgcgtccttccgaacatgcgcgtgctcgtgccggcagactactgggctgcaaaggcagcgctgcgccttgccgcgaagacgccgggtccggtctatgtgcgtctcggccgccacaaggtgcccctcgtctacgatgagacgttcgcaggcggccttcccttcgcaggtgtcgtgcgcgaaggcaccgatgtgacgattgccgctgccggcgtcgaggtctcgcaggcactcgctgcggcagacctcctcgagcaggatggcatctcggcagaggtcctcgacatcttctccgtgaagccgctcgacgaggagacgatcctcgcttccgcctccaagacgggccatgtcgtgacctgcgaagagcactcggtctatggaggcgtcggctcggccatagcagagctcctcggcgagaagctgccggtgccctgccaccgcgtcggcatgaaaaccttcggcacctcggcaaacggcgatgtgctgctctatcacttcggcttcgacggagagggcattgcgcaagaggtgaagaaggcgctcggccgttaggtctttgcaacatctctgatagaagcagggctttgctttgagtcctgcttcagcgtcctgagctaatcgtgcgtttttcagggcccatagcgtctgcagcctgctgcagacgctatgcttgctatgattttcgaatcaatctgtccgctgattcgtgcatacaggaaagagaaggagcttctgtggccaatcactttcgcagtcgggagcggcaggggaatgaagagctggaagacaccggcgccctgcagacgagcgctcctacaccagaagacgagcccgcttctgcgggcacatatcaggatgtgacatcgcaagacgcagacaatggagagcctctcgacgaggagtcctccgtcatgcagtccatctatgcaagcgtcgccgagaaggcagcagctgcaccgcaggcacaggatgatgcggccgcgccggcagacatcgacgacgatctcgacgacctcgatatcccgggcgctatcgacgatctcgacgaaccggcaccggcaaggactgccgcccctgcacccgaggcagcgcccgcgccggaggcgcagccatcctcgacgtctgtcttcgccgttccttccgtcgagcatccgacgcagcagagcgctggcatcgtgcagtcctctgatgcagacgatgacggcatcacgtcctacgcaggcctttcctcgaatggcatgccccaggtcccgcatgagggaacgccgacgatctcctaccgcaatgtcacgctcatctacaaggcccagccgaacaagccggccctggaggatgtgagcgtcgacatctatccgggcgagttcgtcttcattgtcggacactccggatcgggcaagtccacgttcatcaagctcattacccgcgagctcaaggcaacgaagggcaaggtcatggtcgcaggccaggacctcacgacgatgcgcaactggaaggtcccgtacctgcgccgccagatcggctgcgtcttccaggacttcaagctgctgccggacaagacgacctacgagaatgtcgccttcgctctcgaggccatcggcaagcccaagtccgtcatcaaggcccaggtgcctgaggtgctgcgcctggtgggtctccaggacaagatggacaactatccggaccagctttccggcggcgagcagcagcgtgtcgctgtcgcccgcgccatggtcaacaggccgccgctgcttgtctgcgacgagccgaccggcaacctcgatccggccatctcgcttggcatcatgaagctgctcgaccgcatcaaccgcaccggcaccaccgttgttatggccacccatgaccgcgagatggtggactccatgcgccgccgcgtcatcgcccttgagggcggccacgtcgtgcgcgaccaggagagaggaggctatggcaactatggcaccatctaatatcggctattcgctgcgtgaggccatgcaccacttcaagcgcaacttcggcaccacgttcggcgctatcgtcacgatcttcctgtcgctgttcatcatcggcacgttcgtgttcctgtctgcccttgtcgacaacatggtcggcaacgtcgaggacaaggtcacgatccaggcctacctcgcagatgacgcatcccaggacgccgtcgatgccctccagacgaagatcgagggctgggacaacgtcgagtctgtcacctacaagagcaaggacgaggctctcgaggaatacaaagccacgatgtcgaacaagaacgccgaggacgctgttgcggcactcgacggcacgaacccggttcctgcatcgcttgtgatcaagctcaacgatccgcaggaggtcgagaacgtcgcgaacaggctcatcgacgattccgacttcgcctctgtcgctgacgattccgatccggccaactcggtccagtatggacgcgagacggtcgagcgcctgttcacggtcacgtcctacatccgtatcattgcaatcgtgcttgtcgtgctgctgacgtttgtcgccttcgtcttcatcaacaacacgatccgcctctccatctcggcacgccgccgcgagatcggcatcgagcgcctcgtcggcgcctcgaacggcttcatccgtgggcccttcgtcgccgagggcgctatcgaggcactcatcggcgccctgctcgcaatctgtgcgctccaggccgtcatcacgaacgtcctgccgcgtctccaggagcaggtggcgttcctctcgttcaacctgcagcctgccgtcattgcgcagacctatggcctgctcatcattgtcggcgtggctatcggcctcttcggctccgccatcgcaatgaggcgctacctgaacgtctagcgccaggcgcaaagcattttgttggtctagtatgggggtggcacgcatgagcgtgctgcccccatactcttgtctcgaggaggactcatgtcgcacgcaaagcgcaggccgaagaaaggcaggagatacggacgcgacaggggacacaagccccagcccacagcgacaggcaccctgcatatccatgaagggggaagggcccgcgtcgtctgccaggaagggacattccgtgtcgcccatggaggcctccatgaggcgatgaacggcgacaaggtggccgtctcgctcgtgccggcaaagggtggcgagcgccaggccattgtgagaagcgtgctcgagcgcgggacgaagacgctccttgcgcgctatgaggaggcggggccgctccgtgccctcgtgccgctcgatatccgcgtgagccatgacttcttcatggtctctgaggaccgctcggatcgaaagctcggcgtgcatgacggggacatcgtgcgtgtgcgcatcctcgaatatccgtctcgtggcgtctccggcacggcgacaatcgagcgcaggataggctctcccgcaggcctcgatatgggcatggagtcggtccttgcctcctttgacctgccggatgagttccccgctccggtgctcaaggaagcggagggcctcgtgccgggcgtcgcagaggcgcttgcacaggacagataccgcaaggacctgagggatatcccgcttgtcacgatcgatcctgccgatgcaaaggacttcgatgatgcggtcttcggcagaaggatggggcagggcttcgagctcctcgtcgcaatcgccgacgtcacgcactatgtgcgtccgggctcttccctcgacaacgaggcgcagcagcgcacctgctcggtctatctggcggaccgcgtgatcccgatgcttcctgaggccatctcgaacggcgtctgctcgcttgtgccccacgaggaccggcttgcgatggctgtgaagatggagctcacgagcaagggcgaggtcgtctccgccacgcccatgaaggctgccgtcagaagctgtgcacgcttctcctacgacgaggtcgagcgcttcctggagacgggagaggagcttccctgcgaggccatctcgcgcgaggcggtgaaggagagcctgaccgtgctcgacgaggtggcgcgtctccgcatcaagattcgcgagaagaggggtgcgctcgatttcccgtcgcgcgaggcgaaggtggcactcgacaaggacggcacgccgaccggtgtcctgattcgcgagaagacgcgggcgacctcgcttgtcgaggaagcgatgcttcttgcaaatgagtcggtcgccaagatcctctctgaccgcgaagcgccctgcgcctaccgcgtgcatgaggcaccctccgaggagaatctcgaggcgcttgtccccatattcaaggagctcgacctcttcgggagcttagacgaggtgcttgccttcgagaccggcaatccccatgcgatgcaggctgtgctggcacgctcggaaaagacgccttctgcctacctcgtctcgacgatgctcctccgtgcgcagaagcgagccatctatctcgaccacaacgaggggcacttcgcgctcggtacagcggcctactgccacttcacctcgccgatccgccgctatccggatgacaccgtacacagggcgctcaaggcctatctcgaggggaagctcccgaagctcgctgaaggggcgcatgcgctgccccagctctgccgcgactgctccgacaaggagcgcgtagccgatgctgcggcgcatgcctcgcaggacgtgaagatggcggagctcttcgaggaccatgtcggcgaagcgttctcgggcatcgtcgacggggtcgagcgcttcggcatcttcgtcgtgctcgacgacacgatggcagaagggcttgtgccgatacggtctctcggcgacgagtatttcgactacgacgagacgcgcatgacgctcacgggcgagcagtcaggaaagagataccgtctgggccagcgggttgcggtcaccgtgcatgatgtggacacgatgcggggacgcatcggttttgcgcttgtggcgaaccaggcacctgcatcaagaagggccgagacgggtaggaacgcatagatagagaacagacggcagaggcaaggcttctgcacgcatgacaggaacgatatgggaactagcaatcttcaggatgagctcgtcgcggcagaatcgctcatggtcgacgggcaggatgaggcagcaaagaagcgtctggcggcacttgccgaggacgccgaggaatacgttgacgcgaactgccagacgacagaggatacgcagtggttcgcctttccgacgctcttcgagcgcctggcctaccgccgtgtcgagaaggatccgcgcacgctcgaggatgtgggagagccgctctcgaggctctattccgaccttgcgcttgcctgcgtgaggatgggggatgcacaggaagccatcgaggcgctgaagcagtgcatacgctggaaccccatggactgcggagcaaggctcgacctcgccgagctcttccgtgcccagggcgacagccaggaatatctggcactcacgtattccgtcttcgaacgcgcaagcgatgcccgccatctcgcgcgtgcgtttgcaaacttctccgagtacttcggagcgatcggcaagccccggacgcaggcagcggccctgcgcgctgcgcgccgcctcgatatgggagacgacgggaagctcacgcagatgctcgccgacgctaagggtacggaccacgatccggatgaggtagacgattcggaatgcagcgagcttctgggcaaggaggggctgcctgacggcgcaaatgccgacatcgcggtctgccttctcttctgtgcctccgatgcagccgaattcggcaacaggaaccttgcgacggagctcacgatccgcgcccgcgaccttgtcggcaccgatgcctgcaaggccctcctcgagctcatccatgcggatgacgagaaggatgagaaggacgagggggaggcgtgatgggcaagcagggaaagccgaacatcaagatcatctcgaggaaccgctctgcctcccacaactacttcatcgacgagacgttcgaggcaggcatcgagcttgcgggctccgaggtgaagagcctgcgcgacaggccggctcagctcacggacacgttcgtgctgatccgtggcggcgaggtgtggctcaatggaatgcatatccacccgtacgtgaacggcggcgtctggaacagggatcctgaccggaggaggaagctccttctccacaagaggcagatcttctacctcgaccagaagctccgccagaagggcacggccatcgtgccgctccagatgtattttgacgagcacaaccgcgtaaagctcacaatcgcgcttgcccggggcaagaagctctacgacaagcgtgcggacatggcaaaacgggataccgagcgcgagatccagcgcgcgctcaaggcgaggagccgctagcctccaagcggcttcggagaggggatttcaatggatacacgtgcgctcttcaagttcacctctggcctctatgtggtctcggcgtccgacggcacccgcgagagcggctgcgtcgtgaacacggggctccagctcacctctgagccgctccaggtcatggtggccgtgaacaagcagaactatacggaaggcatcatcgaggcggcaggacactttgcgctcgtgccgctcacacgcgaggcggacatgccgttcatcggacgcttcggcttcaggaccggcgcgaacttcgcgaagtatgcaggagacgatacgttccgcacgatgttcggcgatccgtatgtgaagcagaatgcggctgccgtcattgcctgcaaagtcgtccagaccatggatgtgggcacgcatatggtgtttgtcggcaaggtcgaggacgccgaagtgctgagtgacgctcctcttctcgactacggctggtaccactcggagctcaagggaaagacgcctgcccgcgcctcttcctttgtccccgaaataggctaaagttacatgccatggaggggaagggccccttcatgaagcaggaaccttttaggagaggaagcaccatggccgacgaagagaagaagacctacaagttcgtgtgcaccgtctgcggctacgaggtcgaggtcgacacccccgagctccccgatgactacgtatgccccgtctgcggcgtgggccccgacatgttcgaacgcgtcgaggactagcaccagacagaaacgctgtctctcgcgacagatgtgcaggcgcaatggcggcgaagtgctgctgttgcgccttttttcagcctgcatgcacaagcgcatagaatggattgccgtaccccacttccggaagagcggacattttctatgcagcgtgcacagcagacatcggaatccatcgagctcgccgtcctcctcgcgctttcgggcggccttatggacgcctattcctatctgggacgcggcaaggtgttcgcgaatgcgcagaccggcaacatgctgctgctcggcgtgaacatcgcagacggcgactggcaccaggccgcccactatgcattgccggtcctggccttcgccttcggcatcgcccttgcgcataccgtgaagcatgtgagccatgagcaccacctgcattggcggcagacgtcgcttctcgtcgaggcagcccttctcgtggccgtctcctttgtgccccaggatttcgaccttctggcaaacagcctgacgtctcttgcctgcggcatgcaggtccaggccttccgcaagctccatggacggggattcgcgacgacgatgtgcatcggcaatcttaggagcggcacccacaaccttatggatttcatccacacacgagagagcgagcacctcgagtcggcccttctctactacggcacaatcctcaccttcatcatcggtgccatcatcggctcgcgcctgctttccgccttcggcctccatgctatcgccgcgagctccatccttctgacggctgccttctgcctcatgttctgggaccgagagcacaggatggaagaggaggaagcttccctgaaggcatagcgcctctgtcagaaacgctgccaagcgggtatacttgtatgaccgcgcaagcggtgcgcactttgagaacagcagagcgatctgcttatcgaaccgggggtgactggtttcgacagggcagacctgagatgggcagcaggccgtggtctcctcgccacgttaaacaggggtaccgtcaaattgaattgacgacaactcttatcagggctcttacgccctcgctgcttaacttttagctagcagccgtcaatccgcagcatgctcccgactgcggtgcggcgtcatctgagggagctgcacttccggacgtagcgggtatgccggaagccaagactgaaccggctgggatgccgagcgcaggccggcgcgcgtgaggcatccgagattcaagcactggctgagcctggagacacctgtcaggggtttgttttggaccggagttcgattctccgcacctccaccaaaagcgatgcgggctgcgtgcatgtgcacgtggcccgcttttttcatgccgcagccgggctgctgctagactgggggccgtctgcgctgagagcgaaactggtcttttggaagtggtctttcccatgcaggatgtgccggcaacagaggaagagtggacagagctcgaggagctcgtctcgtccacatcgtttacgcatccccaccatatgcctttgaggtggcatgacacgatccatgagccggatgcgatcgcacgcgatgcctgcctcgaggaccgttgcgccatcattgcccgcgtcgggctcctgacgctttcgggcggcaccggaggctggcgcgtgcgcgaggccatgaaccgtgtggcccagacgctcggcgtcgtctgctcggccgacgtgagcctgctcacgatcgagtgcacctgcgtcgatgggacggagcgcgaaaccttcatcgtctcgctgccgtcctgcggcgtgaacacgaagcgcatctggcgcatggagacgttcatgaaggatctcgaggcctgcggggcagacctcacggtcaaggagtgccatcgcctcatggaccagatcgagcatgagacgaaaggcggctacacgccgctgcagtcggcacttgcatcggcgcttgcctgctccgccttcgtcttcctgcttgggggaggcgcgccggagatgctgtgcgccttcgtcggggcaggcgtggggcagtatgtgcgccgcatcatgggggcgcggcgcatcacgcattttgcctgcgttgcggttgccgtgtcctgtgcctgcgtgagctatcttctggcgcttatggccctaggaatcttcgatcctgcggcgctttcgcacgaagcgggctacatcggtgccatgctctttgtcatccccggctttccgctgatcacaagcgggctcgatatcgcgaagatggatttcaagagcggcatcgagcgcctgtgctatgcgctcacggtcatccttgtcgcgacgctcttcggctggcttgttgcaagcatcgtccatcttgcgccggatgacttcgtgcccctggggatagcgccggcgccacttgccttgatgcgggcagccatgagcttctgcggtgtcttcggcttctcgatcatgttctcgagtccggtgcccatggcagccacggcaggggcgatcggcgctgttgccaatacgctcaggctcgagctcgtcgatcttgctgccgtgccgcccgaggcagcggccttcctgggagcccttgcggcaggcctcatcgcctcggctgtgaggaaaaagctcacgttcccgaggatctcgcttaccgttccctccatcgtgatcatggtccctggtctctacatgtatcgcgcaatcttctatcttgcgtcctacaacatcgccgactcgctcacgtggatggtgagggcagccctgattgtcgtgttcctgccgataggccttgctgctgcccgcatcctcacggacaggcactggcgctatctcagctagggctcaagtgcccaatcttgggtataaccttctcattggataccggaggaggatatatatggcagacgtggcactggtactcgaaggcggcggatttcgcgacatgttcacggcaggcgtgacggatgtcctgatggagcatggcatctatgggttcagcgctgtctggggcgtctctgctggtgccatgaatgcagcgacctacaagagccgccagatcggccgtgcgatgcgcatcatgcttgcctaccgagacgaccctcgctgcatgtcctggtggtcgtatgtgaagaccggcaatatcgcggccgaggacttcctctacgacaaggtgcagaacgagctcgatcccttcgacaacgagacgttcaaggacaacccgatgcgcatgtactgcgtcgcctctgacgcgatcttcggcacgcctgcctatctcgaggtgaaggagctcccagaggatatcgaagccatccgtgcctcctcgtcgcttccgctcttctcgcataccgtgaaggtcagaggccacgagatgctcgacggcggcacgacggactcgatccccttcgcagcagctctgggggagaaggagcttccctacatcgaggacttcaggccggcggaaaaggtccttgtcgtcctcacgcgcgaccgcggctatgtgaagggccttggcaacgaaggccttgtcttgcgctcccaccgctacgatgactacccctacttcataaaggcgctcgaggatcgccgctacatgtacaacggtgagcgcgaagacctgtggcgccgcgagaaggagggttcctgcctcgtgatcgcaccgcctgagcctgtcgatgtcggcgtcaacgagtcggatggcggaaagctcctcgacctctatatcgagggcaggcaggaagccatcaggcacctggatgagatctgcgcattcgtgcctgagagcacctggcagcccgcgcatcccggccgcttctaggcagtgtcggatctatgtggacgagctgtgggaacaaaagaatctttgcaggtcatgtggagccgttgtatactttgaaggctttccactgagccccgtaatctcataggataagcatttcgttacaggtacatggaggagtcaagtgaagaagtcgactcattacgccaaggccggcgaagtcgagcgcaagtgggtgctcatcgacgccgacggtgcgacccttggtcgtcttgctacgacggcagccaatgtgctccgtggcaagaacaagccgcagtacaccccgaatgtagacacgggagacttcgttgtcgtgatcaatgccgctaaggtccagcttaccggcaacaaggcagacaagaagtcctactggcgctactccggctggctgggcggcctcaagaccgaaagcttcaaggaggctatggagaagcaccccgagcgtgtcatcgagcacgcggttcagggcatgctcccgaagtcgacccttggtcaccagcaggccatgaagctcaaggtctacgctggtcctgagcatccgcacaccgctcagaaccctgtgaagatcgattggagggcctaaccgatggctgacaacaccgctgtttacaccggcaccggtcgccgcaaggaggcaaccgcccgcgtccgccttgttccgggtaccggcaaggtcaccgtcaatggccgtgacgcactcaactacttcggccgccagcagctcgtcgacaacgctctggcaccgttccgcgtgacggacaccgagggccacttcgacgttatcgctctctgcgatggcggcggcatcaatggccagtccggcgcactgcgcctgggcatcgcccgcgcacttctcacggctggcgagtaccgcgctgacctcaagaaggctggctatctcacgcgcgatgcacgtgccgtcgagcgcaagaagtacggcctgaagaaggcacgcaagcgcccgcagttctcgaagcgctaaagctttctggcttgctccattcaagagtccgtctccagttggaggcgggctcttttcgtatacttcggaaaagcatgagaatggggagacatgaagattgcagcattctaggtcagaccggacgaggccgaggcattccagcgtgtggagaagctccccttcatggatgcgctcacgctcgagtgcggccttctgccagaccatctggacgtgctcgatggggccgatgcagcgctggtcttgggacaagtgccgctacggcgaggagctcctctccaagattgcaggccgtggcgtgcatgtgcttgtcacccgcaccatcggcatggaccatatcggcctcgatgctgcacgtctcggcaccatggtcggcaatgcgcgctatgcgtctgattctgtcgccgacttcacgctcatgctcgtggccctcaggcactgcaaggctgcggtctgccagcagaacgtgaacgactattcgctcagagggctcgaaggcaggacgctctcctctcttgccgcggacgtcgtcggtaccggcgccatcggcgctgccgtcgtgcagaggctctccggctttggctgcgagatcctggccacaggccatcatgtgaaccctgaagtcgcgaagcgcgctgcctatgtatcgcaggacgagctcttccgtgcgcccgacgtgatctccttccccgtgccggcaacgcctgcaaaccaccatctggtatcccgtgaatcgcttgccgagatgaaggatggggtggtgctcgtgaaatacagcccgccccgatctcctggatgtctctgcccttacagaaggcatcgaatcgggcaagatcggcgcccttgcgatgggtgtcctcgagggggagcagggaatctgccgctccaaccgttcgggggacatccttcggaaccgtgacatggcatgcctcaggcagttcacgaataccgtgctcgcgcagcacatggcgttctgcacggcggaggcggtcgaagagatggccgagaccgccgtcgcgaaggcgcatgagctcttcgagggcagaggcgcctgaagcgattgatagcgtgccgaagggctagaattggtatgtcttgcatgaaagcttcataccatatgggaacgcagcagctgctctgctagaattggtctgtctgcaagttagacttcataccaaatgagcatgcactgtcagcaaggaggctctccatgtgcggcatcgtcggctacgtcggcaccaagcaggcaagaccatttctcctcaagggactcgcgtccctcgaataccgtggatacgattcggcaggcgtcgaggtgctctctcctgatggagagctccacggtgtcaagtgcgcaggacgcgtcgcgacgctcgcccagcgcacagagtgcgcaaatctcgtcggcacgtcgggcattgcccatacaaggtgggcaacgcacggggcgccgtccgaccgcaatgcccatccgcatgtggactgcactggccgtaccgctatcgtccataacggcatcatcgagaacttccgcgagctcagggcgcagctcatcgcttcgggccatgagttcaagagcgataccgactccgaggtcatagcgcacctcgtcgaggagtccctggcaggacctgcggggcatgacctcctcgaggccacccgcatcgcagtctcgtgccttgaaggctcctgggcggttgctgtcatctcggcagaggcgccgggagagattgtctgtgcacgccgccgctctcctcttgtcatcgccgagacgcctgacggctgctatgcggcctctgacatcacggcgcttgccggcaaggcgaaggaggtcatccagctcgaggatgggcagcttgcacgcctgcacgaggacggcacctgcgatgtgatcgatgcggagggcacaccggtgcccgaaccgacgaagcttgcggtcgactgggatgcctctgcagccacgcttggcggatacccggacttcatggcaaaggagatcgcagagcagcctgaggcaatccgccgccttctcaaggaccgtctcggcaagcatggcatcgagctcgacgagctgacgctcacgagcgaggagctctcccagatcgacaaggtctacgtcgtcgcctgcggcacgtcctaccatgtcggcctcatcacccgcgacttcatcgagaactgggcaaagatcccggtcatcgtcgagcaggcctccgagctcaactacaaggacacggtcctcgtgaccgaccataccctctgcgtcatcatcacccagtcgggcgagacggcagataccctgacggcagcgcaccggctcaggggccttggctgcaagatctttgcaatcacgaacgtgctgggctcgaccgctgcgcgcgagtctgacggcacgctctatatccaggcgggtcctgaggtctgcgtcgcctcgacgaaggcctatacggcacagatggtgggtgcggccttcctggcacttcgccttgcacaggcacggggcgccctcacggcagaagaggtcgagaagaagttccatgacctcgagtgcgtccccagcctcatggagaccgtgctcaagcgcagctggcaggacaaggaggccgcccgcgtcttcagacgcgcccactcggccctcttcctgggccgtggcgtgaactccacgaccgccgcagaaggagccctgaagctcaaggagatcagctacctccacgccgaggcctatgcagcaggagagatgaagcatggcccgatcgcccttctcgagcccggctacccggtcgtcgcgatcgtgcctgccgaccatgtccacgacaagaccatatccaatatccaggaatgcatcgcccgcggtgctactgtaataggggtcgcgacagacggcgacgaggacgtcgtaccgctgtgctcgaacgtgctctgggtgcctccggtgcccgaggagttcctcgtgccgctcgttgctgtcgtgcacctgcagatgcttgcccgctatgtcgcgctcgatcgcggctgcgatgtggacaagccgcgcaacctggcaaaatcggtgacggtggagtaggcatatggcactggcggggatcggcgtcgatatcgtagagattccgaggatggcacgggcgctcgagcgcacgccgtccatgaggacaaggctcttcacgaaggaagagcgcgactactgcgactcgtcggcccgccccgccgtgcactatgccgcacgcttcgccgcacgcgaggctgtgctcaaggccctgggaactggtttttcccagggcataggatatgcggacgtctcggtcgcacgcgatgcagcggggcgtccgaagtgcgtccttgctggacgtgccagggagatcgcggagaagcagggcattcaggaggtcgcgctctcgctctcgttcacgcgcgagcttgcggttgcgaatgccgtggctgtgaccgaggccgtgcgtcccaagaaggaggagacgcccgatccgcagcgcgatcttgcggaatccttcaggaaggccagaagcgtcctcgatgagctcgacgctgtggaggcccaaggcgctgccaattctggcgaggagacgaaggttcaggacagataggcctatatgcactaaaatctttgaccagcgaggcgcccgccttgcctgggctaaggaggatcatcgtgcaaccagtcctgaacgtggaggacgtgaaggccgtcgagaatgggctttcggaacagggcgtgagcatatcggagctcatgcgccgtgcgggaggagccgctgccgaagaagtcatgcgtctcgaagacgtccatgcggtcgcaatccttgtcggcttcggcaacaatggcggggacggctgggtggcatcgcaggtgctccagagccatggctacagcgtgacggtcgtctctcctgtcgagcccgaagagattaagagcgatcttgcccgcctcgtcgccaagagcgcagaagatgccggcgtcgagattgtcgtcgggcctccgcgcgaggacctcatggagatcctctcctcgtccgaccttgtccttgatgccatgctcggcacgggcttccacggggagccgaagccgcctttcgatatctggatcgacaccgtgaacgccgccggcgtgccagtcgtctcgatcgatgtgccatctggcctctctgcacagaccgggcatgcacccggcgcctgcatcgtggcagacgagaccgtgacgatgctgtgcctcaagccgggcctcatctccgatgagggaagggatgtcacaggcggcatcatcgtggcgccgctcgcagagcagacagagcgcacggttctcgacaacgaccccacggcctggcgtgtcgagcccgctgactacgcagatgtcgttgccccccatacgaacaatgtggacaaatacagcaggggatccgtacttgtggttgcaggatcttcccgctatcccggtgctgccgtcatggcagcaaaggcagcagcccgcgccggtgctggctacgtgacgcttgccgtgccggtgacaatcgcgcccttgatccagatgcagctccccgaggtgccggtcgtcggcgtcgcggcagagcaggatggcacattctccgcagcagcacgcccggtgatcctgaagctcgcagagcgcagctctgccacgctcgtgggccctggcatgcgtgtcacgggcggcacggttgcagtcgtctccgccctcatcaattccaaggcgccgcttgtcgtcgacgccgacggcctcaactgcctcgcacgcctcacgaatgggcatctcgatgagttcccggaggtcacgaggcgagacgccccgcttgtgctcacgccgcaccgccgcgagctcggacgcctcgtcggccttgccgatacgccacctgactcgctgactgctgccctcgaggcggcacgccgcatcgtctgggcagatggcggatctgaactctgcgtcgtcgcaaagggcacagcgacagcctgtgtcggcgtcgaggcagcgcttctgcctgagccgggcacagcaagccttgcaacggcaggctcgggcgatgtgcttggcggcatcatctgcgcgcttcttgcccgcatgccggatgacatcgaggatctgccccttatcgtagcgtttggctgcgagatccacgctgttgccggcagccgtgccgcaaagcgctatggcagccgcggcgtgatggcgggagatattgcagacgaagtcggcctggctgtcgacgagctcgaggaccatgtctcctcgcttgtcgctggtgccgccgaggaccaggagccttcgctatgacagagattgcgtgtcccgatgaccggtgggcctgggtcgagatcgacctgtcggctctcaagaagaatgtccgtgccttccgcgcccagatagacccgcgcgtgcgcatgatgtgcgtcgtgaaggccgatgcctatggccacggcgccgtgaggtgcgcgaaggagatggcaaaggcaggagcccagcagttcgccgtcgcaaccgtgaaggaaggcgtcgagctcaggcgcgccggcgtcgaggagcctatcctcatgctcgcgcagcccccggtgacggccgtggacacgcttgtcggctacgatatcatgccctctgtctatacctccgatttcgcgcttgcctttggcgaggcagcagctgctgctggcaaggtaggcaagtaccacctcgcgatcgattccggcatgaaccgcatcggcgtacgtcctgaggatgccgtcgagttccgccgctcaatcgacttccatcgcggccttgagtgcgcaggcacgttcacgcacttcgctacggccgatgtgccggatgactgggacttcgtgctccaggcgcgcaggttctccgataccgtgcatgcactcaaggcagcaggcttctcctgcggccttgtgcactgcgacaatacgcccggcacgatcctccacaaggagctgcagatggacatgtgccgtgtcggcgtcggcctctacggcatgcagccggcagagtcgacggcaccctacatctcgctcgagccggtcatgtccgtgaaggctcgcatcacgcgcgtcacgatgcctgaggtcggcgagggtgtcggctacggcatgacctaccgcatcccgtacaagggcacgcagatcgcgaccgtgaacatcggctacgccgatggcctctcgcgcctgctctcgaacaacatggacgtgctcgtgcatgggaagcgctgtgcgcaggtcggcaagatctgcatggaccagttcatgttcgcagcagacgcgccgggtgcccatacgctcggcaatgccgtgccgctctccgagggcgacgtcgtgaccgtgcttggccgcgacggccaggaagagatcacggcagacgagatggcagacaggcgccacacgatcaactacgaggtcacctgcgacttcggcctgcgtctggaaaagctgtatgtctgaggcacggccccaggcacggcgcacccgtgcgaagaagccgcgtcccagccttttggatggggagagcaggatggcaatcatgcagattccggggcatgagcatcagaagccccgcgaggtgcggctcgaggagatcgaggccgtgctcggagactgcgagcggtgccccttgggccagacgaggacgaacatcgtcttcggtgtcggcaatcccaacgcccgcgtcatgttcataggcgaggcccctggcaggaatgaagacctccagggagagccgttcgtcggcgctgccggacaaaacctcgacgatctgctctctctggcagggctcaggcgcgaggacgtctatatcgccaatgtcctcaaatgcaggccgccttcgaaccgcaatccgaagccggaagagatcgttgcctgctcgccgttcctgcgcgagcagatccgttcgatctggcctgatgtgattgtctgcctcggcaatttcgcagcgcacttcgtgctcaggaccgaggaaggcatatcgagcctccgtggccgcatgcatcagacggggcacttcaacgtgctgccggtcttccatccggcagcggcgctctaccaccgcgagtggcagcagtatctcgatgaggatttcgcctatctcggacagtggctgcgcgagcatccggcaagctccgagaagcaggaaacaggaaggggctagcgatgctgcctcagacgatagatgagaagacctataagagcgtctctgccgaggagacccaggggctgggcgaggcgctcggacatctgctccaggcgggagacgtgctcgtgctcacgggagacctcggtgccggcaagacccagctcacgaagggcgtagcccggggcatggggattgaggacgatgttacgagcccgaccttcacgatcgagatggtctacgaggggaaagagcttccgctctaccacttcgacctctaccgcctcgatgatgcagacgagctcgaggacacgggcctcttcgatgtgctcgggggcgacggtccctgcctcatcgaatggggcgagcagttcgagagcgaactcggcgacgagaggctcgatgtgatgatagaacgcctcgacgacgaagtggcagagggcgtggagcctccaaggcgcatcacattcacgccgcatggcacgcgtgcagaggagctcgtgagcgagcttcaagatgcctgtgcccgcacagaatagaacgagacagaagagagcttcttcatgaggtacgagaagacagaagggcgccttgtgctggcgctcgatacatcgacggacatgctcgccgcagcagcggctgcctggaaggaggagcctgggaagacgcctcaggcccagcttcttgcagccggtgaccatatgtgccgccgccaggccaatgtcgagctggcacagaccctgctcgatgtcctggccgaggcaggcgctgcgatggaagatgtcgacgccgtgatcgtcggacgcggtcctggctccttcacgggcgtccgcatcggcatcgccacggccaagggcatcgcttcggggcttggatgcgccctctggggtgcctcgacgctcgatgcgaccgcctgggctgcctggcacgcaggagtccgtggcatgctcggcgtcgtgaacgatgcgatgcgccacgaggtctaccctggcatctatgagcttaccgaggcaggcgtgaagcgcacgttcgtgcgcgagaccgtcctcaaggccgatgcggcagcagacgcctgggcaggacttgctggcaaggacgagcttcagctcacaggaaacggcctcatcaagtacaagggcctcttcgagaaggcgggatttgcccgcttcgtcgatgaggcactctggttcccgacgggggagggcctcatgtcggcagcagcggcggaaggtgccgcccgcggcgacggcgatcctgccctcgtgcttccgctctatacaaggctttccgatgcagaggagaacgagcgcaagcggctcggcctcaagaagccggcatccgtggatatcacgggcgtcgacgatatgctcggctccatccatacgcagctgcgtccgatgacggtaaacgactgcggcgctgtggcggcactcgaggcagagatctttggagcatcttcccacacgccctggagcgagcatgccttcttcgaggagatctcgcagcctggcaggagctggtgggtggcccatgaccaggagaagatcatcggctatgccggaggcgtgcttgccggtgccgacttcgagatcgaggatgtggcggtagcgaaggatcgtcgccatgaaggcatcgcgtcgcgcctggtgtcgcgtgtcgtctacgacggcgagatgctcggcgccgagaccgcatcgctcgaggtcgacgaggcaaatgaggcagcacgtgcctgctatgcgaagcttggcttcaaggaggcaggcaggcgttccggctactatgggcctgatacggcagcactgatcctgaaggtggcgctcccgcttgcagcagaccccgaaggcatggggaaggcgcccgtgccggctgcatcgatccgcccgtggcctatccaggtcgcgccgaggacggaagatgtggcagcagccatcaaggccgcatcccctctgatcctttcgatcgagtcctcctgcgatgagaccgccatggccgtcatcgaccacgagggacagatcatctcgaatgtcgtggcaacatctgtcgacttccactcccgtttcggcggcgtcgtgccggagattgcaagcaggaagcacgtcgaggccttggtcggcgtctacgaggaggcgctggcgcgggccggtgcgcactacggcgcagatacgcttgctccgtcagatctggctgcggtcggcgtgacgtcgggaccaggcctggtcggagcccttgtcgtcggcgtcgccttcgcgaagggcctctgcgctgcctgccatctgccgatcattcccgtgaaccacctcgagggacatctctttgcaaacctcttcgagacacccgacttggagcctccgttcgtggcctcccttgtctccggcggcaacacgatgctcgtgcatgtgaaggcctggggagactacgaggtgctcggccagacgatcgacgacgccgtgggcgaggccttcgacaaggttgccaaggccttgggcctgggatatccgggcggccccgtcatcagccgccttgcggcagagggcaacccccgtgccatccacttcccacgtgcgatgatgcactcgggagactatgccttcagcctctccggcctcaagacctccgtcatcacctacatcgagggcgagaacaaggcaggccgcgccatcaacctgcccgatcttgctgcctccttcgaggctgccgtcatcgatgtgcaggtcgcaaaggcaaagcaggctgtggaggagacgggcgtctccgacttctgcgtcggcggcggcgtcgctgcgaacccgcagctgcgcgaggcctacaaaaagacattcgggcgcatgggcgtgcgcgtcacggtgccgccccttcgtgcctgcggcgacaatggcgcgatgattgcgcttgtggcgctgcgctcctataaggcaggcgccttcggcgacctttcgctcgatgcgcacccgaactcgaagctcggcgactggtcttctccggagcacccggtcgtctggcagggcgagcaggcgtggctcaaggccaagaagtagcgcacatatatcaggaatgtgatggtttttatggaggggacttccggcggaaagcggtaagtcccctctttgcgcaggaagacagccccttttctgtacaggcagttacggcgttgtttccctcatcaaagttttttgggcgcatcctgaaaagggctgtatcctttgagcttggtacccgtagctttctcgcattcagttgcaagggggaggggaatgggtcccctccggttgcgtgtacagaagggatatatctaccacaggaggatctgccatgttcgaaagccatgcattcacgcgccgcaatttcctcaaggcctctggccttaccgccatctctctcggtggcgcaacgtttctgaccgcctgcggcccgtcgaccgccacgacgagctcttcaagctccgattccagctcgtccaaggcaagcttcggcgacaacggcacgatgcgtgtcggcatggaagtcgcctatcctccgttcaactggcaggtctccgaggccacggacaacacgattcccgtcgagggacagtccggtgcctatgctgacggctacgacatctacttcgcgaagctcatcgcagacaagctcgatctcgagcctgtcgcagtcaagatggagttctccggcctcgtcgaggccctgaagaacggccagatcgacctcatctgcgccggcatgacggcaacggatgagcgccgccagtccatcgacttctccgatgcctactggaccggccactacggcctgctcgtgaaggagggctcgaagtaccagaacgcgacgagcctctccgacttcgccggtgccgccgtcctcggccagcgcgatacgctgctggatgatgtcatcgacgagatcgacggcgtgaatcacctgacgccggtcgactccgtccctgcccagatctcgagcctgaactccggcgcctgcgacgccatcacgttcgacgtcgagaacgagaagggcatccttgcctcgaacccgggccttgtcgctatccagatcaacggctccaagatcctcttccaggaggatgcaccgatcaacgccggcatcgccaagggcaacgacgacacgcttgccacgatcaatgacctcatcgacggcgtctcccaggacgagcgccagaaggtctgggacgacgtgcaggcacgccttccggagtaggaagaccacaagataccaacaaggcaggcatcctctgcacattctctgcaggggatgcctttgcggcaaaggagcgtactctcaatggccaaaaaacgcggattcgcgcggttcgtgcaggaagaccatcgctatgtcttcctcggcacttccgccatcgcctgcgtgggcctggcgctggcaaaccagccccattccccatcgagcttcctgctcaggtcctacgcggtcgaatccatcctctactacgtgcttctggcatggcttgccgtgtcggctgtggcacttgtgaacaagcttgcgaagtggaaggggacggcctacgccgagacctcgcccttcacgaagcctgaagccaagaaggcagagcgcatcggatcctacgccgtctgggccatcgtggccatcttcttcgtcgaccgtggcatcatcggcctttgcgaccttgtctcgaacgccatcacccaggactcgaacccgaccgacttcctcgcgtcgatgttctacatgctctaccagatgagggatacgttcatccagggcatcctcggcacaatcgagattgccgtcatcggcaccgtcgtcgccttcttcctggcgcttggcctcgtgttcctccggctcatggagatcgaccgttccgacaacgatttcgtccgcttctggaaggtcgtgggcgtcggcttcgcaaaggtctattcggccgtcatgcgcggcacgccgatgatgatccagggcctcatcatctactatgcaggaacaggactcctgacgggacagggcatgacaccgacgcagatcctcgcagtctggtcgcccttcaatgccggcctcgtgacggtgtccctgaactccacggcctacatgatggaggtcttgaggagcggcatcatggctgtcgatccgggccagaccgaggcggcacgctcgctcggcatgtcccagtggcaggccatgcgcaaggtcgtcttcccgcagggcatcaagaatgcgattcctgccctctcgaacgagcttgtcatcaacatcaaggactcctcggtgctcatggcaatcggcgtcctcgagctcacgtttgctgtccgcacgattgcaggcgtctacttcaagcagatggagccctacatcgctgctgccgtcgtctacctgatcctgacgatgatcgcgacgaagctcctgaacaagttcggcgagcacttcgatgccaagggcgagcgtgtcgtgctcggcacgtccgatgtgcctgttgccaaggcccagggaggcgatgagaagtgagcgaagagaagacgcagcctgtcgtgcgcgtcgaggggctccgcaagagcttcggcgagcatgaggtgctcaagggcatcgacttcgatgtcatgcccggcgaggtcgtcacgatcatcggcgcttcgggctccggcaagtcgacgctcctgcgctgcatcaacctgctcgagacgccggatgagggccatgtgtggttccgcggcgaggacctgacggcagagcatgtgaacgtgaaccgcctgcgcgagaagatcggcatggtgttccagggcttcaacctgttcgcgaacctcaatgtgcttgacaactgcacgcttgcgcccgtgacgctcaagaaagccacgaaggcagatgccgagaaggaggccatgaagaacctcgaggccgtcggtcttgccgactttgcgaaggctcctgtggtgtctctttccggcggccagaagcagcgtgtcgcaatcgcgcgcgccctctgcatgaagccggaccttatgctcttcgacgagccgacctcggctctcgaccctgagatcgtcggcgaggtcctgaacgtcatgcgcgaccttgccaagggaggaatgacaatggtcgtcgtgacgcacgagatggacttcgcacgcaacgtctcggacaaggtcgtctttatggaccagggcgtcatcgccgagcagggcaagcccgaggacatgttcacgcatccgaagatgccacgaacacgcgagttcctcgcacgctatctctccgagtagccgcacagacctatatgcagcatcgagaaggcagcctccgggctgccttcttcttgtgcggggcgtcgctcttattgaagtgaatcgcacttcacttcaataagagagaaattacggaagcgaaatccagttcgcttccgtaattggatgggcagattgtcaagctgagtgcaacatctccctgtagacctcgttggctgtcctgtatttcaggaccttcctcggcctgccgttgatcaggtccaccgcatgctgcacctcctcgtccgtgaccttgccgaagtcggtgcccttcgggaagaactcgcgcaggagcccgttggtgttctccaccgtcggcttctgccagggatggtgggggtcgcagaagtagaactgcacgcctccgagggcctttgtgacatctgcatgccccgcgaactccttgcccctgtccggagtcaccgtctcgagcgggcgcccctccagaagcgcgacctcggccctggagacgctggcgctgtcatgccggcatctccctgcaaggaggagcctcgatgccctgtcggcgagcacgagcaggcatgcggaccccggaccgactaccgtgtcgtcctcccagtcgccgaggcgcgacctcgcatcggcctctgccggcctctcctccacggtgtgcgagatcctgatcttgcccctcgtctcgggcctcttcctgcggatcctcttccccttcctgcgcaggtggcgccgcacctggccttcggggccggctcccggcaggtcgagcgtgcctgcatggacctcgcggtagatcgtcgagaggctcacgacgcaccttccgccgttctccagcctgagcctgccgtctatctcgtccggggaccagtgcctgtccatgatgagcgagcgcaccttctgcgcgagcgcagggtcggagagcctcctcttcggcctgcatctcctgtggcgcgcctccgccctcctctgggcggcgcatgccccatagcgcccgtgccggccgttcctcttcagctcgcggcagatggtcgacctgtccctcccggtctctcccgcgatgtagccgatggaccttccctctgcatgcagcgtggctatgcagtccctctcctgagggctaagatgactgtagtggcacattccttccagcttccgacgttgacctagacaaccaacatcgtagccttccgggatgtgccacgcctgcattcggcgggccatcctgttgcactcagaatgctaatccgccatgggaaagggaagcgaatctggcaggatgccggatggctgccgtgcagacgattgcatgaggctgtcttgtgccatacggggaggctccgctgcatgccggtggctttcgggcagctgcagcaggcctctgacggaagatatcgaggctgcgtgccatgccaggcgctctcatgctaggatgctaggcatccaagagagaggatgaccatgatcgatggctttgtcccggtagctgccgtgacgcccgaagtgcgtgtggcggatgtcccgttcaatgtaagctcgtgcctcgaggcggtggagcgcgccgcttctgccggcgccaaggtcatcgtcctgcccgagctatgccttacggcctatacctgcgaagacctgttcctgcagcaggcgctcctcgaaggggcagaggcagggctcagagagctcgtggagaagacggcagatttcgatgccctcatcttctgtggagcgccactcaggatttcgggcaagctctacaactgtgcctgcgccatgaattccggcaatcttctcggcatcgttccgaagcgcttccttccgacctacaacgagttctatgagggaaggcacttcgtgccaggccccgaagaggtcacgcccatcaatgctgcgggattcgtgaatgtgcccttcggcacgcggcagctcttctcctgcgagaccatgcccgagctcgtcgtcgcagcagagatctgcgaggacctctgggtgccggagccgccttctgtggcccatgcccaggcaggcgccaccctcatctgcaatctctcctgctcgaatgcaatcgtcggcaaggctgcctacaggcgcagcctcgtctctggccagagtgcccgcctcatctgcggctatgtctatgcaaatgccggctggggagagtcgacgcaggacctcgtgttctctgcccacaacctcatctgcgaggatggacacatcctcgcagaggcaaagccgttcggtgacggcttctgcctgagcgagatcgactgccagttcatcgcagaggagcgccagcgcatgtcgagcttcagctgctcgctgccggccctttcgggatacaggcaggtgcgcttctcgctcgagaagacggaagtgcgcctcacgcgtgccgtcgatccgcatccgttcgtgccggacgacgaggcgacgcgtgcagagcgctgcgaggacatcttccagatccagagcatgggtcttgcgaagaggctcttccacacgcattcgaagtgcgccgtcgtcggcgtctcgggcggcctcgactccacccttgcccttcttgtcatggcccgtgccttcgatatcctggacctcgatcataaaggcatcattgcggtcacgatgccgggcttcggcacgacgaagcgcacgcattccaatgcgacggagctcacgaagtctctgggtgccaccttgaaggaagtctcgatcgatgcagcggtgcgccagcacttcgctgatatcggccacgatgagcgcgtccaggatgtgacctatgagaactcgcaggcccgcgagcgcacgcagatcctgatggacatcgcaaaccaggagggcggcctcgtgatcggaacgggcgacctctcagagctggcactgggctgggccacctacaacggcgaccacatgtcgatgtacggcgtcaatgcctcggtcccgaagacgcttgtccgccacctcgtgcgctatgtggcagatacctgcggaaacgagacggagtcggcggtgcttctcgatgtgcttgcaacgccggtctcgcccgagcttctgcctgctacggcgcatggcacgatcagccagaagacagaggaccttgtcggaccctatgagctccatgacttcttcctctaccagatgctgagatgcggcttcgcaccgaagaaggtgttcaggcttgctgtctatgcactcggtgacgtctacgacgagaagacaattctgaagtggctgcgcatcttctgccgccgcttcttcgcgcagcagttcaagcgcagctgcctgccggatggaccgaaggtcggcaccgtcgccgtatcgcccagaggagacctgcgcatgccctcggatgctgtctggacgctctgggaacgccagattgccgagctcgaagaggcagaagcctagtttccatgcattgaaggaatggagaaggggaccgagaggtccctttctccatgtctggatacgcaatcagtggggcgtcagtatctatggggcataaaatctaagcgccttatagaagattttttcttctttgaaggtataacttcgtgcatgtgggtatgattctagacgtccgcaaagggagggccgaacaccctccaacgtctgatgaagacgtcgatagaggaggttcaaacatcatgactttgaagcctttgggagatcgtgtactcgtcaagcctgcaccgaaggaggagaagacggcctccggcctgtacatctccagcggtgcacaggagaagccgcagcgcggcactgtcgtggccgtcggctctggcaagattgacatgaagggcgagcgcatcgttcctgaggtcaagccgggcgatgaggtctactacggcaagttcggcggcaacgaggtcaagctcgacggcgaggattacctgctgcttcgtgccgaggacatctacgcaatcatcgaggcctaaggcttcgtatccagaaggataaagggatagcggacgctatccggtttcaaggagatacaaatggcaacaaaggacattaacttcggtacggatgcacgtgcccgccttgccaagggcgtcaacaccctggcagacgcagtgaccacgacgatgggcccgaagggccgctatgtggcgcttcagcgctcctatggcgctccgaccatcacgaacgacggcgtctccgtcgccaaggagattgagctcaaggaccctgtcgagaacatgggcgcccagctcgtgaaggaagtcgccacgaagaccaatgatacggtcggcgacggcaccacgaccgctacgcttcttgcccaggtcctcgtcaacgagggtctgcgcaacgtcgcagctggtgcaaacccgattgccatgcgccgcggcatcgacaaggcagtcgacgctgtcgtgaagaagatggttgcctccgcaaccaccatctccacgaagaagcagatcgctgctgtcggcaccatctctgctgccgaccctgagatcggcgagaagatcgctgacgcaatggagatcgtcggcaaggacggcgtcatcacggtcgacgagtcccagaccttcggcatcgacatcgacaccgtcgagggcatgcagttcgacaagggctacatctccccgtacttcgcaacggacaacgagaacatgacggccgagctcaaggatccctacatcctcatgaccgaccagaagatctcgaacatccaggacatcctgccgatcctcgaggctgtctcgaagcagggcgctccgctgctcatcatcgctgaggacgtcgacggcgaggctctggccacgctcatcctcaacaagctccgtggcacgctgaacatcgctgccgtcaaggctcctggctacggcgaccgccgcaagaggatgctcgaggacatcgcaatcgtgaccggcggccaggttgccatgaaggagctcggcgtcaacctctccgatgtcaccgccgagatgctcggccgtgcaaagtccgtcaagatcacgaaggacaacaccacgatcgtcggcggctatggctcgaaggatgctatccacgagcgcgtcgcacagatcaagaacgagatcgagaacacgacctctgacttcgacaaggagaagctccaggagcgtctggcaaagctcgctggcggcgttgcagtcatcaaggtcggcgctgctaccgaggtcgagctcaaggagattaagcaccgcatcgaggatgctcttcaggcaacccgtgcagcagtcgaggagggcattgtcgccggcggcggcgtcgcattcctcgaggcagcctctgcgctcgatgatgtcgagtgcgctgatgccgacgagaagatcggtgtcgatatcgtccgcaaggctctcgagtctcctgtcaagaccatcgcatccaacgctggctttgaaggctctgtcgtcgtcgagaagatcaagggcctgcctgagggcgagggcctgaactccgcaaccggcgagtggggcaacatgatcgatatgggcgtcctcgatcctgtcaaggtcacccgtgtcacgctgcagaacgcagcatctgtcgcttccctcatcctcatcaccgaggctacggtcacggatgtgccgaaggacacgacgatcgaagaggccatctctgcagcagcagctcagggcggccagggcggcggcatgtactaatagctgcagccagaacagctctatctgactcggaaggctccggatgccacaaggcgtccggggccttttcccatgttagggggggacgttcctgctcttttcccgctttgcaggggcgctcgtgaatgcagcggcagaacgggcatcctccgcggtacaataagcaggttcatgcgtagagggggatacatggcagagaagcacgatcttctggacgacatcatcgatatcacgaacaactggggcgctgtctcgaagcctgtcgagaccgtcatgaacgggatatcgttcgatccggagacggctccgcagtgggatccgtcgaagtacaaggagcgtccgcgtccgaactccgtgcgctgcctctctgttgcatccaaggatccgaaggcctgcacgaagtgccaggatgtctgcccggtcaatgccatctcgatcacggagacggcgctcaccgtgaacgagtcctgcaggaagtgcgggctctgcgcggctgtgtgcccgaccgaggcattcctgatccagaagctcatgccgaagacgctctacaacagcattgcgaagcaggcagcatcgcatgaccatgtctatatcacctgcacgcgtgctctggggcgcatcccgaaggaaaacgagatcgtcctgccgtgcgtcggcgcactctccaaggagctgtggttctccctcttcatggagtatgacaacatctccgtgtacctgccgctcggtgtctgcgaccgctgtcgcacgacgacaggcgaggaggcctataccgacgctatctcctacgccgaggagctcacaggcgctgcctgcggcctcgaggtggacgagaaggcgctcgaccacgagtactcccgtgcctacaagagaagccagttcctgggccaggtcgcacgcaccggcacgagcctcgttgccggccacaatgccgcaatcaatggtgcccaggcggtcgcgcagaggattcagaaccacacgaagcgcgtgaacgagcttacccgctcgctcgagcaggcagtcggcgtccagaacagccagcaccaccgccgcatgctcacccagcgccgcgagcttgtcatggcagcgctgcagaagtggcccgagcctgccaagcagatgaagagcgagcttccgacctgcgacatgtcgaagtgcacgatgtgcggcgactgcacggaggcctgcgtcctccatgcaatcgagctcgaccgtgacggcaagatccagatcgagcctgcctactgcgtcggctgcggcgtctgcgcgagggtctgcaaggaaggcgccctcgagatgcatcccaccgatggctccgccctcgtcgtgcccgatccgcatgcagaggagatcgagcgcgaacgtgccgaagtgaggaagctcaagcagcagggaaagaaggtcctcgacagttcgctcaaggccctgggcgataccttcggcgaggattcctcctcgaagaagtagcaaacacgcacaaagccatccccagaagaaggagaagatagaacgtgtctctgtccatcggaatcgtcggcctgccgaacgtcggcaagtccacactgttcactgccctcacgaagaagggcggacttgccgccaactatccgttcgcgacgatcgaccccaatgtcggtatcgtggacgtgcctgacgagcgtctccagaagcttgcagacatcgtgcatccgggccgcatcgtgccggcaaccgtcgagttcgtggatatcgcaggactcgtgaagggcgcaaacgaaggcgaaggcctcggcaaccagttcctcgcaaacatccgcaactgcgatgccatctgcgaagtcgtgcgctacttcaccgatcccaatgtcatgcgcgagaccgggcgtgtcggcgagttcgtcgatccggcagcagacgtggacacgatctccacagagctcatcctcgccgacctcggcacgctcgagcgtgccatcccgaagctcgagaaggaggccaagcgcgacaaggagaatgccccgaagctcgctatcgcaaagcgcctccaggactggctcaacgaaggcaagcgtgccgccgacctcgatatgacagaggacgagaagaaggctgcacatgacctcttccttctttcgatgaagccgatcctctatgtcgcaaatgtcgacgaggaccagctgggagagaagcttgcgcccatcgacgggcaggagcccatccccatctgcgcagaggtcgaggcagagcttgccgagctcgatcctgccgaggcgaaggagtatctcgagtctctgggcctcgagaagagcggcctcgagacacttgcgcaggctgcctaccatctgctgggccttcagagcttcttcacggccggcgagatggaggtcaaggcctggacggtgcgcatcggcgccaaggctcccgaggcggcaggtgtcatccactccgacttcgagaagggcttcatcaaggccgagacgatctcctatgaggactacgtcacgctcggcggcgaggcaggggcccgcgaggcaggacgccttcgcatggagggcaaggactacgtcgtccagaacggcgatgtcatgcacttccgcttcaacgtctagggacggttcagagactttctgaggggctgcatcgcagggtgtggcccctcattcgtatgaaggcactgggcagctgagatgggctgagattggcttgatagccacaaaaagaggctccggcatcatgccggagcctcttgtgtgtcggagctctgcgtctcggtgctagtcgctgccgagaatcacgaggacatctcccgtatacgagtaggtgtgcgaagagtcattcacgtagttgatcgtgccgagcgaggagagcgtctcgccgacgcccttggcaatggccatgctgtcgtcgccgcggtagacgatcgtgatctcctggtagtcggagggatcggcgacgcctgtcgtcgccgtgtagcctgccttctcgagcaggttcgcggctgcggcagcagcgccattcgcgccagagccgttcagcacttcgatatcgcccttgtggacggcgtccacgtcgtccattgcagagccggtcgacgtcgtcgtggtcgtcgtgccatcgcctgcgctggcagagacgcctgctgtcggatcgtccgaggcattctcgtagggcgactcgccgctatcgacgcgctccatcatctcttcccattcgtcttcgatggtgacctggtaggagatgccgtcaatcatctcgccctccgtcggattcaggccggagtagacgttgttgtccacgtcgaggtccttcatctggagggcaagggagatgatttgggaggcgtcgagatcggtcgagacaccgtcagcgaggttggagatggtgttggcaatggtgagcgggtctgaggagagaaccttcttgatgatggcggtgatgacggcacgctggtttgcagcgcggtagaagtcgccggcaccgtactcatcgtaggcatgcctcgagcggcagagggcaagcgcctgctcgccgttcagggtttgcgttcctgcctggatgttcgcattggcgagcgggtccacgacgtcggtcggtacggtgacctcgatgccgccgattccatcgactattgctgtcagggcctcgaagtccacctctgcgtagtgggagatatcgacgccggcatatttctcgacgacctggaccgtatagctcgggccggccagggcataggctgcgttgatcttctgcatgccatagtcgcccatgtccaccatcgtgtcgcgggcgatggagacaagcgtgaccttcatgtccttcggatcgatgcgcgcgaggattatcgtgtcggacctgaagttcgacgaatcgtcgccccattcatcggcgcgctcctggctcttgtccacgccgagcagcagcatgtagaacggctccgacacttccttggagtccgtaagctgcgcctcgagctcaggcgtgatgttcgccttgatcttgctgttgatatcgctgtagaacttcgcgaacgcgacgcctgcaacggcaatgattgccaccacacagatgaggaccgtgcggagaatgaaatgcttcttcttcgtggcccgctttgccacgtagtggctcggaccgttatcgcgcgacagggcaccggctgtaggttccagctgccctctgttcctgtgtgccaaaagaagtctcccttgtaggggtggatgcaccaccgtttggcattgtgcaatcttacatcttagacatgtcacccaccggcttactgaataggcactgaagttcatcaaatgcccctacctgcggatatcctgaatggtagcattttggcggtgagcggcatccgtgtattcggggcagcggtatgcagaaaagcttggcatccatacacggcacgcgaggtgtctccatttgccgtatcatggaacatggacaagaagaacctctcgcttatcggaggcagcaatgcagagtgctcggccaaagcagttcgtcgtcgtcttggacttcggcgcccagtatgggcagctgattgcaagacgtgtccgcgatctccatgtctattccgagattgtcccctgcgacatctcggcagaggagctcaaggccatggccccttcggccatcatcctttcgggcggtccggcctctgtctatgcagatgatgcgcccgacatggatgcagatgtcttcgagcttggccttccggtccttggcttctgctatggccagcagatcatggcagcaaagcttggcggcaaggtcggccacaccgagaagggcgagtatggcccggcgcagctcaagcgcacgggagactctgagcttctcgatggcacgcccgaggagcagaccgtgtggatgagccacagggatgccgtgaaggaagtgccggaaggctttgtcgtcacatcggtgaccgacacctgccctgtcgcctccatggagtgcgcttcccgccgcctcttcgcgacgcagttccatcctgaggtccgccatacgcagtatggcaagaagatgctcgagcacttcctcttcgatatcgcaggcctctccgccacctggacgatggacaacatcatcgaccagaaggtggaggagattcgtgccgaggtaggggacaagaaggtcatcctcgcactttccggcggcgtcgactcctctgtcacggcagcgctcgtgcaccgtgccatcggcgaccagctcacctgcgtcttcgtgaaccacggcatgctgcgccgcggcgagcccgagatggtcgaagaggtcttccgcaagcagttcaatgtgccgctgatccacgaccatgcagagaagcgctatgaggagctccttgctggcgtgacggaccccgagaagaagcgccgtctcatcggcacgcagttctggaaggagttcttctccatcgcccaggacctcgacggcatcgagtaccttgcccagggcacgatctatcccgacatcatcgagtccggcgccagaaagaccggcggcaaggcttcgacgatcaagagccaccacaacctgattccgttccccgaaggggtccacttcgacctcatcgagccgctcgaccacttcttcaaggacgaggtgcgcgagctcggcatcgcgctcggccttccggcaaagctcgtctggcgccagcccttcccgggtcccggccttgctatccgcatcatcggcgaggtcacgccggagaagcttgccatcttgaaggaggcagacgccatcgtgcgcgaggagctcgatgcatacaatgagcgcctcttcgaggagacaggagacaggaactccgagcatgcctgctggcagtacttcgctgtgcttcccgacatcaagtccgtcggcgtcatgggcgacgagcgcacctaccagcgtccgatcatcgtccgtgccgtggagtccacagacgcaatgacggcagactgggcgaagcttccctacgatgtgctcggcaagatctcgagccgcatcgtcgacgaggtcgacggcgtgaaccgtgtcgtctacgacatcaccccgaagccgcctgcaacgatcgagtgggaataggccatctcatccagtctcatcccgcacctctagtcgcggtggcttgcaactcgtgccctgtattgggcaaagccgcaaagactttcgcgaagcgccaaatgcgagaagcccccggaatcttcggatttcgggggcttatttcatgggtgtcagcctgcggaagcactcttcggccgtcttcgctgggatgacgcgttgcgacctcttgccgagaaaggaggctggatgccaacatgccaaagcgagaagagtatcttcatcgcgttctttagccgcactggcgttttgggccgagccatgcagtcatcgggcagtcaccccgttttgtgccttctgtttcgcaaagccgcaggcagaagtaaagagcgacaaattgcaaaaccgcgatttccggcgatttcggaccccctgaaagagcgtctgtcactcttcgcactgcgtggggcaagccatttagggcccttttcggccccgagaaccggcaatagtgatgcgagagtgacgattcctccgcaatcgttgcggctctacattgtgcttgtacattcgtgctgaacttctacggatacaaaccatgaatgtgcaagccgtaaatctatacccactacatgagcggcaggattatcttcaaacattcaggaagctattcgcgaatctattcctaaatcgcttcctgaatgcgtgagtgcttcctgaaagagcgtctgtcactcttcgcactgcgcgagacaagccatttagagccctttttcggccggcagattgtcaagctgagtgcaacatctccctgtagacctcgttggctgtcctgtatttcaggaccttcctcggcctgtcgttgatcaggtccaccgcatgctgcacctcctcgtccgtcaccttggctgcatgccatttgctggattagccctgcagccacctgccttgttgacggctagaccctcaatcctataacgacgttctcgttcttgtccttcagggcgcacagtaggcttgcccccatagcagatggtgtcgccgatagcagcagtcagaagaagatgcggatggttgcctacgagctcattcatcgaagcggcaacgagctgctttgacagtatgccagaggacgaccggaggctcacgtcccgaacggatagccatcgatatcaacgcgagacatcatcatggaggagcctgcggaacgcgatttccaggacagcgccaccggagcggatatgaacgctctgcgtgacgccatcaacgacatcgcgccgcagaaggcgaagatcctctgacagaggaggagctgccagctgaaccagataatgcagtctgccgatggtggtactactacgaccatgtggttcaagcgctgccgaggcggctcggcaaaggagagagaccggagcacggacggtggcctgtttactagggatgtaggttggtatggaaacgaaagggccgctgagtgtgtggatgattgttgcaccgggccgtttctggtgggatggaaccgctggaaatacgcttgcttagtccgaacattcgtgtctgatgttgacggtaaaattgaactatcattgcaacgtactacaggagacaacaatggatgatctttcgattgaggttgggcctcacgtgcccaacttgcggttgcacgaatttcgaatcggaagcagcccggagagatgaagattacaccgatactggccattcacctgtgcgcactgcggaaggacctttactcgcaaggagctcatagagacgaatgccgagtctattgatactccgctcgacgacatgaaagacgaaatcgtcgacagcagcgaaagactcaagaaggctttcaaagggtggaagattaaatgagtaccgagctttcacttgttgccacatgggcgcctatcgttatctctgttgtgagccttatcctcactgctttttctccatcagaagctaccgcctcgacaaaagcgataaagagcaaaatgcggaacttcgccaaattcagaaacaactaagcgagctgccctgcaaaaagcccaggaagatggcccgcaaaaacatcctcaaaagtcgaagctgccatgtattgtcgggctcaagaagcatcacatgcgcatcgcaaacgtcggtggcacggttgtgaccgacgtgactaccacttgcgacgacggttccctattgtacatgcaggacaaggaaccattcgaacgtctggaacccggaaaaattttgatcagactgtagtctttgctgccggatcgccatcgaaattcaaaatcacgactcactggcatgacgctatggcaatgagcacagcctagacaacatcatcacgtggtagccagcaacactcaatagctaggctgttagcgaactatgacctagcgtggcttagcgtggcctaacgtcctgcgtggctttgcgcacgcgcctcctatcagtatctctctgcctgtcccgtcgaatagacgcgactccttgggcctcgttgcgatccgagggcaccagatgcaagacgagaggacggtaggccacccatgaaagacgacatcctccagatgccacgagacgcgttcccgacacccatcggaatatcggataatgatgccgaaagccgcgagaatgccggggggagatgctaaggatctgcggcctcctcgacatccgaagcaagcggcctgcccgactgcctcatggacgtgctgcaggttacgagatttcttagtctacgacgctgctaacccacccaacaagcgcgtcatagcttaccgatccatccgcaacgcctagcatagctttgaggaaaactgctgttctgcgcctgatcaatgcaagacattctgagatacgtaccgagcagggcagcgcccgttccttttcccatcgataaacggatggtcggatatgatgccgaaggcgtatcggcacgccttatcgatagcgcttgggtacaagtctgcgccatcaaaagtttggaacggttgcgccacgctgaatcgagaagtcctcgtcgcgcaggccggcaagtccgccgaccgctcgattgccgccgccgcatggatgaccaacctctttttggagaaggccataacgctcatttagcaagctcttcgaacacgtcagcgtattcatccataaagtcgacagcaacatcgtggcgctgctgctactctccgagccggctgaatcacgacccaagtcgttgttcttcaagatggtgaccgaccttccagtcctgttcacctctgccgtcacgcgtgaaaagttgttcttggcctctgcgagccccatcgtcaaagctgccatttccgacctcctaaatactatccagtatttagccagtatataaggctatttcaagtaatagtttaatggtaatctcctgtacggctatcacaatcacgatcggcggcttgtgggtggatggttctccattacgggcagcttcctaaattgcttaaagtggtcgcagggttatcggcggtggccagcagactgtacccctatgcagccatgctaatgtccgcaagaattaagcacggatacacggcagcgtcctgagctgcaacgattgcgaagaattgtcactctcgcattgctattgccggttttcagggcggcggattagcattctgagtgcacaggatggccgccgaatgcaggcgtggcacatcccggaaggctacgatgttggttgtctaggtcaacgtcggaagctggaaggaatgtgccactacagtcatcttagccctcaggagagggactgcatgccacgctgcatgcagagggaaggtccatcggctacatcgcgggagagaccgggagggacaggtcgaccatctgccgcgagctgaagaggaacgccggcacggcctatggggcatgcgccgcccagaggagggcggaggcgcgccacagagatgcaggccgaagaggaggctctccgaccctgcgctcgcgcagaaggtgcgctcgctcatcatggacacactggtccccggacagatagacggcaggctcaggctggagaacggcggaaggtgcgtcgtagccctctgacgatctaccgcgaggtccatgcaggcacgctcgacctgccgggagccggcccgaaggccaggtgcggcgccacctgcgcaggaaggggaagaggatccgcaggaagaggcccgagacgaggggcaagatcaggatctccgcacaccgtggaggagaggccggcagaggccgatgcgagggtcgcgcctcggcgactgggaggacgacacggtagtcggtccggggtccgcatgcctgctcgtgctcgccgacagggcatcgaggctcctccttgcagggagatgccggcatgacagcgccagcgtctccagggccgaggtcgcgcgcttctggaggggcgcccctcgagacggtgactccggacaggggcaaggagttcgcggggcatgcagatgtcacaaaggccctcggaggcgtgcagttctacttctgcgacccccaccatccctggcagaagccgacggtggagaacaccaacgggctcctgcgcgagttcttcccgaagggcaccgacttcggcaa

SEQ ID NO: 57 - DNA, 29987 bp, Unknown
  Metagenome-assembled genome
gatagcgcgcctcgtcccgaggccgcgtgtcgcaggacgtccggtgagcatctcacctcgcgacaatacgatcgggcgaccgcaggatgcggccccagggcgaggttacgcgcatctcagcggccttgcttgtgccatgagatcgagcgggtgcgaaagcggacgcgagggagaggacggtccgtggcgcgctcaagcccccagacgatgacggttagagggaccggattctcggaaattgcgcgcgaagctctggaaaatgctgggccattaggggtaatataattcccacccggtatggctcaatggcagagcaacagtttgtaaaagtgtgggtttgggttcgactacctctacctggctcccataaaaaaaacagcaggtcaagtatgaattcgtggcatgcttttttttagttctctgaacaacggaaggtgagagttcaagcagggtttctagtagttcctgcagcaaggattagccgaaatcgaagccggctctgcaaaaacaggcgccagcaagaaaacaggcgcctagcaccagagcgcgtgggcatactgccgattgaggaagcacagccagttgataccgacattccaagaagacggtaccgcctctgcgggccgacgtaccgcctcgtttcggcctatggggaaccgccttattcccagttacccctcctgatcctatgcccttcttggagggccatggtactggcgcattgtcgggccctgagatcgatgcaacgcgggcgctcttcacgatcctgccgagtatcgagtccgcgagatctacgaattctatcctcagtaccattggtcgggctcgagctgcgaggcgatgaggcgttctgccccttcctcgaggcgctcgaggtatctcgaacaggtcgattgcatttccttgcgttcctcgatcggctcagtgggaggaagtcgtccagtatgaggagcctgggaactgagaaggcccgtcgattcgcatcgtacagggccccttcgggacctcgcgatgtcagctccaggacatgtcgttcagtcgcacgttaggcaccgtgatgttgaggagcttcctgcaggcggcagggcccatgccatgcggccacatagctcttcccgcctccgctcccgacaggagcacgacggtctcgttcgaggcttccaggcgcatgaaggcgagcctttgcgattgcggtccctgcccgaggcgtccggtccgggcagatagggctatgttcctctatgcaggcgccgggaagcttgaagagggcgcgcaggaccgccttctggatatgcgtcccccctggccgtgcgctcggcctcgatgcagatggccgaccttctcatcgaacgagtgaggttgggtcatcccctcgtccatgcatatctcccgcaagcttctggccgaaacgccctgattgcgccatctggttgaacagcttcgaagtcctcatcgctcagcatcctgccccctctcctgtgtggctggcgccctgggcgccgcccatgcatgggccgcacggtccttatgggcgcattgcagcgctatggagcgcggcggaaggcgccccgactcatccgcacgctcgggcctgatggccgaattcgcattcctgaaccccgcgtgtagctcggcacggcgccgggcgcagtgaccatcctggcatgcctctcgaggatgtcccgcctgccgcacttcgcgagcaagcggacagtatattcggaggcatgggaatagcctgcgggctcgaccggatatgcgaatccagcacctcgagagagcgccctggcctcggggcctacctccgctgcctgcgctcgaaggaatccgcgcatgtcagagccgacgaagcctcccgggggcatcttcgggcatgtcctccggcctaggtggagtactgtccgcgccttcccgaaagccggggatgctccgccaccacctcgccgccctccagacggcaacggtggcagagccgatcctggacatcgacccgtggccggacgagccgcccatgcaccgaatagcgaattgttagtccaccgggacatggttagtctggcgattaccttgcagcgcctccattcaacatcttcgaaagcgggcttccggcaggggattgcagggcagcctctcctctccgaaagaacgcgtcgtcgcgacttcgttcccgctgcgggaaggggcgttgcatcgagctccgacgacaagccgctccacctcggcatggccctctgcgatgaatggaagaacatctccggacaggggcgcgagcacccatgtctcgcacagatcacagccttttcggcaagggccttgtcctcgggcgcacctcaagcgcgcaggcacgatgccgcagccatagtgctggccatctcgagatacaggtcgttcagccttgatgggagcgcccttcccctgtcggtctgtcgctgtcgcgcagttgtccggaaccagtagtatgtcggggaccccgcccatcgcctcgatgggcagaggaaaatgggccgagatccgaactatatgagcgcgagcgcatgtcggcgaagaagcctcgcccagatccagcccgagtacggaaggcagcgacgaagaggtaggaagcatgcactgcgtccgtgagggatacgggtccatttccgccgtgagccccgaccagtcgaacgagcagcgtgagtccggtgggatcgtgggcggatccctggcggagagctcgtgcgtgcggatgattactcgccccaccttctcgcagactggaggaggcaattagagccgcttcctccggatctaaatcgcagagtagtagcgcttccactgagacgtgcgggtcatcttggggacattcgcaagcttgctcgcagatgcgctcattagtcgggctcgagacactcttcgccgcgctttcagtccggccacggcgaaaagagggccgagggccgagaccgtcggcctacgtcatgcgcggagagctccttctgcgcctatcccggctccttcatggttcggaagcatcttgagacggtcgcccgtgctgcatccgagcgattgggcggtctcgcttccagctcgcccccttttttcgccagcagctccattcacatctttcttggtggccatgcaggcctcctctcttcggatggagacgcctccaataggcatcctccctggaggaggggcctacggccgtcagctgtaccccatagtcggatgccggtaatcgggtagatggaaacaacgtcttgcgggtactaattggaccgtactaggcagccgattgcaagttttacaaatctttgaaggaattctgcattgagagggccgttgccaggcaccgctggacggaagtggagaagcgggttgtgtggccaaatggaaatgggtgcccgtcagagagaagagatgaaaagcataggcgctatgggcgttatccagtaaaaaaaagcaggtcagatggggcgaaaagcaaacggcggtctgcttggaacccacttgctcgtaatgaattctctgccagttgtgcaagaagtggcgggagtagttacgcccgctgggtggattgatgttgacatgaaatttggggacgtcgtactatcttttccgctgaaggggagcacaggctcggcagcaaacgcttgaaaacggttatatattggggatgtggcacagcggcactgccggagacgttaaatcggcttcctctggagtgccttggttcgagtccaagcatacccactggcccgtgtagcttcagtcggtaggagcattcgttggtaaacgagagaggtaaccggttcaaaccggtcgcgggctccaggattcaggcatatggcggtgtattttgttgtagctcagctggtttagagcaccgcggctcatacctcgccgcgatgtcaccggttcgaatcaagtccaccgctacagagcttccgcggcgccttgggcgcctgctaagcaatacgagggtattatcagtaagacccgaccaacaagtggtcgatttcgaaggaggacggccaatggccaaggaaaagttcggagcgccactaagccccattgtaaacattggtacatcggccacgtgaccatggtaagggacgaacctgaccgcagcatcaaccaaggtcctttctgagaacccgggctgcacggcaaactacacggccttcgagaacatcgacaaggctcccgaggagcgtcagacgcggcattaccattaccgtcgctcacgtcgagtatgagacccgagaagcgtcatacgcacacgttgactgcccggccacgctgactacgtcaagacatgatctccggcgcagactcagatggacggccgcaatcctcgtcatcgctgcaaccgaggcccgatggctagacggcgtgagcacatcctccttgctcgtcaggtcggcgtcaagtacatcgtcgtcttcctgaacaagtgcgcgacatggttcgacgatgagagctcatatcgacctcgtcgagatggagacccgtgaccttctctccgagtacgatacccgggagacgacattccatcatccgtggctctgcactcggcgccccaacggcgatccgaagtggtcgagtacatccgcgagctcatgcgtcaccatcgattggagttacatcccgacgccgccgcgcgacaacgagaagcccgtttctcatggctatcgaggacgtcatgaccattctggcgcggtgtaccgtcgcaaccggccgtgtcgagcgtggcgagctcaagctcaacgagccggtcgagatcgtcggcatcaagccgacccagaagtcgaccgcaaccggcatcgagatgttccgtaagacatggacttctgcgaggctggcgacaacgtgggcatcctgctcccgcggcatcaagcgcgaggacatcgagcgtggccaggttatctgcaagcgggctctgttccagccgcactccaagtttctctgctgaggttcgttctgacaaggacgagggtggccgtcacacgccgttcttctccaactatcgtccgcagttctacttccgtacgaccgacatcacgggcaccatcacgctccccgagggcgtcgagatggctagtgccggtgaccacacgacgatcaacgtcgagctcatccaccacatcgcaaggaggagggcgaccgcttcgcagtccgcgagggtggccacaccgttgctgatggccgtgtcgttaagattgttgagtagatctaaccgacgaggctttctgacccggtgcccctcaggtgccgggtcttttcatgcaagcaccatcagacccagttatatgcaacattctgtgcagcggtctgagagttcctatcgctagttgacagaatcgacctagggatggtacgtagtccaccgcgtcatggtcgagggcgtctcggctatgacaagtattcaggaggatcaatgcgtactttggttacccttgcatgacactgagtgcaagcgcgtcgcaactacaccacgaagaagaacaagtcgaacaaccctgatcgacttgagatgaagaaatattgcccgtgggtgccgcaagcacacgctgcacaaggaaacccgctaaaatagggttagtcataggccagtagctccaatggtagagcggcggtctccaaaaccgtttgttgagggttcgagtcttctgcctgccagcaattacaccgacatcccttacggggtagtcggtttccatgtagtaaggttcttttgatctgagggttagcgcatggctaagaaggagcgccagaagaggtccgcacgccggcccgtgcacagaagcgtgcagagcttgaggcggcgcagccgcatccgttcgcttccgcagtcgaggcaaagaaggctgatgcttctgcagtcgcaggagacaaagccggctaaggctgcaaagaagccgggacgcgtccgttcctacttccaggctgtcaaggctgagatgcatcgtgtcgtgtggccgtcccacgaggagctcaaatactcactgtcgccgtcacggtctcctgatcgttttcggctctgcatctggctcgtcgatacgggcgtcgtcgctctgatggtcggcttcacgggcctgagggggtaaagatggcaagcactggtatgtcgtgcatacctactcgggatatgagaacggaaggtaaagaccgatctcgagcaccgtgtcgagaccttcggcatgacggacaggattacgaattccagattctgtcgaggaagtcactgaggtcaaggaggcggcaagcgcgagaccaagaatcaaggtcttcccgggctatgtccttgtccgcatggagatggacgacaatgccttgactgcctggactgtcgtcaggaacacgccgggcgtaaccggcttcgtcggtcttgatggctccaagccggcacctcttcgccgctccgagtacaacaagatcatgcgccgcacgccgaacgcaccgaccgaggtcgttccgaagcgtgtagcctcgtccttcgaggtcggccagtccgtcaaggtcatctccggtcctcttgcagacttcgatggccagatttccgagatcgatgcagacgcgagcaaggtcaaggtcatgctcacgatcttcggtcgcgaaaccccggtggagctcacgctcgaccagattgcaagcatctaaggcatcgctgcgcggctccgttcggtgaggaagcttctcggcagctgcgttgtgaaatagcacgtatccgtttctgaatcaggagactagcatggcgaagaagcaagtcacgcacttcatcaagctccagattcctgctggcaaggcaaaccctgctcctccagtaggacccgctctgggtgcagcacaggtcaacatcatgcagttctgccaggcattcaatgctgccacgcaggacaagatgggtgacatcatcccggtcgagatcacggtctacgaggatcgctccttcgacttcatctgcaagaccccgcccgcaacccagctcatcaagaaggagcttggcatcaagagcggctctggcgttcctcagcgcgacaaggtcggccagctcacgcagaagcagctcaccaagatcgccgagatcaagatgccggacctcaatgccaatgacatcgaggccgccaagaagattgttgccggcacggcacgttccatgggcgtcacggtcgcagcagagtagcttcattgctgtatctgagagcgtgtgcctcggcggtgcacgctctttgaatgaaaaggcgggaaaccgccgctatgtgggagggcatcacgcccgctgaccacaggaggtaagaaagaatgccgaagcacggaaagcagtaccgcgagaacgcggccaaggtcgagagcaagctctacacgccgaaggaagctctcgagcttctcaaggaggtctccttcgcgaagttcgatgagaccgtcgaggtctccatccgcctgggtgtcgatacccgcaaggctgaccagaacatccgtggctccatctcccttcctaacggcaccggcaagactgtccgcgtcgccgtcttcgctgagggcgagaaggcacgcgaggcagaggctgcaggcgctgacatcgtcggctccgacgacctcgtcgccgagatccagaagggcaacctcgacttcgacgctgccatcgcaaccccgaacatgatgagcaaggtcggtcgcctcggccgtatcctcggcccccgtggcctcatgccgaaccccaagctcggcaccgtcacgatggacgtcgagaagatggtcaaggagctcaaggctggccgcgtcgagtatcgtgcagaccgctatggcatctgccatgtgcccctgggcaagaagtccttcgacacgaaggctctgctcgagaactaccaggctctgatctccgagatcgtccgcgtcaagccggcaaccgcgaagggcaagtacatcaagtccgtcgcaatctccacgacgatgggccctggcatcaaggtcgatccgaccatggtgaggaacctgcttgccgagtagtgcggatactgctgaatgcagaagagggaaggggcaaaagctccttccctcttttttgtggctcagggggctctgcgctgtgtgaggaacgtggagagcatgccaagtcaagacgttgccttgacgcgaaattgcccatctgcgatacttccaagctgcaatgcatatagcacgtccgctgccagagacagccggtgccgaaaggctcaaagggttcgcccgccagcctaggtggtccaacaaagacttcctggaccctgtctggcttggccgggcagggtcttcgtttgacccgccgcgtcggtggttcgtgccaaacgaagcaacaaggaggtgtacatcatgccgaatcagaaaaatactgccatgctcgagaaggtcaaggcctctctcgatgcatccaaaggactcttcgtggttgactatcgtggcctgaccgtgaaggagacgcagcagcttcgccgcgacctgcgcgaggccggtgcagagatgaaggtctacaagaacaacatcgttcgcatcgctctcaaagacgccgagatgcctgagctcgattgccagggcacctgcgcctacatcttcttcgagaaggatcctgtcgaggctgccaaggtcgtcaagaagaccgccgagaagctcaacaagcttgagttcgtcggtggcatcgccgatggccaggcactctcccctgaggatgcaaaggcatacgccgacctgccgagccgcgaggagctcatggcccagctcgtctacgtcgttgccagcccgctgcgtggcatcgcttccgtctgcgctggccctgcacgcggtctcgtcaccgctctcgacgctatcgccgaccagaagaacgccgcataggcacgcacgtctgcactacctgctagatcagaaaacatcagaggcgctatagagagcgccccgaacaagaaggagtcataccatggctgtcaccaaggaagagatcgttgaggccctcaaggagatgcccgcactcgagctttctgagctcgttcatgagctggaggacgtcttcggcgtctccgctgctgctcccgtcgctgtcgccgctgctcctgcagcaggcgctgctgctcctgaggaggagaagacgaacttcgacgtcgtcctcgagggcttcggcgagaacaagatcgctgtcatcaaggttgtccgcaagctcaccaaccttggcctgaaggaggccaaggaggtcgtcgagtccgctccgaaggccatcctcgagggtgccaagaaggaggacgccgaggctgccaagaaggagctcgaggacgccggcgcagctgtctccctcaagtaacttctgcctcacggcataagctcaccttgtacagaagggaccggggtttacacccggtcccttctttgctattctttcttgtgttgagtcagagggtgtccatagcccctccacaattctgctcgatgtttctgcagcttaaacgatggtcgggcctaaataaacgattatgcggtataagtcaagacttcaatcttgactaaagcagtatccttctgtagattactagtttgcggcataatgccgcatacgtctgtatgaaggaggaaatgcctggtgcataccgcaaagtcttccgccgtcaaattccagaagcgcgatcgtgtcagcttcagcaagattcctgaggtaatggagctccctaacctcatctctgtacagaaggaatcgtacaaccgcttcatgacggacggcctcgctgaatcgtttgcagagttctctccgatcgaaaataatgccggcaccatggaagtcacgttcggcgatttccagttcggcgatcctgcccacacgatggccgagtgccgcgccaaggacatcacctatcaggctccgctgcttgtcgatgtgaagttcgtcaacaagctcaccggcgagatcaaggaacagctcgtcttcatgggcgacttcccgatcatgacggagaggggcaccttcatcatcaacggcaccgagcgtgtcgtcgtctcccagctcgtccgttccccgggcgtctacttctctgaggagaccgattccggcgtgctcgtgcaccatgcacagttcattccggcccgtggtgcctggctcgagttcgaggtcgacaagcgcggccagctcgtcgtatccatcgaccgcaagcgccgccagtccgcgacgctcctgctccgtgcccttggcatcgcagagtccgacgacgagatcatcaacctcctcggcgactccgagatcatccgctccacgatcgagcgcgatgtcgcaacgacgcgcgaggatgccctcatcgagatctaccgtcgccagcgtccgggcgagccgcctaccgtcgattcggcaaaggcgctcctgaatggcctctacttcaacccgcagcgctacgacctcgcacgcgtcggccgctacaaggtgaacaagaagctcggcctcgatcctgccgagaacacctccacggtcctcacgaacgaggatatcgtctgcgcactgcgctacctccttgcccttcatgcaggcgacccctcgaagaagacggacgatatcgaccacttcggcaaccgccgtatccgtacggtcggcgagcttgtgcagaaccagttccgtatcggcctctcccgcatggagcgtgtcgttcgcgagcgcatggcttcgcaggacgctgacgatatcacgccgcagtccctcatcaacattcgcccgatcgtggcggccatcaaggagttcttcggctcttcgcagctctcccagttcatggaccagaacaacccgctctctggcctcacgcacaagcgccgtctgtccgcacttggccctggcggccttgcaggccacaagtcgggctcgagccgccgtacgaacgtgccgacggccgtccgcgacgtccacaactcgcactactcccgcatgtgcccgatcgagacgcctgaaggcccgaacatcggccttatcggctcgctcgccctctatgcccatgtgaacgagtacggcttcatcgaggctccgtaccgccgcgtcgtcgatggcaaggtcaccgacgatatcgactggatgacggcagacgaagaggaagaccacaacatcgcaccggcaaacacgccgtacgaccccaagacccgccgcttcgtcgtcaccgacccgaagaccggcgagcttgtcgagcctgagcgtgtcgttgcccgtacacgcgacttcgacggctccttcggcgcacctgctgaggtcgacgtcgccgatgtcgactacatggacgtgtctccgcgccagctgctctccgtcgcagcaaacctcattccgttcctcgagcacgacgacgcaaagcgtaccctcatgggtgcaaacatgcagcgtcaggctgtgcctctgatccgtgcgcatgcaccgttcgtcggcaccggcatggagttccgtgctgccctcgactccggcgagctcatctgcgccgagcatgagggagacgtcgtcgaggtcgacgcagcccacatcgtcgtgaggaccgcaaacggcgacgagcgctacgaccttccgaagtaccagcgctccaaccagtccacgtgcatcaaccaccgtcctatcgtccatgtgggcgaccacgtgatcgagggcgagcctctcgctgatggtccttccgtcgacgagtccgagcttgcacttggcacgaacctcaccgtggcctacatgccgtgggaaggctacaactacgaggatggcatcatcgtctccgaccgtgtcgtccagcaggacctcctgacctccgtcaacatctcccgccacgagatcgatgcccgcgatacgaagctcggtcctgaggagatcacgcgcgagatcccgaacctctcggaggacatgcttgccaacctcgacgaggatggcatcatccgcatcggcgccgaggtcggcccaggcgacatcctggttggcaaggtcacgccgaagggcgagacggccctcacggccgaggagaggctccttcgtgccatcttcggtgcaaaggcccacgacgtgcgcgatacgtccctcaagatgcctcacggcgcctatggacgagtcgtcgacgtggtgcgcttcagccgtgaagcaggtgacgatctgccgcctggagtcaacgagctcgtgcgtgtcttcgtcgcgcagcgccgcaagatccagcagggcgacaagatctctggacgtcacggcaacaagggtgtcgtctgcaaggtcctgccgatcgaggacatgccgtacatggctgacggcacgcctatcgatgtcctgctcgacccgctcggcgtcccgtcccgtatgaacgtcggccagctcctcgagtgccacctcggctggggcgctgcacacggctgggatcaggagtctgctgattccgaccgctacgtgccgggcccgacctatgtcgctacgccggtcctcgatggcgcaacggacaaggaggtcgctgaggtcattcgccgcacgaacatcaacatgatgaacaaggcgaaggtcgactacggcgagcacatgatgagcgagttcgtcccgcagctcaacgagcgcggcaagacgacgctctacgacggccgcaccggcgagccgttcaagagcccgatcacggtcggcgtctcctacatcctgaagctcggccacatggtcgacgacaagatccacgcccgtgcaaccggcccgtactcgctcgtcacccagcagccgctcggcggcaaggcgcagttcggcggccagcgcttcggcgagatggaagtctgggcactgtatgcatacggtgccgcctccgtcctgcacgagatgatgacgatcaagtccgacgacacgaacggccgcgtcaaggcctacgaggccatcgtgaagggcgagaacgtcccgaacgctggcatcccggagtcgttcaaggtcctcgtcaaggaagtccgctccctggcactcaacatggagccgatctcctacaagaagcgcgacacgcaggccaaggacaaggcagccgcaaaggcagccaacccggcagatgtgtttgcgtcggcagatgcagacgagctcatcggtggcatctccggatccgccaagtccggccatgaggccctcattggcaattcgttgaacgagaaggagtaacggtggcagaattcgataccacagatttcgacgcaatcaagatctccctcgcttccgcagacaccatccgcagctggtcgcacggcgaagtcaagaagccggagaccatcaactaccgcacactgaagcctgagaaggacggcctgttctgcgagaagatcttcggtcctgtgaaggactgggagtgctcctgcggcaagtacaagggcatccgcttcaagggcatcatctgcgagcgctgcggcgtcgaggtgacgagcgccaaggtgaggcgcgagcgcatgggccacatcgagcttgccgctcctgtctcccacatctggtacttcaagagcccggctacgttcccgctgtcccgcctgctcgacatcaagagcaaggacctcgagaaggttctctacttcgcgtcctacatcatcaccgatgtggacacggaggcccgcgatgctgacgcagcagacctcaaggaagagcttgcagccgacctcgaagagctcgatgccgagcgcgacgaccagatccagcgcgtccgcgcgcaggcagccggccaggaagagggctcggagttcgacggcgtcgagccgctctccgacgacgagatccgcgccgaggttgccgatctcgaggcagagtatgccgaagagaagcagcttcgccaggaggccttcgaccagttcatgcagctcgagaagcgccagctcatcgctgacgaggcactcttctccgagatgaagcgctactactccatctacttcaagggcggcatgggcgcagaggccatccgtgagctcctgcgtggcatcgacctcgagaaggaggccgaggagctccgcgccatcgtgtcaaacgaggagtcccagaagcagaagcgcgacaaggctgtcaagcgcctcgagatcgtcgactcgttcctcaagggcggaaacgatcctgcagacatgatcctggatgtcatcccggtcatcccgcccgatcttcgtcctatggtccagctcgatggcggccgcttcgcagcatccgacctgaacgatctctatcgccgcgtcatcaaccgcaacaaccgtctcaagaggctgctctctctcgatgcccctgacatcatcgtcaacaacgagaagcgcatgctccaggaggccgtggatgccctcttcgacaacggccgtcgtggccgtcctgtcacgggcaggggaggacgtgcactcaagtccctcgcagagtccctcaagggcaagcagggccgcttccgccagaacctcctcggcaagcgtgtcgactactctggccgttccgtcatcgtcgtcgacccgcagctcaagcttcaccagtgcggccttccgaagaccatggccttggagctcttccgccccttcgtcatgcgccgtcttgtcgagctcggcaaggtcgagaacatcaagggcgcaaagcgtgccatcgaccgctcgcttccggctgtctgggacgtgctcgatgaggtcatcaaggaccgcctcgtgctcctgaaccgtgcacctacgcttcaccgcctgtccatccaggccttcgagccggtgctcgtcgagggcaaggcaatacatctgcacccgcttgtctgcgcgccgttcaacgcagacttcgacggcgaccagatgtccgtgcatgtgccgctctcgaccgaggcccagaccgaggctcgcgtcctcatgctctctgccaacaacctgcgctctcctgcatccggcaaggtcctcacggttccttcgcaggatatggtcttcggcgtctactatctgacgacggagaaggacggcgtgtccggcgagggcgcggtctacgctgacttcgacgacgccgtgaacacgatcgagaacgatgtcgacctcgacatgcaggcaaaggtcacggtccgcgtgtacccgaaggatgccaatgtcatcgaggacggcaggcgcctcttccgcgtcaagctgtcccagaaggaggtccaggacttcgacgtcaccgacggccctgtccacttcgagaccacgaccggccgcatcatcttcaaccaccagtgcctgcctgctgacgtccccttcatcaactacaagatggtgaagagcgatatcggcaagctcgtcaacgagtgctgcgaccgctacagcacggccgaggtcgagccgattctcgacgcaatcaaggcaacgggcttccactatgccacgcgcgcaggcctgaccgtctccgtctgggatgctgtcatcccgccggagaagcagtccatgctcgatgaggcgcaggccaaggtcgacgagatcaacgagaactacgaggatggcttcctcacggagcaggagcgccacgtcgaggtcgtcaatgcctggaccgagggcaccgaagccctcggctcgaagatgctttcgggcttcagcgaggacaacccgatctacatgatggctgactccggcgcccgtggttccaagacgcagcttcgccagctcgccggcatgcgtggcctcatggccgatatgtccggcgacacgatcgacctcccgatcaaatcgaacttccgtgaaggcctcgagcccctcgagtacttcatctccacgtacggcgcccgcaagggcctcgtcgacacggcatcccacacgtccgactccggctaccttacccgccgtcttgtcgacgtcgcccaggatgtcatcgtccgcgaggaggactgcggcaccgacgaggcagtgcactacaacatctacctgccgggcaccacgacgctcaacaccgacctcatcggtcgctgcacgctgcacgacgtcgtcgatcctgagaccggcgaggtcctcatggctgcaggcgactacatcgagtctgctgccgacctccagaagcttgctgaccacaagctcaagaaggtcgagctcagggcgcttctgacctgcaagtcgaagtacggcgtctgccagaagtgctacggctgggatctttcgacccgccgtccggtcaacatcggcacggctgtcggcgtcatcgctgcacagtccatcggcgagccgggcacccagctgacgatgcgtacgattcactctggcggcgttgcaggcgcagacgacatcacgcagggtctcccgaccgttgcccgcatgttcgacgttgtcggcaacatcaacgagaagatcctcggccgcgaggctgaccttgcctccgtctccggcatcctcaagatcactcctgaggggaccgagtatctcgtccagatcgtcgatccggacgacacgacccgcgtcctctccgagaagcgcatcccggcatctgtccgcttcatgcctgaggtggaggatggctgcgaggtccgcgccggcgaccagctgacccgcggcttcgtcaacttccgcaagctccgccagctcacggatatcgagtcgacgatgcacacgtttgtcaactccgtcaaggaggtctacacctcccagggcgtcgacctgaacgacaagcacatcgaggtcatcgcacgccagatgctgcgccgtgtccaggtcacgaacccgggcgactcgacctacctgctcggccagtacgtggaccgctacgtctttgctgatacggtcaggaacatcacgcttgcaggcggcacgccgcctgaggcagagccggtcatcctgggcaccctcaaggtggcaagctccatcgactcctggctctcgagcgcatccttcatccgcaccgctggcgtcctcaccgaggctgccatcaagggcgatgttgaccaccttctggacctcaagtccaacgtcattgtcggcaagaagattcctgccggcaccggcctttccgcctacagcgacgtcgagctcacctaccacggccagaagatcgatggcccgacgagcccgaccgcaaagtccctgcctgactgggcacctgaggagctcaagtccatcgaggaccagcttccgaagcagctcgactgggtcggcgacgattacggctacggcggatctgtctactcgaagaacggccgcaccctctcttccgaggatgccaagctctacctcttcgacgacctcggcgtgtcccagcgctggacgaacaagttcagcgaggagggcatcgagacggttggcgacctcatcggcaagaccgaggatgacctgctgcgcatcgacggcatcggtgccaaggccatcgaggagcttcgtgatggcctcgaggcgaggggccttctctatgtgctcgagccggatgaggacgaggcggactccgaggatctctcgcagctactcaacatggtgttctcgcctgatgccgattccgacatcatgctcggcaccgctgctccttccacgcacacctacgacgacgagctcatcggcgcgccgaccgaggcaacgaaggaagagaacgagaaagacggtgtcatcaacgaggacctcacgtccctggacgatctcttgagccaggtcgtgaacaacgaggacgacgacaagtaagtcctgaaaacaggttctgaaacagggtccggcttcgctttggcggggccggacctttgttttggagacatttccaagaaatatatgtggctgtcatggaataaggatacgcccggtggcgtggtgttttgacaactggggtggcgggtcgtaaagtatctgcttgcgcctattccggcgatgtcgtgctgcgtcgtctgtagcataagcgtacgttgtaccagtagcaaaaaggagaagagctttgcctactattaatcagctcgttcgccagggccgcgtgagcgtcaaggccaagtccaagaacgctgctctgcagcacaacccccagaagcgtggcgtctgcacgcgcgtcttcaccacgacgccgaagaagccgaactcggcactccgcaaggttgcccgtgtccgtctcgtcaacggcatcgaggtcactgcctacattccgggcgagggccacaaccttcaggagcactccatcgtcctgatccgtggcggccgtgtccgcgaccttcctggtgtccgctacaagattgtccgtggcgcctacgactgcgctgctgtccagaaccgcaagaaggctcgttcccgctacggcgcaaagcgccccaaggagtagcagccgctttcgagtttcaaccgctagcttagaggagatataacatgccgcgtcgtgcagcagcagtccgccgcgaggtccagccggatgcaaagtacaacaaccgtctggtcacccagcttatcaacaaggtccttcttgacggcaagaagtcgaccgcagagcgcatcgtctatggtgccttcgatatcgtcgcagagaagagcggcgaggatgccctgaccgtcttcaagaaggccatggacaacatccgcccgaccctcgaggtcaagccccgtcgtgtcggtggcgcaacctatcaggttcctatggaggtcaactcccgtcgtgctacgacgctggctatccgctggctcgtgaacttctcccgtgcccgcaaggagaagacgatggccgagcgccttgcctccgagattctcgatgcctccaacggcgtcggcgcatccgtgaagcgtcgcgaggacctctacaagatggcagaggccaaccgcgccttctctcactaccgctactagtcgggatctgaggagcagaatatggcaaagccaaagtatgaccttcatagcctgcgcaatatcggcatcatggcccatatcgatgcaggcaagaccacgaccacggagcgcatcctctactacaccggcaagacccacaagatcggcgaggtccacgacggcgcagcaacgatggactggatggttcaggagcaggagcgcggcgttaccattacgtccgcagctacgacgtgcttctggaaggaccatgtcatccagatcatcgacacccctggccatgtcgacttcacggctgaggtcgagcgttccctgcgcgtcctcgacggcgctgtcgctgtcttcgatgctgttgcaggcgtccagccccagtccgagacggtctggcgccaggcccacaactacaacgtcccgcgcatcgccttcatcaacaagtatgaccgtgtcggctctgacttctggcacgccatcgacacgatgaaggaccgtctgggcgccaacgctgtcgcagcccagattccgatgggcgcagaggctaacttctggggcctcattgacctcgtcaccatggaggcatgggacttcaaggaagatgccaagggcatgatctaccctgaggtcatggacgagattcctgacgagttcaaggagcaggcacaggagaagcacgatgagcttctcgagcaggccgccaacttcgacgacgacctcatggagaagattctcgaggacgagactccgacggtcgacgaggtaaaggctgccctgcgcaagggcgtcattgccaacaagatcaacctcgtcttcgtgggctctgcctacaagaacaagggcatccaggagcttcttgacgcaatctgcgactacctgccgtccccgcttgacattccgcctaccgagggcaccgatcccaacacgggcgagacgatctcccgcaaggctgacgtcaacgagccgttcgcagctctcgccttcaagatcatgaccgacccctacgtcggcaagctcacctacatccgcgtctactctggtcacgaagaggcaggctcctacgtctacaacgtgaacaaggacacgcgcgagcgcctcggccgcatcctcgagatgaatgcaaacgaccgtgtcgaccgtgaggcatgctctgcaggcgacatcgttgcatgcgtcggcctcaagaacacgacgaccggcaacaccctctgcgacgagaatcaccccatcgtgctcgagtccatcgagttcgcaaagcccgtcatcgacgtcgctgtcgagccgaagtccaaggctgagcaggagaagatgtctgtgggcctcgccaagctcgctgaggaggacccgaccttccaggtccacaccgaccacgagaccggccagaccatcatcgccggtatgggcgagctgcacctcgagatcattatcgaccgtctgcgccgtgagttccacgtcgactgcaacgtgggcaagccgcaggttgcctaccgtgagaccgctggccacgctgtgaagcatgtccagggcaagttcgtccgccagtccggtggccgtggccagtacggtgacgcaatcatcgacatggagccgaacgaggagggcaagggctacgagttcatcgacgctaccgtcggtggctccatccccaaggagtacatcccgtctgtcgacaagggcatccaggaggcgctccagtctggcgtcatcgccggctacccggtcgaggacatcaaggtcaccctcgtcgatggctcctaccacgaggtcgactcctccgaggctgcattcaagattgcaggctccatggccatcaagaaggcccttcaggagtccgatcctgttcttctcgagccgatcgagcgcgtcgacgtcgagacgcccgagcagtacatgggcgacgtcatgggcaacctctccagccgccgaggcaagatcgagggcatggaggatcgctccaacaccaaggtcatccgcgccaaggtgcccctggccgagatgttcggctatgctaccgaccttcgctcccagacgcagggccgtgcaagctacaccatgcagttcgacagctacgaggccgtcccgaagaacatcaaggacgagatcgttgccaagaacgccggaaagtctgagtaattacaagctcgagcgtcttcgctctaaatggaggtaccaccgtgtcaaaccagaagatcaggatccgcctcaagggctatgatcacgaggtagttgatcagtcctcgaagctcatcgtggacactgcacagaagacgggcgcccgtgtttccggccccatccccctgcccaccgagcgttccctctatacggtcatccgttcgccgcacaaggacaaggattcccgcgagcagttcgagatgcgcactcacaagcgcctcatcgacatcctcgaccccacgtcctcgaccgtcgactcgctcatgcgtctcgacctccccgcaggcgtcgatatcgagatcaagctctaaggtctcccgatagtgcatttaaggctcctctgcttcggcaggggagcttttcttctctcaaggagctcagacagggcatccaaatagcttgcagaacgtggccttcgtgtctagggaacgcccggcaacgtggaaaacaaagccgcaggcagatgggctgaaaaacattgagaagatattgtgaaaccagacatatgagtgtaaagtaataaagctgtctttcgggggcatctatgcgcatgcgccgattgcccagaaagacgcacatcacaggatgtggtccgctgggggagggcatacgagtgtccactgggtcccatgaccaccgaaggtaaggattgagtatggtcagcactattctcggccgcaagctggggatgacgcagatcttcgacgaggacgacaacttcgtccctgtcaccgtcatcctggcaggcccctgcaccgtctcacaggtgaagaccaaggagacggacggctacgaggccgttcagatcggctttggtgcgctcaagccgaagcacgtgaacaagcctatggctggtcactttgccaaggccggcgtcgagccgatgaagtatctgcgcgaggtccgcgtcgatgatgcttctcagtacagctgcggcgacaaggtcactgtcgaggccttcgcagacgtgaaggcagtcgacgtcaccggcacctccaagggcaagggcttccagggcacggtcaagcgctggaacttctctcgcggtcctatggctcatggttcccgcaaccagcgcgagccgggctccatcggccagtgcgcctatcctgcccgtgtccgcaagggcctccacatggcaggccacatgggcgatgagcgcgtgacggtgaagaacctcaagctcgtgcgcgtcgacgcagagcagaacctcatgctcgttaagggcgctgtccccggcggcaaggacgctatcgtatctatccgcatggcttaaggccacacagcacagctttaggctaacaaggaggacaaatgtccagcatcgatgtaaagaatatggcaggtgaaacggtctctaccgcagagctggctgatgccatctacggcatcgagcccaacatccctgtcgtgcacaaggtcgtgactgtccaggctgcaagccgtcgccagggcacccactccaccaagaaccgcgcagccgtttccggcggcggcgtcaagccgttccgccagaagggcacgggccgtgctcgccagggcaccatccgcgctcctcagatggtcggcggcggcgttgtcttcggaccgacgccccacagccatgcacgccgcgcgaacaagaaggaagtcaagctcgcaatgcgctccgtcctctccggcaagctcgctgattccgagctcgtccttctggacaacgttgcattcgagaagccttccacgaaggctgcagctgccatgatcaaggctctcggccttgacggcaagcgtgtgaccgtcgtcgtcgacgacgaggatgtcacgagctacctctcgcttcgcaacctccccaatgtcctcgtgatcggtcagtccgaggccaacacggagtacctgatcgacaatggcgcactggtcatgccggttgctgtcgcgaagtacttcgaggaggtgctcgcgtaaatgaactccaagtacaacgtgatcatccgcccggtcgtcaccgagcgttcctttgacttcatggagcagggcaagtacaccttcgaggttgctgccaaggcaccgaaggaggagattgccgacgctgtcgagaagctcttcaacgtccatgtcgtgaaggtcaacaccatgtgggtgaagccgaagacgaagcgcgtccgctatgtcgcaggcaagacccgcacgtggaagaaggccatcgtcacgctcgccgagggtgagtccatcgaggtcttcgctcagaaggcagctgccgaagagtaggtatctctgcccccgcgcaagcgggggctcagttcgggtgccgtgcatgtaggatacgcgcggtaccgtggtaatccggcgtcatcgcgtcccgaggcatgagcctcatatccctgaacacgatggccaacggacaagaagggaaagcaatggctgttaggcatctaaagcccacgagcgcaggcaggcgcttccagacggtatatgactacaaggagattaccgcctccaagcccgagaagtcgctcctcgcgccgctgccgaagaaggcaggacgcaacaactatggccgcatcaccacccgtcaccagggcggcggcaacaagcgtcgttaccgtatcatcgacttcaagcgccagaaggacaacgtcccggccaaggtcgctacgatcgagtacgatccgaaccgcacctcccgcatcgctcttctccactatgctgatggcgcaaaggcctacatcctggccccgaagggccttcaggtcggcgacgtcgtcgtctccggcgagaaggacatcgacatcaagccgggcaacgcaatgccgctgtccgagattcctgtcggtacgctgatccacgctatcgagttccagccgggcaagggtgcagcaatcgcccgttccgcaggcacctccgtccagctcatgggcaaggagggcaagtacgcaatcctgcgcatgccgtcctccgagatgcgccgcgtgctcctcacctgccgtgcaacgatcggcgaggtcggcaatgccgaacactccaacatcgtcatcggcaaggctggccgccagcgctggcgtggcgtccgtccgaccgttcgtggtacggtcatgaaccctgtcgatcacccgcatggcggcggcgagggcaagaaccacacctccggccgtccgtctgtgacgccgtggggcaagccgacgaagggctacaagacgcgtgacccgaagaaggcttcgaaccacatgatcatccgtcgtcgcaagaccaactagaccgcgaacaggagttgaaacaatgagcagaagtctcaagaagggcccgtacgtggagactcgcctcctcgagcgtgtcaccaagatgaacgagtctggcgacaaggaggtcatcaagacctggagccgttccagcaccatctatcctgagatggtcggacacacgatcgctgtccacaacggtcgtcagcacgtccccgtattcatcaccgagtccatggtcggccacaagctcggagagttctctccgacccgcaccttccgtggccacaaggaagcataaggaggtcacgactaaatgaagcgtattgaagtcgagaacggcgtctccgctactgcaaagtacgtgcgcatggctcctcgcaaggttcgtctggtcgtcgaccagattcgcaacaagtccgtgtcccaggctctggagcttctccagttcgccgaggttgcagctgcagtgcccgtcgagaaggtcctgcgctctgccgtcgcgaacgccgagaacaacaacaacctccgcgcgaacaacctctacatcgccgaggcctacgtcgatgaaggcccgacgctgaagcgcatccgtccgcgtgcaaagggctctgcgtcccgcatcaacaagcgcacgagccacatcaccattgttgtcgctcctcgaaaggaggcgtaagggatgggccagaaagtacagcctactggtttccgcctcggcatcaccgagaactggcgttcccgttggtacgctggcaaggattactccaccaagcttggcaacgacctcaagattcgcaagttcctcgagaagaagcttgagcgcgcagccctgtcccgcgtcgagattgagcgtgctggcgacaaggtcaaggtcattatctacaccgcccgtccgggcatcgtgatcggcaagaagggctctgagatcgacgccctccgcaccgagctcgagaaggtcgctggcgtctccaagggccagatctctgtcgacgtcgtcgagatcaagcgtccggagcttgacgccacgctcgttgcccagtccatcgctgagcagctcgagggccgtgtcgccttccgtcgtgccatgcgcaaggcagtccagtctgcccgcaaggccggcgcaaagggcatccgtatccagtgctctggccgtttgaacggtgcagagatgggccgccgcgagtggtaccgcgagggccgcgtgcctctgcacacgcttcgcgccaagatcgacttcggcgaggccactgcccgcacctccatgggtgcctgcggcatcaaggtatggatctacctcggcgagaagcttccgggacagcctgtgcccaacccggcactcgagggcccgtcgcgtccgcgccgccgcaataacgagaggaggggcaactaatgctggctcctaagcgtgttcttcaccgcaaggttcagcgtggctccatgaagggccaggccaagggcaacaccaagatctacaacggcgagtggggtctcgtgtccctcgagcgtcactggatcaccaaccgccagatcgaggctgcccgtgtcgccatcacgcgtcatatgaagcgtggcggccgcatctggatcaccatcttcccggacaagccgattaccaagcacccggccgaggcccgaatgggttccggcaagggcaacccggaagagtgggtcgctgtcgtcaagcctggccgcatcatgttcgagatcggcgacgtcgacgaggcaaccgccaaggaggctctgcgtcttgcgcagcacaagcttcctatcaagaccaagatcgtcaagcgcggggaggagtagaacatgaagccgagtgaagtccgcgcactttccgacgaagagctccagaagaagctcgaagacgctcgtgccgagctcttcaacctccgtttccagatggcaacgagccagctggacaacacggcacgcgtgacgaccgtcaagcgtgacattgcccgcatccttaccgagatgcgtgcacgcgagctcgcagccgcaaagactgcagccgagaactagatcgtaggagatacaaatggctgataccgaagagaggaactctcgcaaggtccgtaccggcgtcgtctgcgctatctctggcgacaagacggttgctgtcgagatgacgtacaggaagcgtcatccgaagtacggcaagatgatgaccatcaagaagaagcttcactgccacgacgagaagaacgagtgcggcctcggcgacaccgtccgcgtcatggagacccgccccctgagcaagaccaagcgctggcgtgtcgtggagatcgtggagcgcgccaagtaagttttctggtataagacatccccgtcacgtgcgctgcacgtgtggacgcacctctggcggggtctatgttcggaggaacattcatgattcagatggagaccatgctcaacgtcgccgacaactccggcgcacgtcgagtcaagtgcatcaaggtcatgggcggctccaagcgtcgttacgcaggcatcggcgacatcatcaaggccgccgtgcaggaggccacgcccggtggcaacgtgaagaagggtgacatcgtcacctgcgttgttgtccgcaccgtcaaggagacgcgtcgcaaggacggcagctacatcaaattcgatcagaacgcctgcgtcctggtccagaaggacggcacccccgtgggcacccgtatcttcgggccggttgcgcgtgagctccgcgatcgcaagtacatgaagatcgtctcgctcgcacctgagacgctgtaaggagacgattagtcatggcaaagatgaatgtgaagaagggcgatcaggtccagatcatctctggcaaggaccgcggcaagcagggcgaagtcctgcgcgcgttcccctctgaccgcaaggtcgtcgtcgagggcgtcgctctcgtcaagaaggctcagcgtcctgacgctcagggccagaacggcggcttcgtgacccgcgaggcaaagatcgacgtttccaacgtcatgcttatctgcccgtcctgcggcaagccgacccgcgttggccatgccaagaacgacgagggcaagaaggttcgcgtctgcaagaagtgcggcgcacagttctaagcctgcttccagagcacgcccaagcgctccgagccatacggttcggggcgcttttcttataggcagagggctcaggcggcgctagagtggattcatcgagagaaagggccacctatgtccgatatgcgtatcctggtcgtgctgccagtaagcgaagaggaagcacaagagctcaaagagacagcacctcaggccaccttcatgttcaaggcgctggtcaaagatcctgagcgcattgcaacgacgcctgaattcgagctcacggatgaggagattgccgctgcggacatcatcatcggcaatgtgcccgcagcgcgtcttttgggcgcagcacgtctcaagtggatccagctcggaagtgccggtgccgatgcctacgtgaagacaggcgtgctgggggaggatgtgcgcatctcgaactcggtgggctgctacggccctgcagtggccgagcactcctttgcgcttctgctctcgctcatgaagaagctctatcggtatgaggatgaccagagggcgcatgtgtggggcgaagaggggaatgtgtcgacgcttgatggtgcctctgtccttgttatgggtgcaggagatattggcgagcacttcgctcggctctgcactgccatgggggctacctgcactgcctacaggagccacgtgccaaccgagcttcggattcgtaccggcagcgtttgcccataccatagcgggcgagatgcactcatggaggcactgccttcctcccggtcgtggcatcctttctgccaagcacgcctgagacgaaaaggctcgtcgatgaggagtactggcggcactcccgaggggcgcctatctcgtgaagccggcaggggagacctcatcgactatgcagcgctcaaagaagcgcttgagatcggggcgctggcaggtgcggccatcgtgtctcggatcctgagcctctgcctgatggagtccgctctgggatgtgccgaacctcctcatcacaccgcatgtcgcaggttctggcatctgccgaagacgagaagctcgtgttcctgcgtgcgaaggagaatctggcgcactatcttgcaggggagaagcttgtgcatgaggtgaagaggtagacttctgcctccaattatggattcgctccataagctgcgattcttctggcaaacctcgtgaagaactcgtaagatatcaatttgtgtctctatgtcgggggattttgtctcggacatgagatgcagctggctcctgggtggaccaggaggcgtgaggacggaaaccccacgctcaaaaccccaagatcgaaggagtacttcatggcaacaagtatgtgccgcgcctcaaggagaagtactacctacgcagaggtgcgtgacgctctccagagcagttcaacaccccaacccgatgatgatcccgaagttcgagaagatcgtcgtcaacatgggcgtcggcgaggctgcacggacgccaaggcaatcgacggcgctgtcgctgacctccgcgccatcaccggccagcagccgatgattacgcacgcccgcagtccatcgctacgttccaccttcgccagggccaggcaatcggtgccaaggtgaccctgccggcgaccgtatgtgggagttcctcgatccctgacgcaacggcaatcccccgcatccgcgacttccgcggcatctcccgaagagcttcgacggccgtggcaacttctcatgggcgtcaccgagcagctcatcttcccggaatgaggttcgaacagatcgatacaccaccgcggatggacatcaccatcgtcacgaccgctgaaaccgacgaggagggcaaggctcttctcgaccctacacttcccgttcaaggccgagtagcattttcgttgggcactgagatgtgcccttgagttcagagacgcgccccggataagagccggggctgctcaagttaggaggatctgtgctaagacatctgatcgtcaaggcttcgcgtgagccgaagtactctacgcgcacgtcaaccgctgccagcgttgtgggctccccactccgtgtacgccaattcggtctgtgccgtgtgtgccttcgcgagctcgcaagcaagggcgaacttcctggcgtcaccaaggctagctggtgaggcgaggagaccacgacgagcgctcgggccacgggctcgggtgaaccggccttcagtttcatcacgaactaggagaaggatcaatgaagattaccgatcccatttcggacattgctgaccggtatccgcaacgccaactcggcaggcaagccgacggttacgatgccgtcgacgaggtgcttgtcgagattgcttcgctcatcgccgaagcgggctacattcgagggttaattccgttgagacaccaagcctccagaagacccagccatatacacgctgaagtacggcaacgcatgccccgcgtcatcaagggcatcaagagcgtttccaagccggcctgcgcatctactcttccgccaaggatcttccgcgtgtcctgggtcctcgcactgccgtcatctccaccccaagggcatgatgtgcgaccggatgccggagctcggcatccgcgaagtcatctgcttcgtctggtaagtccgcgacagaagaagaagggagacacaagtccgtatcggcagaagcctgtcacggttccagcaggtgtcaccggaccatcatggcaacgaagtcaaggtcaagggccccagggcgacttgaccgtacgttctccgattcgtcaccatctctcaggagggcgaggagattcacgtcgtccgcaacgacgagaccaccgagtccaatgcggcagcagggccttacccgcacgctcatccacaacatggtcgtcggc

SEQ ID NO: 58 - DNA, 22766 bp, Unknown
  Metagenome-assembled genome
gctggtcctcaactcgattgattgatataacgatccaatcagaaaagaagattataatctgtagccgggaggatagggaggggagataggaggaaggggaggggggaggaggatcgggaggaagcgggaaaagatggtaccctcgcagcgctgtgcgcgggtgtacaaccctgtcaccggtcgctgcacattgaagggccggccggtacaccccgggagattggcctcagcttagcgaaggcacgcactcaacagctcttatgcggaaaatggtcatggtttctgaagatatagggtttggtaccacccaatataggtatgccccctggagcgtgtgtctcagggcggttcagtgatcttcctgttctgtgaagagtctctgtacagtctctctatccccgtccacgatgtgcttccccgaaatcacctcacagttccggagaagataagcgcgtgttcgcaaattggccggtttgtggtggcgattgcagcgccctcctgtcacgtgtcgattggagcgcgggagccggagcctgacgcggggggaaaaaactcccagatccacaggctgtacacagccttgccgaccagggggcggggctctttggtctcacccacgatcttatagatgagtggatcttgaggcggatcgggtctttagcatcctcgcacagggtacgttggtaggctgtatccggcacgcattgaggcgttgtcacagcgtacggaaaattctacggcaggtggagctgccgtcgtcctcctgagcttgcattgcgtcgtatttggagcgggacgttacgtggccggctgctcctgcggctcacaaccagatgggaaagcctatagtagccaggccagctgtctgttcttgagcgttgcgacgtcgcatcaaagcgcttgcgcttatcctggtgacggtggccacgtttatggcacaggaccagtggcctttgcggcgctcgcaggaatccttgtctcgtttgtgcactgagtccgatccatcctgcgatatcgcgcatggggtccgtccacattgatcattctgatgtagtgttgctgatcaactcctcaggtttgatgggacgggggacctgcaattggggttcttctggcgagcgtatcggggcgtgagggcgcctgcgcggttacggatcgtttgatcgtcgcgtttgccctcgtcgtagcttcgagcacaacccctctgagggggctgtgacggggtgtagcgcggcttctacagccgctgcgaaacctcgaagttgcagttgacgatgtgagcatgacgatggcactggggcgttacggttttcgccggtcagcgcacaggagtttgcgcagatcaaagatgcgcaggaggcccgggcgcttgattcagtaaaggaaacatcgcggagcggttgggtcattggaacgcggttctggtgcctgcgaatgctggcactttcggagatcggacgaggtagcgctttccctcaatgatcgggcctacggggcacatgcgcggattcctgaggcaaagccgctcggtgtgcgtgacattgcgcttctcgtggtgagttgtggtgtggtaggatagcaggaagtgggctataacagcagcctgagatggatacaacattggtgctgaagatcggatacctggggcccaatttgcgggctttgcagcgcagccaaacacaaggacgtggcaggggaacttagccgcgccctcaagacctttctgcgaaggccggttgagctcattgtgccggtaggacggataccggcgtccacgccctggctcagtatgtgagcctgccggttaccgcacaggaagcgtgtcatcaaagccaagccgcattcagcgtgctctgaatgccctcaccccggacgatatctctatccgtggggtcttccgggcttcaaaggatttctctgcccgctttgaggcgacctcccgccactatatttaccgcatcgtagccgggcaggcgcggccggtactctcatgggactatgcctggtggtaccgtggcgcgctcgatccgcttgcaatgaaccaggccgcacaggcactggtaggggagcacgacttcgtcagcttctgcaagatggagtcggcgcagctcttgcagcaggcggggctctcgacctgtcgcaatattcaggaggtcaaggtctaccgggctcaggagaccggagagaacctgatctgtgtatcggttaagggcaacgccttcctccacaatatggtccgcatcatcgtcggcaccttagccgaagtgggacgaggtcatcgggatgtgagctgggtgcagaaagcgctggcagcccgtgaccggaaagctgccggcccgaccgcaccggcgagggggctgacctttgtggacgtcacctatcccaagggcgcactcctgccctgggactagagggctgtgctccttctttcggctcttcgacgtctctagtggatagcgcatgcaagctgactctggaccgagaagttgagtttcccagtctgaagaagatcatcgtcctgaagtatctggtgttcctgaagcccctggcggcgctcctcgctaactggacgagggagttgagcccttcgagaaacgaattggtggatcccttcttccaccagttcaagatctcctcccgctccttcctaagggtacctgccacccccccttcatcttagccaccgcagagtgcatcatccacaaacagagccggtctggggccttggctgtagattctctgtcgggacagccataggtgtcctgcatcgctttgccgtctggcaggtatgcgcctccctgagatgtgtcttcgcggggtcgagctcctctctcttcgcaagctggcactctgtgaggctctcccacctctttagccatgcgtaagttcgtctgggtaagcatccttgtgcttctttgccgaccctcacctctccgtgcacctcacagggtctgtcgcctttgtgaagagctgccaccacatggaagctgtccgcaatctgggcggcctggggcatcgctgcggtgactcccaaggagttatgtctttgccatgtcgcgcatgacctctaagcccttcgtctggtccctgtgtgttccttaagctcatctcacttgccgcccttgtcctttgccttccgtaatggcgcgggcgcactggtagtcgaggtcagccatgatggctgatacagctttggtcgcaccttttagcggtgtcacctgtacccacacgcacgactctggaatagtctgctgcatcccttgccttcgatgtcgccttcccaagcagcctctatatgcacatgggctgtctcgtgcagaggcttatggccacaacgctcatgacaaacgatcagctgggcctcaaagagcgccgtgatgcgtcttcgggcacacctttcagagcatccttgcgacatgcacgccgtccttggggcactcaacactgcgccgtgcacgatcgtctcgtactgccagatgttgagatgccacaaggtcctctcccgtctgccacaggtgctatagcgcctgtggaaggcagggctcaccactgcccggcccccgacatgcgccaccctcacagggagcacgtcctgcactcatctgcgctccttaaaccagacaccgaagagctccatttgcccctaagccctataggacctcttagagagccttgccagcatgcctgccttaagcatccatatcgcgccttaggactgaggcctttcctttccggaaatccttccatccgggcgtcccacgctcaaggggatgcaggagtgctacccaccatcagtagcgagcttcttttctaatggctgtatgggggcgtaactctgtggttctcctctgcctgaggcatagcgtcaagtgcatgtgggcatacatatacattgtttgtatcagtgaacaattttcttcgatcatgacgtggctggtcgggaccagccacaggaggtagttttggatctctttgtggacacattgctggacagcctgggcgacaccctccagctcatccccttcctcttcgtgacctactttgcgatggagtggttagagcatgcggcaggctccaaaacggaacaggcggtcagtaatgccgggaaagcaggccctctgatcggatcgcttctgggcgcgatcccccagtgcgggttttcggcgatggcggcaacgctctattccgcccgtatggttacggtaggcaccttggttgcggtgatcctctcgacgagcgatgagatgctgccgatctttgtggctgcccagcagccgcctgcgcgcctcttgtcgatcatgggcattaagattgcctgcggtattatctttggatttgcaatcgatggaatcatccgcctgatctgtcgcgggaaagagggggatggatacttccatatccatgaattgtgcgaacgtgagcactgcgagtgcgatgaggagagcggcgctcaagagggtaccgacgaccattcggcgcacaacaagtggtggcgcatcacgcgcagtgccctgatccacacggtgcggatctcgctttttgtgttggtgatcaccttcgcgttcggcctcctgatcgcggcgatcggctccgatacggtgacgagtatggctgcctatcacccggtccgtgcggtattcgcgacggcgctgatcggtctgatcccgaactgtggagcctcggttgcgatcaccgagctcttcctcgaggggctgctgcccaccggctcaatgttggccggtcttttgacggcaggcggtgtcggattgttggtactcttccgcaccaatgagcacgtgaaggagaatctcgcaatcgtcctcgccatttatctgattggtgtgcttgtgggtttggccttttccgctgcgggtattacactttgattgttattctgactctgtttcaactgcggctctaagagggtacctatgcgacgaagagcaagattcgaaagaacggacgtcccgacaccgagcccgagacgcgatgcgatcgctgtcgccgcaatcatcgttgtcgctatcgtttccatccttattttttcgtattgctatactcgcgctgagagctatgcgcacttcaacgatccggacctggaggatgcccgggacaaccaacataccccggatatcactgcgttgagcgcatccgctcgaaaggtcgacgggattgatacctacctcgtgctgacccgtagcgaagatggcagcagccttaagtgggccagcatctttgccctcaatacgaataacgggatgatgacaagggcagagctgccggtcgatctggcgatctccacgaacagcggaaccacgacgctttccgcgctcttcgcaagcaacggaggccctgactgtgtcgtaccggtgagcgatgtggcctcaatcaggttcacccacattatggttgtgaaccataacttctgggacctgttgaagacctactgcaacaccccggaggatcaggcccgcgagattgcaacctcactgcgcgcctcgatcacgaccgatctcagcaaccgcagcgccgacgatatgctctcgcagttccacacgggggatgcaggcgatgtggcaggtgtctcctacacgaccgcggagggagccagcggctccacgatcaacgcgcttgaactcaacgtagcgctgggggtcctcactgcatagacacgacggtttcaagagaagtgatggaaccgtgtccaatatttgtaggtgtcttgttagttctgtttgtaaattatgggaatgcccactcctttcaacacgtgtataaaaagctgatagagtaatgaaaatacagcgcacagtctctgtgcgcatgagccttgtaatgtagggtggaggcttcagtaagttcatgtcagtcagcgggcgaagcatacccaaggtaagtgtgatcgtgagggcgcacaatgctgccacaacactgccgcgcctgttggactgtcttgccgctcagacactcgataagctacagattatggtgatcgacgccgcatcgaccgatgcgaccttacgtgtcctgtccatggcgcaggagcgggatgtgacgctggaggccgcccacatcgaggcggccgagtacccccatgcctacaacctagggattgaacgggcccggggcacctatctcttctttatggacgggtcggctaccatggcgagagggacgctcgagcgcctctacacgctgtgcgaggaccacaacctcgatctggcgatgggatctgtgggtacctctgagcgcagcttctccggccagctgagtacgcgggtcctctacgatagcaacgatcagttccaccgggatgcctggcggttcttcgccttgggattgctcccgtatccggaaggcaaactgatgcgccgctcctgtgtcaaacaggctggctccctcttctcctgtgatggcgggatgtcgttcatggtgagctttctgaaggaagcctcaggcgtcgccttcgatccgctcgcgatctacaacgcgaataccctctgcgatccggtgggctggggcatcaccgactgcatggaggatggcagccaggatatgctcgatgagctcttcgcctcgtgggggctctcacaggatgcgcagacccagtccatgcttcagaatcgctatctggccgggttgatcgcctcgatcatccatacctgcagtcccgcctgtgagcttgatggggcgcagaagcgcgcccacattgagaaagcgattatggatgatcgcacgcagaaggtcgcccatggggaccgctcgctcaggagcctgatcgcccggatgatgctggcggccatccgccgcaaggatgtgacgatgacgatgaaggagggggagctcttctcctggctcacccgtcgctatcccaacctcaagatggatctcgtctagatttttctcccgttaccgtttgtcattcttagaagccttagaatcacgctgattcggggcgtggcgcagtgcgccgaacgtaaagcggggcccgtcggtcacgagccgataggcggtttcgctcatcatatggggcaggtagctcagatcagaaatattgggggcttcgattcccacgatcgcgcagtatctgcgcttggcccctggggcaatgattgaactattgaggacaatctcagaatccaaccttctatagcaacgctcgattgcgtcgtagagcccagggtaggtgagccctgctgcgttgactgaaagctgcgcatagttgagggcgcgtaccgcgagcgcctcctgtacttttgattcatggattttgagccgatccgccacgtcgagcatgtcttcgatgcgctccatcggcatgagcggatgcttgcgcagctgtgcctgcgcctgctgcgcgctgttctcgtggtagcggtagtaaggcttgtccacataggcgatgcgatcggtctgacagagggtctcaatcaggaaggggttgtctgaccaacctgcaccggggatggggaggaagcggatgtgtttctcctcaatccagtccctgcggtagagcgccgaccagatcgcggggtggtggagcaaaaactcctgcgcctcagtgattgcgaagggctgctgcaggggatggatccgatggtagtacgcgcaggggatccgcatcggtttgccaccgttctcaccctcaaagaggcgccagtaggctgctttgataacatcgacgggcttcgggaaggtatccgcgaaggtcagcaagtccgaaaagaagtcaggctccacactgtcatccggctctaagatcgccaggtagtcgccagtggcctgctcaaagcctaagttacaggttgcgccgtagcctgagttcggtctgtcgatcacgcggatgcgggggtcccggtcggcctgcgcctgcaggtgcgccaaggtctgatcggtggagccgtcgttgagcgctaggatctcgaggtcggagaagctctgatccttaagcgattggagcgccacatcgaccgtttgttcgacattcatgcagggaacaatgaccgataccttgtgtttcatagcaaccctcgctgtgcttgcatgttcttgtatcggtctgtatgatacgccaagccgatgccccctcgtcctgtccgggatatggagtatgcctgacattcccataaactacagtttacgggattttggtgtggcccatgtctcaatcgacgtgaatttgctggggtgttgccacaacacctctacacagttgtcagtctgctggcttttacttgtgtgcaatgtttacggcagcgttgatgtctgcactcaccaagatgctatctttgggttcgctataggccgcctcagatgtgcttgtctaagaaaaggtgtgcttacttgtcagcgggcttgtattcgatccccacccatataggatgctttggacgtgtaggtctccttttgctgtatgtatcggtatgtaagctagcgttcgagtagcctacagggaatctgtatgaacgcttgatcattctttctgccgtgattgcttcctggctgcatcccatgctggatctaacaatcagtgtgtctgtgttcttctctatgaacaggttggtgatggtgcgtggcgctttgagcatgcagtctcgcacacgctggctccctttgtcggccacctgtcagatttgcctgtgtctagtcggcttttcagatacgccaagtgtgtattgcaatagtagttagctgacttgagccatcgcctgccaactaagcgcccatggccggaggtgagccgtacggcgagattgtcagcttctatatccactcccctaacacagcactcattcaagctaaggggctgttgggctttaagcacatattggattttgaaagcagctgttggctgtttaggaaggatacccttgatacactgcccatccaaacgttcgacatggcccggataggtttgtagaagctacctgtgagcgggcagtctctacaacccgttcgtgggaagtatcagcaagaacacgctgccctttgtcctgtagtgcaagatcaacacttgagagtagctatagtcgccacttttgcatctcctcaatactgtaggggaagctttcaagctataggcgacaccctttatcgtgtgcggggccccttcggcttgcagcatcttgtaggtatcgttggttttgcacagatgatagttggtctttcagctgaaaagcccgcctgcaatgaagagatgctgccttgtttgatacaaagccttgctgtagaggttgttcgcatataggcaaagacatttcaacccgcgatagtggttggcactgagatggcagctgtagttggtttgcgctccatactgcacccttgtcttacctgcctaaatatcgatagcttgctgtatgcaatatattcactgacacctaagagcaagaagcgccaccttgaacaatcactgtgagcacaaaaacccttcgagatacctgctttgctgccacctcatcctttccaccaactagcaaaggaagacactcatcacttaggtgatgatcacaaacatcacctaactctcactaaaaaaatcgctctgaagcacaccatccaaatactccacatgcaaaccgacaaagaccatatccgctacatgatccaaacactcgtgcgtgctttgtatgcactcaccgcctttcacataagagaggcccatgcatcatacctgtgttatgtctgctggcatgaacatatgttctggtcaagtggacagctcatcgccaccacaggtgaagtcagcaccgaaaccctcaaacacttgagagctaaggcagacatgattggacggcatctcatcctgcgagctgaagtcccatgggttttcgcgccacaaatcctctataaactgatggctggtataatcgtgagaacgcagagacttactcgaagggttgaatcatggagcgattggcactggtgactgtcacgtacaaacgacaggacctgctgcgccgcttatttgattcgatcctgaagcttaagcaggccccttggcgcatcgtcgtggtcgacaacgagaacagcccaaagaccgctggcatggtctcagagttcacccagcaggtgcacgacgcctggggtgacacgccctcagaccctgatagagagggcggtgtgaagcgggttgtgtatttcccccaacgtgataactgcgggggctcaggcggcttttcacgcggtgtggggcgctcctataagttaggggcggaatggttctggctgatggacgacgatgtcacggtcctgcctggtgcggtcgatgccttcgacaggtggagtcaccagttccaagccatccagggccagcgctacgacactgacggcgggcacttctactggcaatatcggttctggactgcgctggcgatctacaatcctttctcccgggacagctggcgtgaaggagagacctacaagagctgcaatgccctgtgctttgagggcagctgtgtgagccgcaaagtggtcaagcagattggtttgcccgatgagcggttcttcgtgtatctcgatgacgcgctctatggctatttggcaagcaaagtgtgcgaggtggcgctcgttcctgactacgtgctgcgccgtgaacgcgcggtgcctgacaaggagctcggcgtgcgccaactgaactctacgagcgatatgacgcgctactatgtgacgcgcaaccgcggttatttcgcgcggtacctgatgctctatcacgactacaatccggtcggctatggctttgggacgctcctcaccttcctaaaggaattcatccgcctggtggcggtcgatcgagaacatttaaagaccggttgggcacgcctgtgggcgggctatcaggattccaagcagattctgcacgaccccacctggaagccgatgccaccgcttgaggattaatctggtcgagataccaacacggtcatttatagtttctttcacaacactgagggagcagaagagggacccatctatgaggacgggtccctcttcacaactcaagcaatgctgaagcatcgaacctatgcggtcgcaaccagcttcttggtcatatcagctgcggcagccttgcctgcgcccatagccagaatgacggtagctgcaccagtgacgatgtcgccgcctgcccagatacgaggatctgaggtttggccggtcttctcgtctgcctcgatgtagccccacttgttgatcttctcagggccaatcagcttggagatcgggttggcgttcgtgccgattgcggagatgcccagatcgcaggggagtacgtcgacggagccctcgattgggataggacgacgacggccggactcatccggctcaccgagtctcatgttctggaccttgacttgggccacggagccattctcgccggcgatgaactcgatcggggaggcaagttcgtggatttggacgccctctgcctttgcgtgctcgatctcagcacgacgggctggcatctctttctcagttctgcggtagcagagcatgacgttctcagcgccgaggcgcagtgcggtacggacggagtccattgcgacgttgccgccgccgaagaccacgacgtcctttgcgtgcttggtcggggtgtcgtacttcgggaactcgtttgccttcatcaggttgacacgggtcagatattcgttcgcgaagaagacgttcgggaggttctcgcccgggatgttgagcatcttcgggagacctgcaccggttgcgatatacatcgcgtcgtagccctcgtcgaagagctcctctgcggtggtgatacggccgacaaccgagttgtactcgaacttgacgccgagctgctcaaggccgtcgatctcacgcttgacgaccgctttcggcagacggaactcagggatgccgtaagcaaggacgccgccaccggtgaagaaggcctcaaagacggttacgtcaaagccgttgcgggcaagctcacctgcacaggtgatgccagacgggccggcgcccacgacggcgaccttcttgccgttcttcggagcaaccttcggcgcggaggcaacctcaggcatatcgcccaggaagcgctcgagctgaccgattgcgaccggctcgcccttcttgctgcggatgcacttgccctcgcactggttctcctgcgggcagacacggccgcagattgcagggagcatagactgttcgtggatgatatcgaggccacggccgaagtcctcgttgcggatagcctcgatgaacttcgggatatcgatgccgaccgggcagccgtcaatgcagaacggcttcttgcagtcgaggcagcggttagcttctttgatggccatctctttggtgtagcccttatcaacaggacggaagtcctttgcgcgctctttcggatcctcttcgttggccggagtgcgtggagatttcatatccggtacgtaacgaccatttacttgtggcatgcgcagatctcctcctcataggcgtgaagtgcctgtccctcttcggtatggtatgcagcctgacgggcacgcagatcgttccagttgactttcgtggcatcgaaatcagggccgtcgacgcatgcaaacttggtcttgccgtcgacctcaacacggcagcagccgcacatgccggtgccgtctaccatgatcggattgagcgatgcggtgatcgggcagttgtacttttcagcagtgagcgttgagaacttcatcatcggtaccgggccgacgcagaagatgtggtcgatgtcgccagccttcaatagacgctcctccggagcggtgacaacgcccttctcgccgtaggagccgtcatccgttgtgatgtggatacggtcatccggcaggatggagcggaactgatcctcgagcaggagcaggcccttcgtgcgggcacccatgatcgcatggacgtccttgccatccttgacgagtttgcgggtgatcgggaatgcgatagcgaggccaacgccgccgccgatgacaccccacttgccatcggcgaactcgctcggccggccgagcggacccgtgacatcctccagcgaatctccagcctcataggtagagagcatcttcgtagtcttgccgaccaccatgaagatgaactcgacccagccctcttcaggattccagtccgcgaacgtgaacgggacacgctcgcccgtctcgttggcgcgcaccatcaggaactgaccagcatgtgcatgctttgccatctgcggtgcctcgacgcggaacttaaacaccttctcggagaactgcgtcttttcaaggatcttgtacattgataaactcctctccaaaaacgtccataggatggttgagccccttcccgtgggcccggccatcaattcaccaacatgcccattgtagcggtcaaataagcatgtcttctgcatgatttgcagcaatcggtgccatatatgtagattgtggtaccgatattgtgtacctcatccgaggcgtgcagcttctgccgcaaagcccttcgcaacggtgcgctccacgacatctgcagcgtcctgggcctcgattgcgaacgactcgagctgggtgcccttcaagggacgcagcgtatactgggcgacgctcatgcgtccgggaggtctgcccacgccgaaccgcaggcggcagaagtcgcggctccccatcttctggatgatggagcgcaggccgttgtgtccgtcatggcctcctccgaacttgagccgtagcctcatgtctggcacatcgacatcgtcgtgcacgacgaggagctcctccggggagatcttgagctgccggacaagcttcgagatgggccctcctacctcgttcatgtaggtctggggtcgggcgagatagatatcttttcctgcaatccttacccctgccatcatcatgccggcctggctcttccagtagcgcactcctgcatgctttgccagcatatcgatcgtggcatagccagcgttgtggcgggtcttctgatatttggcgcccgggtttccgaggccgacgacgagtcgtatgtctttgggctctgccatggcaacctttccgctttgggccctgaccatcatctcaagcatatactcctggcgggagggagaggtgggattaaatggccgggtccttcccttctccagaggatgaaggcatcgaaagccgtattcgggaaggaagctctcccggccgtcctcccacgcgaagtgtccacctgaagctgcggcgccgatttcgaaatggagaaggacgatatcgaggtctgcggcagagaaagggctgtctttcgagcggatcgagacgaccggcgtcgcgtcctgcgtggtgcgaccgcaccagccgatcttaaagctctactggttggtggaggtggggggcaagaagggtggaagagacgcccgccttgaaccaggcaggagactctgttccttccgggatggatgtgacatcttcttcgctcttcgaggggtgtagatgtcctgtgtctgtaccgtgtctcagggctacgacgagcacgagacggtcttcaggctcgaccatgcgcttcttgaacgtgagcgccacccagcaagtggcaaagcccagctcttgtgccgtcagtacgatgcgcttgccgaaacatcccctgcacactgcttgagcgaaggggtgggggtgtcggcaagcagaagatagcttgagacattgtggaacttcccgtggtgggcaagaaacgagctgggggcttccggctcggtgatggcgaggctcatatgcaggctgtctgcctcattcgagtgggcaatctcctggccgaaggcagagcgctcctcttctgtgagcagggaggacgtgaagcttctgatagagtgtctggcctcttgtgcgtcatggaaatccatgagggtcctttctgtcttgtggctatctggtgtctacgcggaagtgcttttcgccgcgccgtttctcccctgtttcacgaagtgtccggaacaggggagaagggatgtcttgaggtggatgaaatgccccgggtgcgaccggtggcacgcgggcggtaggcggtgctgagacagcctcatccggctgtcttcgtaccatgctttgaaacgaaagtgtcagatagagcgtatcccatgattaagacataacatatacataaatcgtcggaaacttgatggaagcagttgcctgcaacgatgggacgacgaagggatcgggatacagaaaggggagccagatgcctttggtacgcagtcataaagcgcagggaggcagaagttcctccgaaagttcggcggcgatgcgcggcttccgcgtgcatctcgaagagtatcggccgcttgcaagctcggcagagcgcaatatcgtgaacttcctgctcgagcatccgaggggcgctgtcggcgtctcggcacatcgtctcgcagagcttacctatacctctccttcgacggttgtgcgcctctcgcgcaagctcggcttcacgggctacaaggagctccagcaggcactgctctacgagcttgccgtggcagacaagagcagaaatatcgtctccgaaggggtcatgtcaaccgattcaacccaggaaattatcgacaagatcacagcccgtaacgcctcgacgcttgcactcacacgcgacgggctcgaccctgccgcaattgaccggacggtcgaactcatccacacggcgccgcgcatcagcctctacggtatcggcgcatcgcttatggttgcccacgatctgcagctgaaactcctgcgtctcgatatcccggcagaccttatagacgatctgcactcccagctcgtctatgcaaagaatgagcgtcccggtgacctcgctatcgtcatctcctattcgggcatgacggaagacatactgaggtgcgctcgggctgccaaagcaaacggagccacgattgtttccatcacgcgcggcagcttttcgtcgccgctcgtaaagatgtccgatgtggtgcttggggtcgcagcgacagagctcgtgctcagaagcggggcgatgtcctcgaggatcgcacagctcaatgttgtggatgtgctgttcacggcctatgtgagcaggaactacgagaagagcatggagcatctctcgaagaactggatcaagaggagcgaggtgccgcaggaagaggcaagtatcgaggacggtgccgagctcggatggaaggactgagaagggcacaggaaaggagaggaacagacaatggagacaggagatgtgcccgcgatcgatctcggtaagctcgcgacggaagcgcgcaaccccaggaccatgcatctcgacgagatgagcccgcgcgagcttgtcgaggtcatgaactccgaggacacgaaggttgcgggtgccgtgcacgaggtcttggacgatgtggccgtggcggtcgaatgggcacgcgatgcccttcaggctggcggcaggatcgtctacttcggagcaggcacctcgggtaggctcggcgtgctcgatgcagtcgagtgtccgccgaccttcggtgtctcgcccgacgtcgtggtcggcctcatcgcaggcggcgagaaggcattcgtgcgtgccgtcgaaggagcggaggactcgctcacactctgcgcagaggagcttgatgcacttcatctggagccacgcgatcttgctgtcggaatcgctgcctcggggcgcacgccctacgtgatcggcggcctcaagcatgcgcatgagctcggctgccgcacggtcgcgattgcctgcaacaaggggtccgatatcggcaaggtcgcagatcttgcgatcgaaccctgctgcgggcctgaagtcctgacgggatcgacccgcctcaaggccggtactgcccagaagatggttctcaacatgatctccaccggtgctatggtcggctgcggcaaggcctatgagaacctgatggtcgatgtgcagcagtcaaacgagaagctcgaggtcagggcccagaatatcgttatggcggcgactggctgcgaaagagcggcagcagagcgtgtgctcgccgaggcaaagggctccgcgaaatgcgcgatcgtggcaatcctggcggacgtcacggcagacgaggcgaagcgtcgcctcgatgcaacgggtggcaaggtccgccaggctctcaagggaagctgataagggtactgagcggatggtgtagggggaccatctgcgaggcatagcacaacaaggaggaacaatgagcaaggatttcgaagggatagccaagagtgtccttgccgcagtaggcggcaaatccaatgtcgtgggcaacatggcatgtatgacaaggctgagggtcaaggtagtcgattcttctagggtcgatgaagcagccttgaagcaggtcgacagcgtcatgggccttgtcgctgacggcgaccgctatgagatcgtcttcgggccgggtgtggtgaacaaggttctcgagccgttcgcgaagcttaccggcatcaagccggatgatatggccgatatcgtgaacgatgctgctgcgaagaacaaggcagcgcagaaggcgaagcacgacaagccggttcagcgcttcctcaagaagatcgcgaacatcttcgtaccactgcttcctggtatcatcgccgcaggcctcatcaacggcattgccaatgtcatcaacgtctcgagcggcaacgcctttgcaggcgtctggtggtaccagtgcatccgcacgatgggctgggctctcttcctgtatcttccgctctttgtcggtatgaatgcctgtaaggagtttggcggctccggcatcctcggtgccatggcaggcgccctttccatctcgaacacggctatgccgctcctgctcaagacgtctgatggtgctgcagccgtgaatctgccgatcgcgcttccggtcccaaccttcgctaatggcgccttcacgatcaacttctcgacggtctacaacccgtctgcaggtggccttttaggtgccctcatctgtggcatcttctttgcgtggctcgagaaaaagttccataaggtcatgccgagcgcgctcgacacgttcctgaccccgctcttcacggtctgcatcggctcagtcgtcgccgtgctcgtcctgcagccggtcggtgcattcctgactcagggcatcttcttcatcctgttcttcttctacaacacgctcggcgttgtcggcgcctatctgctctctgccacattcctgccgctcgtctctgtgggcctgcaccaggcgctcacaccgatccatgcaatgctcaacgatccttctggcccgaccggcggtatcaactatctgctcccgatcctcatgatggcaggcggcggacaggtcggcgctggccttgccctctatgtgaagaccaagaacgagcgcgtcaagacgtacctgcgcgagtccatccctgtcggtattctcggtatcggtgaacctttgatgtatgccgtgacgctgccactcggtaagccattcgtgacggcctgcctgggagctggcatcggcggcgtccttgcctggctctttcatcttggtacggtctcccagggcgtctcgggcctctttggtctcctgattgtcgttccgggcacgcagggactctatgtcgtcgcgatgcttgcagcctatgcagcaggctttgccttcacgtacttcttcggcgtggatgaggatcgcatcaacgacgtcttcggcaccgaagcttaagcttcactatctccggtggttccatgtcccgccggaatgcaggggagcgggtctgcggcttggctgcaggctcgctttttaggaaaaacacaactggatgcagatgagcaggagggaccttcatggagtgcggcatatcgctctatctctcatctggggcagactttgcgtcgaaaatcgtggaaaaggcatcgcttgctggtatccactacgccttcacgtcgcttcagataccggaggagggtggcatcgacgatgcggcgggggcgaagaagctccttgcgctctgccgtgatcacaacatcaagctcatctgtgacatatcgccggcgacgctcgcaaagctcggatgccgcgactatttcgagctcaggcgcctgggtatcgagtatgtgagactcgatgacgggtttgatgccagacagacggtggagctctcgggcagcttccatgtggtcttcaatgcttcgacaattacggaggaagatatagcggcctggcggcgcgcaggagcagacttcatgcgtttcagtgcctgccacaacttctatccgaagccgctcacggggctctcgatcgactacgcggctgctgtgaacaggaggctcaaggacctcggtttcaagacgatggcattcgtgccgggagacgagacactgcgcggacctcttatgcagggccttcctacggtcgaagcacatagaggggatactggcgatgagctcgtgtgcgacatgctcgagcttggctctgttgcgacggatgtcgtactcatcggcgatcctaatgtatccgatcatgtctggcagcgcattggcgagctttcctgcggatacgtgagccttggctgcgaggtcgaagagcctttccactacattctcgaccgcgtgcagcatgacagaccggactcctcgccctggatcttgcgctcgcaggagtcgaggcgctggaaggatgtgccggaggcgcccgaggcagataggcacggtgaggtccaggtgcagccaggagacatccttatgagcacgaaggcgtatggccgctacgcaggagagctcgagattgcacgccagagctttgcgctcgatgcacgtgacaggattatcggccatatcgcagagtcagaccgtgtcttcctgccgtatctcgtgcgaggagcaggcttcaggcttcggaatgtgagaagaagtctctgacaaacatggagtaccgggaagcagctgccttccggtgctcttcttaggcaaggcctggcatcggtgtttcggaggccagacagtatcggagcatgcacaaaagctagatgcaggctcgccacgcagatgagcacatgcttgaagcgatggggcttggtgcagctctggcgtggcggtattgccggctgacctggttttcgtttggctgtgaggtccggcctgtccacaatagatcgtcggctctcctctgcagatgccccgtcctatcgaggagacagtgaccctcagttgtggatataaaaagggctcctccgcgtttttagtgggtagcacaggtcagggatgtctgagccgagaagctcagctttcccagtctgagcaagattatcgtctcgaagtagggcgtatttctgaagtcccctgctgcccgcttgatggactggacaagggagttgagaccctccaggatcgcgttggtgaagctctttgtcccaccagtttaagatcccctcgcgccctttcctgagggtccttgccatcgtcttctgacctgtgtcaatatttcggacggcagattgtcaagctgagtgtaccatctccctaaagacctcgttgactgtcctgtatttcaggaccttcctcgccctgtcgcagatcagctccaccacatgccggacctcctcgtttgtgaccttgccgaagtcgctgcccttaggggaagaactctagcaggagcccgttggtgttcttaactgtcggcttctgccatagatggtgggatggtggggtcgcagaagtagaactgcacgcctcaaagggcatctgtgagccctgtatgccctgcgaactgcttgcccctatccggaagtgagcgtctcaagacatccctgcagcagcccgacctcggccttagagacgctcccactgtcgtgctggctctttccgcggcaagcagcctcgatgccctgtcggcaagcacaagcaggcacacgggtctcgctgccacgagcgtgtcgtttccccactctccgagacgagacctctcatcggcctgcttgggcctctcatccacggtgtgtaagatctcgatcttacccctcgtctcgggcctcttactgcggattctcttccccttcctgcgcaggtggtgccgcacctggccttgcgggccggatcccggcagctcgagggcggcggctacggacctgcctgtaagaatagtcggcaggctcacgacgcacctgccgccaccctcgagcctgagatgttgtctatctgctccagggaccagtgtctgtccatgatgagtaagcgcaccttctgtgtaagcgcagggtctgaaagccgccttttcgccctgtatctcctgcggcgctcatccgccttccttttgggcagtacatgccctaaagcgtccgtggcggccattcctcttgagcttgtggcagacgctggagctatccttgccgatctctgccgcgatataggcgattggccttcccttgtgccacgcagctcggctatgcagtccctctcctgtaggcttgagatgcttgtagtagcacattccttcctgctttcgacgttgactttgacaaccaacatcgtagccttccggagtgtgccacgcttgcattcagcgggccatcctgttgcgttcagaatgctaatccgccgtccgaaatattgacacagttcatggggatagagaagaccttctgcacactcgatgtctgcctcacccttgcaaaccttgccatgtgcatcttttgccggcaggctgcacctcccggctcccagagtcgcctgatccgtcttggagccttctgccggatgcgatgcatggggcaggacagatgccaggatggcggctcctgcacgtgctggatgggcatctttccttgcctttcccgcatgccggtcgcgaaaggccacgtggctggtcctttctggtacgttatgggcattaatcatcgtttccctaggtccgccagatcccgtgcgaccatttcgctttgtcgagctcttctgttcgagcgtggctatggcagtgacttgaagtgatcagataatatctgctggtcatttaccagcctggtttcggcccgaatgatgtatgttaattgagcagcaaaatttccctggtcaattagtttgaacggaaacgtggatcatgcatgctgcctatcgttgtaatcgtttgctttgatatcactgggcgatcggctggttttcttctgagaggtactacgcgatgatgtatccattcatgacgctggatgacgacacagagattgttcactctatgcattcgggcggctgcatgaaggtatacattgagcgaccagacgggcatgatggctttccccatgtcacctgctggcttcccaatgatgtctgggaaggcgattttggattctccgaggatgacgttgcccgcttcaagggcatagtgcattcctgcgctcatctgctgctcgagtttgcggcgggcagaggatttgagaacgcctgagacttctgggtgggtactgcttttcgttaggctctccgcgaatacttcgtccctctgcctcttccgctgcgttccaccaggtttttcagctcgagcgaagcaaggagacgtcctgtcgtcgaaaggctcatgtcgcaggcgttcgcaatctgctttcgagacatgagcattcctgtgggtaatgcattcaggactgctttttcttctactgttgtggcaggatgggagccaaacgtgggaagcgtcacacggatgctcgcatcgagaacatcgaagcgaggaggcagttccccctctggataggcttcccggatgcgcggaactccggacccgaagagttcgatatagcccagtctgaacatgaccgtggcaagggtcggatttctaggtacagatagaccacctgcaaggt

SEQ ID NO: 59 - DNA, 109054 bp, Unknown
  Metagenome-assembled genome
tcggaagaagaagcgtgaatttgttgtcggagaaggacggcaatatgctcgagcgtgcagagggagttctctcatgaagcctctggcagggccggccgcgatgatgggccagggccctcatcttctgcctcgaagccctcacttcgcacagacatcgtccagagcgcttagggtagtctgcagagatagcggggacagtcgaaaagcgctggacacgcgagagaatcggttctgcggaatcttggggtcggtcgtgcagaggctgaacaccggacatgctcaggaggccttagagcgtctcagcaggcgcatgaaggctgccgcgtgagctgtggaaccgtcgatgatgtagaccttgtaggagcccatggaagcgcgaagctcacacgggtgatgatctctcgacaagggtacccgccggcggctgccgcatagagctcatagaatcacggtgtgctcccatgcgcgatgagcggcaactgagtcgcatgtgcatcgggtagcttggcctggcccctttcccacatgagtggcttggccaagatcccttgccctcgtcgttcttgcggtgcattggggccaccgcagaagagataggaatgcgagggagaccctgccttcccgagcaccaggcatgctcgcagcgtcgatacaaaacattgctagtctgtccggacgacgtactggaaggtcaggggccgagttatgttctgtagagcgattcatactggttctcctggagggagggtggggtatgtgctcaggtccagatacgcgcgcacccgtttgacagaaagccgggcagggcagagctccagataccagtaatgtacctgcactcttgcacgggcatctctgcaaagacaacgttacaattgttcttagaaacaatttgctacgtcaaaagtgtctattggcagtgctagggcactcgtgtcgctccaaaccgacggaggagtggagggcgacatatggctagccgacgaggagcttttcagtttcgcgtcgtcctgttacgcggagcactgacaataggactctgggtgggcgttgccacaccggcgaagcggaaaagagcgtcctgcatgaagcaggatagcgtcccactctccaaaacttaagcagtcaaaggaggcggccacttccgcgtgccacgggagcatgtctgcgtatccattctgccgtgccgctgccttaaccgttgcacagaaataagggctcctgaagcttctggtgggtaggcaaagacctgccaccgaccccgcaagcgggatgattccgtcggcggggaggcgctacagccggtctgcgctgtggacgacgaactcgaacatgccggcggtgagatccggcccggctcgcggggacgggactggcgaatgtgcgttggtgcggatggggggcgtttcgcaagtccctttggccttgtgcggttggacgtgaagaccgcgagcgcatgctcggccacccaacgccgcgatgaacctcaacgtcttagcgcggatgcactcgcgacagcaagaaggggaatatggggtcatcatgggcaggaatcaggccgcaggggctatctgtaggcagttagaagtaggggacatcgccagcagcaggacgaccgatgggcgggttttggaaatgtgataactcagaacaaggacgggatggggaaggccgacgctcgaccccggaggggcagatttagccttctcaggggcaagggggtcacgttcgagcggatggacggcgagagacgcatgcgctacctatcgcgggaagtcgtacatatttcagcgtagcgtacaggacgccttccaggagcgcgtcggagggggcagcacgacggcgagtacgcgaaacatcgacttatgcgaactggttagacttggagcggctcgacgagagatcagggcgggcactccttacgctcgcgccgacgcggaggcacctcgcgaaggcgcggggccgacgaggtggggaggaggcattacgaagatggccactccatcgtgcgcactacatgagggccgcttcccctcgagccgctgcccggagggtagggcgagactcgaggctccggcgcgacgagctactcgaggcgacaccagatggcactatgccggggagatgccgatatgggtgtgtgatcgagctctcctccttcggcactgtcgaggaggcgtgaagctactgcgcaaaagccgagggtcgacgcgggagatgactcgcaacgagaaactacatgctcaaaaagaggccaaggggatgtccgcgaaacgcctgttgccacactcggccgccattcatcaaaggctcggaaccaacggccaccgttgcgaggcgcgccaagcgagccccacaggaccgctctcccgagcggggtttcgaagcggtcacgcctcctcgcgcatgagaaaccagcatccaacagatagcgacgctcctgctcctccacaagcgcatggccggggggaccgagctcgccgacgagggctcggcacgtctccgtcccctggcagacgacgtgaaggccgtgctctccgtcacccgccccgacgcttccgcagaggcgtccatggaattcctcgtcgagctggttgaccgctggttctgagtgggtatagtgaatacagatcgcaaaacccgagagggttttatgtggcggggacgcgtgagcgcctccgcctaattttttggctcttcgctgtttctagtgggtagcagatgagacggcaagctgggccaagaagtccaggcggccgagccccatcgacctcccgaagagctgcgccagcatcccggtctgtgcgtctatgcacggctccgatcgtcgcatccgccagtcgacggaatcataccgcctgcggggtcggcggtcgggaggagcaacctgtgctacccaccagatgtttcagagagccatgaaaaggagggcacagcctgcgctgtgccctcctggacgattcatcagagcctctaggccttacttctgctcctgcagagccttctcggcttccttgtcctcttcggcgatggcctttgccttgatatcgacgcccgtgcagctcatggcatcggcgtagatcttctttccggtcgggtgctcttcgagccagagctccttggccttcggtgcccactccttggcatacggagcggtgcgctcgcagagctggtctgcggtctcgggggccgtgtagtcggagctgtgtgcgccggactccttgacgatctcgggcaggaggtacgggttctcgagcatcgggcagggctgaagcatgttgtcgttccagggatagtgagcacggtaggcctggaagatcggctgatgcaggcagtcgagccagctcatgtcacggatgttcacgttcgagtagtggatgaagacgcagggctccacgtcgccacgggcgttcacatggcagtaggcacggcctcctgcaatgcagccgccgacgtactcgccgtcattctggaagtccattgcgaagatgggcttgccgccggtgacgccacggatctcgcggatgcggtgcagcatgtactcgcgctgctcgaccgtcggcatgaggtcggcattggcaccgtcgccgaccggcatgtaatggaagtaccaggcgtagcggcagcccttctcgatcagaaggtcgatgaacttgtcggagctgacgcgctcgacgttggcgcgggtgtagcaggtcgaggtgccatagagcaggccatacttgtgcatgagatcgaaggcacgcatgacctcctcgaaggagccctcgccacggcggccgtcgttcacggtcggctcataggactcgagggagacggagaagacgatgttgccgagctcctgcaccttctggcagaacggctcgtcgacgagcgatgcgttcgtgaagatgttgaagagggactcgttgtgcttctcggcgatcttgaggacgtcggccttgcggacgagcggctcaccgcccgtgagcatgaagaggtgggtgccgagagcctctgcctcggtgacgagcttgtcgatctcgtcgtaggagaggttcagacgattgccgtactctgctgcccagcagccgacgcagtgcttgttgcaggcagacgtcggatcgaagaggatgatccagggtacgttgcactggtacttctctgcattctcggtcgtgttgcgaagtcctcggaatgctgcctcatagccgccattgaggatggcagtcttgagcacgttgtggtcggtctggtcgataacgtcgaacaggaacttctcccacttcgaccccggatacagggctgccttcatgccacgggtagctcccgggttcgtgtccttcaggagctttcctgccatatccacgaacttgtcgatgttcttctcgcggtcaggacctgcaacggtcttcagggcctgatcgagcgcaatgctgaacgccttgcgttctgctgcatgagccagctttgactgcatagtgcctctccttctagcgtgcaccgaaccagcgtatccgcagatagcaactatttttgacgccgattcaaattgactaggagtactttaccaccccactgccatccctcaagtcacaaatctctccttacgcatattctgaaaggaatccaaacgcaatcagcagaatgggcagggttgcctatgcatcgaacgcatggagccagcccagtccatccacatttgcacggatatgggcgcagcttgcctgccacttggccgcctcgtcctcggaaagctccggcacgaagatgtgctccacgccggcagcgccgatgacgcagggaagggatgcccagatgccagtgacgccgtagacgccctcgatgcgtgtcgataccggcgtcacgagcttcgtatcgccgaggatggcagagacaatcttcacggtgccgcgggcgatggagtactccgtgcagtgcttgcccgccatcgtgacgtagccgccgcggcgtgcctcttcctcgagcttgtcgcggtcgaacttcctgcctgtctgtgcctccacctcatctgccgtgaggcacccaagcgtcacatggctccagcaagcaaactcggagaagccatgctcgccgagcatccaggcatggatgctctgagggtcatagcctgtggcatgggagatggcatgctggaagcgggcagagtcgagcgtcgtgccggatcctatgacacgtctccagtcatagtggccgctctcctgccagatggcctctgccaccacgtcattcgggttcgagacgctcacccagatgccgtcaaatcctgcctccatgatgcggggcacaaacgtcttcacctcttcaggcgtgaccatattctcgccgtcacggtccttctgcgacgcctcgatatggcccgtggcattcacgatcacatcgcactcagccagctcctcatagcgcgtgtcgcactcatggacctttgcggcccttggatagaacgccatcgcatcttgcagatcgttcacttgggcacggcagagcttctcatccttgtccgagatgaagagctccgtcacaaggccctcttcgagcagggcattcgcgacatgcgttcccacatggctcgctccgatgatgccgacctttgcctggctcttcatgccatccttctttctcttcgatgcatcttccacatccgactctacccgttgcatagaggagctgtacaggaacccgtgccattttggcccattcggccacccagcagcagacctgcgccttcttagggctaccatcaggagcagaaacatgcaccgagagcgaggagactccatgggataccgtacctacacctgcccttctgccgcacgctgcggcggctgcgaatggctcaatgtcccctatcccatacagctgaagcgcaagcaggcggcactcgcagagaccttcaggcccttcctcgaaggtgcttctgcacccgagcttctcccaatcgtcggtatggacgagcctctgcactaccgccacaaggcagcgacgccctttgcccctgcccctcatggccgcatccgctacggcttctatgcaaagggcacgcaccgcatcatgaatgtgcccgagtgcctggcagaagacccgaggtgccgtgccatcctggcatcagttgcgaagaccgcagagcgcatgcacatctctgcctacgacgaagaccgcggacgcggcgtccttcggcatgctgtcgtgcgctgcgcctggaagaccgatgaagtgctcctgaccgtcgtcgcaaacggcgagagcctgccccacgagaaggagttcgtcgagcgcttcctcgagtacacgcccgaggtcacgacgcttgccctgaactcgaacgagcgcaggacgaatgcaatcttgggaccccatacccgcaccttgaagggcactggcgtcatgcacgacgagcttctgggctgccgctttgcgatcggccccgtctccttctaccagacaaacccggagcagaccgagaagctctatcagcttgcgatcgagcccatgctggcagatgcagaggagggctctgccctcgaggtgctcgatgcctactgcggccttggcacgatcggcatctgccttgccgccgaagcgaaggcacagggaaaggaagcccatatcctcggcgtcgagaagggcgccgaggcaatccggcttgccaagcgcaatgcacgggacaatggccttgaggatgcatgccgcttcgtctgcgacgatgccacgaactatctcgaggcgcttgctcgccagggccgccacttcgatatcgtggtcctggatcctccgcgcgcaggctcgacgcctgagttcctctcggctgtcgcaaccctggcgcccgagcgcatcgcctatatctcctgcaatcccgagacacaggtgagagatctcatggtcttggccgagcgcggctaccacgtggactccatccagggcgtcgatatgttcccgcacacgaagcatacggagaccgtcgctgtgctgacacgctaggaggcagcccatggattccaggacgaagaaggcacttgctgcaggagcgcttgccgccggtaccgcagcagccgtcgccgccctgaagaggacagatccccatcttgtgcgctgccaggacggatgggctcttgtctcgacccatcggatcgaaggcacgcccgtgcgtgtcatgcggcagggcggtgtctggcagtctgccacctatctgggagatgcgtgggctgaacccgtctttgcctactaccgagcctttgatgccatcttctcagccagccctgccttcgaagcagcatcgggccatgcaatcgcccatgccctcatgatcggcggaggcggctttgcctggccgaagcatgcgctgacagagcatgcagatctctcgctcaccgtcgtcgagcatgatccggcaacgattgcctgtgcccgcaggtggttctatctcgaccggctcgagcgcgaagcaggagagcgcctctctgtcatctgcgctgacggacgtgccttcctcgaagaggcagatgcacgcttcgatgcgattctgaacgacgccttcacaggagctctccctgtacgctcgcttgccacggtcgaggcagcacgtgccatgaaggcacatctcgtgcccggcggcctctatgcggcaaacgtcgtatctgaagatgagggagaggatgtctcgttcctgcgcgactgcgtggcaacgcttgaagaggtcttcgcgcacgtcgcagtgctccctgccgaggacgagacgtatggaggcgaggacaactacctcgtcgtggcaactgacgcagcgctcgctcttcccgatgccatccccttcgacgaggagttcctgggtgcgatacttgaagatgaaggctgagatctcggctcctcctgtgccctgaagacaggagctcccctcgcgcgcctatgtgatccatgaagaaggggccagaagccctcacccctgaagaggtcccggtgcctcaggtgcgccccggcgatcgctcatccgcatccgcgccttcggcctcaaccattcggagatcttcacgaggcagggcctctccccttctgtcaccttcccgaggatcttgggcatagactgcacgggcgagattgccgagacgaccgatccggagaggctgccacgcggccagaaggtcgtctccctcatgggcgagatgggacgtgccttcgatggcagctatgcagactatgcactcgttccgaatgggcagatctatccggctgcatccgatcttccctgggaaaagcctgtcaccatccccgagaccggatataccgcctatgggtcgatccagaacctgaaggtggaagacgcggaccatgttctggtccgcggcgccacaagctctgtcggcattgccgcggcacgcctccctgtggcagcatatcctgcgctcgaccttgcgggcacgacacggaacctcgcaaaggacgagctgctgcgtcgaggtggctgcagacgcatcatcgaggaccgggacggtgtccttcagacggacgggcacctcgacaaggtcctcaagctcatcggccctgccaccctgcacgataccttcgcccacatctcggaaggcggcatctgctgatgcaccggcgagcttggcggacagcggcatctcgatgaccatttcgatccgatcatggacctgcctgcccatggctatctcacgagcttctgctccggcaacgtggaccaggcacgcctccaggccctcttcgacgagattgcacggactcatgccgacctgggaccggcaaaggtcttccccttctccgagctcagggtagcccacacctggctcggcagcgagagatccggaggcaaggcggtcatcgtcctctgagactctcccaacatgtaccttctgttgccccgctgtgacgtttatgctccatttcctgtcttctgccggcgcctgattcatcgaagcgtatcgtagatgacgctcggccagctttcagaaagagaggatggacatggcattccgcaattcgaaggcagtgattgtcggtgtcggcaacgtcggtgcgacctgcgcctacagcttcgtgaaccagctgctctgcgaagatcttgttctcgtggacgtgaacaaggacaaggccttggcagaggcgctcgatatccagcattccgtctacttcatgaaccgcaacatgcatgtgagggcaggagattactccgagtgcaaggatgccgatgtcgtggtgatctctgcatctgcaccgatgccgaaggactcccacgaccgcctcgagatgctgaagccgtccatgggcctcatgaaggccatcgtgtcctcgatcatggaggcaggcttccatggcatcctgattgtcgtctcgaaccctgtcgatgttatgacctactacgcctggaagctctcggggctgcctgcaaaccaggtcatcggctccggcacgaacctcgatacggcacgcctctgcacggcattctcacgcatgtacgatctcgacgcccggaatgtcgaggcctatgtgatgggcgagcacggcgattccgaggtcgtcgtctgggactccgccacaatcggcggcaagaggatcgacgatgtcctgcgtgacaacgcctcccgcacgaagggcacgacgaagcaggagcttgcgcatgaggtcgtggaagccggctgggacatcttcagccgcaagggcaacacctgctacggcattgcctcttccgtgaccgctatcgcccgctcgatcttcttcgacgacaatgcgatctatccggtgagcgtccgcctcacgggacagtatgggatcgatggcgccttcctctcggtgccgacgatcctggaccacaccggtgccaaggagatcgtcgagatccgcctcgccgaggacgagctttccgctctccagaagtcggcaaagctcctcgaggagtactacgagatcgtagacagcaactaggctgtccagaacatagctatgcacgaagggagccggaccagacgatccggctcccttcttcttcgatcctgttcccgcttctagtctgcgaggtagggcacgccgtcaggacggtaggcgagcttgccctgggcaagcttctcgatcacatagggatagagcacatgctcgatctcgtggatatgcgcctcgagctcatccacatcccaggcagggtcgacctcgagggcacgctgggccaggatcgggccgcagtcatagcggctgtctgcgacgtgcaccgtgacgcctgtgaccttgacaccgtagtcgaaggcatcctggatggcgtgggcacccttgaagctcggcagaagcgccgggtggatattgagcactcgtcccgggaaggtctcgaggatcggctcatgcaccatgcgcatgtagcctgccataacgacgtagtcgacattcttctgcttgagctctgtcgcgatgaccatgtcggcctggatcgggtcggcgtagatcgtcttgtcgagcgtaagcgtctggatgcctgccttctgggcacgcttcaagccgaaggcagaaggacgcgacgacacgacaagctcgatcgaggcatcgagggtgccatcagcgatgcggtcgatcagtgcctgcaggttcgtgccggagccggagatgaggacaccgagcttgagcttctttgcctcgctcatcggtagaccaccttgcccgtgccttccgtgacctcgcccataacgaagggatggaggccttctgcctcgaggtcctcgcagacctcgtcgaggtcgtcctgcgcgcagaggatggacatgccgacacccatgttgaaggtcttgtaggcctcgtcgggggtgaggcctgccgccttcacgcagtagtcgatgacaggcgggacatcccaggcgggaccatccgcacctcctcggtcgacgaccgcgtcaagcgtcttcggaagcgcacggttcaggttctccgtgatgccgccgcctgtgatgtgtgccattgcatggatcggtgcgcccttgcgaaggacattcatgagcttgccggcatagatcgtcgtcgggcgcatgacggcgtcagccagagactcgccgccgagctcgggaagcggacgctcgagctcttccacggtcttgtcctcgattgcgaccttgcggacgagcgagtagccgttcgagtggatgccggaggaaggaaggccgatgatcgcgtcaccgagcttcaccttctcggggccgatcatcttaggacgatcgacgacgcccacgacgaagcctgcgagatcgtagtcatccggcttcatgacgccaggatgctcggccatctcgccgcccacaagggcacagccgctcatcttgcagccttcggcgatgcccttcacgatctctgcgacatgctcggcgcggagcttgccgatagcgatgtagtcgaggaagaacaggggctctgctcccagaggcacgatatcgtcgacgcacatggcaacgaggtcctggccgaccgtatcgtggcggtcgaggagctgcgcgatggcaagcttcgtgccgacgccgtccgtgccagagacgaggatcgggtcctccatatccttgcaggctgcgagcgagaagcaggagccgaagccgccgaggcctccaatcacctcaggacggttcgtctctgcaacggcggccttgatcgcatcgaccgcgcgtgcgccctcgtcgacatcgacgccggcatccgcatagctcatatgctttgtttccatggtcactgctcctcctcgtggatctcctggatcacttcttctatctgcatgcgcgcacctactggcggcttcgtgaggttgtagagacggtagcccgtaaggaagcgtccctcggagaactcttccggcacggcgaccggatactctccggtaaagcaggcgcagcaccagccgccgcgagggcagctctttatgaggccttcgaccgagaggaagtggagcgagtctgcgccgatatacttgcggacctcctcctcgctcatgcgggcagagatcagctggtcctgcgtgccggtatcgatgccgtagaagcagggccacttgacctcgggggacgtgatgcgcacgtgcacttccttggcgccggcatccttgagcatgcggacgatctgcttcgacgtcgtgccgcggacgatggagtcatcgatcatcacaaggcgcttgccggccacgttatcgcgcagggcattgagcttgagcctcacgccgagctggcggagctcctgcgtcggctggatgaacgtgcgggcgatatagcggttcttgatgaggccctcgccgtagggaaggccgagctcgtgggcatagccctccgcaggcggaagtcccgagtcgggcacgccgaagaccatgtcggcgtcgaccggtgcctcgcgggcaagctggcgtcccatctcatagcgcatggagtagatggaccgtccatcctcataggagtcaggacgggagaagtagacgttctcgaagatgcagcgcgcccggggacggggctcgacgccgcgctcggaggcgaggccgtcatccgagatgcgcacaatctctcccggctcgatgtcgcgcatatactttgcgcccacgatatcgagcgcgcaggtctcggaagccacgacatagtcgtcgtgtccaaggcgtcccaggacgagcggacggatgccattgggatcgcggaaggcatagagcgcattctcgcgcacgagcgccatcgcatagccgccgtcgatcatctccatcgtatggcggatgccctcgcgcaggttgtgcgtctgcatcgtgaagtagccgatgagcttggcggcgacttcggagtccgtgttggagcggaagaagacgccgaggtcgatgagctcgcggcgcagcgcatccgtattcacgagcgtgccgttatgggcgacagcgatgatcgtgtcatcgatcgtcgagagatggggctgtgctgcctcccagctcttggagcctgccgtgccgtagcgcacgtgtccgaccgcgaccttgcctctgagggctccgaggtcggcatccgtgaagaccgcatcgaccaagcccagatccttgcggacaagcaccgtcttgccgtcgccgacggcgatgcccgccgattcctggcccctgtgctgcagggccctgaggccgaaggctgtgagccttgccacatcgcggtcgggcgcccagatgccgaagacgccgcattcctcattgagatggcttgcacacggattctcgtccgcgcgatccctcatgtctgaaaccatgctctcccctcgccttgtgccgctaggcagcagcggcggcagcatctgccgacgcagcctcgctcttcggcacgcagatcaagaccgttcgtcctattccattgtcgtagttgcatgttacgagtgtgagcacatggctcgtctgcgcaataatcgcggaagcatcagcgcgcgaagccgtggcccttcccagaagatccgtcagatagctgtggaagtcgtctcccgtcatgaacgagagcgttcgcacattcgtgtcatcagccgtcgtcttgtagacaaggagcggctcgagctcgtagctctgattgttctcatcgacataccagaccgtcggatggctgtcgaaggtcgcctggtcagccatatcggcaaccggcttgaacatcgagccatcgagcagatggtggccatagatgatcgtctgggcatcgcgcatgcccggctccgtattctggtagtccatgaagacctggccgcccagggaatactcgcccgtcgcagtatggcggagatactcgtcgttgttggcgccctggtagaccgggtagttcacgaccgtatcggggatgtagatccagcccacgacatccgggttgatggcttcgagccccgcccagtcgatgacaggcgccccattcgcattgtcttcgggctctgtcgcgtactgcgcaagctcctcgttcacctgctcctgctgctggtactgctgctgcgcatggaaccacatgtagcccgcaatgccgataaggacgacgccggcgatgaggagaagagtcgagagcacgcgaagcaccgggtgcttctttttcttcttctcgtccaggccatagggatcgagctcgccgtaggcagaggccttgcccttgcgcttgcggtcccgtgcatctgcatgcctgtcatggccgacgatgggcgtgaacccctcctggatcgtcgtcccttcatcgcctgcgctataggcgccgccctgcgtgacagacgcctcttcatcgtccgtctcaggtgcagcaatctcttccgacggttcctcgtcttccggggaaacgtcctgtttcatatggcgtgccataggctagctcctatatcggcaagacctgcacgaggtgcagagagagggcaatatcgcagtgagcgtaacaaaaaactgcctcccgcgcacgcgggaggcagtcttgattcctaggacagcttctttcccagataggatgctgcatagggcttgtcgaagttgccgttcgtagccttcgtgagggcgcccatgaccttgcccatgtcacgcttcgtcgtggcgccgagctttgccatggtctcatcgatcagaagctcgagcttctctcctgcaacctgctcaggaagcagggagtcgaggatctttgactgctcctcgagcagcgcgatgcgctctgcgtgcgtggcctcgcctgccttgtggaggccgtcgagctcctctgccgtcaccttctggagcttcttcacggctgccgtgatgtcggcctcgctcacatctctgcgctcgtcgacctcgatctgcttcacggactggttcacgaggcgcagaatctgcgtacggttcttgtcgtgcgccttcatcgacttcttgatctcgtcgagcagttcctctttcgtcaagattccattccttcttccggaagccgggtgcttaagcctcggccatctccttcttcatctgaacgatcttctcgcgccattcaggcatcgtcgcgccgaggatctgcgtggcgtagatggcagcgttctttgcgccgccgattgcgacacaggccacgggcacgcccgaaggcatctgcaccatcgagaggagcgaatccatgccgccgaggtcggacgtcttcatcggcacaccgacgatcggaagcggcgtataggcggcaacgacaccgccgaggtgcgctgccttgccggcagcggcgatgatgaccttgaggccacggtcagcggccgtggttgcccactcctggacctttgccggattcctgtgggcggatgcaatcacgagctcatagggaacgccgagctcctcgagctccttcgtgcatgcctccatggtcggcatatcggacttcgagcccatgatgatgccgacaagcggtgtttctgccatgcaatgcctcctagacatccgggcagcgctgctgccctcttgattggtggctacttcgagctggactgggtatcgcccgtcgtggaagacgtatccgtcgacgttgtggtcgaagacgtcgagctcgagcttgtacctgagctcgtgaaggtggacgagcttgaatcggtgggctcggagctgtcgcccgcatcgcccaagcccagaatctctgtcggcgaccaggtcgtgatctcgcttctgagcttcgtctggatgtcctcatccatgccggcgatcgtgcacgtgaagttcacgcggccatttgccgaggtggacttcctccagatgaatgtcatgaacgattcgaggtcgcctgtcggcttcaggaatccgaagagcgaggagcgctcgatcgtgccgtcagatgccctatgcacctggacgtggtagatgaccgtatcgatgttggggttcaggagcgcattgaccgcgaaggccgtggcttggatctgcgagcctgcgaagcactccatcgtgtcgcgcgaggaggtatcgatgacggtgacctcgaccctgccggtatcctccgatgcctcctgaatcgtgaagtcatccgggaactgcgtgaagccattgccccactcgacgccgcccgagagggcagatgcgaccgtgcggacattggcctcgtcggagaggtttgccgtattgaggcggcgtgcaacgccgcaggagacctgcgcgagcacgagcaccgcaaggaagatcaggatgaccgtgatggcagccttcgtgatcgacttctctaccgtcgagccggacgggtcatctcccgaaagcgggtcgacatccacgccgtgtccgaacagtcgccggtgagagcgctggcgctctgccgcatccttgttgctgtggcctgtctcgtcgaccttctcgaagagctcctctgcctgctgggcatcaagggcatttctctgctttatgggcatgcgcactcccatttcctcgccgctgcgcaacgcttgcatcaggtccaacatgagccagcctcaggccggctcatccaatgctaagtatacgcaactatttcgggcacgtgtccctctcagagacggcttccctcaaactgcatgcggtagtagcgggcataggtgccacccaaggccagaagctcctcatgcgtgccccgctcggcgatctgtccctgctcgatggtcgcgatctcgtcggcgtccttgatcgtcgagagcctgtgggcgatcacgatcgtcgtgcgtccctgggcaagctcggaaagcgctgcctgcaccgccccttccgactcattgtcgagggcagacgtcgcctcatcgaagatcagaagcggcgggttcttcaggaagacgcgtgcaatcgcgatgcgctgcttctggccgccagacaggcgggcgcctctctcccctacctgggtctcgaagccgtcaggcagggtctcaatgaagtcggcaatgttggcgcggcgtgctgcctcgacaatctcttctgccgtcgcatccggctttccgtaggcgatattctctgcaatcgtcccgtcgaagagatagacatcctgctggacgagccctatctgctcatggagagacttctgcgtgaccttgcgcacatcctgtccatctatcctgatggatcccgcatccacatcgtagaagcgcgacagaagggagcagatggtcgacttgccgccgcccgaagggccgacgagcgcaagcgtctcgccgggatgcacgacaaggtcgaggccacgtatgacctcgctatccgttccggggtaggtgaagtgcacgtcctcgtagacgatctttccttctgtgatggcaagaggcttcgcatccggtgcatcctcgatatcgggctgtgtgtcgagcacttcctggaagcgggcaaagccggcaaccgctttgaggaacgtctccgtgaagttcaggatgttcgtgatcggcgtcgtgaagagcgagatatagagcgcataggtcgaaaggtcgatcgcctccatgcgtccctgggcgcagagccagccgccaccgacgatgatgcagatgttgagtattcccatcatcacggcaatgagcgactggtagatgcccatcgcatggtacatgcgcaccttcgaggcgaggtaggcatcgttcgagcggcggaacttcttcctttccaggtcctcagcagcaaagctcttgacgacacgggcaccggccaaggcatcttcgacgcgggagttcacacccgagatgcgctggcggttctcgatgaagactgcctccatgcggcggttcgcgaagaagttgaagacgacaaggaccgccaagacgaccgcgagcaccgcggtgagctctccgttgatgccagccaggatcgcgaaggagccgatgatctcgactgcgccgatgagcaggaactcagggccgtggtgcgccgtctcggagatatcgaagagatcgctcacgaggcggctcatgaggtcgcccgacttgtggcggtcgaagtaggagaagctcatccgctcataggcatcgaagaggtcctcgcgcatcttcgactccatgcgggcacccatcacgtgtccccagaagatcacgaagtagcggcaggcaaagcgcacggcatacatcgcgacgaggccaagagctattgcccagagggctgagaggatagcgtccgggccttccgtgaagagccccttcgtgaggacgcgcaggatctgagggaacgcaaggtcgatgccggcaaccaggagggcgcagatgatgtcgccgacgaagagatgcacctgcccctcgtagtaggaaaggaagctcctcatgaggttccgcttcttcggccttgctgccttagcctccacccgttccgcctttctttctgctctccttatggaaagggaatgccgaagcactccctcttctcgtctctgctactgctgctggtcttccggcacgggacccggatcgagccgtctcgataccgcatcgcagatgagggcgccgacgacggtctttgcatcctcgatgcgtccgtcgagcacagcatccaccagctcgccgacgtcgaccagatcgacgttgatgaactcgtctgcatcaggcgagctctctgccagcttgagccctgtcgccatatagatatggatgagctcgtcagcaaagccggcagaggtggcaatcgtcgtgagataggccatcttctgtgcagtgaagccagtctcctccttgagctcgcgctcggcacaggccagaggatcctctcccggcgcaagcttgccggcaggaatctcgaccgtgacgcgtcccagggccgtgcggtactggcgcacgaggcagatctgcccttcctcggtgagcgcgacgacagcgacagcgccgggatgcctcacgacatcgcgtattgccatcctcccgtccggcagcttcacctggagccggtcgacgttgaagatgcggcctgtccaggccacgtcctccgtgagcacctgctcctcgagctggcggtctctggggtcatcctcgccgaggacgaggtgccgcgcctcgggcgcgcccgaaagatggtcctggacgctcctgtcgccgtcgaaggtataggcacccgctgcatcattgagtgtcgctgctgcttcggtcctggcggcagcgaggtccttcttgtccggaagcacgtcgctcgaaagcgtcgcagcttccggcttctcgatcttcttttccatgctaagcctcgagcgcagcacggcccttgatggccttgatgccgatatcgtggcggtaggtcttgccctcgaaccagatcttgtcgcacgcctcgtaggcaaggtttcgggcatcctcgaaggtatcggcaacagccgtcacatcgaggacacggccgcctgcggtcacgaggttgccgtccgcgtcaagtgccgtgccggcatggtagaccgtgacgccgggcattgcattggcatcctcgacgccgacgatcttcttgcccttctcataggagccaggatagcctgcgctcgtgaggaccacagagacggcccagtcgtcgtcccaggagaccatgtcaggcgagagggtccctgcatcgcaggcaaggaaggcctcaacaaggtcgcccttcatgcgcggcagcacgacctgggtctcggggtcgccgaagcgggcgttgaactcgaggaccttggggccgtccttcgtgagcatgaagccgccgtagaggcagccggagtaggtgatgccttcgctcctcagctcatccacgaccttctgctcgatctcgaccatgcggtcaagctcgcccggaagaaggatgggaacaggagagtagacgcccatgccgcccgtgttgaagccacggtcgccgtcaagcgcacgcttgtggtcctggctcgtcgcaagcggcacgagggtcgtgccgtccgtgagggcaagaagcgagcactcggggcctttgagcatctcctcgacgaccacggtcttgccggcatcgccgaagtgtccgctgaagcactcatgcacgccttcgagggcctcctcggtcgtgttcgcgacgatgacgcccttgccggcagcaaggccatctgccttcacgacgcaggggccggcaagctccttcacgtaggctgcgcacgcatcctcatccgtgaagctcttccaggctgccgtcggcacgcctgccttttccatcacatgcttcgcgaactccttcgagccctccatctgggccgcctcggcattcggtccgaagaccgggatgccagctgcacgcacagcgtcgccgacgcccttgacgaggggcgcctcagggccgattacgacgaggccgactccgtgctctttcgcgaatgctgccaccgcctcaggagattcaggatcgagctctgccttctcggccagatcgtacatgccgccattgcccggcgccacatagatcttgccggcacgcggagactgggcaagcttcacgagcagcgcatgctcgcggccgcctgcgcccagcaaaagaatcgagaccttgtcttcagccatcaggggcctccttctaaagaccgaaggtgccggctcagaatgagccccggcaccttccctgcttgcttagctgatgctacttccagtagcgatcgattgtctgctcgcggtccgggcccaccgtgatgatggagacacggacgccggcaagctgctcgaggaagtcgatgtagtcctttgcctcgcgcggcagctggtagaagttgcggacaccggagatgtcgcacttccagcccggcagcgtctcgtagaccggcttcgcgtgatagaagacggactggtgctcaggcaccgtgcggtaggtcttgccgtcgcactcataggcaacgcagaccttgatctcatcgaggcagccgaggacatcgagcttcgtgattgcgaggtccgtgaggccgttgacgcgggcggcgtagttcacgacgactgcgtcataccagccgcagcggcgcttgcggccagtcgtcacgccgtactcgtggccgacctcgccgaggaggtcgccggtctcgtcgaagagctccgtcgggaacgggccagagccgacgcgcgtgagataggcctttgcgacgccgaggacacggtcgatctgggtcgggccgacgccggagccggtgacagcaccgcctgcggtgcagttcgagctcgtgacgaacgggtaggtgccgtggtcgatatcgagcatcgttgcctgggcaccctcgaagaggatattcttgccagcctcgagctgctcgttgaggaacagcgaggactcgacgatgtacgggcggatgcgctcggcgtacggcagatacgtctcgcagatctggtcgaccgtgtaggtcggcagctcatagaccttctcgaggatcgggttcgtgtaggcaagcgcgctctcgagcttctcgcggaagatgtgctcgtcgagcatgtcctggatgcgcaggcccgtgcggttcatcttgtccatatagcaggggccgacgccgcgcttcgtcgtgccgatgaggttcttgccgagcttcttctcatgggcgccgtcaagatccttgtggtagggcatgacgatatgggcgttgccggagatcttgagcgcggcgcaggagatgccctgcttctcgagggtatcgatctcgccgaggagaatctcggggtcgacgatgcagccattgccgatcaccggatagacgcccttgtacatgacgccggagggtacctggtgaagcgccagcttgtggcctcctgcaacgaccgtgtgtcctgcgttcgctccgccggcgtagcggcacaccacgtcgaagtcgccagagatgaggtcggtgaccttgcccttgccttcatcgccccactgcgtgcctacaagcactgatgctggcatgtgaatcctcctcggtccatagctgataaggccccgcgccaggcgcgggaccccctcagtatacggcacgccaacagctgccgaaggccatatcttgcatgagaagagagtctccagagtggggctctgagctactcctcgtggtgcgtatcgacctcgacgaacttcgtcgagcccggcaggaacgtgagcggcacgacgcccagagggccggaacggttcttcgcgatgatgaagttcgtgacatccttgtccggacggtcgtcgcgcgccgcctcctcgtcggtcatcgagcggtcgaggaggatgacgatatcggcgtcctgctcgatagcgccggattcgcggaggtcggagagctgaggggtctttcccgtacgcgattcgacctgacgggaaagctgcgagagggcaacgacaggcacgcctaggtcctttgccatgatcttgatgccacggctcatctcggagacctcggtcgcacgggagtcggaccttctgcctcctgaaggcggagacacgagctgaaggtagtcgaggatgacaagagcattcttctccttgccgtggagcatgcgccgtgccttggctcgtacctcggtcacggtcgtgcccggcgtatcgtcgatcattatgtcgagatgcgagaggtcgaccgtggcctggaggagctgctgccactggttgtcgcggatgttcgcagcacggatgtcctggaggctcaccctggcctgggctgcaaggagcctctgcgcaatctcgaccttggacatctcgagcgagaagaaggcgaccgtcgtgccgtttgccgcagcattcacggcgaggttcagtgcgaaggaggtcttgccgacaccaggacgggcgccgacgacgatcatctggcctgcacgcaggcccagaagctgcttgtcgatgccggggaagcccgtctggacgcccaggaacttctcgtcctgtgccgccatctcgccgagctcgttgtagaggtcctccatgacagtctcgagcgtcgaatagttgctcttgatgtcggagtccgtcgcattgaggatgagcttctctgcctgatcgacgacttccttcgtatcctcgggagcatcgtaggcaagggctgtgaccttcgtcgaggcctggatgatcttcctgagcgtcgagtcgcggcgcaggatctctgcgtggtggcgccagctcgccagggcaaaggagttgcccgagagctcgagcagataggtgcttccgccgaccttcgcaagctcgccttccgacttcaggtagtcggcaagagagatcgggtcgaccggctggctcctgtcgaagaggtcgcgcatcgcaaggaagatcgtgcggttcgacggcacatagaagtcgtccggcgagagctcgacaagcgcatcctggagcacatcaggcgagagcagcatggcggagaggaccgatgcctcggctgccgtatcctgcggcatgacgggctcggccggaagcgaaggcgcctcgtcctcgcggcggtatccggcattgtcggccatttgctcctccttccctgacccggctgcagtgcaggcctttcccggagctttcctttgccttgcaggcgtctgacacagagcttgcagaggatggtgaaagcctcatgccctgcaacctgtggctttgctggttttcaacgttttcaacaatttgtcgaagacgtcttcatgaggttttctacaaacagaacacgcgtgccttcgtgcaggtcagggccgcattctgaagaattcctctcatgccccataggcatctacgtgcagattcttgcatttccgcaggtagattgcgtgtttttgaggcgtctagcaaaaagcgccctcccccggggctgaagtcctgggaagggcgcagtgttcgaggtgcttgccagacctgccaagagacacgtctggcagaacttcctgttgaaatcccttgtctataagggatgggcaggtgaagatatcacctactcagcaggggtctcggctgcttcctcggcaggagcctcctcgccctcggcctcttcggcctccggctcgggctccggctcctcgacatcgccgacgagaacggtgatctcggcgttgatgtcacggtagaagttgatcgtcacggtgtggcggccaacggtcttgatggcagcagcgtgctcgatgcgcttgcggtcgacctcgacgccgagctgggccttgagggcgtcagcgatcatggtcgtcgtgacggagccgaagagctggccgtcgtcgccgatcttggcatcgaccttgatggacttgccatcgatctgagccttgagctcctgcgccttcgcgatgcgctctgcttcgcgcttctcgatgttgcggcggcgctgctcgagctgcttgatattgccaggggtagccggctgggcgatcttgttggggaacaggtagttctccgcgaagccctgagcgacgtcgacgatgtcgccctcgccgcccttgcccctgagctcacccataaggatgactttcattgggacactccttcggttggttgccttgcggcaactcctactttgtttcagaagcccggtactggtagctccgcagacccttccgctcgatattgcggaaatccgcgaggccgtcgaccaggcccactacgctcattgccatgaattctgtctcgagccacacgcacaggatgctggcaagcacctgtccgaagcgtccgatctcctgggtcgccagaaaccacacagcgaccgcgatgccctggatcgcgcatgcgacacgaagagcctgaaggaggttcttcgcccagaacacgacctctgccggcacgggcatgccttcgcggtccatgaccgtcaaggcaaacgtcgcgacaagtgccacgagcgcccagatcggaagatcgaaatcgcggagcttcacggcgcactctgctgcgtcaggacctgaatgcacgaacatcgcgcacccgagtcccgcgctcgcacaccacgcagccgccattgcggcataggcaagcggccagtactgccgaagaagcgcgatcgcgccctcaagggcgctctgcacctccgagcttccggccatctccccatactctgcagcagctgccgtgagcatggcatcgatgctcgcgccgagcgtcgtccccgcagcataggagaggacggcatccgtcgcgatgagagcagcggcaagtccgagcacggcgcacagaagcgtgctggcacggagcttcctctttgccaccagaagccccagaatgaagcccgagatggcaggcagtacaggctccatcagagaggaggcctgtatcaccgctcccacagccacagccggaacgacggcagcagcaagagccagaaggctctcccttgcgccgcgccctttcgtggcaaggcaggtgccatacgccgtggcaaagccagaaagcagcggaatgaacccggagacgacagctcctgcgacacaccagatgagtccggacacgagattgtccggcccctccgtgcgtgcctcgaaggctcctctcggagcgagctctgctcccgactcagctggcacgtggtgccagccagcggaagcgttcctgtccttctcttcgctcactgcctgccggctctgctcgagacgggatatggctagtcgcggttgcggccacggccgccgcggctggagaccacggaaaccgtgtacggcagaagggccatctcgcgagcgcgcttgatagcgactgcgaggtcacgctgatgctgcgtgcatgcgccagtcacacgacgcggcttgatcttgccgcggtccgtcgtgtacttgcggaggagctggacatccttgtaatcgatgtagtccacgtcctccttgcagaactggcaatacttgcgacgcggctgacgctgaaaatcctgagccatgtctaatttgcctttcttttcaggcagccggagccgcctgagttcttcttgttcctgctagaagggaatgtcctcgtcgtagacatccgccgaaggcggcgtctgctgagtcggacgctgagaggtctgtccgtaagctgccggagcagagaagctcggagcctgctgcgcacgcggcgcctggctctgggagctgccctggccctggcgggacgacatgaattccagatcgtccacaatgacctcgagcttgctcctgcgctgcccatcgcgttcccatgagctgtagcgaagcttgccttccagagcaacctttgtgcccttcgtgaggaagcgtgcaagggcatcggcacgggtgccgaacatcacgcagtccacgaagttggggacatcctcccattcgccggatgcattgcggcggcgatcgttcacggccacgccgaaggtcagcacggtagtgccgcctgccgtagcacggatctctccgtcacgcgtcagattgcccgaaataacgaccctgttgatgctcacgctgctcacaacctctcatctgcgggctttgtgcccgcgcttccatagctagtccttgtccggacgggccacgatcatgtggcgcttcactgcgtcgttgatgcgaaggacgcggtcaagctcggcaatgtcggctgcattggcatggaagttgatgagggtgtagtcaccctcggtgagtccgtcgatctcataggcgagcttgcgcttgctccaatcgtcgacgctgtcgacctggccaccgttctcggtgattgcgacgtcaatgcgcttcatgacaccagcgcggacctcttcgttagaagcaggatcgacaaaaaacagcagttcataggccttcatgtggtcacctcctctgggctagtggctcagggtcgtgaaggtcgcgccccgagcaggaaaggttcggtctagaaccataccacagggtaggccctcttcccctgaactccataactttccttcgccatgtgcagctcatgtgcactgtagcagacccgtctgacagctttggcagcccctgctgccatcttatgtgcagctttcttgcaagagaaaggcggaaggctcagggccctccgccttcttgaagcgcatctctcttctgcctcagcgctcgtctggatcttcatcctccgggcggcgcatgatgagcgttgccggctcatctgcaggagcagagctctcgccgatggcaggaaggcctcctgccaggcccttcctctcgggctcttctgcagccttatccggctcttctgcaggcgcaggagccgcttcaggcgtgcccttgtcctcaggcgcaggcgtcgcctggggctctgcggcagcctgggccggctctcccggcgtctcggcgtccttcttcgcagagtcaggcagcgggtccttcgagcttccccaatgggggacatcgaactgctggaaccagaggccaagcgcattgacggctacagtctggagcgctgtggcgaagacagctgccagatagagcacaagcaccatccagggcgcgaagcgggcaaggaagtgggccgccagaaccgcgatggcggcagcggagcctgagtaggcaaagagaccgcccagctcggccagagacggcacgacgatgatgagggcgcagagaatgcagaagccctcgatcaggaggcttcccaggaagagcacgagggcgatctcggcaatgcttccgaagtcgcgcttcagcatgtcccagatgcggtcaagctgatatcccgcacgtgcatgctggtagattgtcgcgcggatggcggcgacccaggcaatcgtgctccagaggatggcgacgaagttccagaggagcgcagccaggccatctgccgagggacgcaccgctgccaggaggatgaagtagacagcggcgtagccgagcatcgccaggaatgcccgccagccgctcttgatgcaggcaccgaccttcacgccggactgcttcggataggtctcctttccccaagcggaaagccgtgcccactctgcctggtagccccagacgccgagggggccggcaatcggcacgagcttggcaagcggcagcacgagcagcggcttgtaccatcccttgtcatgcgtgagcatccgccaggagcggcccatgtattcctttgtctcagcgctttctgccatgcgcagacctccaacatagtgcagcatgctcatgcatgcgtctgacagccatctgacacgtctgctatataccctactcgcccggatgcggcacctcggcgcaatgccccatgagcatcaaggattcctgaaaaggccgatagatatgaaaagagccctgaagcatcagggctcggactcttctggcggagagggtgagatttgaactcacgtacccgcgaacgggtaaacggttttcgagaccgccgcattcggccgctctgccacctctccaattatgaaagaacgtggcgcccgaaggcgccacggaagcttgctggcggagagtctgggatttgaacccaggatacgctttaggcgtatacacgatttccaatcgtgctccttcggccactcggacaactctcctcaaaaccgcgaaggaaattgtacaatactgtccctgcgttgggaagaggattttttcgttttcttctgaggtccggtttccaggcctcgtccacgcctgccaaagccccgcctgagcggaaaggatgtccgtgttcgacctgctgtttactggatctgcgcaggcacaggccgtgccgatgcctgcctggctcgatcttgccgctgtcgtcgtcggctcgctcacgggctgcatcgtcgccgaagagcgcaagctcgatcttgtaggatttgtgggactctcgatcctctgcggcctcggaggcgggcttctgcgcgatatggccatgcagcagggcggcgtctacctgatcgattccccctatgccatccctggctcggtcgcgattgcgctcatctcgttcgcgttcccctcgcccttcttcggcaatccttccgcactcgaatggttcgatatcctctcggtctcgctcttcgctgtctcaggtaccgacaaggcactcctgcatggcctttctgtctgggcctgcgtccttatgggcacgctcacggccgtgggcggcggcatgctgcgcgatgtgttcctcggagatatcccgcgcatattcaggaaatcgaacctctatgccctctgcgctgtcgcaggctctcttgcctacttcgtcttcggcacgataggtctcagcaaggtcatctgcgccctcatctgcattgcagtcacggtcgggctcaggcgtgcctcgcttcgctatcacatcatgtcccctgccgatgtggacctcacgcccaaggtcgaggcaggcgtgaagcgggcagagcgaaaggtccgggatgcacgccagaagcgcagagagcgctagcaagctccgaaacagacctcagatagcacagggcccgcctccgaggagacgggccctgttcattgcttccagagcgtctttgcctacttgttcacgaggccatggcggacacgccacttgcggcgctcgatctcggagaggatgcgcttgcgcatgcggatgtgcttcggcgtgatctcgacgagctcgtcgtccatgatgtactggagggcctcctcaagcgtgaacgtgcgcggcggcgtcagctggacggcgatgtctgccgtcgaggaacgctggttgccgaggttcttcgtacgggcaacattcacgaccatgtcgcctggcttcgagcgctcgccgacaatcatgccctcatagcactccgtgcccggctcgatgaagagcgtgccgcggtcctggagcgtgccgagtgcgtaggcaacagccttctccgtcgacatcgagatcatggcgccattgctcctgccgccgatctcgccggcataggggccatactcgaggaacgtgtggtagaagatgccctcgccgtgggtgacgttcaggatgcggttcttgagtcccatgatgccgcgggtcggaatcgagaactcgagatggcaggagaggtcggtctgctccatgctcgtcatgtttccgccgttgttgccaaatacctcgatgaccttgccggagtactcgcccgggcactcgacgacggcctgctcgatcggctccaagcggttgccgttctcatccttcttgaagaggaccttcgggcgtcctacctggaactcgaagccctcgcggcgcatctcctccatgaggacggaaagatgcaggatgccgcggccagcaacctcgacgccggtcttgtcgggcagctcctcgatgcgcatcgtgacgttgttctcgcgctcctgcatgaggcgctccttgagctggcggccgcccacgatgtcgccgtcacgtccgacgagaggagaggtcgaaggctcgaagatgatggagagggtcggcggatcgatctcgatcggctcgagctcgaccgggttctccggatcggtgtagacatcgccgatatcggtggagtcgacaccgacgaccgcgccgatatcgcctgcgacgacctcgtcgcactccttgcggccgaggtagtcgaacgtgaagagctgcttcacctgtgccatggcacgggagccgtcgttcttcacgacgaggatgcggtcgttctggtggatcgtgccggaatagacacggccgacgccgatgcggccgacgtagtcggagtggtcgatcgtgacgacctgcatggcaagcgggccatccggatccacatcgggggcaggcatggcatcgatgatcatgtcgagcatcgggtacatgtccatgttgccgtcatctgggtcgagacgggcaaatccgttcacggcggaagcgtagatcacgtgctccatcgtgaactcgagctgctcgtccgtggcgccgaggtccatcatgagatcaagggagtcgttcatggcctgctggggatctgcgccctcgcggtcgatcttgttgatgacgagcatgatctggagcttcgcgtcgatggcatggcgaaggacgaagcgggtctggggcatggggccctcagcggcatcgacgagcaggagcgctccgtctgccatcttgaggacgcgctcgacctcgccgccgaagtcggcgtggcccggggtgtcgatgacattgatcttgacgcccttgtattcgatcgagatgttcttggacaggatcgtgatgccgcgctcgcgctcctggtcattggagtcgaggatgcggtcctggacctgctggttcgcgcggaaggcgtcggtggccttcaggagcttgtcgacgagggtcgtcttgccgtggtcgacatgcgcgatgattgcgatgtttctgatctgcttctgcagcattgattgcctctctaatctcagggacaaaagacgcgcacccggcttcatttcagccactgcgcgcggttttcaggccattcagaggatttacgcttgcaaatatagttgatgaagatgtgacgatgtggcgaagagccaggctccacgtaaattctgctgcctagatgagcggctcgagctctcctgcaggcgcaggatcggtccaggcaaacttctcatgctcccctcgccccttgaagagcgagtaggcagaataggcctcgtagccctcttcgccgaactcgaggagcacggcatcctcgtaggcgccatcctcgtcctcgatggccccctcgtagacgatcgcatagcgcaccggcgtggcaaggtccgccttcggatctcctccggcagagacaagctcgcctaccttgtcatgtgcgccttcgatgcaggcctctatcccgtcatccacgaactcgtaggatgcggtatggcccgccgcgtcctggacggcaagcaccggctccacgtccttgccttcggccagaaggtcgaatgcctggcccatgaggtcgcaggagagcttgtcgagctcaggcgtcactccttgctttcttgccacagcaccaacccttctgccggcatatccggcgtatctctttcggacccattctagcaggtcctatgcgtccgtctcgtcagtagcgcaccgtatagaagccaaggtcgccacggcgcagcgtccgcgtgtgctctatggcctcgccgtcctggtcatagcttatgcagtcgtatgccatggccggccctcccggctccacgccaaggaagcgcgcatcgtggacgccgagctctgcgatatcgagatgctcagaggtcgcatcgacgaccttgccgtagaagccgaagacctcatagagggagaagacccctaagtctatgccctcgagcctcgggaacctcacgagcggcacgaccgtgcgctcgagcgaaagcggacagccatcgacgctgttgagccttcttatcgcatagacaggatcgtctgcctttatcttgaagagctctgcgtaccaggggcctgctgccctcgtctcatgcgagaggatgcggacctggggcttcttgccctctgccctcgtgctctggcggaagctcctgccatcgccgatatcgagagtgccggggctgcccttcgtgacgaagacgcccttgccctgggcacggcggacgagaccttctgcctcgagcgccgcgtaggcattgcggacggtctggcgcgtcgtatggaagatctcggagagctcctgctcggagggcagcacctcgcccaggccgtagccgccgtcctcgatcttcgtgcggatggcctcgcggacctgctggtagagcggcgtccgcttttgctcctcactcatccgcaatcaccttctccggaatctcatgcccacgtgagagatgctcctggcgcgcatagaacgtatagcggtcggagcggatgacggccttgaagtactcgacaggggtcctctcctctgtctcggagacgccggtctggaagtagacggggtctccttcggcaagccccagctcttctgcctcgtctgcgtcgacacgggtgatcgagaggcgctcctcgccgtgcggcagcgtgatgccgtactcctgacgaagcgtatcgaagagcgagcgctcctggaaatcgtatttttcgatgccagggcagaccgccacattgatatagaccgtctcgatcatgcagggaagatcgtctatgaggcggacacgcctgagctcgaagatcgggtctccttcctcgagcctgagcttgtgggcgacgtgggcatctgcgacctcgctctttgcccagagcaccttggaggagggggtcttgccgacagcacgcacggtatcgctgtagccgttgtagccacggcagttcgattccggccgcctcatcgcgacataggtgccagagcctccccggctctcgagtacatggcgggcaatgagctcgcgcagcgccgccctgagggctgtgcgcgagatgccccactcatcggtgagcgtccgctcggcgggcaggcggtcgccttccttgaggccagctgcatcaagataggcaagtatgttctcgaatgccgcctcggaaggggcgaccctgcgttcagccatcaagctttctttcttctggtcttgtcgaggagcttctgatatcccgcacggaagctctcggaagtcttgcccgttgcgtcggctgcaggcacgacgccgtgctcgtccgagacaaggaagtactcggcagcatctacgctgccttcgagataggcagaagcgaggtccggcatgcgcacgaccggcatgcccaaggtctgggcaaggtcctggatgagggaggtggcaccagccacgcgctcctcgggaccggcacccaagatcagggttccgtccggacgaacggcccagaacgtctcgggggcgatggcggtctcctcgaactcgcgcctcgacctgagcgcacggatggcaagctcgcgggcggcggtctcctggagcggatcgtagggccctaccgtcatggcagcgcggccttcttcgtcgacgatgatcatgaggacgccaaagggatgggccgcagagccttcctcgagcgtccactcgatgtgctgcttggcccattcgaggagcgtgccacgcagaggcgcaccctggatccttcttgctccaagcgcccgcatatggcggttctcgagcggcagcttctggtcgtagagcctccagcggcagaccagggcaggcttgccgagcgtgaagtccttcatatcaggttccggggcagccttgttctggctctcgtccttcgtatccacaggcaggctcccttccttcttctcatatcttcataccaaagcttacaacgaacagttgcgcctgtgcacagaacgcgtatcgtaggcatgccagatcaagcatctgcacaggaaggagagacatggaggagaaggtgaaacgcggccgctttgcaccgacgccttcgggccgcatgcatgctggcaacatcatggccgccctcctggcctggctctcctgcagaagcgaaggcggcaccatggtgctcaggatcgaggacctggatccccgagcccaggaccggaagaacgccgagctcctgatggacgacctctcctggctcgggctcgactgggacgaaggccccttctatcagagcgaacggcgcgatatctaccgcgaggccattgcagagctcagagagcgtggcctcacctatccctgcttctgcacgcgcgcagagctccatgctgcaaccgctccccacgcatcggatggcacctatatctatcagggcacctgccgccatctcacgaaggaggaggtggccaggaagtctgccgaaaggcgtccggcaacccgcctcatcgtgcctgatgcagacgatcccagaggaacgatttcattcacggatgctgtctatggaccgcagtcagaggtccttgcccgcgactgcggcgatttcctgatcgagcgctcggacggtgtccctgcctaccagcttgcagtcgtcgtagacgatgccctgatgggcgtcaccgaggtcgtgcgcggccacgacctgctagggtcgtgcgcacgccagatctacctgcagcgcctcttcggctaccccgagcctgcctacgcccatgtgccgctcctcattgccccttctggcaggaggctctcgaagcgcgaccatgacctcgacctcggcgtcatgcgcgagcgggcaggacgtcctggccccatcatcggcgctctggcagcagcggtcggtctcgcagaacccggcgaagaggttctgccagagaacctcatatcccgcttctcctgggagaaggtccgtgcacatcgcgcagatattgtggctaatgcccaatttcttgcaggtcctccccttgtaggcaaccacgcaagtggggtatgatgcttgagcacctattggagagctgaccgagtggccgaaggtgctcgcctgctaagcgagtataggacacaatcctatctggggttcgaatccccagctctccgccagcatatgacagggactgcgcgaaagcgtggtccctttttctttggcctgaacccaggcacatgcaatcttttgcctcatagcatgcccatcagaatccagcgtacatgaagatgcctcccctctcctgcgtccaggaaaggggaggcagcgtccagcaatcggagatcttgccctcgaggctagacgatatgtagagtgatcgggacctcactctgtgaagcagtggccatcgagtggcagcatgggttaggctcggtcctgaaggagtccggcttaccatattcacaggaggtcccgaccagttgtactctaccagcatcggcttgacgtgcatgcccgttccatcagcggcgcggcgttcgtcttcgagacgggcgaggtcgtgcagcgcacattcggctacgaccccgacgcggtcgccgcctgggggcacgctgcgcagctgcgggctgcctctacgagagcggccccacgggcttcgacctgcagaggaggctcgtcgctctgggctgcctgccacgtgggcgccgtctcgaagatggtgcggccctcgggcgaccgcgtcaagaccgacaggagggacgcccatttcctctcgaggctgctggccgtgggcgagttcgtgagtgcgcccctcccacgctggccatggggcggcgcgcgacctgtccgcgcccgcgaggacgcgcgcgaggcgctgatgagggcgcgccaccagctgtcgaagttcctgctcaggaagggccacgtgtggccgaagggcaggtccgcgtggaccaaggcgcacccgagtggctgcgctccatcgagctcggcgacccgtgcgagcggctcgtgctcgaggagtacgtcgcgcaggtagggagtgcgaggacggccgcgaccgcctcgactcggccatcgccgagaggtccggcgccgacgaccgccggcgtcacctccaggctccgcgccctgcgcggcgttcgaccgtcaacgccttcgggatcgccgtcgagatcgggacttctcccgcttcgccagccccagggcgctcatgtcctacgtcggcctcgtgccgtcggagtcatcgtcgggcgagacgacctcgaggggcaggatcaccaagaccggcaacccgcacgtcaggcggctcctcgtcgaggccgcctggaccacgccaggcctgtcgccggcctccgagaccgagtggcctcgtcggcggggctccggcggaggcggcggggattgcggcgcgggccaaccgcaggctgcaccgcaggtacctcgacctgagggcgagggggaagggcgccaacgtcaaacgtcgccatcgcccgcgagctcgtcgggttctgctgggcgctcgccctctgcgggtgagctgccgagctgcgaaaccaccctcccgcacgcgcggcgcggccgaggcgcgtggggcaccccgcgatgaactatgcgcagcgaggccgggcctcgccacgcgcgaccctagaccagcggagctcccagccgaagcgtcggaatgcgttagccaacacgcggatatcgagcgagctgcagtcgtggtgcggcggcgggggtggcataagaaaaaggcaggccgtccccgagaagtggaggctggccttgccttgttgacaagttatctacatatcagtgccatctgacttcagacctcctgcagcctcatggagacagcagcgatggagaggagaacgctcctttcctgaactagcagtgaggatatgactcattagctatttagttgggctggcggttaagtctcttttctcgtccctgccctgatcaggtgctttatcctttttcctccacttcactaacccctacccattcccctttcaccctcccccccccccatccctccccccccccccctcccctatcaattcctacccttctcccccccccccccgctcttcccccatccaccccttcaaatctcgagctcccccccccccccacctcccccccccatcctaccctcccacaacacaacaaactctccacccaacccccccccaccccacactcaaccatataccctcccctcctatcttgcctccccactaagtacttcccaaaacaacaatcctatacccaccccacacaatcacctcctgacgccccttccacttacgacatgattcccccatactcccccccccaccccgtggatagccactcctacttaccaaaagcatttttcacccgtcgaaccagacacgccctgggcgccgtcgcgcgggaggtggccatagaaaaaggcaggccggtccccgagaagtcggaggctggcctgcctttgccacttgacaagtctatctacatatcagtccgccatctgacttcagacctcctgcagcctcatggacagacagcagcgatggagaacgctcctggcagaagcgggacggatctatgccctcctgagatcttttctgcggcctggccggaaggcgagtgtctgccgccgattcagggcatgcctttttggccgtccatccatcctgggcggcgacgttgcggcatgtgctttcaaaatctgtgctgtgctggggttcgaggaagatggcagcaacgtgtttctgcgcccctcgatgccaggagtgacactgcggccctgccgatgtcatgacagacgccggtacgcgaattcccgtatgccattccaggggctggggattcgccaggccagtctatcggcggctatctccgataagccgccgattagccgccgacaggatggctgcaatacgggcactcttcgacgagcatgaagaaatcagtgcttccatggttgtcggagcccttggcctgagcgtccggcgcgtacgggaaatacttcagcagctgacggatgccggagtcctgatgaagcagagcgacagacgctctgcgcgctacatgcttacgccgaggcagaaacggcagtctgattgatatgttcggacaaagcgagaaggcagccctgcttgtctgcagtgctgccttctgctgaggatgatgcctcgctctaggcgatatcccgatagtcgatgagctcgaggtcttcctgcgcttcgagccaggctctgaggtcaggatcgatcagggcatcgacctctttcgtacggttctgtgtgagggaggaatgttccaggatgtaggcatcgagatatcctggatggaataccatgactccggtctcgccttccttgaggccctctgccgtgcggtggatgaagtctgccggatggtactgctcggttggcagcatgtcctcgcagaacatgcggacctcggtcgtaccgcagagtacgtggtttgcggggtcgaaggaggccttctgctccctcaggtggtgctttgctgccacatcagagattgcctggttcagcgtcttcgacatgacggcatgtgcctcgaagtagtccggctctctgcccacaagctcgacaaagcgggcatgctgcgcctcgatctcgcgcaccgcatcgtcgtagtcgacgaagtcgatgccttccttgaagctctggcggaaggtcctgctgctcttgagctggccctcttcgtccaccaggctcggaatcgtcgcagggtctgcgcacggcgtgccgaggcagacattcgtgtgctggccaatcgcgatgtctttgtttctgagccaggagagcccgcgtttggcctccggcatgttcggcatgagccccacggagcgtatgaccccatccttcacggcacggacgataccgagattcacggcgtagctgtatcccagatcgtcagctctcagaagcagacgcttcatgtgcaaccatcctttctctgcttgcttgctcatccatcttatgccttgagggctgccttctttgcagcagcttcttctgcagcctgccggtcggctgcaagctgctccttcgtgaagccgaagctgtaggagatggcagcggcagcgatgaaggcgacagcagaggcgatgcatcccatcaccatgttgaatgtgcctccggcaacgaatccgacaacacccaggatgttggtggcgccgaggacataggtcgtgacatggaagatgcctgcaagggcaccgccgatagcaccgcctgcgatcatgccggcaaagcagtgcgtgtacttgaaaccacagccatagagcgcaggctctgtgacgccgccgaggatgcccgagaggaagtagccgaggttggcgccgcgctcatcgggctccttgagcctgaggaaggcgccgaatgccatgccccaggttgcgaactgagcgatgccgcccgcaaccatgacacaggaatcggagccgagcgtcagaagctgcatgatgccaagcatgagaagcacctgatgcatgccggtcatgaccaagaactcccagagggcagcgatgatcgtgagggcaaggatggtcgcgatgccgccgacgttgccgaacgagaacatgaggttgccgaatgcattgccgagcacagagacgattggggcgagtgcgcagaggccgacgggaaccatcacgaacatcgtgaggaagggcacgaagacggtagagagcatatcgggaatcacgcgcttgaagaacttttccacctgccagagcacgggcatgcagagaaggatcggaagcaccgtgttcgagtaggtattgagcatggcaggtatgccatagaccgatgtgaaggcctggccggtatcggctgcagccgtgacgatgttcacgaaatcaggcgcgatgaggatgcctcccatcatcatgccgagcatcttcgaggcgccaagctgctgtgctgccgagtatccgaggtatatcggcatgaagtagaagccggcgtcgtagatccagttgtagaacaggttgtagatctcggagtcggcagaccacacattgagcatgcctggtcctgcgatgacagcgatggtgcgaaacattgctgcgcccatcatgacagggatggcagcgatcatggtcttcgagagatagttgagaattgcctgtccggcgcgctttgccgaccagggctcctttggcttgtcgtcatcgaggttctcgtcgatggagccgccggcagagacgccgagcttcacgattgcatcgtagaccttcggaacgttctggccgatgatgacctgatactggccacccgaccactgacagccgagcactcccttgatatccttgatcctgtcgtcgtcggggaccgattcgtccttcaggttgatcctcagccttgtcatgcagtgcgcgatgcttgtgatgttgtccttgccgccgacagcgtcgaggacctctgcggcaatgcgttcgttgtctgtcatctcgtgcctcccagatcagagcgtgaccagatactccatctgctctggcttctggaggaggcgccttcctccggctccggaggatagctgcatacaaaaaaatgccccccgagccataccagagcagcagggcacacagaatctgtgcgtcccagccttggtaatgcctcgtggagcgaagtccagtgcgtagcacccaatgcatgggagagaatagggcagccagaagcagactgaagggatccaaagagcgaacggtcggaattctgtcgtgaacggcaggtgctaggggcgttttgccgtctcacgctcgaagacgcggttcacatgcaggatcagatagacccgctcctcctcgtcgagcgtcttcatgagattctgcccgagatagtctgcgacggcattgccgcaggaagacacctccggatagcgctccagaagctccggcagcagggcagctgcgcccgaagaggcatgctcgccagagatcagccggcctatcaggtagcgcatatgggtcgcgaagcgggcatagtcgaaggagctgcgctcgacctcgatcccgagccgcctctccactatcttcgtgctgtcctcgatgaggcgctctgtctgcttctgccgctccgtgtcatgggcgcttgcggagatggcgctgttcacgatcgagagggcgatgccgacagcctccgtacggggaagatgcacgctgaaggtgcgctcgatgccatgcactgccatctcgccgatgcggtactcggccggatagctctgctgcacatcgaaggcaagcggcatctcgacgaccatatgctcttcggcgcgcttgattgcaaaggcgatatgatcggcaagcgtgacgggcaggttcggcgagagctcgtaggaaagtcccgaacgggcaaggtctgcaagctgtgccgcgaattcgagcacatcttcgggaagctcgctcacaagtcccaggtatttggggtcgacgccgtagaaggtgcgcttgatgtcggagagtgggacctcgcggggaaccgtgccgaagccgatgccatttccgagcgcgatgagctcgcgtcccttgccatctacgcagatggcggcattgttgttgatgctcttgatgacgcgcatggagctcctcggcaagacggcggttatctcctgcattgtagcggacggcccggcagtccataccagctgctggcagacggcgctcccagacacaggaagaaggcgatgccccgaggtcgggatgctcagggtctggaggcgctccgaggtgcagctcctttgttcctgctgcaatgttccgcaagctggtctcggcctgtctcttccgggggggcgtggctgacaggggtctctatataggaaacaatgaattctgcaatctgccaaagcgatagccaaacatagaaaagaggtagtaggggagagcccatctgggcgcctatgctgaaatctatgaccagctccggctggagaggagagaggacatggcaaagatcgacaatgccgcgctcaagaagggcggcttcatggcgcagaagcagaaaggcttctactcgctgcgcctccatatcacggcagggcatctggattcacgccagcttatcggcgtttccaaggtggccgacaccttcggccatggctacatccatctgaccagccgccaggccatcgagattcccttcatcaatgtcgaggacgctgatgccgtgaaggcgatgctcgccgagtacggtgtcgagccgggctgctgcggagcgcgtgtgcgcacggtcacgggctgccagaacaactgcctcaaggccgaggagaacgatctgggcatcaagggcggcaggaaggtccagtggaagccggatgcctgcatccattgcggcatctgctccaaggtctgcaagccgggtgccatcacggatgacgggaagagaatcgtcgtcgactacacgaagtgcgtctcctgcggcaagtgctcgcagaagtgtccggtcgcctcctggaactaccagacggtctacaacctcacgtttggcggcctcttcggcaaccacatcacgaagggcaggaagctcctgccgccggtcgagtccgacgagcagctgctcgccgtggccgatgcgacgatccagtggtacgacgaccacgcggttgccggtgaccgcttcaagttctgcctcgaccgcgaaggatgggagagcttcgtgccggtcgtcaggaaggcctacgacgaggcagcgcctgaaggatgccccaaggccgattcggtagaggtggagccggcagcgccggctgcccagtagggagtttccatggctgagaatgcatatgagatagcggacaccgtcgatattacggatctggtgtgcccgatgaccttcgtgacagcgaaggcggcgctggcggagctcgaaatcggcgaggtgctgagggtgcatctggcggcaggcgagccgatgcagaacgtgccgaggagctttgccgatgacggacagaaggtgctctctctcaaggaagcagaggacggcgcctacgacctcgatgtgaagaagctcgaagacgaatagtgcatagctgatgtctggatatgcaggaaggacagccatgaacatcacggtaggcggagagaagaagagcgtgcctgagagggagacgcttgcccagctcatcgcagacgaaaaggtcgagaatgcggcgtatgtgaccgtagccgtgaacgagtccttcgtcgaccatgcggacttcgcccagacagagctccatgagggagatgcggtcgagttcctctatttcatgggcggaggtcgctgatatggcattcacgtctgacgagctcgagcgctattcgcgccacatcatcctcaaagaggtcggcgtcaagggccagaagaagctctgcgccgcgaaggtcctgatcatcggcgccggcggtctcggagccccggctgccctctaccttgcggcagcaggcgtcggcaccatcggcatcgtggatgccgacgaggtcgagctctcgaacctccagcgccagatcatccacggcacatccgatatcggcaagcccaaggtggaaagcgcggcagagaccctgcacgatatcaatcccggcgtgcatgtcgtgacctatcgggagttcgtcgactccttgaacatcgccgacctcatcaaggactatgacttcgttatcgacggcgtcgacaatttcccgacgaagttcctgatcaatgatgcctgcgtgatgggcagaaagcccttcgtgcatgccggcatcatccgcttcaagggccagctcatgacctatgtgccgggagaggggccgtgctaccgatgcgtcttccacgacatgccgccgaaggatgccgtgccgacctgcaagcaggcgggcgtcatcggcgccattgccggcgtcatcggctgcctcgaggcgcttgaagccataaaatacatctgcggcataggtgagcttctgacaggaaggctcctcacgttcgatgcgctcaagggagacttccacacgatcaagctgccgccgagagatccgaattgcccggtatgcggagaccatccgaccgtgaccgagctcatcgactacgagcagccgtcctgctctttggcgcagcatggcaccgcactcgactgagaggagaggcatgctccatctgagcggcgacgatttccacagcatggcagagcgggcacgctcgcatgcacccgaggaggcctgcggccttctggctggctatcgcgacgaggaaggcgaagccttcgtcgagcacgtgttcttctgcgagaatgccgaccatacggcagagcatttcacgatctcacccagagagcagctgaagatcctcaaggaagccaggagctctggcatggagatcttgggcaactggcactcgcaccctgagactcctgccagaccatctgaggaggatctgcggcttgcgcaggacccttctgccatctactgcatcatctcgctcgaagcgcctgcctggccttccatcgttgcctaccagaaggatgcatccggcgctgtctcgagagtgctggtaagccatgatgcgtgagggcatcgtctttgcaagctatggcacgcttgtggatgaagcgcgcaggaccgacatcgcgcctgtcgcagaggcgctcgcggatgcgtttgccggcctgccttttgctgaggcctatacaagtgcctgggtgagggagcatctcgcaaagcgtggcattgcatccacaagcctcggcgagacgcttgcatcttttgcagatgaaggcgtcacgcgagccatcgtccagccaggcctcatcgtctgcggcgatgcatgggacaagcttgcagcagaagcgcaggctcttgctgaacgctttccggatggccttcttcttgggcgtccgcttctggcagataagcaggaccaggaagagatggctgaggctcttgccgaggcgtttccaaggcgtacgttccattccttcgtgcttgtaggccatgggacaaagggcgtggcagatgccgcctatgcaggtgttgtagaagcgcttcatgcagcagggcgcaccgactttgccctcggcctcatggaaggcacacccgatgccgacgaggtcgcgaagaagctcgtacgcaatggtacgcattcggctacaattgtcccgctcatgctcacggcaggaagccatgtgcgccgccagcttgcgggagagggcgcagcaagctggacatcgcgcttgaacgcagccggcattgctacggattgcacgctggcgggccttggctccctgccgggcgtgagtgccatctttgtccgccatgcacgggaagccgaagctatccgctgagacagacagcctgtatcttcattgataccgatatcgacagaaaagagagcgttccatgctgaatgacagccgtcttgtgcgtcctgccgcggtggcagccacgcttctgcttgcttcgagcctcgtggcgcttcctgcctgcagtcagacctcgaccaccacatcctcgtccgatgcacagagcacgtctgctgcttccgacacgcagagcgttaccttcacggacgatctgggccgcgaagtcacggtctcgaatccgcagcgcgttgttgtctgtatgggctcctttgcgggcgcctggcagctcgcaggcggcacccttgtcggcgcttccgacgatgcctttgcgcactacggggttgattcttcggccgtttccggtgtcggcaagtcgacagcgctcagtctcgagagcatcctcgacctcgatcccgattttgtcattatgaccggcatctctgacggcaagcacacgacaggggtctcccaggaggatatggaggcagccctcggcgaagccggcgtccctgtcgccttcttcaaggtcacgacatttgctgactacgagcgcgtcatgggaatcttctgccggatcacgggcagggacgatctctaccagcagcatgtcgctgccgtgaagagccagatcgacgccgatatccagacgtattccgtcaccggaagggcgccgaccgtgcttgtcgtgagcgcctattcgaagggccttgtcgtgcaggactcctcgggcatgaccggagcgatcgtgcgtgacctcggtgccgtgaatatcgcagacgagaatccgagccttctttccgacttcagcacggaggctgtggttgaggctgatcctgactacatcctcgtgcttgctgcctctgacgatgaggcgacggcacagcagtactatgaggacgcggtcggctccgattctgcctgggcagacctgaccgctgtgaaggaaggacgcgtcacgatgctcgatgcggcgcacttcctctacaagccgctcgacaagtgggccgagtcctatgagatcgtgggccaggcgctcagcaagtaaggaaagccgtggctgcagctgagaacaaagagatgaagaggacagggcacagaggcaggcgcttcggtaccctggcccttctttctgtcggggcgcttctggcagcgatccttctgggccttgtctttggcgcttccggtgtcggcgtcggcgacgtttgggtgcttgcaacaggacaggatatggcggcaaaggcgagaagcatcctcgtctcgatccgcattcctcgcgtcctggcaggagtccttgcaggcgccgccttctcggtctcgggtgccctcatccaggaggtgctcgacaatccgctcgcaagccccaacatcatcggtgcgaactcgggcgcaggactcgccgtgctcacggtgagcgcgctggcaacggtcggtatcgcgctgccgctgcctcttccggctgccgccttcttgggcgcccttgttgcttcgggactcatactgcttgtgtcatcgcggacaggggtctccaggctcacggtcgtgcttgcgggcgtcgcggtgaatgccgtcttcagtgccggcatgaacgcagtcctcatcatcgcgccgaatgcctatctgggctcttccacctatctcgtgggcggactctccggcatcgtgatgtcagatctcggcctgcctgccgtcctcatctgcgcaggcatcgtgcttgcctctcttctggcgccacgtctcaatgtgctttcgcttggcagccaggcggcgcatgcggtcggcgtgccggtggctctccttcgtgcagcaggcctggccattgcgtctcttctggcaggagcctccgtgagcttctcgggcctcatcggcttcattggcctcatggtgccccatgtggcaagacgcttcgtcgggcacgacctgagacgcgtgattccggtctccgcgctctggggcgctgccttcacggttgcagcagaccttctggcgcgcacgctcttcgcaccctatgagctgccggtcggcatcctcatgtctgctgtcggcggtcccttcttcatcttcctcctcatgaaggggaaggggtaccgcgatgagtgatgtgctcacgttccaggacatctcgttcggctacggggagcgcaagctcttcgagggcttttcccttgccattcccgaaggtggtatcacggccgtgctcggccccaatggctgcggcaagtcgacgcttctttccctggcggagggcatgctgaagcctgcctgcggagcggtgctcctctcgggcacagatacgctctccctttctgcaaaggagcgggcaaggcttctggcgatgcttccccaggtgcacaggacgccgtccatgaaggtaagagacctcgtggcatgcgggcgctatgtgcatatgggacctttcggccagctggagaaggcggactgggacaaggtcgacgaagcgatctcgctcatgggactggaagggctcagagacaggaatgccaggaagctttcgggcggggagcgccagcgcgcgtttcttgctatgaccgtcgcgcagggagcgcgtacgctcctgctcgacgagccgacgacctatctcgatgtgagggctgccctggatctcatgcagctcgtgagaaggcttgcggatgagcagaggacgaccatcgtctgcgtgacccacgatgtggatctggccctgcgcttttccgatggcatctgcgtgctcggaagtgcccgtccgacccagcttctggcagagggcactccggaagagattgcaggaagctctgtccttgccgcatcgctcggcatctcggctgtgcgcttcgcccatgcgggggagcaggcatacggaatctttccggcagacgcggtataaggtcttctggcctgcccattctttccgccagcatgtgcaaggctttcgtcagctgctgtgcaactagcttgacatgagatctatgtgatatcacaatgcaatcagattcggaggtcgggctgccaggtaggcaggatctccgagagaagggatgctcagccatgagtgtcgaaaagaaggcccatgccgcaagcggctggctcatgttcttcgtggtacttgccatgttcgtcgtatctgtcgcgctcttcatcttcgatgtcacatctcttacaagagcagacgatctgctgctgcctgagcctgccttcagcatgcctctcctgatcttcacaatcgtcgtcttcgccgccgcctgcttcctctcgaatggcttcttctcgctccagccggggcaggcccgcgtctgcgtgctcttcggcaagtatgttggcacggtcaccgacgaagggctcaggtgggccaacccgctctacgcaaagaacctggggcttgccgaggcagggcttgacagcgagaagcccgagcgcggcaagggcggattgaagagcgtgcgcggttctgtcatctcgacacgcctgaggaccttgaacggcgaacgtctcaaggtgaacgacaagatgggcaacccgatcgagatcgccacggtcgtgtcctggagggtctccgatacggccaaggctgtcttcgatgtggatgactacgagtcctatgtctccatgcagaccgagaccgccctccgccatgtcgcgtccgtctatgcctatgaccacatggaggacgaagacgaatcgagctcctcgatcacgctgcgctccaacatcgaagaggtgagcgatgcgctcaaggcagagcttgacaggaggctcgcgccagccggtgtcgccgtcgaagacgcacgcctcacgcaccttgcctatgcaccggagatcgcccaggccatgcttcgccgccagcaggctgacgctatcctcgcagcacgcaagaagatcgtcgagggcgctgtctcgatggtggagatggcggtcgacaggctttccgccggcggcgccatcgagctcgacgatgagcgcaaggcagcgatggcacagaacctcatggtcgtgctctgcggcgagtccgatgcacagccggtgctcaatacgggaagcctctatgcataaaggaaagagggcttgggcgtgagccgcaagcagtatccgctccgcatcgattccgatatctgggatgccatacagaagtgggcagccgatgacatgaggagcgcaaacggacaggtcgaataccttctgcgcgatgccctgaagagggcaggacggctgccgaagaagggcggcccgaagggcagggaagaagagcagtagcagggaggtgtccttcgggggcacctccctgagcgtgtctcatcaggctgcaatcagccgaggatataagtttcagcgacaggctggcaggccctgcatcgaatctcagaagcatgcattcatcactcgccgacggcgagaagccgtgacatagcggacggaaagatgtctttcgcccctctctatgctttgtgcgccttctcggcgagcatggtcgggatattgagctcatggagcctgccttctccgttcgtgtcgtcgaagacatcgcctattgcaaggctcggatggagcatgccgcccagaatctcttcgggggagtgggagagctgcacgccggcatcctgtgcggcaagctcctccgcaagcaaggggtcggtgacaggatcgaacggcagaccgtgtacgatgcgctcctcagactcgtcgacgacgtagttgaagccgccgaaatcgaagcccgcaaggaaggtgctgcctggtaccagaacgcgtgcaacctcgcggaagatgggcgcactcgcgcacatagcagaggctcacaggattgaggaccatatcgaagcttgcatcttctaaaggcagtccctctgtcatatctgccttcacgatctcgatgtcgtagccttcgcgctctgcgacaaggcgctcgcttgcgagctgcgcctctgactggtcgagcacggtacagcgtgctcctgctgcagcaagaatcggcatctgctggcctcctcctgcagcaaggccgaggacatatgctccctgaagaggcggaaaccagcttctgggtacgggctgtgtcggcgtgagcacgatctgccagtctccttctgtggcagccctgtaggtttcatggtctatgggcttgccccacacccagccttcgctgacccagtgatctatcgtttcggcgttgatgtcctgatagcgcctgttatccatggcccacgcactcttctgtctggtttccagatgagtgtatcaggcggacctctccactttgccatccgctgcatgggtgctacaatccgccttgcatctgcagatgaggtttctgaagatgcagacatagaggggagctggcatgggccggctgagaggggacagatggtcccgaccctttgaacctgatgtgggtaatgccaacgaagggagcgccatgacgcagatggatgctgcgcgtgcaggtaccgtgaccgacgagatgcacgcagtagcagtggcagaacacagatccgacgaattcatcagagacggtgtcgcaaagggaacgatcgcgattcctgcgaatccggcacacaaggcactcaagccctgcggcgtgggcacaggcctgcgcacgaaggtcaacgtgaatctcggcatctccggcgatatccagaatgcgccggaagagtgggaaaaggtcaggattgcagaagagttcggcggggatgcgatcatggacctctcgaactctggcaaaacccgtccgttccgccgcgagcttatctccaagactcctctcatggtcggcacggtccccatctacgatgcaatcggctacaacgacaagcctctcgtgaagctcacggcccaggacttcctggacgtcgtggaagcgcatgccgaagacggcgtcgacttcatgaccatccatgctggcttcaaccgctcggttctgaacaccctgctcgagacgaagcgcctcacgaatgtcgtgtcgcgtggcggctcgctcctcttcgggtggatgatgacaacaggggaggagaaccccttctatgagcacttcgacgacgtgctcgatatcctccatgaccacgacgtgacgatcagcctcggcgacgcaatgcgtggcggctccacgtatgacgcgacggatgcctccgaggtgtcagagctggtcgagctcggcaagctcacgacgcgtgcctggaagaagggtgtccaggttgtcgtcgaaggaccgggacatatggccttggatgagatccaggcaaacatgaagctccagaagcgcctctgccatggtgcgccgttctatgtgctcggacctctcgtgacggatatcgcgccgggctatgatcacatcacggccgctatcggcggagccgttgcggcatcttccggtgctgactggctctgctatgtgacgccggccgagcacctgaagctccccaatgcaaaggaagtgcgcgaaggcctcgtcgtcacccgcatcgcagcccatgccgcagatatcgcgaagggcattccgggagcccgcgacatcgacaacaagatgagcgatgcccgccgccgcgtcgactgggatggcatgttcgcatgcgcaatagatcctgaccgtgcgaaggagatcatcgcggaggcgcctcctgaggaggatggcacctgcacgatgtgcggcaagatgtgcgccgcccgcaccgtgaacaggatcatggcaggtcttacggtcgacctcggctagaagcgaagagaagaaaagcatatgaagcagcagggcagatggcagcatctgcctctcgctgcatggaggagcatacctatgaatacagaagagcttggtgcctgcctcgacagcgtgcggaagacctcgcctctcgtgcactgcatcacgaactatgtcacggtgaatgactgcgcaaatgcggtcctcgctatcggtgccagcccgatcatgagcgatgagccggacgatgtggaagacatcacctcgatctgccagggcctcgacctcaacatcggcaccctgaaccgccggagcatcgaaggcatgaaccatgccgccgcaaaggcagcgtctctgggccatgcaatcgtgctcgatccggtcggtgccggtgcctcgaagctccgtaccgagacggcacagcacctgctcgacacctaccatccccagcttgtccgcggcaacatgagcgagattcgtacgcttggtggagcctcgtcctcgacccgcggcgtcgatgcctcggctgctgacgtggcgacagaggagaacctcgccgaggcagctgccttcgtgaagcgccttgccgtggcgtggaagtgcacggttgccgtgacgggcgctatcgatatcgtgagcgacggcatgaggacctgcgccatcaggaatggcgtctcgatgatgggccgcatcaccggcacgggctgcatgctctcggcaatgcttccggcctgcctggcagcgaatgaggatgcatatatggcaacggttgccggcatctcgatgatgggcatctgcggcgagaaggcacgcgcacgcatggcaggggaggacggcaccggtagcttccgcacgtatctcatcgatgcgctctcgaacatccagagcacagatcttgtcgagtctgcgaaggtggccgatctctgatggcagaggagacgaagctcggcccttgccagcgcggaccctggtcagccgcggacatcaggaagagcatgctctgctatgccgtgacagatagagcctggctccggggaagaacgcttgcctcatgtgtcgaggatgccattgcaggaggcgctaccttcatccagctccgcgagaagaaggcctccgtcgatgagacggagaagcttgtgctcgaactcaaggacatctgcgctacccaccacgtccccttcgtgctcgacgacgatgtcgagcttgcaaagaaggtgggcgctgacggcgtgcatgtcggccaggaagaccttgcctgcagcaaggcccgcgagatcctgggcgaggatgcaatcatcggcgtctctgcccagaccgtggatgaggctgtggctgcctggaaggcaggtgccgactatctcggcgtcggtgcgctccatccgacgccgacaaagcccgacgcggtcgatgtgacctatgaggagctgacccgcatctgcgcggcggtccccattcctgtcatcggtatcggcggcgtcgatgccacgacggcgcatgagctcgaaggcacgggtgttgccggaggggcagtcgtctctgccatctttgccgcagatgactgccgtacggcgacagagaagctcaaggcagagcttcagaaggtcgtctccgcatgaaagcggtcctcgctatagcagggcttgacagctcgggcggggcaggcctggcgcaggacgtggcaaccatctcgggaatgggccttcatcccaaggtggcagccacggccgtgacggcgcagtcgcttgcggcagtgcatgtggtcacgccgcttccgcccgagcttgtgcagcagcagatccgtgctgctttcgaagaccttgtgccctctgccgtgaagatcggcatgctcggcacgcaggagatagctgctgtagcagcgaagacgctgaggcaggtcggtgcgcagaacatcgtggtcgatcccgtgctcgcggcaacgagcgggaccctgcttctcgaggaggatgcagaagaagggctcttctccctcttccgcctggctacgctcatcatgccgaatgtgcctgaggcggagaagctcctgggacatgagatcgcttcgcggaatggcatggtcgctgcagctgctgagctccagcgccgcttcggctgcgctgtccttctcaagggcgggcatctgggacttgccgatgactgcctggctgaagaggacggcgtctcctggatatcggttccgcctgtcgcgggtggctctgcccacggaacgggatgcatgctctcgagcgccattgcagcgggactcgtcgcagacagaggcacggaagatgcggtgaggcaggcaaagctcgtgcttgcctgtggccttcagagcaagacggtgcttccggaaggagcctatctcggactgcctcgtatctagcaggcagccttctgcgcgcggacccagacctcttcgggcgcgaggtctatgccgtctggccagacgatggtgccgaaggcggcatgtgcgcgctcgaagaaggccggatcctggagctttgcccagggaccttggcccttgatgtcggagaggtcgaggatggcagcgctgccgttctcgaaggtggcctctacatggcttgcgtccagcgccttggcagcaatggtctgctgaaacgtcttgaagctcgacatggccttctcctctccgacagaacgtttctcgctgatgccagcgtctgctccggcaccgcctcctgtcaagagcggccagactcgctatttcatgcagcctgctgcggctatttcagctgatatctggcggacgctcagcatgcatcgagctttgagcttgagacatgataccggactggaatatgcatcggccttatcggggtgggtatgctcaccccacgttcaagcagcacagggcagttcatcggggctgcggaaccaaaggcgctccagctgctggcgtatcggaggcgagtgagatgctattgctcgttgtcatgtttgtccttctgctcatggtgggcttccagctcatccgtggcctcttcttccgtggcggcatgggcatgggaggctggttcggtggctggggcagaggtgccggctggggagatcctggcatgcgtggtggctggggacctgaaggcggcccccgtggccctcattgcggggggggccggacggaagaggtccaggaggtcctgatgggcgaggtggcggcccgggaggtccgggcatgcgtgcctagatgcaagacgtattcatgaaagcagcgccagctctctgtggctggcgctgcttcttctctatctgctcgctttcgcccaggaagacttgaggccatgcacagcgaggtcgaccgcacgataggcaccgtcgtagatgcccatctggttcgcttcctcgatgcggccgcacatgaacgagatgaggttcctgtcatgctggaaggagtcgatcatcgagaggacctcttcggtcctgtccatctcgtaggtgccgtctcctacctctgcggcacgtatagctccccatgcctcatggccgccgatgcggtggatcatgagcttcgggatgggatagaacgagaattcgcttggcttcgtgacaaggatatcggagcagtgcatgaggacattggaactgtatacggctgagaagatgtcctcatcgcagaaggcatggatgccctggacatctcctgcataggctgcttcggcgaaggcttccgtgccggcaaagtcgccgaagtgggtctcagcgagagcggagagcccatcgacggatttcacgagcccttcccagacatccttgtggtcgccgacattgatgaagacggcggcctcatgcttcttcacgtaggggatgaggtgggagacaatggcagcaaagagctcctgctgcgctcctgcgccgccgacagagagaaggtagtgcacagggccacctccgagcacgcgctcgcgacgggacctgcaatcctcgggtatcgctgagaccagctcgtggtccacatagtggcccgtatagaagagggaatgttccggcatgggggcaagctgccttttcgggtccatgccgcggagctggtggtagccaagataggcgctcggcgtctgcacggtgtggattgagccttctgccagatgcagcgccattggccagttgtcgggaatcgcattcacgacgtgcgtcatcccggcatggactgctgcctgtgcacaccacgcatgggtgccgatgaaaggcgtgtcctttgcgatgtcgcggaagagcggcaccagaagctcgctcatcttctggtcgcctgcgttgtaggagagcttgcggaatccttcgctgttgagcggctcccagaagagcttgttgaagaggggaacctgctgcgagaccttcgagcccttggaatagaggctgttctgccaggcgatggcagcagatcctgtcgagcctttgaatgaggcaaggtccatccagtagggggtgtatcccatcgcatgagcagccgatgccatggccatcgcaatccggtagtgcccgaaccccatgcggatattgccgacaatgagaggagcgccatgggcgtcatcctgcgtggcagaggtctcgggaggcatgggtgccgctgcggcatctgccttgatatcgaaggcatctccggtgcctgagggcacgaggttccggacgccgagggcgtctgagatcaccggcaccggcttggccgcaaggtggtagaccgcattcgagtcatcgccgaaacgcttgagatagctttccttggagcggacggccttctcataggtgtgctcgtcctggacatttccgaaggcgcttttcgcccggtcctcgtctctttccatggattcctccttgacgggtggcggcatgcttgatagtctgactatcaaagtgatagacagactatcactcacgcggcaaaggagtcaagaatggagtacgcaggtctcgacacaagcctgctgaagcgggggatgcgcgaccttacgggctctgccgaagagagccgcgatgcccatatcgtggcctgtgcagcggcgcttttcctgaaggatggcctgggagaggtccggatgaccgacattgccgatgcttctggtgtcggcgtagccacgctctatcgccgcttctccacgaagacgaatcttgcgattgcggcagcgacgcttctctggcagcgcttcaatgaccgcatcatggatatcgtggaatcggaccgcttccttgccatgtcgggcgcagaccgcctcgagtgcctgctgcgcgagtatgcagcgcactatgcggcaaacagggaattcgtgcgcttcctcgacgacttcgaccatctgatgcttgcagagcatgtcggccttgaggcgcttgccgactatggacgcgaggtcgactcgttctatctcatcttcgtcgatgcctaccagctcggcgtctccgatggcacggtcaggcagatcgacgatttcaggacgttctaccgcacggttgcccatgcgcttacgggcctggcagagaagatctcccggggcgatgtgattccctccgaccgtttcgaggaaggcccctcagagcttgtctgccttgtcgatatggcagtgcgtttcgtcaggatctaggcacatttctgcgagaagggatatccatggagagcaggccgcttgcagatgggaagaccatccgcctcttcgcgatcggacagcttggctgggcaatactttcgggcatcatcagcaactggctcgtctactactacatgccctccgataccctggtcgcagaaggcatgcccatcttcatcacccagggcatcgtatgtgccggccttactgtcattggcatcatcacgggctgcggacgcctgctcgatggcttcatcgatcccttcatcgcttcgaagtctgactctcttgccaaccctcacggcaggaggatcccgttcatgaggagggcggcgattccgtttgcagcgatgacggtgcttgtgttcgtgctgccggggacttcgtctgcggtggcgaacaatgtcctgctcttctgctgtctcatgctcttctacatcacgctctcgctctactgcacgccgttcaatgccctgattcctgagctcggacgtacgcaggagctcagaatcaacatctcgacctatatctctgtgacctatttcgtcggcactgccatggcatatctcgtgacgatgatctcaggcttcctcgagccggccttgggccctgccaatgcattccgtgcgacggtcgccgtgcttgctgtcgtcgctgccatctgcatgctcgttgctgccttcgggatcgacgaggtcaagtacgccgatacgcagccgagctcgactcccatggggcagtcggtcgtgaagaccttcaagaaccgcgagttccagatcttcgaagggtccgacgtcctctactgggtctcaatcacgatgttccagacgggccttccgtactatgtcacggagctcatgggctttgacgactcctggaccttcatcttcttcgctgcgatgacggcgatatcgctcctgttctatgcaccggtgaacatcctggccaagaagatgggcaagaagaagcttgttgccttcgcctttttcttcttctgcctcgcctttgccgtgacatcggtctgcggccagttcggcatcccctcgcttgtctggggcatcctcgtggccgtgcttgccgccgtgcccatggcaatgcttggcatcctgccgcaggctgtgcttgccgatatcgcagaggctgatgccatagcgtctggagagaaccgcgagggcatgttctatgccgcacgcacgttcagcatgaccttggggcagacgcttgcgatggtcctcttcacgtcgctctcgacggctgcagggggacagatgggctaccgtctcacggcaatcgtcgcgaccatcttctgcttcgtggcagggcttgtcttcacgcgctatcacgaagccaaggtgctcaggacgattggcgccacggagtcggcttctgtagaggaaggcagataggatggctttgctcgcacatatcctgaaggcgccttcctggaagctttcctggcggacagcggccggaaaggaaggaacggcatccgtcctcgtgccgggagtgcctaggcttcccttaatggcggagctcgaggagacggagaatggctgccgcctgtggattgagcctcttgagcctctgatggtggcctccgtcgaggcgacgatcgagccagatatggaaaaggccacggcgctcttcctcaatggctacaactcctggaccgactcctgcgagcgtccgctcgatgcttcgatggccggccttgcccatacgccgaaggcggccatccgccattgggtgctcgatgcctcgggtgactaccgcttctgcccccagaatcccaagagtggacatcagcacggcgaaggctatggatatctgcgctacggagatgagacgctcctcttcggagaatgcctgcccgatcttgggctcacgacgatccaggaagatctcgatgcgcagaagttcaggatcgtgaaggaagggccagcccgtctcatcgagcccggcgagcgcatctgcgtctttgcgctctgccttctggagggaacagcaaaagaggcattcgctcgctttgtgacatgcataggggagaggcgcaggccagctgagcccctcgtcggcttcacgagctggtacaggcactacggggatatcgatgaggaaaagcttgtgcaggacctcgctggtgtcaaggcagcgctttccaggcaggtgcccgaaggcatccttccggtctttcagatcgacgacggctacacgaaggtaggggactggatgcatccaagcacagagcgcttccctcatggcatgggctccatggcagagaagattgctgcagtggggcttcttccggggctctggatcgcacccttcgtctgcgagaaggactctcggctcttccatgagcatcaggactggctgctgcgcgatgaggcaggaaaccccgtgatgagcggctctcactggtcaggcggctatgcgctcgataccttgaaccctgaagtccgctcctatgtgcatgaggtgctgggacttgctgcagatacctggggattccggcttctcaagctcgactttctctatgcggcagcgctcctgccgcatggcgggaagaaccggggcgagctcatggcagacgcgctcgaccttctgagggattccgttcctgaaggcacgctcttcgatctctgcggcgtgcccatcatgtctgctatcggccgcaccgagtactgccgcatcggctgcgacgtggggcttgactgggatggcgcgccgtacatgaggatatccggccgtgagcgcgtgagcacgaagaatgctctcggcaatatccggggacgtgcgcatatggatggcgtggcgttcctcaacgaccccgatgtcttcttcctgagagacgatgtgaagctctctgaagcacagaagaagacgctccttgaggcagatgcctcgttggggagcgtccttttcacgtcggatgatatgggcagctggagcgaagagcagaagcggacatttgaagaggctctgcacgcattcgcttcgaggaagcgcggctagattctaggacttgcgtgcggcatccacgaaggcatgccagagcgcacggtctgaggcgagtgtcggccacgtgtattcagggtgccactgcacgccgaggacgaaacgtgcctcaggaagctcgatgcactcaggcacgccgtctgttgcctcgccggaaaggatgagcccctctcccagcttcccgacgcagcagtggtgggccgagttcacctggatctctggctttcccacaatatgggcaagaagcgtatctggcttcacctcgacagggtggacaggatcggtcaggaccttggcatggcgccagagctgcatgccttcccgtggcttgaggcttggcacatccatgcagagcgtgccgccgagtgccacgttcaggagctgcgtgccgcggcaggttgtgaagagcggcttgtctgcagcgaggatcttctgcacgagcggaagctcgaaggcatcgcgctcggggcagaggagggccgggtcgtatggctcggtgctgccgaagcgggcagggtccacatcggggccgccctgcagggcaaagccgtcgcagagctctacaagctggttgattgcatctgcgtcatctgtcagcggaagcaggataggcgtgcctcctgcatcgatgattgcatcgggaaagcagcttgccatcccctcggtcggggcaagctggtcggggacctgtgcggtcggcaccttcctctcccagcggggagcgatgccgataagaggacgcctcgaagatacagacatgggaaaggacctttcatgaggacaccccgcatcgtttgcggctgatgcggggcgccagatgtgcagtgcgggatatcctggctagtggcccatgatggagtcgaggaagtcgcgggcacgctggctcttcggatgctcgaagaactcgtcaggtgtgccttcctcgacaatctggccgtctgccatgaagacgacgcggtcagcaacgcggcgggcaaagcccatctcgtgcgtcacgacgatcatcgtcattccctgctttgcaagctcgaccataacgtccaggacctcgttgatcatctcggggtcgagggcagatgtcggctcgtcgaagagcatggccttcggatgcatcgcaagggagcgggcaatcgcgacacgctgctgctggccaccggagagctgggcggggacctttcctgcctgctcggccacgccgacgcgtgccaggaggtccatggcctccttcttggcctgctccttcggctcatgcaggacatctatggggccgagcgtcacgttgtccagtatcgtcatgtgcgcgaagaggttgaactgctggaacaccatgccaaggtcggcacgcatcgcagcgagctccttgccttcctggggaagaggcttgccttcaatcaagatctcgcctgaatcgatggtctcgaggcggttgatcgtgcggcagagcgtcgacttgcccgacccggaagggccgatcacgacgacgacctcgcccttgtggacggagagattgatgtccttcaggacatggaggtctccgtagtgcttctcgacatgcctgagctcgatgacgggtactgtggctgcctgtgtatccatatggctcctatccattgccaatgcctgcctatcttcctgctagacgggattctcgttcgtgcgggccacgatcgaggagccctgcttccgggcgagggagatggcgaactggttgatgccgtaattgatgaggatgtagatgattgcaaccacgaagtaggtggagacgagtgcatcgtagttcgtgatgaggacacgcgcattctgcaggaggtcggggaacgatacgacgtaggcgacggtcgtgtccttcacgacaacgaccagctgcgagatgagcgacggtatgaccatgcgggtggcttgcgggaacacgatcttgagcttgacgtggagcgggctcatgccgagagagagggcagcctccgtctggcccttcggcacggcgtacatgccggcacggaagacctcggccaggacacctgaggcagcaagcgcgaccggcagcgtgatcatccagaacgaggacatcttgatgccgtactgggggatgaccaggaagaagaagtagatcagaagcaggctcgggacgccacggaagaagttgatgatcacatggcagatgccggccaggatcttgttctcgctgatgcggcccatcatgaggagaaggccgagagcaagggcgatgatgcctgccgtgacagcgacctcggccgtgccgacaaatccctggagcaggaaacgccaggtcgtccagcgcgtgaagaaggcccagtatttcggggcgagctggcctgtgacatagaagcgctggacgatcgcgaagatgcccagggcgacgaggacgagcgctatggccgtccagatgcggatgcggcgacgggtcttgggaccgggtgcctcgtagagggcgtcgcgcatggagacagtcgtggcactcatctcaggatcctcgctttcttgtcgattgcattgccgacaaagccgatagcaagagcggtcagggcatagccgaacgcggagatgaagaacgtggcaatgccgccagcgacctgggtgttgatcgtcgagacgatgccggtgagctcattgggatcgagcgggacctgggagccgagtgctgtcgtcagcatgacggcgatgagcaggtttgtcatcggcagcacggacgagcgcagggcctggggaatcacgatgcggcgcaggatctgcgtgaacgtgaggccgatggagcgtgctgcctcgatctggccgacgccgatcgtgttgatgccgctcatgaagttctccgacccgaaggcagagcccagaaggattgtcgcaatgatcacgcaatcgcggtaggacagcaggaccttgagatacggcagcgcatagacgcaaatgatcagaagcgagatgccggggatgttgcggaagatctgcacatagaggtcgcccacgacgcgcagcggcttgatcgggcagacacgcatgatcgtgatgatgacagaaagcagcatcacgaagacgaacgagatggcggtaagctgccaggtcgtgagaagggccgtgatgtagtccgagccataggcgctccagagctcagcgaagctcatgcatcctctccttcctttctgtgaggtgccttctggaagaaggcgtgtctctagaagtatgaggtttccgcccgggtgcagcggaaacctcatagtgtgctaacagccaggaaatatgctggatagggtgcctatgcctcgatgacaggaggctcgggggcgttgtcgaggcccgtgcggtcgccgatagcgatcttccagagctgctcccacgttccgtcatcctcgatgctcttgagccaggcgttgacgaaatcgacgccgtcggagccgagcgggaggccaatgccgtaaggatcgtccggaccgaacgggtcgcctgcgatgcggtacttgcctgggttcttgacgacagagcccatctggagcgtctcgtcgatcacgtaggcatcgacacgtccctgctcgagagcctggcgtgcctcctcgtcggtgctgaactcctgctgcttggcatcaggggcaagctcgctcacgatgctgggacccgtggagccagactggaccgcgacgttcttgccggcgaggtcatcgacgctgttgatatcggtgttgtctgcgaggaccaggatggcctgctgggagacgaagtaggggcctgcgaaggagatgaccttcttgcggctgtccgtaatcgagtaggttgcaaatacggcgtcgacctggtcgttctggagcacggactcgcgggtatcggatgtgacctgcgtgaggtcgagcttcgtctcgtcgcccaggatgtagcgggccaggagctgatagaggccggcatcgaagccgcggaccttgttgtccgtctcgttcaggaggctgaagagggtggaggtgcgggtgccgccgacgcggaacgtgccggcatccttgatcttcttggcccaggcatttgcggagatcgttgcgtcgtctgcggtggcgccgccagcaatcagggagtcataggcgtcgatatcgaggtcggtcgatgcgctcgacgtgtcggacgagctcgagggcgaggatgaagacgcggtgctcgaagaggtgtcagaagaatcgcaggctgcaaggccgaagaggcctgctgctgcaatggtgccagctcctgctgcgagtgcctggcgcctggtgagaagaagattgtcaagcttgcgcatgtcagtgcctttcttttcattgttctggcttccgcaaatcatgctcccctgtctcggaagccatggcaaaagagatagtgcgttatttataccgccatagtggcattaagtattcaaccattggccgaagaggtactgttctgcaatgaatctttcagacagctggctatatccaggaaagatagcggggatattctctctgatgcattaaccattcatccggtgctgcgcggcgttcagaaaagagctatcttcataattctgaatgttgcctgccgaaaagggccttcctcatgctgcgaatgctgaacgggcgggtaacagaagagggacctgatagcggcagggcgggtgcgggcgcgctgtccggacaaggaggcgccaatggagcccagaaacagcaaggaagatatcggcaatgccggcagagggtgtgccatgacaaggaggggagcgcttggccttgcggcaggcctcgcaatgctcggcgtagccggatgctccggctgcggcaagacggatgacgctgcagacgcagcttcagatgcgcaggagagtccggctgaaacggacagcaccgatgccgggacgcaggaagaggcagctcccgagccaacggctgaggagcttgcggcacagcatatagaggagctcttgggtggcctcacgacagagcagaaggtaagccagctcttcttcctgaggcccgaaagccttgtctcggatacgatgacggaagcaggttcggaggcgcagcaggcactccaggcctatcccgtaggtggcatgtgcttcttcggaaagaatctcgaggatacggaccagacagtccagatgctctccgccctgaagacgtattcgaaggatgcctgcggcataccgcttctgtgctctaccgacgaggaaggcggcacggtctcgcgtatcggcggaactcctggcttcggcattgccaatgtcggcgacatgcgcgctatcggcgatgccggcgacgtctcggcagcacgggacgtggcggagacgattgcgggctatctcctgccactcggcttcaatctcgacttcgcaccagatgctgacatctgcaacaacccggacagctacacgatggcacagcgttcgttcggaacgactgctgccactgtcgctcctatggtggcagcgcaggtcgagggcttcgtctcttccggcatcgggtgctgcgcgaagcacttcccgggcatagggggtgcggtcggcgactcggagaccgagcctatcgtctccgagaagacggcagacgagatggcagaagaggagctcaagcccttccaggctgccatcgcggccggtgtccccatgatcatggtcggtcacctctcctgtcccaatatcacaggcgcgtatgcacctgcttccatctcgagggaagtcgtgaccgacatgctccgcgatcgtcttggttttgacggtgtcatcatcaccgactcgctcgagatgggtgccatcgtccaggattacacgatcgaggagattgtactctcagcgctcgatgccggtgttgatatgctgctcatgccaagcgatttcgaccgggcctatgcggctgtgctcagcgctgtggaggcaggagacatctccgaggacaggatcgatgactccatccgccgcatcctcaagatgaaggtcggcctggggctcgtgtagcgctcaattccatcggatgctctcacaggcgtatgatacagaagaaggctgatgtgcagagaggagcagccgatggagaagggccgggacgagatttcgctctttgatttcgcctatctcggcgagtggggagagacctctgcgcgtctggcacagatgaccctgcctgagcggtgggacttcgccggaacagggcctcgccgctacgagatcctgagcgactatctgcgcttcacgttccttcgcctcgagcgtgagggcaaggtcctcatcagcgatgatgaagatttctgcgccttcaataccggccttgtcgatgaatcgtatgaggacatctttgcctgcttcacgccgaacaggattccggacaggcagccctggtatctcgaaggcttcgctgcggcaggagcagacaggctcggcgacaggctgctcaggagcttccacgacctgccggagcgtgcgcgctatctcttcaaggcagaggatgtgctctacgacgtggaccaggtgccgacgcctgactatggccatatcctgatcggcaatatcgaccggctgcctgaggccttcctcgtgcgcgagcttgcagacaatgaggaagagctggcatgcacgaagcgcgcgttcgcagcgaaggagaaggatgcgcgcagggatgccttcgatgcgcttgcaaagcttctggatgccgaccagctgcgcttccggcgcctgaaggaccggcttgatgctgccatcaggctgtcggtcaagcaggttgcctggaactggaggtgggcggtgcctatctactatcctgccagagactgtgtgagcctgcttctgccgctcgacctcacagaggacgagcagcccgatatcgcgctcgtgctcgagcggacgcagtcgggccgctacatcggccagacgatactgacggcagagatggcatacaaggatgcgcgcctgattgcacgtcctggagccgaatggctcgatgcctgcttcgtgaagtgagacttgagcccgagtggaaagataggagagagtctgatgataaagccggatacgcccgcatgcgtcctcttcgacttcgacggcgtctgtgccgataccgagaggtatggcatagagctcgacagagaggtgtatgagctctacggcatcaatcccacgaaagaggagatgcagtcgcttgtcggcacgacggggcttgagtccatcccggcacttttcaggaggtatggcctcacggtcacggcgcaggagttctttgcaaagcgccgtgacaacacctgcatctaccgtgatttcccgctcgaggcagaagcaggccttctggatgtcctgaaagaccttcgtgcccgccatatcccgacgggcttggtctctacgacagcagcttcctccatcctctttgcgctcgacaggctccatcttacgtcctgctttgacgtgattgtcacaggggacatgtgcgagcatcacaagccagagcccgatccctatcttctggcgctgaggctcttgggaaaggatgcgaaagactccatcgccgtcgaggattctcctgtcggcatccatgccgccaaggctgcggggctctatgtgatggggtatcggggcgcaagcattgtgcaggacacctcggaggcagatgagcagctcgaggagttcccatcattcagggtctagcagcctggcgctaccgccagacggagcgtagtgagtccgccttcgctcatgacaatcaaagagcctccatgctgagtggcaagacgtttcacagcctggaagtcttcgagggctgagagcttctctgctgaggcggggataggcatatcgcatgagatgaagagcatcccgccgtgctgcttcagcgaaaggtctatggcccgttcttcttgattcttgcctcggctggcaacaagcatcgcaaggcgtccaatgcccgtgaccaatgcatagaggtctgtgctgcggagtgccccgccatcaatcctgcctgccatgcacgcaagcgtgatgtcctgctgcccgcagagcagctccatctttgcaagcgctgcattgatggcttcgctgtgcgtccggagcgttgcatcgtagcttctgagattcttctcgacacggtcgagatatcctcccaatccttcggtctgctctgcacgcacacccgcgacaatatgccgcacatcgtgcatgaggctgcccagccgttcgaagagggcatgggaaagatcgagactggattgcgcatcggcaagtatctgctcgcttgcccgcgcttcccgcgaagagatgaccttctggcaggccatgtattgaagcgaaagcaccatgatgcagaccagaaggctcatccatacggatctgaggcgagaatcatcctgctggaacagcccttggaagccaaaggtgcagaggaaaagcatggccagaagggcagaagctccgagcacgccgtagggttcgtcttcgagaagccgtcctccggtcctggagaggacatccctgaatatcagccggacagctgtgtaccagacgatgcaggcaaaggcgctcagacagaaatagagcgcaagattccgggtgaggcttggccatatccagagcgcaagccattcatgcaccacgatgtagacaatgtgctgggtcgtgtaggcagtggctgcactccagagaagatcggtcaggcctatacggaagcagcactgcagcgagaacgtcatagcaaacacaagcgataggtaccagaggacgttcatggcatcgggcagtgctgccgagacaacgaattccctgaaggggaaatagccaagcgagacgaaagagaagcctgcaatgaggcccgcagccttgagtgcggccttcggcttcggctctgcctgtatagcaagcaggacaaaggcagcggcaaggtattcccagacgaagcgaagctcctcgaagatagcgagaggggttgcagcagcagcaaggaaggcagccacgtcagatacctcccgcacaggcaatgaaggcctcggtgaaggccttgcgcctcgatctgctcatagcgagctcgtctgcgccgacctttacgctggaacctgagattgccttgacctgcttgaggttcacaaggtagtagctgttgcagcgggcgaatcctgagctttcgagcttcttcccgcacgccgtcatggtcttgcgtgtgcggtaggtctcatgagcggtgtgatacatgaggtagtgaccatgcgattcgatgtagagcacatcgcggatcgggaggatcaccatgccatcagcagtcttgatgacaagagactgctccgagcgttcttggacgcgggccaaagccctcgtcagcttgagcgagaaggtcgggtaggagatcggcttgaccagatagtcggcggcctccacttcgtagccttcgagggcatattgcggcatgctcgtgacgaagacgatcgtgatatcgggattcacactgcgcagaagccttgcggcttccatgccggatatgcctggcatgtctatatcgaagaacacaagagagaactgggatgaatcctcccgcagaaaggaactggcatccggaaatgcgatgggctcgatatcggcatcatggctctttgcgtactcatcgatatagcggacgagattgtccctgtcgagactagaatcgtcgacgattgcagcctgcatgcatcccctttccagtttgcatcctcgctacatcctagcctatcggcgggggcggattcgccgtgctggcgaccgctcgaccttccggaatccgcagacggcgcttttccgtcgaatcctgccagcgcgctgccgaaacgtgccagcccgctgtatctgcatcctgcttccgaagaagatggcatcaacaagaaagggcttggaggcccataagtgaagccatcaggatgagggaggacatcagatgacggattcgaagaagccgcagaccaaaggcggacttacgaggcgctctgtgctggggctgggaggcatcggagccggtgctgttgccctgggtgtcggcaactactatgcgaacaagtatgtgccggttatcaatacctatctcgggcagaagagctacgaagtcaaggatggtagcgcaggaactgaggacagcgtctacttcaaggcatcctatagcagcgagtcggagcgtcttgcggcagatgcatccattgccaaagaagttgcgcaggaaggcttcgtcctcctcaagaatgatggcgcgcttccgatggcagaaggcagggtcacgcttctcggtgtaagctctgcagacatcctctacggcggtggcggctccggcgctgtcgactcctcgactgctccgaccctgaagtctgcgctcgaggcttctggcttcgaggtcaacccgacgatgtggagcttctacactgaaggcgcgggcagctctatccgcatggatgtcgccgatatcgcaggcacgggccgctatgtcatccatgaggtatctccggacctcttcaccgatacggagaccgcaagtctcggcgactacagcgatgctgccatcgtcgtctttgcccgctccggctcggagagctcggatgtcccgagggcatatgatgagtcgtatcttcaggacgtcgatatcaaaggctataccggcacggtccattcgagcaggctcgattcggatgacgatcttggacgtcattatctggagctcacctcgaatgaggaagcgcttctggagtatgcttcctagcacttcggcagggttatcgtgctgatcaattccggcaatgctatggagctctcgttcctcgacagcagccgcttcaacgtcgatgcctgcctctggatcggcaacccgggccaggacggcctctatgccgtgggcgatatcctgacaggcgccgtgaatccatctggcaagacggtcgatacctacgcccgcaactccctgtctgcgccggcgctcatgaacttcggctcgaatatcatcgctggcacagacaatgcgccatacgttgtctaccaggaaggcatctacgtcggctacaagtactatgagacccgctacgaggactgcgtgctcggacagggcaacgcagattccgcagtcggagcatccgacactgcagacaagtggagctatggcagcgaggtgcagttcccgttcggattcggcctttcctatacctccttcgagcaggtgctttccggaagcgcccagaaggatgatacggtgacccttaccgtcaaggtcaccaacacggggtctcttgcaggcaaggatgtcgtcgaagtctatggccagagcccctatacggactatgaccgcgcaaacggcgtcgagaaggctgctgtccagctggtgggcctggccaagaccgatgagcttgcacctggtcagtcgcagacgctcgaggtggccgtctcccttgcaagcctcaagagctacgacgagggcggcaaggggacctacatcttcgaggcaggcgactactacctcgcaatcggtacggatgcccatgacgccctcaacaacatccttgctgccaagggtgcatctggcatggatgcagagagcgatgcaagaaaggccgtgaagctctcacttggggagagcagcgactacgccacttctccctataccggtgctgcagttcagaaccagttcgaggatgcggacatgcggagctatgacgcaagcttcacctatctgacgcgcagcgactgggaagccagctatcccacggcctacatcttcacggcaactgatgaggtgctccacgcgcttgctgtacaggagggacaggacgatccttccgcggtgatgccgacgacaggtgcccagaatggcctcacgctcgcgatgctccgtgaggtcgatgcggacgatccggcatgggacgatcttcttgaccagctgacacccgaagagatgtacaacctggtccgtgtcggcggctaccagactcaggcggtcaactcggtgggcgctccagcaacggtctgtgtcgatggccctgcctatgtcggcaatgctggcacgacaggcgtcaatactgtcgagaagacctatgcctggtgctccgaggtcgtcatctcctcgacctggaatcctgcctgcgccaaggcaatgggagagcagatcggcgaggactgccttgctcagggcgacctcaactttgcgggctggtatgcgccgtcgatgaacatccaccgtacgccattctcgggacgcaacttcgagtactactcagaggatggcttcctctccggacagttcggagctgccacggttgcaggtgcccgctccaagggcgtcatgacattcgtgaagcacttcgctctgaacgaccaggagaccagccgtacgactatcgccacgctttccaacgagcaggcaatcagggagatctaccttgcagccttcgagccaagcatctcgggaggagacgagggcacgctcggcatcatgctgagcatgaaccgcgtcggccttgtctggtctggcgacaacaagggtctcacggcgaatgtcgtacgcggcgagtggggctttaagggtgccatcatcaccgaccaggcatcctacccgcaggccttcccgctgctggccatccgtgcaggccttgctggcggtactgacatgtggctcaactccggtaccgacaactggcagatcgatggctatgcatcgaatccgacggtcatgacgcagctgcgccaggcctccaagcacatcctctatgccgtctcccgcagccttgccatgaatggcatctcttccacggcaaaggtcgtctctgtcatggcgccatggcagatggcactcacgggaatcgatgtggcagcagcggtcggtgctgcggcaggcatctacgctattgtccgcggggcaaagcgccgcaaggctgaagctgccgaggacgaggaaagctcagacagcagcacgagcgagtagcttcctcaacatctggatcagtgcccctgaagccattgacagcttcaggggcacatctgcattgggagtgttttcggattcgtccttgtggctagctaagtgcaagcggagaagcgcatggggtatgagttctcttgaatgatgcaggctttctcttggaggaggtactcatggaaaatgctcttgaagcaatccataaccgccgcagcgtccgcgcctatgaggacaaggcggtgccgaaggaccttatagacaaggttatcgatgctggactctgggcgccaagcggcatgggcaggcagtctgccatcgtcgttgctgtcacggacaaggagaagatctcctggctctccgagctcaacaggaagatcggcggctggaaagaggggttcgatcctttctatggggcaccagtcgtgctcatggtcctcggcaagaaggacatgccgacctatgtctgcgatggctccctcatgatcggcaccatgggaatcgcagcggaagagctgggtctcggcagctgctggatccatcgcgcgaaggaagaatcggagatgccggaagtccaggagtggctctcctcgctcggcgtgcctgaaggctatgaaggcgtgggacatctgatcctgggctatcctgtgaaggacaaggtggctgctccgcagccccgcaaggacggccgcgccttctgggcggagtaggcggcaggaagcaggaatcctgccttcggtggctgaagggccggccgatcaggtcttgaaggaggaggcctgggatggagacagtccttccatggctcgtgaacctcttcacgccggcgacccttctggcagaaggccagggctggccgctcttcggagctgtgcatgttgcctggctcgcggcatcgtgtgctctcatcgccttctgtgtcctccattaccgtgcgctgcctgctgggcaagcgcggaagcggatgacatacgtcgtggcgatcgtgccgctcatccttctggcttcgcaggatctgggtttcatcgctacaggcacgttcacgcccagctggtggccgctccattcctgcaatgcctgcgagtatctcggcatcatctatgcgatatggcctgctgcctggatgggggagacgctcttctgcctttctgccacaggagccatctgtgccgtgctgttccctggctgggcatggtgtccgcctctgttatggccggtcgtctgtggttttgccgagcattccctgatgcttgccctggtcctcatgaagcttgcgaccggcgagcttcggcccagcctcggacgtctttggcaggcggttgccttcacaggtgcctatcttgtcttctgccttgcggtgaatgcccacttcgggacaaacttcatgttcgtgcgcgtgccggcagaaggctcccctctcgaggccttcttccagctcttcggctggccaggctatctggtgccctatgggctgggggtgctcggcatctggattctcatgcataaaggatatgttaggctgtgccggcattgcacgcatgcaggggcatgcaggcactgagatacgtgcctctgcacggatgcgcagacatcctgctggctggcatgtcaacacgataaactcttcttgaaggagcagggatgtgctgggatactgtcgtgctgcaactgatggtggcagggcctggcatccgaggaactctggcttttgtgccctgccttcgcgagaaagggtgcagatggaagcgctcaagctcctgggcatcctgatcgtcgtgatcggatttgccctcaaatgggattcgatcctgacgatcatggctgccgctgtcgtcactgccttcattgccggcatggatcctctggtattcctgcagacgctgggcaagagcttcgtctcgaaccgcaacatgctcatcacggtcgtcgtgttcctgctgacaggcacgctcgagaggaacggcctgaaggaagcggcgaaagacgtgatggcaaaggtgaagaatgccacagccggcatcgtgctcggtgcctacggcgtcttccgcgtgatctttgctgccttcaatgtcagcttcggtggcgttgccggcttcgtgaagcctgtcgtcatgcccatggcagaggcggcagacgaggcaggtggccacaagatgtcccgcaagcatcatgaggagctcaaggccatggcagccggcatggagaatgtcgcctggttcttcggccaggtgctcttcgtcggcacgtccggcatgctgcttgtccagggcacgatggctgacctcggctacacggtcgaccttccccagctcgctgccatccagatccctgtcgccgtcgtcgcggtcgtcgttacgacgatctactacgcgatctgcgacaagaagctcacgaaggaagatccgaagcagctcgaggctgaggctgcggccggcgtgaaggaggaagactgatgggtgtcatcgaattcttccagagcgccgatgtgacgctttcccagaagctcctcgaggtcgtctacctgatcattggcctcgtctgcatctatgcaggaatccgcaatgcaaaggacgagacgaacgaaaagaggatcggcacggccttcttctggtgcattctcggcatcctcttcatcgtcggcccctgggtgccgtatgaggtggacggcgtcctcgttatcctcatggtcatcccgccgattgcaaagcaggtcggcaagggcgcagaccgcacgaagccgaccgacactgaggcgcatgccggctacaaggacctcggcacgaagatcttcatccctgccttctccatcggcgtcgttgccctgatctttgccctcttcacgaagatcagctcgcttgtcggcatcaccgtcggcgtcttcatcggcatggtcgtcctgcacttcatgcgtccgaagcagaacacgatgaaggtctatctcgaggattcccgccgcatgatcgatatcgtgggcacgctgatcatgcttccgaccctgcttgcaatcctgggatcggtcttcacggcggcaggcgtcggcaacgtgatctccgatatcgtcggtgccatcatcccgcagggcaacatggtcgtcggcatcgtcgtctactgcctcggcatggccctcttcacgatgatcatgggcaatgcctttgccgccatcacggtcatgacggtaggcatcggagctcccttcgtgctgtcgctcggtgccgatcctgtcatcgtcggctccttggcccttacctgtggctactgcggcacgctcatgacgccgatggcagctaacttcaacatcgtccctgtcgcgattctcgagatggacgacgagtacggtgtcatcaagaagcagatcgttcctgccctcatcatgcttgccttccagaccatcctcatgatctgcctggttgcactgtaggatgcgctgcatctgggtagagagacggtaggaaagaaaagagagcctgccttccggcaggctcttctgggagagagaaggaatgcatgaagaagattcttgtgacgggcttccaaccgttcggtggcgagaccatgaacccggcctgggaggctgtccgcaggcttcctgacacgattgccggtgcctccgtcacgaaggtcgagatcccggtggttttcggcaagggccccgaggcagtggacaaggcaatcgacgaggtccagccggacctcgtgctctgcgtcggccaggcaggcggccgtgcgaagatcacgccggagtttgtcggcatcaactacgccgatgcccgcatcccggacaatgacgggaaccagccggtggcagagaagatcgcagcagatggccccgacgcctacttcgcgacgcttcctgtcaaggccatggtccaggccatgacagaggccggcatcccggcagaggtctcctacacggctggcacctatgtctgcaacgatgtgatgtactcgctgctgcataccctggcaacgaagcatcccgctgtccgtggcggcttcctccatgtgccgtatgcgacggagcaggcctgccatctgccatcctccacgccgagcatgtcgctcgacatgatggcacgcggcatcgagctcggccttgcagctgccgtcgagcacgacgaggacgtgaagacggctactggcacgacgcactagccatacgtgtgatggatctgtgggatgccccggaggctcaggcttccggggcatcttctgtatggagaagtgccagctcagagccttgaaacgacagatggctgttccgggacagacgtccgaatcatgcgggatggtaaagaggctatacatctttcatgcagaatgggcacatgatgccgaccatccgggagcgattcaggaggctgccatgggctatacggagcgcgagcactggtgccagcgggatgacaagaagatctatgggaagctcttcctgccggatggctgggatgatgggcgtccgcgtgccacggccatctttgcccatgggctctcgacgaaccatggggacatggagccgtatgcgaggacagctgccgataggggcatggtgagctatgtcttcgacttctgcgggggtggcggctactcaaggagcagctggcaggacaacatgtcactcttcacggagcagcacgacctcgaagctgtcgcctgggagctctcgcgcgagcccttcgtcgacgagcgcaacctcttcctctgcggtgcctccctgggtgccacgatcgccctcatggcagcaagggcgaatgtgcagctcgtgaaggcctgccttctgctctatcctgccttcaacctgcatgatgcagtgcacgctgcctgtcagaggagggaggattttcccgagcgcttccacatcatgagcatggacgtgtcgggagacttccttcgctcctgctgggattacgacttcttcgagcatatcccggcatttccccaggatgtcctcatcttccatggggacgcagaccaagtcgtgccgctctcgtattcccagcgtgcccagtcgctcttcccgcgctgcgagctccatgtgattccaggcggtggtcatggctttgtcgacccctattactgacaggtcgtgaaccaggcagcagaatggctccgcgcccatatctggcgctagaggccttggggcacctcaggatctcttccctggaacgaggcaaggatctcgtcgagcgatattggcgccatagcgttcgcatcgacaccaacgtcgtagcggagcgtcccctcgttccgcatccttgtgttgtagcttcccggtgccgtctcttcctgccccgaatggatgtgtccatggagcatgatcgagcctcggtgcatgccttcccaggaaagcaggggatagtggcagagcacgatcatctgtccctcttctgtcttcatcctcatgagtggtgcttcgagcacgaaggtatgggcgacttccggacgcgaccagtccttgtcgtggttgcctgaaatcaggtggaccttgcggcagacaatcttctttctaagcgcatgggcatgctcgaccgtgcagtggtaggagaagtctccgaggatatagagcgtatcggtcggagcaaccttgatattgatgttctggatgattgtgtgctccatagcctccagggaggaaaagccgcgcttctgggtggcgaggctctcatgtcccagatgcaggtctgcggtgaaccagatcatgtagctctcctctccgatccgtcaggcggctggcggcaggctgcccatccatcccatgccgctataattcaaggacaaggggtgcaggcctttgagcaggtacctgaaagaccatgcatgctatgaaggggacctccctatgaagaagatcatactcgacctcgataccggcatcgacgatgcccttgccatcgcctatgtgctcggaagccctgacgccgagctcatcggcatcaccggcacctacggcaatgtcctgatggagcagggccttgtcaacagccttgccctgaccgagcttctgggccatcccgaggtcccggtctttccgggcaagacccatgcgctggcacaggatggcttcgccgtgagcgaggcctctgccttcatccatgggagaaatggcatcggcggggtcgaagtgcctgcttcccggcgtgctgccgaaaagacgcctgcagtcgatttcctgatcgaggcggcgcatcgtctgggagacgatcttgtctatgtgccgaccggtgcgctcaccaatctggctgctgcgctcaggaaggacccctcgctttcagcatgcctgcacgtggtgatgatggggggcgcgctcacggtgcccggcaacgtgaatgcctggacagaagccaatatcagccaggatcccgaagctgccgacgaggtgttccgctctggcaccgatgtcttgatggtgggactcgatgtcacgctccagacgcttctcacaaagaaggagacagggcagtggcgtgcgctcgggacgaaggcaggaaatgcctacgccgatatcgtcgactactatatcggcgcctatgccaagaccgctccctatcttggaggatgcggcctgcacgatcctctggcagctgctgtggcgctcgacccgacgctggtgacgtgtcttgccatcaacatgaaggtggacaccgaaggggcgaccaggggccgcacaatcggcgacgagaccaggctgaacgatgcgaagaagaccatgaaggtggccgtcgccgtcgacaccgaacgcttcctttcccagttcatggagcgcatcacgaagcttcttgcagctgcctgatcgagagaggcagaagcgaggctgcggacccgcctgctgccatccaaaccctggcgaccggcatggccctgctgccacattgctctgtgccaggcttgcctgccggggatggatggagggccttgctgccaggggaggagctttggctcatggcggaaccatggaggcaggatttcctgaccttttggtcatatctatgttactatctccttaaaggtcatatagatatgacaaacaggctgctgtatgggaggtctgcatgaagaggcttgaaggcaagatcgcgattgtgacgggttcgacgagcggcatcggcatcggtatcgccgaagcatttgccaaggaaggcgcccatgtggtcgtatgcggcaggcgcgaggcgcgggggcaggaggttgtggatgccatccatgaggcaggcggaagcgccagcttccaccgcatggacctgaacgatctggagacagtcgatgcgctgatggcagatactgcccaggaatatggctgcatcgatatcctcatcaacaatgctgccggcgtcggcctggcagatggccgggtggacgagatctcgctcgaggactgggatgccatgtttgcctccggcgtgcgtggcaccttctatgcgatcaaggcagccctgccctacatgcgcaagaagaaggcgggctcgatcgtgaacatcggatcgatggcatcggttgcaggagatctgggctcgacagcctatgcctgcagcaaggctgcggtcgatatgctgacctcgtcggtcgcgctccagtatggcaaggagaacatccgctgcaactgcgtgcgtcccgggctcatcgtgacgccgcagaacgaggcccacgtgccgcagcagctcaaggacatcttcctctcgaacatcgaggtcaaccgctatggctgcccggacgatatcgcgcaggcatgcctcttcttcgcctccgacgagagcgcctatgtcaccgggcagatcatcaatgtggatggcggcatgaactcccatgcctctacagtggcccagttccgcgccatgggctcgaggacctggtagcgcatggcagaagaggagctgtccgcatcccggaagggccctgccctgaagccggcctggcgcatgcgcgcggtcttcgagcagaaggtggtggcgccctaccgcgatacctaccggggcgatctcgggcctgcccaggtcgcagccctggaggagctctatcaggcaggggagctccgccagcaggagctctcagcagccctcaggatcacgaagcagcatgcatcgaagatcgcagcgcggctcgaggagcgtggcttcgcgaagcaggtgccagacgatgaggacagccgctgtcgcaaagtctgcctgaccgatgccggcagggcctatgtggaagcacacatcgaagagggctccgagcgggtgcggcgcctgctcggacatctgagcccatctgagcgcgaggagctttcctcggcgatggaatgcgtggcacgccttctcgaaaaggcctgaggctcgcaggacccaaggagggggctggcgctgtaaactgcgccccgtttgccaaaatcttcagcctgtgcaggcgcagcgcggcacagaaagctacccgccgagcgggtgaaagcaagcgatgctatgcagcaaggtccagattccaggccggggcgtggggcgccctgtcttgatgccataccctcaaggcaagccaaacatcttttgagaccatgcacggggtatgaagggttggacctgtctgcatgatgcaggcagggtgcagcaggcagcccctcctcatcggagctgcctgcatcgcttcgaggttcagagctcgtgcctgaggggacggatcttgctgtctgcgatctcgaggatcatgtaggtgcagcgccccgagcctggtgccggcatgagggtgccggggttgaggatgagcgcatctcctggtctgccggcatcttcctgatagcggtgcgtatgcccatagaccacgatatcggctcccgcctcgagggcccgggcgcgcagggccagaagccgcggcgcgtgctatctatggccgtgggtcatgaggatgcggtgggcagaggatgcaggacgtggcggcagcgggtctgtgtagccggctgcatggacgcctgagatcctgttgtcttcgatatcgatcacaagctcgtcggcaggatctgatggcgcaagcagtgcatcgttgtttccatggacgagatagagaggctcagggatgcccagacggtcgatatcttcctgcgctgcctcgaagtcccctgcgaggaggatggcatcgagcgcgccttcgggcctggcatcgtccagggcctcttcgagatggtcgagcctccggtggatgtccgatccgatcatgagcctgagcatggcctcgctccttctcttctgctgtcctgcaccagtgtaggcgatgtctgcggctgtgcggtatctcctgcgtttcgttttgcaatccattgcagaagctttgcatgcccacgcgggcgctgtgtctggcgtatgctttcgcccgtgccgacattctgatcgggcctggcagcatgctctgaagggattgccttccaggagcgttctgaagcggtttctgcacgcagattgcgagtgctgaaggaacgcctgtgcgatgcagctgacaaggcatgaagcgatcgcctctttgcggcagcagctgcctgctgcagagcaggcatggacgtctgctatcgcaacagcgttggatgggagaaggcttctgcgctacaaggggaaggtgtggacatgctttcctctctggatgatgcagcattgtgggacatcgaactcatgcagaagactgatgggatggcactcggaagcaaagccttggtccgggcagccgtgcctgcccgctgcatgacatgaaacgggcaggttttctgtgcgaggctgccctcgtgaccgtgcttggcccctttgcctgggagttcgcctcccgccatatggaggccaagaccttcatcacggctgagataggagcggctgtggcagcagatgcagcgcttcttctcttcggccatctggcaccttggctcttctgcgctgccttcgctgtctttgcgatcgtggaggcaagcctgcgtccgctctcgacaaatatcctgctttccaagttccgcgatgccggtggaacgactgcctcagccatcaacttcacgagcatggttcagggctctctgggcatgcttcttgtcagtgctctcggcactgactgcgtctctgctcttgcctggacgattctcgggagcatggtcgttgctgcccttggctggcaggcagtccttcgccgctatccccacacggcagagatccgtgcctgggacgaatagcgcacttgccttgcgcatggcatgcgcactactctggaagaatctttagagtcctggaggcatgcatgcagaacatccctgaagcgatagaggtcaaaggcgcgagggtccacaacctgaagtcggtcgatgtgcgtgtgccgctccatgagattgtcggcattgccggcgtctcgggttcgggcaagagctcgcttgcgcttggcgtcctctacgcagaaggatctcgtcgctatcttgaggcgctctcgacctatacgaggcggcgcctcacgcaggcagccagggctgacgtcgatgaggtgcgctatgtgccggcagcgctggcactccatcagaggccgcctgtgcccggcatcaggtcgaccttcggaacgatgacggaagcgctgaactcgctcaggctcctgttttcccgtgtcggctcctataggtgtccgaacggacacagggtcgcgccgtcgatgaatgtggcgctcgagaagccgatcgtctgtccggtctgcggcgagagcttctatgggcttggcgcggaagagcttgccttcaacagcgatggtgcctgtcctgcctgcggcggcaccggcacgatgcgcgttgtcgacgagagcacgctcgttccggacgagtcgaagacgatcgacgagggagcggtcgcgccctggggcacgctcatgtggtccctgatgaaggatgtctgccgcgagatgggcgtgcgtaccgatgtgccattctcggagctgacgccgaaggaacgcgagatcgtcttccatggccctcaggagaagcgccatatcgtcgtgcatatgaagagctcgaatacggcaacagagcttgacttcacctactactccgccgtcgctacggtcgagaatgcgcttgccaaggcaaagacggaaagcgcggtcaagcgcattgcccgcttcctgaaggaggaaccctgcccggcctgcaaaggaacgcgcctctccgatgaggcgcgcaacccccaggtcctgggcatcgatctggctgaggcgacagccaagacggtggatgagcttgcctgctggctgcccaaggtcgtgccgagcctgcccgaagaggtgaaggcgataggctcatccatcgtctcgacgctcgatgagcctctctcccgtctccagcagctcggccttggctatcttgcgcttgaccgcgcgggctcgacgctctcgacaggagagcgccaacgtgtgcagctcgcgcgttcggtgcgcaacaggacgacaggcgttctctacgtgctcgacgagccttcgatcggcctgcatccagcaaatgtcgaagggctcctcggcgtgatggacgaccttctggcagatggcaattcggtcgtcgtcgtggaccacgatgtccatgtgctcgagcatgcgcagcatctgatcgaagtggggccaggctctggcaaggaaggcggccgcatcatcgcccagggcacgcctgccgaagtggcagaaagccccgactcccgcatcgctgcctatctgctgcaggaaaagccgaaaaggatacggcctgtccgctcggtggaaggcatcttctcgcgcggtgcgctcaggctttccacgaacgcgctccataccgtgcatccgctcgatgtggagctgccactgggagcgctgacggtcgtcacgggcgtctccggttccggcaagacgacgcttgtcctcgaatgcctcgtgccggcactcgaagcattctcgaagggagagaagcttccctcccaggtgaggagcatcgctcccgccggcatccgcagggtgcatctgatcgactcgacgccgatcggcgcgaatgtccgctcgacagtcgccacctattcgggcgtgatggacgagctcagacgtgccttcgcgcaggctccctctgccaaggagcgcggcctccatgcgggagacttctcctacaacacagggtctctgcgctgccccgtctgcgatggcaccggcacgatctcgctcgatgtacagttcctgccggatgtcgagattgcctgtccttcctgccacggcgggaggttcggcgaggcagcatggcagataagacgcagcttcgcccgtgcgaagaaagggacagagccgaggtcgtttgcgcttcccgagctcatggagatgacggtcgacgaggcacttgcagccatatcctcgctcaggcgcgtccatgcccagctccaggtgctccacgatttgggccttggctatctcacgctcggcgaggcgacgcctgccctttcgggcggcgaagcgcagaggctcaagcttgccggggagatggagcgcgaccagaaggatgcgctcttcgtcttcgatgagccgacgatcggccttcatccccatgatgtggaagtgctcgaaggggtgctccagaccctcatcgaacacggggcgacggtccttgtgatcgagcacgatctcgatatgatcgcgaatgccgactggatgatagatatgggaccgggaggcggcgaggcaggcggccgcatcgtctatgcaggggtgccggctggtgccagcagctgtccggcgtcggtgacaggccgctatctctgagatgctatccttgtgcccagaggcacagaggaaaggcggctgcagtggatcttgcaggcgaagggatcttcgtcgctctggcggcagtcatggccggtctgggacagctctggttctggcggctccgtctcggcgaggagcgcacgatctggcttggatgtgctgcgcttgtggcggctggcactgctgtcatggctctctccatcctgcttgttgtcatcttccctgagggcgtcttcccctgggtacagacgctcgtgctggcaatccttgctatcttcttcatcttcctcctcatgtttccgatcgtcctcgtcgtgacgctcatcgctacgggcatacggctcgtccggagcgagggaagaagcctgcgcaacatgctttcgcttggcctcggatgcgcgatggtcgcctatgtgaccatctggccgtttgtgcggagcgctctcagcgacgttccggttttcggcaatgtcttcgatttcatcttcggcttcatagctcttctcatcgctcttctgggcacagccttcgctttctataccgtggcaggcgtcgccgtgcagtggccgcaccggcatcgccgctacgatgcggtcgtcgttctcggcgctgccctcatggaggacggcacggtcacgccgcttttggcaaacagggtgaagcgcggcatcgagctctggcatctccatcccgaagcgaagctcatcatgtcaggcgggcaaggtgcagatgagctccagcctgagtcccatgccatgcgtgtcttcgcgcttgcgcagggtgtgcctgaagatgcagtgcttgtcgaggaccgctctgcaaacacacgcgagaaccttgccttcaccgagaggctccgcgaacaagaagagctcacttctgaaggacggcttcttgttgtctctgatgactaccatgtgttccgtgcgcttctgatcacccgcaccctcggcatcgctgccgacggagcaggcgccaaggtgcggctctacttcgccctcaatgcgctcgtgcgcgaatgggtggcctatgtggacctgaagcgcgccgtcttcatgaagctcacgctcgccgtgcttgcgctttacacggcgttctgtctcctgacggcatgtgcctgaggacagccgttctgtgcggcatgctgccttagaggtccccgcagcaatgctggcatgcaggaaggcgcccctcctggaaggcccagacaggggcgcccagcgaagggggctattctgcctcagaggctgagggccttgagctctgaggcggtcatctcgacaaacttttcggtcttcttcgcattggtgacgaaggcggagccgattgcgaacatgtcgtctgtggccacgccgagcgcggcgttgatgagcacgtcggtaacactgctgtctggttcttctggacgatgatcctgttcttcccctggagcatgacccagacctggctctggcggtcgaagggtgcggacacgatcgcgtcggcaaagccgtcctccacgggattgggcctgccttcatgaaggtctcatccttgatgcggttgaagagctccttctggctgccgaaccctgcctgtcttgatggtcttgagcctgaagccgaatgccctgtcattctcctgcctggcaggggtggccagtacagagtcccatggccagaagcatggcggaaagagggatctgctgcttcatcccaacgcatgagagaaggagctgggggatggcatgaggccaggagggatggccctagcggatgggcgtctttgccaggatcgtgaagcggttcttgcggtagctgatatagccttctgcctgcatccggctgagctccttcgagagcgccgtacgctcgacattcagatagtcggcaagctgctggcggttgaagggaatctcgaacgtgttggccttgtgcttgatagactccgcattgagataggccatgaccttctcgcggacgctcttcgaggcgatgaggaagctcctgcgcgagagcatgaggttcttcttggcagcgttcatgaggaggttctgggagagctgtgtggtccagagcttctgcgcttctgcatagtgcgcaagaagcgagatcctgatgaagaggatgcggcaggactcatgtgagcgcacatcgacgagcagcggctccttcggcaggagcgcataggtctctgcgaaggcctcgcctttgccagcaaagccgagaatcgtgcgggtgccccaggcatcgttgctctcgatcgtcacagagcctgcgagcacgatgcccaaagactgcgtgagcgtgccggcacgcaggataagctcgtctttcctgtagcgctcctcatgcatccggagcgcttctgccatctcttcgagcgcttgggcgctgatgcccctgaagagcgggatatctgagagggcagtcgtatccattgcatcctctttgccgtagatttctcaaaatgtggtcctggcaacatactctagcagagaagcagccaacaatgaagaggaaatgataccggataggaaacatattcggtggatggagaggcctgcaggtacggatgcctgcagtgaaagaaaggacaaatagcatggatacgccgatgttctgcttccagtgccaggagactgccggctgcaagggctgcacgcgttcgggcgtctgcggcaagacccctgatgtggcagcaatgcaggacctgctcatctacgtgacgaagggcatctcccaggttgcttcggcactccgtgccgagggcaaggaggtcacgaaggacacgaatcacctcgtgacgacgaacctcttcaccacgatcacgaatgccaacttcgataaggaagccatcatcaagcgcatcgaggacaccctcgtcgcaaagaagcagcttctcgctgagctttcctccaccgagggcctgcctgaggcagcgctctgggagggcacgcgcgattccttcgaggagaaggcacgcacggtcggcgtccttgccaccgaggatgaggatgtccgctccctccgcgagctcatcacctacggcctcaagggcctcgctgcctactcgaagcatgccaatgtcctcggccgcgatgcagacgagatcgacgctttcatccagcaggcgcttgccaaggtcacggacgacagcctcacagtcgacgatctcgtggcgctgacgctcgagaccggctccttcggcgtcaagggcatggctctgctcgattccgccaataccgagacgtatggcaacccggaggtgaccgaggtcgagatcggcgtccgcaagaaccccgctatcctgatctccggccatgacctcaaggacctcgagatgctcctcgagcagaccgcaggcgccggcgtcgatgtctacacgcactccgagatgcttcctgcccactattatcctgccttcaagaagtatcctcactttgctggcaactacggcaacgcctggtggcagcagacgaccgagttcgagaagttcaatggcgccatcctcatgaccacgaactgcatcgtgccgccgaaggccagctacaaggaccgcatgtggacgacgggtgctgcaggctatccgggatgcggccacatcgaggcagacgagaacggctacaaggacttcacgccgatcatcgagcaggcaaagacactgccgtctccgactgagatcgagcgtggcacaatcgtcggcggcttcgcccatgagcaggtcttcgcgcttgccgacaaggttgtcgctgctgtcaagtctggcgccatccgcaagttcgttgtcatggcaggctgcgacggccgccagaagacgaggagctactacacggagttcgcagagaagctcccgaaggacgttgtcatcctcacggcaggctgcgcgaagtaccgctacaacaagctcaacctcggcgatatcgatggcattccccgcgtgctcgacgctggccagtgcaacgattcctactcgcttgctctcatcgccttgaagctcaaggagatcttcggcctcgacgatatcaacgacctgccgcttgccttcaacatcgcctggtatgagcagaaggccgtcatcgtccttcttgccctgctctccctcggcgtcaagaacatccacctcggccccacgcttccggcattcctctcgccgaacgtcgcaaaggtcctcgtggacaacttcggcatcgccggcatcacgacggtcgacgacgacctcaagctcctcatcggctaggatctcaaagactggatctgagacgggcttccggcagcgtgccgggagcccgtttttcgcagggaagagggtgcatatggacttcgcagagatctatgaggcaatcaggcaggacgagcagaacgtgtcctatacagagcgggggatagatccgctctacacggcctctgctacctcccgtgtcgtgatcgtcggccaagcaccggggcgcatcgcagaggagacgcatatcccctggaacgacaagagcggcgagcgcctgaggtcctggctcgggatggagccttccgtcttttacgaccctgcccaggtcgcaatccttcctatggacttctatttcccgggcaaggggaagtcaggagacctgccgccacgtgcaggatttgccgagaagtggcacccgcttctgctctctcagatgcccgacgtgaagctcctcgtgcttgtggggacctatgccgtgcaccactatctggagctgccgcagaaggtgaagctcaccgatatcgtgcggggatatgaggactatctgccaggagccttccctcttgtccatccgtctcccagaaaccagatctggatgaagaagaacccctggttcgagtcggaggttgtgccggcgctccaggatgaggtgcgcaaggctctttcttgatgcctttcttgctatgcatatctactattgcagagtcagcatgataggcatttcacattgcgcttgtccaaccctatgctgtaagcggcaagagaggaagggacggcaatggatgcatgcagcgcagtcaggcctgaagatgctgggctcaccgaagcggacgtcgaggctttcgcaggcctttctggcacggctgcccaggtcgcatttctgagccgctgccggaacagaaggctcgagagccttcacgcagagcaggagaagctcgaacatctcgactatctgatctacatgctcaagaagtcggagaacgcatgaggcttcctgcgcagagcaggatgaggaaagggattgcaatgaagcagacagcaggacgcgatcagctcggaaccttcgcaccggagttcgcccatctgaacgacgatatcctcttcggagaggtgtgggaccaggaagcgctctccacgaagacgaagtgcatgctcacagttacgaccctcatggcacagggcatcacggattcctcgcttctctaccatctccagaacgcgaagaagcacggcgtgacgcgtgccgagatcgcagccctcattacccatgtcacgatgtatgccggctggccgaagggctgggctgtcttcaacctcgcgaagcaggtctggaccgaggacgaggaaggcgccgtgacctctcctgaaggcctttccgaggactttccggtgggagagccgaatacggcctatgcgaagtacttcatcggcaacagctacctggcaccgctcggagacccgcagctcggtgcctgcaacgtgaccttcgagccgggctgccgcaacaactggcacgtgcatcacaagggtggccaggtcctcatctgcatcgcaggcgagggctggtaccaggagtggggcaagccggtccagaagcttacgccgggcgatgtcgtgagcattgcacccgaggtcaagcactggcatggtgccacgaaggattcctggttccagcacatcgcgcttgccgtgccggcagagggcgccacgaacgagtggctcgagccggtcgaggacaaggattacctgacacttgcctagagatggccagacgggagggcctggaggcaccatggctccaggccctttcccatagctggaacatctcggcatccggagtctgctgtgcggcttatccggtagcgagcaggctctgcatgcacggaacaggcagaggaaaggctacccgttcctctgcacgaagacaaagacgggaagagctgtcgggctctcctgctccgtgctatcagatgttggcagcatgcatgaggtgctttcgccaccagctgcagctgccgcaaagccaaagaagccgccgcccgggacatggcggcacagccaagcactgacagtcgtcttgcagccagccagagcttggaggagcgtgcctgcgacgcgtggactaaatggcagaatccgctgctttgcgcctgccaggctcctgctcggcggccggatgacagtgccacgttctgaggactctgcaatcctgtctgaactgcacaaggaaaggaacctcttcagcactcggctacgacgcggcgcatctcgctgatgaaggcctctcctgtcttcgagaggagacggaacttcttccagatgaggtgggcgcctgctgtgagcgtcggctcgagaggcacgaagacaaggtcgtcagggcagacgccttcgatcgagatggcagaagccaggccatcgcgcacaagcagcagggcgttgccgatcatatcgaagcgggcaacgatgtggcagcttccctcttggagcacgccggaagaccaggagatgaggtcgaaggtctcgtgtgccgtacgggaggagaccatcaggtcgaggccttcgaggtcttccggatggacgctggcttttcgtgccagcgggtggtcaggacggacaaggagaccgacgcgttccttctggggaagctcgaggtggtcgtacttgtcgaccttgaaaggatcgagcacgacagcaaaatccacgacgccccgttcgagctgctcctcgatcgtgtcggcattgccggtcgagaggttgagattgactttgggatgaagtgcctggagctggcggaatgcctcgacaacagaagccatggcctgggtctctgctgcgccgatgcggaccgtgccctggagctctgcgccaggacccacttcggactcggtctgctccacgagcgccaggatctcctctgcacgctggcggagcctcatgccgtcctcggtgagcgtcgtcgagcggttcgtgcgcctgaagagcgtgcatcccagttcctgttcgagctccgcgatctggcgcgagagcgtcggctgcgtcacatgcaggacattggctgcttctgtcatgctctcttcgcgggcgaccgccaagaagtatctgagagtccttatctccatagcaacgctccatatcaaaacgtacgttaacggactgttttgccagctcgaacacattatctgccagagatgggacacatcgatccgaaacggcggatagcacccctgctgggattgttcttctgcgggttcttccatgcaatgataagagatgaaactaggcgtatataacgctgaaggagaagacgtgaagctcggtaggcaagaaaagcctcaaagataccttgcctcggggatataaaggacagtatctagatccattgcagatagcccatcagcactctgctcgtatcgcggcaagcatgtcttcggctgtcttgtatgatttgccggtcccacctttcgctatggcctcagctccttcgcggagagcggtgctggtttcaccgttcggaatcgcgctggcggaattggatgtgctgctgcgggtctgctttatctgtttcggaaggttcgttttgctggggcattgactgccatcgcatcgctcagctttttcttgggcgacctgctcgacacctgtctcctgatgcgccttcttccagagctgccgcccctcttctggaaggccttccggtcccgcttccatgaagctctcgctgcctgtctgctctgcggtgcggtagtaccagagcttccaggaaatcattgcgcgcgtgcgctcgagctcggcaatcttctcgtccaccttcttctgccgctcttcgaagagatgcaggcggtcatgataggtatcaggtccttcctggcaccattccatgaactgcctgatatcgcggatctcgagtcccgagcgcttgaggcactcgatcaccctgagggattcgagctgctcctcgtcgaagcggcggatgcctgaggtgcgctcgagaccagggatgagtcccatcttgtcgtagtagcggattgtcgagatgggaaggctgaacatctccgatacctggccaatcgtatacatgcgtatctccaagaatatatcttgacctgaagttaggtttagatattacaacagaatggcaaggagagagggaagatatgccgtcccgttcgagaaaggcctgccaatgcttggagatttcacctaccacaacccctgctgcgtccatttcggaccccatgccttggaagaactgccgaaagagcttgcgtcctatggacctcgtgtccttttgacgtatggcggagggtccgtcaagaggtctggcctctaccagaagatcgtagatatgctgcatgatgccggcaagactgtcttcgaggtctctggcgtcatgtccaatccgaccgcagacaagctccgtgaaggatgcgccgtggctcgggagaacgatgtcgacctgattctcgcggtcggcggcggctctgtcatcgacttctcgaagggcgtgagcgtgggcgcctggactgagggggatccctggaagcacctgtacctccatatggaagagcctgccggcaagatcattccggtcggcgacatcctcacgatgagcggaaccggcagcgagatgaatgcagaatcggtcatcacgaaccatgaagagaggctcaagatcggccatgtcttcggcgtggatgtgattccccgctttgcgatcgtgaatcccgagctcaccttcaccgtgcctgactaccagatgcgtgccggcatctacgatgccttcaaccacatctgcgagcagtacttctcggggactgatgacaatacgagcgactacatcgccgaaggcctcatgaagagcctcgtgcatgcaagccgcattgctgtgaaggatccagaggactacgaggcacgctcgaacatcagctgggtctgcacctgggcgctcaatacgctcattgcctgcggaaagtcgacggactgggaagtccacatgctcggccaggctatgggcgccgtcacagacgcgacgcacggaatgacattgtctgccgtgagccttccgtactaccggctcgtcctgccctacggtgttgcgaagttcgcacgctttgcccgcgaggtctgggacgtggatgcagaagggaagagcgagcgcgaggtagccgaggcaggactcgaagcgatgagcgcctggatggatgaaatcggcgtcgtgaagcatgcacgcgagctcggtcttaccaaagagctgattcctgctgccgtgaaggccaccttcatcctcgatgggggataccacaagctcacggcagaggaggtcgaagagatcttccgcgagagcctgtaggtccttctggtatgcggccagagcatagcaagcttcctgcatgggcatttcacatggctggcaggcggccctatccttgatgcaggaaacaaagagaaaggacttctcatggcaaaggcattggtggcatatttcagcgtgtcgggcacgacgaagcgcgtggcagagcgactcgcaaaggcgacaggggcagacctcttcaggatcgagcctgagacgccctatacgtcggcagacctcaactggcgcgaccgccattcgcgcacgacacaggagaagaatgaccgcagcatccgtcctgcccttaagggcacgatgcctgatgtgtctggctacgacgtcgtctatgtcggattcccgatctggtggtacacggcaccgaacatcgtgaacacgttcctcgagtcagctgatttctcgggcaagacgatcgtgccgtttgcaacctcgggcggaagcaatgcagcagcttctacgcgcgaccttgcgccgtctgctccgggagctcacgtcgaatcaggcgtgctcctgaatggcgcatcggatgctcgtcttgcgaagcttgcagagcagtatgcctaaagaggacggtctggatgcatccattgtccccatgatgggagcaacggatttcggaaggaagaggtggagcatgggagcgaagccccagcccggcacaggcggaaatatctatgtcccctatgaggaacgcacgggcaacgaatcgatcgtctatttcacccgcgatctttctgcccagggcctggcgcgtgcctatgagcaggtgaatggcaacatccacgggaaggtggggctcaagctccacaccggagagcagcatggaccgaacatcctgccgacagggtgggtcaagtctcttcgtgagaaggagcctgagcttcaggattcccatatcgtcgagacgaacacctactacgagggcgaccgctatacgaccgagcagcaccgaaagacactcgaggtcaatggctggacgttctgccctgtcgacattatggatgaggacggcgtggcagacctgccggttctgggcggcaaatggttcgacacgatcggtgtgggcgaccacatgctgagctatgactccctggtcgtgctcacgcacttcaaaggccatacgatgggtggcttcggcggctcgaacaagaacatcggcatcggctgcgctgacggccgccgcggcaaggcacagatccatacgacgccggggtcgtccaacatgtgggatattgccgaagaggagctcatggagcgcatcagcgagtctgcaaaggcgaccgtagacttcttctcgtctgagggacgctccatcaccttcgtgaacgtgctcaggaacatgtcggtctcctgcgactgcgaaggcgtccatgctcagccggtcgtgacgccgaatgtcggcatccttgcctcgacggatatgcttgcggcagaccaggcttcggtcgatatggtcttcgcgatgaagccggaagagaaccacgacctcgtggagaggatgacaacaaggcacgggctcaggcagctctcctatatgaaggagctcggcatcggcaatgaccgctacgtgctgatcgatctcgattacgacggcaggcgcatgagcgtcgaggaagctgtagccaacctcacgccgtttgcaggctagagaagcacttcaagagatggcaaagcggagaagcccgaaagcatgggcttctccgctttcttgcgtttccatgcgtctcttagcagaacctgccctgcttcctggcagcgagaaacgcctcatagtcttcttcggtctggtcggcgtaggcatgggcaaacgtgcagaaggcatcgtctgccgccgtgtcgcgtcccagataggaggcaatagcgaagcggtcgccggttcttgcgtgcgcccgggcaagcgtccagccgcagagggcagcaagatgtgtcaggcggtgggcatcgatcttcgtgaggtcaggcgcccccttgccgtcccagagctggcgtacgtagtagtcatgcatgcggccatcctcggcaggaagcctcgtccagcccagaaggaggtccgaggagacctggatggcgcgctgtccttctacgacgcgctgcccctgctcggcatagccgctcttcccgacatagcgctcgaggacggagggcacggcctccttgatctggagcacgagggagtcgtcagcatccgctccctcaaagacgcagatccaggccctgagaccgacagaccccacgcccacgaccttgcgggcaatatcgacaccgtggtaggagtcaaggagcgtcttcctgttgtcgggcagggaggcgcggtatcccttcaagatcaggcggatgagcctggctgtcgagtcctcatgagcgaacctcgtgtcctgggcaagctcgcgcatgatcgtctccttgaagccgttctcggagaccttcttctgggcgatgtcgcgcaccggcacgatgatgggcggatcgctcacaattctgagcttcccgtccacgacctccgtgaacttctggaccgcgcgggcgctgttcttgcgctctgccttgctgagcgtcttctcgaaggccttgcgctccgacttgccgcccacttcctcggcaagggccttcagatggtctgtgtctgcctgggcataccagacctcgagattgcccatctcggcaaactgtgccattgcctggtgataggtgttcacacaggcacgtacggccttgtcggtcttctctcttgagagtccgagtacacgggcacagacatcgacagaggctgcgagacgcttcaggtcccactcccagggaccgcgtgctgtctcgtcgaagtcattgaggtcgaagacgcgctgacgctccggcgttgcaaagatgccgaagtttgcgatatgggcatctcccgatgcctggacacgcaaaggcgtcataggcgtcgtggcaaggtctcctgccatcggaagggcacagcctcgatagaacgcaaagggatcctgtgccatgcgctcgtagcggatcggcaggagctccgggacgcgatcggctgcctggctctcgaggagtccgagcggattgggacgtgcctggctctttggcggccacatggcctggacctctgctggcacttcctcgcggagcttcgcaccatagatccttgactcgtcaggagtgcgctgctcctgctcgaggaatgctgctgcaagaagcgacgagatcttgtgcgctgccacattggcgagcgtgctcctgcctgcagacgtgcctgtctctggtggatcttctggcatatgtccctgccttcctctggagctccgtgcataacgactgtactcctcgaaggcatgaggtgctgccgggatgcatttccagttggtggcaggagagacgtgcctgctgcgagatgccagggcttgggctatggtagagccggatgcggatgagggaggatgcaatggatctggtacgcgatgaggtggcagagcttctgggaaagctgagctctgcgaagtcgccttcgggcttcgaggatgagacggtggctgtagcaaaggagttctgcgccggctgggctgacgtgaaggcgaattctttgatggatgccctgatctatcccaggagcttcagcggcacgaagccggtcctcatgctcgatgcccatggagacgaggtcggcggcatggtccgctcgatccgctcgaatggcgccatgagcttcgtcgagctcgggcgcttctcgccccacgtgctggcaggacaggatgtcttcgtgcgcacgacagaaggcacgtgggtccgtgccgtcatcggcgtgaagccgcctcacttcatgagcgaagcggagaaggctgccggcagagaggagctcatcctcgactgcggcgccacatcgaaggaagaggctatcaaacgcttccatatgggcatgggcgaacccttcgtgccggcgacgcagtttgaatacgacaaggagcacggcattgctttcggcaaggccttcgactgccgggcaggtgtcacggcaatgctccttgcactccgggagctctcgaagaaagacctgcccttcgatgtggtggcctcgatctcgtcgatggaggaggtaggggagcgcggtgttgccgctgcggtcagggccttccagccgaagcttgccttcatgttcgagggctgcccggcagatgacaccttccagcaagcagacgatatccaggcagcgctccacaaaggcccgatgtttcgctacttcgattgctgcatgataacgaacccaaggtatcagcgctacgtgctggctacggcaagagagcatggcctcaaggtgcagacgagcgtgcgcgagggcggcggcaccgatggaggccctgcacatatgctcgatgtgccgagcgtcgtggcaggagttccctgccgctatgtccatgcgggatgtgccatctgcgccctcgatgatatcgaggaagcggccaaggtctgcgtggctgtggccgaatcgctcacgccggatacggcagaaagcttctgacgggaagaaggaggcagagcctaagccctgcctccttcggatgccattgcctgcctctgcagcctatgcagtctgggcaagtgcctcctcgacaactgctgcgacggcagcgcagcagcgaccgcaatgggtgcctgcgccagttgcgcgctcgacatcctcgatgttccgcgcccccgttgccacagcctcgaagatctcgtctttcgtcgttcccatgcagggacagacgagcccctcctcgccggcgctgtagccgccaccgcggtggccatcacccatctcttcgtcatcgtgtcgatgcccgtgatgggcagcaccatcctctccatggaagtggccgtgctcaccgtgatggtggcgatgcttgccatggaactcatcgccgtcgccgtggtggtgatggcagcgctcatgttcatctccggctgcatccccatgatggtggcggcagtggtgctcgtctgcgccatcttctccatcgtggtggtgatggtggcggcaatgatatccggcttcggcggcatcttcgccgtgatgatgaccggcttcatggtggtggtcgtggcggggagcctctgccgttgtggcagtttcggtaccgatattctcgttctcttcgttcgtcttgttcgtatccataagatggattcctttcttcggaggcgggtcgatcgccttcaatgaagtgagcttgtgctgattggtctatgcggaagtggcattttggatgctgcaatgacagacttccagacggaaagggcagtgcaatgctggcacatgatgctgattccaagcagctatctgagcatagcgagaagccgctcgaggaaggggaatgcctttctgaagggaccagggcagcgctggcggaattcgatgcaatgaaggaatttccggagcgctacagacgctgccgctcgtttgatgagatgctgcaggacgtgcttgctggcaaatgaggcggtccgtctgtctttccgtcgtctaaatgtatggtaccttcctaattggtatatattgaacaggtaccgatgtaatcacaaatgagatgcattcctgaatagaaactgggacattgaacatagagagggccgggacatgcatcccagccctctctggcgtccgtattatgcgtcagctctggcttgctgccctagtcgaggccttcagtgccattcgacttgatgatcttctggtaggcgtagaaggaatccttgcggctgcgcttgtaggtgccgcttccgtcgtcgtgcttgtcgacgtagatgaagccgtagcgcttgcgcatctcgccggtgccagcagagacgaggtcgatcggtccccaccaggtgtagcccttgaggtccactccgtcatccactgcctcgcgcatggcgcggacatggctcttcaggtactcgatgcggtacgtatcgtggatggagccatcctcctcgaccttgtcgagggcgcccatgccattctcgacgaccatcagaggaatctggtagcggtcatagatctcgttcagggcaaagcgcaggccatccgggtcaatctgccagccccaatccgtgctcttgaggtaggggttcacgccgccgaacgtcatgtttcctgctgcctgcttcacgtcgtgcgtgccgacgacggagctcatgtagtaggagaacgtgtagaagtcgatcgtgccctccttgaggtcctcgagatcgccgtcctcgatcttgaggctgatatcgttctcgcgccagaagcgcttggcataggaaggatagtagcccctgacctggacatcggagcagtaccagttcatgcggcgcatctcggactcgtttgcaagcacgtccttggggtcgcaggttgcggcgtaggagaggatgaagcagtccatgttgcccatgcggaactgaggatagtgctcatgcgcgtacttcacgacgcgggcagaggccacgaactggtgatggagtgcctggtagcgctcctggggcgtcgtgtgcgcttcggaggcaggaccggagaagccgcggatcatggacgtctcaaagaggttgcccatgtccatcgtgccgcagttgatctcattgaacgtgagccagtagcgcaccttgtcgtgatagcggtcgaagacggtctggcagtacttctcgaagaagccgatgagctcgcggctagcccagccgttgtacttctcgacgaggtggtagggcatctcgtagtgggaaagcgtcacgagcggctcgatgccatgagcacggcagcagtcgaaaaccctgtcatagaaggcgaggccgagctcgttgggcttttcgtcgtcgccgttcgggaagatgcgcgaccaggagatggacatgcggaacatgttgaagcccatctcggcgaagagcgcgatgtcctcctcgtagtggtggtagaagtcgatgccgtcgtggttcgggtagagcacatcgggctcgatatcgaccgtgatcgtgcgcggcttgtccttcgtgccgcccgtgaagtggtcatcgacagacggtccgcggccgtccacgttccaggcaccttcgaactggtttgcagcagtagcgccgccccaatagaagccctccgggaatcccttgcccatagctttcctccttcttcctgcctgctcgtgcaggcatctccatcactttcaagcatagggaatgagaggtgcgtcctccaggttctgggcgcagaaggagacttcttttcgtctgaaggcagatggccacggcacaggctgacactttctgatacttttcttctgtggggaaaggagcgggacatggatgtcgtgcagaagatgcgggaggcagaaggcttcacgccgacagagcaggagctggcacatacgatcctctgcctcggaccgcgcttttcggactattcgatcaaggagctcgcacagactgcccactgctcgatcgcgacgattcaccgcctctgccgcaagctcggcctcgaaggcatgaaggagctcaaggtcgagatgctggagcgtgcccaggctgctggcacagccgacatcaactttccgttcggcgaaggatggacggcaggggaggtggctgcaagcatacgctccgtcttcgagcagacgcttgcccagacccagtccatgctcgatatgatgacggtcgagcatgctgcatccctcatctgcaacggcccgccaggtcgcctcttcacggaatcgcacaaccgctatccggcaagcatgttcgcagaccgcctgctctcggtcggaatcgatgcgcgcgtgcgaggcagataccgagcggcagattcgctgcgcccctctgatggggaaggactgtgtcgcgataggcatctcctactcaggcgtctccatggcactcgaacgtgcgcttcccgtgctctcagagcggggtgtcccgaccttcttgtggggacgcctgctgcagcgcgtctcaatcccggccttgacggctatctcttcgtgacgatgccgacgctaccagggcgcatcacgcagttcgcgtcgcatctgctgtgcagtatgtgctcgcacgctctattcgcgctcggtctgtgcgacatcctggcccagaagcatttcctaccctgagaagaccttgccgctcacgcgcaagccagcctcatcgacgattgctctcacaggctgcgggacgctgaggcttcatctctgtgccgcttctgtgcagtccgcaaatggctgaatttcttgctcacggtgtgcaatactacgcacacgtggcgcaattctgcacacactgtgaaaacagagcagaaaggaggccgcgagcgtgcctgaaatgacggctcagactgcagagaggcagctttcgctcgtcggtgcgccaggaccggcgcacgtgcgtagcgccaggcgctgcgcgacgctcttgcccgccagatcgaggagacaggagatctctcccgtgtcacggtcaaggcggttgccgatacggcaggcgtgacgagcgcgtaccttctattcgcatttcaaggacatcaacgatctcgttgggcagatcgaggaggagaccgtctccgaagtcggctgcccgtgaggaggctgcgaggacgaaccctcgacgagctccaggacgccatctcgaacttcgagccgtgcccggctctgtcgagctcctgcgagtacttccaggagcgcagaagctatctgccggcccttctgggtgcaggcggagatccgggattcgtcgagaagatcaaagaagagtctcgagatcgctgtcgggagtgccgaggaaggcatcgtattcgatatcccccaggagctcttcgactatctctgacattcgcgatatcggccgaggtcggcgtgctcctcgctgatgcgcaggcggcatggaagagccggcgcacctcatgctgcgtgatgaccgcgcctcatgttcgtgcgccccggtgaccctacgggcaagaattcaagttcggcgtgccctgcctcgacatctggcaagacctggcacagagaagaaggagatgcagaatgaccgagaatggcaattccgtccaggcggagcgcaatgcccactatgcgatgccgctcgtgcaggagggtgccgagctcaagccgaagcagcgtgccgatttccgccacgcccgtcttcggtctcggcatcgatgtcgctccacgacggtgaagctcgctgtcatcgacgagaacgagcatctggtctatgcaaactatgacgccaccacacggacgtgaaggctacggcgcgagtgttttccgcaaggcgaaaaggtcctggagatgcaaagatgcgcgttctcatcacagcctccggcggcatgctgctcgccaagtggctcggtgtcgagttcgtccaggagtgtcatcgcctcgaagcgcgctgtcgagtccctgatttcccgagacggatgtcgcaatcgagctcggcggcgggaggacgccaagatcatctacttcgacaatgggcatcgagcagcgcatgaacggcacgtgtgccggcgggcaccggtgccttcatgaccagatggcttccctcatggagacggatgccacgggaactcaacgagcttgccaagggtgcgacgcacatcttccgatcgcatcccttgcggcgtcttcgcgaagtccgacgtgcagccgctcctcaatgaaggtgcagacacgcgaggatgtggcagcatcgattttccaggctgtcgcgaaccagacggtctccgccttgcctgcggacacccgatccgtggcttatgtcgccttcctgggcgcccgctccagtatctctccgagcgaggaagcgctttctacatcacgctcaacctcttgaggagcacaggacgtccccagaacgcacacctcttttgtcgctacccggcgcagctcttgcgggcgagtccaccgataccgtgacgtttaaggagttcatcgacaactcgataggcctcggacaccaggggctccgaggtcgcacgtctcgaccccgctcttcaagacggagaaggactaccaggagttccttgcccgccacaccccaggtcgtgccgaatggcacgctcgcgggctttaccagggccgtgtcttcatcgccctcggccgctccacgacgatgaaggcagctgtcgtcgcgaggacggcgagctcctctacacgtggtagacaacaacaacggcgatgtctcggcaccgcccgcaagatcatgccgacatctatcaccatctgccgagctgcccgttgccatgtcacgacggaccttctacgtcgaggcttcctatcgaaaaaatccctgtcaggcagactaccggcatcgagacggtcgcgcctgcgtgcgccaatgcctcggccagtatgtcaacttctcctcgataatcggcggccaggacatgaagtgcctccagcttgaataatggcatcatcgagcacaaaaatcgccctgaactgaggcctgctcttcgggctgcggctccttcatcgcgaacttgcgctgactccatgggcatactttacagtgacttcgcgaagcagcagtccgcggcgagcacccgtcgaacctcggcatcgctgcacaatgtcttcatgaactacccgcgttcaagcgcccagaaggacgcgccacgtcggcgatgtcgcgccggcctttcctacttccttctatcaagaatgccctcttcaagggtcaaatcaagcttccgcgactacgacgagatcggaggtacgtcgtcgtccgggcggcaacgttcatgagcgacgcgacactcgtgcctgtcgagctcctgactggccgcgaacgtgatccgccggacatcgcaggcacgatgggcgcctacccgtgcgctacgccctcgcccgctaccgtgctggtgcagacggtgtctcccaccatcctctctcctcgcgaggatattcgacagcctcagtcagcacacgaacgcccactgcgcgctgctcgaacactgctgcctcatcaatccacctcccactcccttcggcaacggccccgcttcatcccgtcaacgctgcgagaaaggctccgtccagcctgtccaaggaggcagagcaaggcgccgaacctcttcgagtttcaagaatcaatctgctgttctaccgcgaatgcctcgatcctgatgcaacaccgcgcggtactgtctgccattcccccgcgccctcaaacaggtacgagaactatccgttctggcatgcgttcttcaccaagctcgcttctcttcatcctgtccgacaggacgacgaggaagacctacgatgcaggcacccgagtcgatgccgtccgagagcgtctgctaccacgcaaagccagccatggccacatcatgaacctcctctgacagaatccacttctctggatgccgtgcatccgctggagcgcgccgatgacgatacggcccgaccactacacactgcccgatcgtcatgtcctatccgcagccctgagctcaacactcgacgagctctcggcatccctcttcgattaccatcgaatccgttcctgccgtatgacagaagacgagcttcagctagctctacctagtctctctgtcccgacgcgaggaggtgctgccaagggcaaggcccgcttccgtggctcccacattacgcgcgaagagatcgaacaggccgtgaactaattcctggcaggcagacatcgacttcaaagaacgcgatgcacaagcggaacagatctccctgaatgtgatcgaggacaacgaccgcccaacggcatcgtcctcgcaggccgtccggtacccaacgacggcgagattcaaccatgcaatccccaatgctcatggcttcggtcgttctcgccgtgcttaccgagacccatcgccacaattggtttttcctttctgagcgccctatcccgcgtcatcgccatggattaccctcccgcctctacccgtgctgcacgctttgtatcgtgagtgaacgacctcgacctcatccgctccagactttcggctgcggccttgtgccctcacaccgacgagtccaggagatcctcgcgagagcatccggcaaatctataccgtgtcaagatcgcgagggttctcgaacctcggcgctgcccttatccgtgtccgctcctcattgccgccctcaaggaggatgcgtggccgagctcgacgcgagacgcggtgccggcaaggtgcatgaggtggcaccggcacgtccacatgggcagatggctcgctcgcagcatagcacaggagaccgatctcacccgccgtaacgccggtctataccgccgcggcaagagcgcgcctcaagaggcgctacacggaggagatgcaggacgaggggcttacaacccgatccctggcaccgcagatgtcctcctgtgcactttccgaatcgtcgaccaccttctgccctcgaatgctacaactgtcgtgctgctccctctgtcgaccacaaggcagtcgacacgggcctgaagtacgtgaacaacgacaatctgtctctaccctcgatccttgtcacgggccagatcatggagggcgggcctttcagcagtaacgactctcccgtacgtcgttcatgatctcccaaccggcggcggcctggccgtgcaacaactacatcgccctcagcagtgaaggcgctcaggatcgggtcaccccgaggtgcctgtcatctcggcttcggctgccacgaacctcgacgaagcaacccgggcttcaaggcgctcaagaaacccgcgcctgctcacgaagcttttatgcccttctctaacgtgcacccctcctcatgaaaagtgcacgtaaccgcgtgcgccccatgaggccaaggcaggggagcgccgacaggctctaccagacgtattctggagcgtgccagatccgctctccccacaacagcgcttcgccgaagccgttctaccgtctctgcgaggatacggtcaaggcgtttcgatgcgctgtccgctcgagaacgacgctcgaagtcccgtcttggttggttgtcggccgtcgcgagatcccgtgaagttccacccagaccggctgagggtaacaaccagttgtccgcgttccatcgagaacgaggcttgcgaggcagacgtcccggccttgtcgacttcttcctttcggcctctcgaccagatcaacatgaggaggagtctcggcaacgaagctacgacgagccgcctcagcgcacaagatcggcatcgatgcacatcgggcatgaggaagcctatcgacgagatgctcgaaaaggtcggagcgcttcgccgtatggctcgtcttggaagccttggggacaaaggcgaagaagtgctgtcgctctgcaaccgatgggccgagggctggctcctgacggccgagatgtgcgaacc

SEQ ID NO: 60 - DNA, 13751 bp, Unknown
  Metagenome-assembled genome
tctcgtccttccgtgttcgccttccttcccctttggttcgttgcgggctcgaagttcgcgatgaattatccgcagcccgaatagcgccgtcgtttcagtgaagccgttctatctttctctattaatgccattatctgtctacctttattccctatcatttccttgttccgtcctctctctcttatgaagttgacactctggcaacgaaggcctgtgcgccacgcaggtggcgcgacgtctcgatctcgccgagtctgcctgcagggcttcgatccggatgccctcagccgtaccgtcgtcgtgacatggccaatcgttgccgcccttccggcagagggtcttagatgtcgtccatagatcgttcgggcggtgccgagtcatcgccgttgttgttgtcataccacgtgttaggagctcgccgtcccctcagagaagttcctcactccctgcgtgccttcctcttcttttgcagtaccggcatcgatgcccgaatgaagacactgcccttagcctaaagcccatctagcgtgcccttcggcacgacctgtgcgtcgtggcgggcacggaacatcctggtagtccttctccgtacaacacaaacttgcatagcgggttcagagacgtgcgacctccaggagccctgcgtttctccgatgctatacgagctgttttcgattacctccttaaacttcacgtatcattttgactgcccgcaagagctggccggtagcgaccaagaggtttgcgtgtcttcggggaccttatcctgtgctcctcatcgaggttgagcgtgatttagaagcgcgtttcctcagcatcggagagatacttgtaagcgggccgcccctgatgcgacatctccacgtatcgtatttccgcagtcaaggcctaacctttctgtttttccttacatcctgtcaactcatatgctgtcccacatcctccatccttgcttccacttcatttctgtctccgttcttcccttcttcctgtctccctcctcctcgatccttttgttctctcttatatcgtttttcgtcctctcctagcgcccccccccagcccctttggtcgttgcactccgagcaagccgatctgccttccctgtcccgtctagtgacatgagtttgacgtggtttgcgccgggatattgttgtctccttcttattccttaacacatatatcatctctatgctttaagcttcatctatcgccgacctgtctgctggtccgttccccccgtgggttctctagactcgtttcacccttttcttaggttatgtggttctggttgctgtcgggtcatatcgtgggtggattggtcggcgggtctggtgggatatgcttgcgtgctcgcggaagtccgacctcccgctcctcaatgaaggtgcagcacgcgaggatgtggcagcatcgattttccagctgtcgcgaaccaacggtctccggccttgcctgcggacacccgatccgtggctatgtcgccttcctgggcggcccgctccagtatctctccgagctgaggaagcgcttctacatcacgctcaacctcgatgaggagcacagatcgtccccgagaacgcacacctctttgtcgctaccggcgcagctcttgcgggcgagtccaccgataccgtgacgtttaaggagtcatcgacaagctcgatagcctcggcgacacgcagggctccgaggtcgcacgtctcgacccgctcttcagacggagaaggactaccagagttccgtgcccgccacgacgcacaggtcgtgccgaagggcacgctcgagggctaccagggccgtcttcatcggcctcgatgcggctccacgacgatgaaggcgctgtcgtcggcgggacggcgatctcctctacacgtggtatgacacaacaacggcgatgtcctcggcacccccgcaagatcatggacgacatctacgaccatctgccggaaggctgcacattggccatgtcacgacgaccctacgcgagggcatcctgatcgaagccctgcagcagactccggcgagatcgagacggtcgcgcccctgcgtggcgccaaggcctcgtgccagatgtcaacttcactcatcctcgatatcggcggccaggacatgaagtgcctccaggtgaagaagtgcatcatcgagcacatcgccctgaacgaggcctgctcttcggctgcggctccttcatcgcgaacttcgctgactccatgggcatacggtacaaattcgcgaaggcagcagtccacggcgagcacccggtcgacctcggcagtcgctgcactgtcttcatgaactccccgtcaacaggcccaaggaaggcccacgatcggcatgtcgctgccggcctttccactctgtcatcaagaatgccctctcaaggtcatcaagctgcgcgactacaacaagacgcaagtacgtcgtcgtccagggcggcacgttcatgagcgagcgacactgcgtgccttcgagctcctgactggccgcgacgtatcaggccggacatcgcaggcacgatgggcgcctacggtgcagcgctcctcgcccgcgaccgtgctggtgcaacggtgtctccaccatcctctcccgcgaggagatcgacagcctcaaggtcaagcacacgaacgcccactgcggacgctgctcgaacaactgcctgctcacaatcaactccttcggcaacgcccgccgcttcatcacgggcaaccgctgcgagaaaggctccggcaagcctgtcaaggagcagagcaaggcgccgaacctcttcagttcaagaatcatctgctgttcgacccgcgaatgcctcgatcctgatgcagcaccgcgcggtactgtcggcatccccgcgccctcaacatgtacgagaactatccgttctggcatgcgttcttcacgaagctcggcttctcggtcatcctgtccgacaggcacgaggaagacctacgaggcaggcacgagtcatgccgtccgagagcgtctgctacccggcaaagctcagccatggccacatcataacccctctcgaagaatccggacttcatctggatgccgtgcatccgctgggagcgcgccgaggacgatacggccacgaaccactacaacgcccgatcgtcgtgcctatccgcagtccctggagctcaacatcgacgagctctcggatccctctgtcgagtactcgaccgttcctcctccgtatgacaagaagaacgagctcaagcgcaggctctacgaggtcgtctctgtccacgcgaggaggatgctgccaagggcaagggccgcttccgtgcctcccacattacgccgaagagatcgacgaggccgtgaactatgcctggcaggcactcgacttcaagaacgcgatgcacaaggcaggagacgatgccctgagtggatcgaggacaacgacgcccacggcatcgtcctcgcaggccgtccgtaccacaacgacggcgagatcaaccatgcaatccccgagatgctgcatggcttcggcttcgccgtgcttaccgaggactccatcgcccaaggttcctgtcgcgcccgatccgctgtcatcgaccagtggatgtaccactcccgcctctaccgtgctgcacgctttgtagcggagaggaacgacctcgaccctcatccagctccagagcttcgctgcggccttgatgccctcacgaccgacgaggtccaggaatcctcgaggcatccggcaagatctataccgtgctcaagatcgacgagtccgaacctcggcgctgcccgtatccgtgtccgctccctcatgccgccctcaaggaggagcgtgccgagctcgagcgcgagacgcgtgccggcaagtgcatgaggtggcaccggtcaacgtccacatggcagatggctcgctcgagcatgcaaggagaccgatctcacccgccgtacgccggtctaccgcgaggcaaagagcgctgccttcaagaaggtgcgctacacggagagatgcaggacgagggctacacgacctggcaccagagatgtcccctgtgcacttcgagatcgtcgaagccatccttcgctccgaaggctacaacgtcgtgctgctcccgtctgtcgaccacaaggcagtcgacacgggccgtaagtacgtgaacaacgacatctgctacccgtcgatccttgtcacgggccagatcatggaggcggtcctttcaggcaattacgatctctcccgtacggctgtcatgatctcccagaccggcggcggctgccgtgcaacgaactacatcgcctcatcaggaggcgctcaaggattcgggtcaccccgaggtgccggtcatctccttacgctgccacgacctcgacgagagcaaccggcttcaaggcgctcaaaacccgcgcctgctcacgaagctgtctatgcccttctctacggcgacctcctcatgaagtgcacgtaccgcgtgcgcccctatgaccaagggagggagcgccacaggctctacgacgagttcatggagcgtgccaagatccagctctcccacagcgcttcgccgaagccgttctaccgtctctgcgaggatacggtcaaggcgttcgatgcgctgccgcctcgagaacgaccgctcgaagccgcgtgttggtgtcgtcggcgagatcctcgtgaagttccacccgaccgcgaacaaccaggttgtccgcgtcatcgagaacgagggctgcgaggcagacgtcccgggccttgtcgacttcttcctgttcggcctctcgaaccagatcacatgaaggagctccggcacgaaggcgacgagccgcctcacgcccaagatcggcacgatgcaatcgaggcaatgaagccgatcgacgagatgctcgaaaagtcggagcgcttcgagccgttaggctcgtctggagcctgcggacaaggcgaaaagtgctgtcgctctgcaacacgatgggcgagggctggctcctgacggccgagatgtgcgacctcatcgagtccggcacgccgaacatcatcgtctgctcgccgttcgcatcctgccgaaccacgtcgtcggcaagtccgtgatcaagcgcctgcgccatgcacccctgagagcacatcgtcgctgtcactacgacccgggcgcttctgaggtcaatcagctgaacccatcaagctcatgatctcggtcgcaaaggagaacttcaagaatggacgctccgagagcttccatctcgagaaccccacgatccggtcacgaacgagagcatgctgccgcgtcggtctaccacaggcgccgcccgggcgagctcgaggattccttcgtgcgcgaaggctcgaaggcaacgggagcctatgcgtcatacggcgagacgacggatgctgacggcgaaagacgtatggcacaggagaaggtgccatccatctgaccctgagcagctcaggagtcgacgaggtaaagcgcaaggcaggcgtcctctaagggctcatccatagcttcaaggagaagggcaggctgcagagcctgcctttctttgcgtcgatgtgcggccgatcacctcgcgtccagaaggctctgccgactggagcgactagcttcgcccacacacgaagtcaggacaacggtcctccgcaccaggtgctgggggaccgcgtttcgtgtcgttgtctctcactcgacggcttgagtacgacaccgacagcaagaaaggcaggctctgcgcctgcccttctccttgaagctatggatgagccctagagggacgcctgcctgcgctttacctcgtcatctccttgagctgctcacgctcagatggatggcacttctcctggccatacgtctttccgccgtcagcatccgtcgtctcgccgtatgacgataggctcccgtgccttcgagccttcgcgcacgaaggaatcctcgagctcgcccgggtggccctgtggtaaccgcacgcggcagcatctcctcgtccgtgaccggatcgtcggggttcggtcgagatggaagcctctcggagcgtccattcttgaagtctcctttgcgaccgagatcattagcttgatgcggttccgctgctgtacctcagaaggcgacccgggtcgtagtcgaacagcgacatgtctcgccaaaccgcccccagaatgccacctatgttcctctttccagtctcttatgcacggacttgccgacgacgtggttcggcaggcacgcacggcgagcacgatgatgttggcgtgccggctcgatgaggtcgcacatctcggccgtcaggagccagccctcgccatcgtgttgcagagcgacgagcacccttcgctttgccgcaaggctccagatcgacgccatacggctcgaagcgctcgacttttcgagcatctcgtctgatcggcttcgccatgccctcgatgcatcgatgccgagcttgtgctgagagcggctcgtcgccttcgtgccgagctcctcttcatgttgatctggttcgagagccgaacagaagaagtcgacaggcccgggacgtctggcctcgcagccctcgttctcgatgacgcgacaacctggttgttcgcggtcggtggaacttcacgaggactcgccgacgacaccaacacgcggcttcggcggtcgttctcgagcggcagcgcatcgtaagcttgaccgtatcctcgcagagacggtagaacggcttgcgaagcgctgtggagagctggatcttggcacgctcatgaactcgtcgtagagcctgtcggcgctcccctccttggcctcataggggcgcacgcggtacgtgcacttcatgaggaggtcgccgtagagaagggcatagacagccttcgtgagcaggcgcggttcttgagcgcttgaagcccggtttctctccgtcgaggtttcgtgcagccgtaagcgagatgaccgcggcagcctcggggtgacccaatcctgagcgccttcctgatgagggcgattgtatttcgttgcacggcagccgccgccggtttgggagatcatgacagccgtacgggagagatcgtacttgcctgaaaggaccgcctccatgatctggcccgtgacaaggatcgacgttagcagatgtcgttgttcactgtacttcaggcccgtgtcgactgccttgtggtcgacagacgggagcagcacgacgttgtagccttcggagcgaaggatggcttcgacgatctcgaagtgcacaggggacatctgcggtgccaggatcgtgtagccctcgtcctgcatctcctccgtgtagcgcaccttcttgaaggcagcgctctttgcctcgcggtagaccggcgtacggcgggtgagatcggtcttccttgcatgctcgagcgagccatctgccatgtggacgttgaccggtgccacctcatgcaccttgccggcacgcgtctcgcgctcgagctcggcacgctcctccttgagggcggccatgagggagcggacacggatacgggcagcgccgaggttcgagacctcgtcgatcttgagcacggtatagatcttgccggatgcctcgaggatctcctggacctcgtcggtcgtgagggcatcaaggccgcagccgaagctctggagctggatgaggtcgaggtcgttcctctccgctacaaagcgtgcagcacggtagaggcgggagtggtacatccactggtcgatgacgcggatcgggcgctcgacaggaaccttgtgggcgatggagtcctcggtaagcacggcgaagccgaagccatgcagcatctcggggattgcatggttgatctcgccgtcgttgtggtacggacggcctgcgaggacgatgccgtgggcgtcgttgtcctcgatccacttcagggcatcgtctcctgccttgtgcatcgcgttcttgaagtcgatgtctgcctgccaggcatagttcacggcctcgtcgatctcttcgcgcgtaatgtgggagccacggaagcggcccttgcccttggcagcatcctcctcgcgctggacagagacgacctcgtagagcctgcgcttgagctcgttcttcttgtcatacggcaggaacggatcgaggtactcgacagagggatccgagagctcgtcgatgttgagctccagggactgcggataggacatgacgatcgggcagttgtagtggttcgtggccgtatcgtcctcggcgcgctcccagcggatgcacggcatccagatgaagtccggattcttcgagaggaggttcatgatgtggccatggctgagctttgccgggtagcagacgctctcggacggcatcgactcggtgcctgcctcgtaggtcttcctcgtcgtcctgtcggacaggatgaccgagaagccgagcttcgtgaagaacgcatgccagaacggatagttctcgtacatgttgagggcgcggggaatgccgacagtaccgcgcggtgctgcatcaggatcgaggcattcgcggtcgaacagcagatgattcttgaactcgaagaggttcggcgccttgctctgctccttgacaggcttgccggagcctttctcgcagcggttgcccgtgatgaagcggcggccgttgccgaaggagttgattgtgagcaggcagttgttcgagcagcgtccgcagtgggcgttcgtgtgcttgaccttgaggctgtcgatctcctcgcgggagaggatggtggagacaccgtctgcaccagcacggtcgcgggcgaggagcgctgcaccgtaggcgcccatcgtgcctgcgatgtccggcctgatcacgtcgcggccagtcaggagctcgaaggcacgcagtgtcgcgtcgctcatgaacgtgccgccctggacgacgacgtacttgccgatctcgtcgtagtcgcgcagcttgatgaccttgaagagggcattcttgatgacagagtaggaaaggccggcagcgacatcgccgatcgtggcgccttccttctgggcctgcttgacgcgggagttcatgaagacagtgcagcgactgccgaggtcgaccgggtgctcgccgtggactgctgccttcgcgaattcctgtaccgtcatgcccatggagtcagcgaagttcgcgatgaaggagccgcagcccgaagagcaggcctcgttcagggcgatgtgctcgatgatgccattcttcacctggaggcacttcatgtcctggccgccgatatcgaggatgaagttgacatctggcacgaaggccttggcgccacgcaggtgcgcgaccgtctcgatctcgccggagtctgcctgcagggcttcgatcaggatgccctcgccgtagccggtcgtcgtgacatggccaatcgtgcagccttccggcagatggtcgtagatgtcgtccatgatcttgcgggcggtgccgaggacatcgccgttgttgttgtcataccacgtgtagaggagctcgccgtcctcgccgacgacagctgccttcatcgtcgtggagccggcatcgaggccgatgaagacacggccctggtagccctcgagcgtgcccttcggcacgacctgtgcgtcgtggcgggcacggaactcctggtagtccttctccgtcttgaagagcgggtcgagacgtgcgacctcggagccctgcgtgtcgccgaggctatcgagcttgtcgatgacctccttaaacgtcacggtatcggtggactcgcccgcaagagctgcgccggtagcgacaaagaggtgtgcgttctcggggacgatcctgtgctcctcatcgaggttgagcgtgatgtagaagcgcttcctcagctcggagagatactggagcgggccgcccaggaaggcgacatagccacggatcgggtgtccgcaggcaaggccggagaccgtctggttcgcgacagcctggaaaatcgatgctgccacatcctcgcgtgctgcaccttcattgaggagcggctgcacgtcggacttcgcgaagacgccgcaacgggatgcgatcggatagatgtgcgtcgcacccttggcaagctcgttgagtcccgtggcatccgtctccatgagggaagccatctggtcgatgaaggcaccggtgccgccggcacacgtgccgttcatgcgctgctcgatgccattgtcgaagtagatgatcttggcgtcctcgccgccgagctcgattgcgacatccgtcttgggaatcagggactcgacggcacgcttcgaggcgatgacctcctggacgaactcgacgccgagccacttggcgagcagcatgccgccggagcccgtgatggagacacgcatctttgcatctcccaggaccttttcggccttcctgaacacctcgcgcgccgttgccttcacgtccgtgtggtggcgctcatagtttgcatagaccagatgctcgttctcgtcgatgacagcgagcttcaccgtcgtggagccgacatcgatgccgagacgaagacgggcgtggcggaaatcggcacgctgcttcggcttgagctcggcaccctcctgcacgagcggcatcgcatagtgggcattgcgctccgcctggacggaattgccattctcggtcattcctgcatctccttcttctcctgtgccaggtctgccagatcgtcgaggcagggcacgccgaacttgatcttcttgccgtagaggtcgccggggcgcacgaacatgagcgcggtcatcacgcatgccatgaggtgcgccggctcttccatgccgctgcgcatccagcgcaggagcacgccgacctcggccgatatcgcgaatgtcagatagtagtcgaagagctcctgggggatatcgaatacgatgccttcctcggcacgtccgcagacgatctcgaagactttctctttgatcttctcgacgaatcccggatctccgcctgcacccagaagggccggcagatagcttctgcgctcctggaagtactcgaggagctcgacagagcccgggcacggctcgaagttcgagatggcgtcctggagctcgtcgaggttcgtcctcgcaagcctcctcacgaggcagccgacttcggagacggtctcctcctcgatctgcccaacgagatcgttgatgtccttgaaatgcgaatagaaggtacgcctcgtcacgcctgccgtatcggcaaccgccttgaccgtgacacgggagagatctcctgtctcctcgatctggcgggcaagagcgtcgcgcagcgcctggcgcgtacgcaccgtgcgccggtcctggccggcaccgacgagcgaaagctgcctctctgcagtctgagccgtcatttcaggcacgctcgcggcctcctttcctgctctgtttttcacagtgtgtgcagaattgcgcactgtgcgtagtattgcacaccgtgagcaagaaattcagccatttgcggactgcacagaagcggcacagagatgaagcctcagcgtcccgcagcctgctgagagcaatcgtcgatgaggcctggcttgcgcgtgagcggcaaggtcttctcgaggtaggaaatgcttctgggccaggatgtcgcacagaccgagccgaagagcgtgtcgagcacatactgcacagcaagatgcgacgcgaactgcgtgatgcgccgctggtagcgctcggcatcgctcacgaagagatagccgtcaaggccgggattgagacgcgctgcagcaggcgtccccacaagaaaggtcgggacaccccgctctgagagcacgggaagcgcacgttcgagtgccatggagacgcctgagtaggagatgcctatcgcgacacagtccttccccatcaggagggcgcagcgaatctgccgctcggtatctgcctcgcagcgcgcatcgattccgaccgagagcaggcggtctgcgaacatgcttgccggatagcggttgtgcgattccgtgaagagcgcgacctggcgggccgtgcagatgagggatgcagcatgctcgaccgtatccatatcgagcatggactgggtctgggcaagcgtctgctcgaagacagagcgtatgcttgcagccacctcccctgccgtccatccttcgccgaacggaaagttgatgtcggctgtgccggcagcctgggcacgctccagggagcgcgccatctcgaccttgagctccttcatgccttcgaggccgagcttgcggcagaggcggtgaatcgtcgcgatcgagcagtgggcagtctgtgcgagctccttgatcgaatagtccgaaaaagaaaaagcgcggtccgaggcagagaatcgtatgtcagctcctgctctgtcggcgtgaagccttctgcctcccgcatctctgcacgacatccattgccgctcctttccccacagaagaaaaagtatcagaaagtgtcagcctgtgccgtggccatctgccttcagacgaaaagaagtctccttctgcgcccagactggaggacgcacctctcattcctatgcttgaaagtgatggagatgcgcacgagcaggcaggaagaaggaggaaagctatgggcaagggattcccggagggttctattggggcggcgctactgtgcaaaccagttcgaagtgcctgtggacgtggacggccgcggaccgtctgtcgatgaccacttcacgggcggcacgaaggacaagcgcgcacgatcacggtcgatatcgaacccgatgtgctctacccgaacacgacggcatcgacttaccaccactacgaggaggacatcgcgctcttcgccgagatgggcttcaacatgttccgcatgtccatctcggtcgcgcatcttccgaacggcgacgacgagcagccgaacgagcttggccttgccttctacgacaaggttttcgactgcctgccgtgctcatggcaacgagccgctcgtgacgctttcccactacgagatgccctatacacctcgtcgagaagtacaacggctgggctagccgcggctcatcggcttctcgagaagtactgccagaccgtcttcgaccgcttcacgacaaggtgcgctactggctcacgttcaatgagatcaactgcggcacgatggacatgggcaacctctttgagacgtccatgatccgcggcttctccggtcctgcctccgaagcgcacacgacgccccaggagcgctaccaggcactccatcaccagtcgtggcctctgccgcgtcgtgtgaagtacgcgcatgagcactatcctcagttccgcatgggcaacatggacgcttcatccctcctacgccgcaacctgcgaccccaaggacgtgcttgcaaacgagtccgagatgcgccgcatgaaactggtactgctccgatgtcaggtcaggggctactatccttcctatgccaagcgcttctggcgcgagaacgatatcagctcaagacgaggacggcgatctcgaggacctcaaggagggcacgatcgacttctacacgttctctactacatgagctccgtcgtcggcacgcacgacgtgaagcaggcagcaggaaacatgacgttcggcggcgtgaaccctacctcaagagcacggattggggctggcagattgacccggatggcctgcgcttgccctgaacgagatctatgaccgctaccagattccttgatggtcgtcgagaatggcatgggcgccctcgacaaggtcgaggaggatggctccatccacgatacgtaccgcatcgtagtacctgaagagccagtgtcgcgccatggcgagggcagtggatgacggagtggacctcaagggctacacctggtggggaccgatcgacctcgtctctgctggcaccggcgagatgcgcaagcgctacggcttcatctacgtcgacaagcacgaccgacg

SEQ ID NO: 61 - DNA, 5999 bp, Unknown
  Metagenome-assembled genome
attggaactaatatcgaagttaagcaagtccaagtcgtatcgttcggaacagcggaaactttcggtaccaaaattattcactgctgtagagtagaggaggaatgcaatatggatataccgacactagcaaaatatttagctaaacgcaaactgacattgaccagcgccgagagcttaactagcgggacctttcaaagccaattagccgccacaccacaggctagtcaaatttatccaggcggtttcatcacctacgccaccacggctaaaaccaagctactcggcgtgccggccgctttgatcgcaaaatatggcgtcgtcagtcctgaagttgctaaaagcatggcccaacaagcgcgcaaaattgccggtactgattttgcgttagcatttaccggcgtggctggtcctgataaattggagggcgtaatggtggggactgtttgtatcggcttagctaatccggaaacgacgttagccaaaacgtattattttcctggtgaacctgagtcagtaatgacgcagagctgccaagcagggattgatttattggtgcaatacttgcagaaatattaaaacgatattgccagctagcgtgaggcagcgtaaagttaagttattaattagctggaagctcaatatgcggatcaatgttttacaacacacacctaatgaaggacctggtgcgatcgcactttgggcgcaacaacaccaacatcaattgtatatctatcatccgtatcaatttcccaaattgcaagaacaaattagccacgcaataaatcccggcaagacagtattttcattgatattcatattttaaagattcaatctttagccagcggcagcggagaaaagctcttttggggtttggtaacctgactgccggcgtggtaagttgtttagcttggcttccactgcttggatatcactagggtctaaagtatccatggacaggcccttaggcacatcacgacggatcattcgattatgcgcctcatttgtgcctcgttctgaagagcggtaagggtgggtataataaaggtcggcaaccccgtcaagcaccgtccccgccgctgcgaattctgccccgttgtcagcggtaacggacttcatgatgtgcccgtattcttggcagatcttagccagttcgtagttgactgaatcggcgtcacggccatcaatcaaacgcaggatctgacagcgagattggcgctcgatcagcgttagaatgacactttcttggccgttacgtttaccgactacggtatccaactcaaagtgaccgaactcttggcgctgatcaatacttttaggtcgctcttcgatacttcgtccggccagacgcttatgcttgggtgaatggtggtgtttggtgcagcgccggtttttttcgagcagatcaagattacggacttcaagtagttgcgcatcgatatagtggtataacgtcttggtcgaaaccatctcctcaggttgatataagccttcaagtttagcacggcccaccgcggcatcaggcgaccaaccgtcttggtgaaaatgggccgtaaagtagttgataaagtcagcgacaccagcgagtttcaaaggtcgatgacaggacattcggttagcttcgtatttggcctgtgccgcttctggcgagtacttgcggtgatattgccgttgaccgttcacttttttaacttggtcgatctcaccacggcgtagttcattactgattgtttgatgacaaacgccgataactctagcaattgcgcggttagagtatccttggctgtgtagcgtggcgattctgccgcactcaaatgaagttaggtggtgacctttttctcggactgtggtattctgttcttgcatcaagacaataacctctttcatttttgtgttggaacatcaatgataacagagatttgtcttggtgttttttattttttcaattagctggatctaattggctaacttgattataaaacgcgcggaggttaaacaatgtcagaaaaaacaactcaagctagtcaacttgaaagcgccctatagaatgcggccgatgtcttacgcgggaaaatggacgcttccgaatataaaaattatttattagggttaattttttatcggtttctatccgagaaaaccttaacgacttttagtgattgggcaggcgaaactgaaaatgtcacccagaaatatgctcagtatatgaatcctcagtttgaattggaaggcgtctcggcgcagcccagtttagtggaatatttgcaaaacacgctcggctatttaattcaaccccaggcgttgtacaccaccctgattggcaagattcaagcccatacttttgcgttagacgatttatctcaagcacttcatgatctggaacagtcgacacaaaatctatcttcagcgcaagacttttcgggtttgtttgccgatgtggatttaagtagtaataaattaggcagttctttacaacaacggaaccaaactattagtgatactatgttagctttaaatgcgattgatcttatccatcatcaaggcgacgtcctaggtgacgcctatgaatacttaatcgcgcaatttgccagtgattccggtaaaaaagcgggtgaattttataccccgcggcaggtgtccgacattattgcccagatcgtgacttatcagcataatgcgggtgaccaccaagtgcggactatctatgatccagcagttggttctggttcgctgctgttaaatgtcggacaacacgtgtaagaacctggtttagtgagttatcacggccaagaactgaacaccacgacctttaacctggcccgaatgaatttaatgttacatggggtctcgtatgacgatatgcatttacgcaatggcgacacgttaagtaaagattggccggttgacgaaccttacttatttgatgcggtcgttatgaacccgccctactcggcgcactgggataacagtgacaaacgcttgtctgatccccgcttccgcgactatggcgtcttaccgcctaaatctaaagccgactttgcctttctgctacacggcttttatcatctgcaggagcatggaactatgggcatcgtcttaccccatggcgtgctatttcggggggctaaggaaggcaaaattcgccaaaagcttctgctggataaccggattgatgccattattgggctaccgctaatatttttcattccaccagtattccaacgttgatcatgattttaaagaaacataaaaccactgataacgtcttgtttattgatgcgtcacgggagtttgaaaaggacaagaatcaaaataagctaacggcagccaatattcaaaaaattgtgaccacttatcaaaaccggcaagatgtcgataaatatgctcatgtggcctcaccggcggaaatcaaggagaatgactacaacttaaatattccgcgctacgttgatacatttggaccggaacccgagattgatctgaaccaggtcaaagctgatctaaagcaactggacgaggaaatcagtcagaatgaacaagcctttaatgaattagctagccagttagtgaccacccaggttaatgatcagtcaaaaccggaggctcacaatgaaagataaccaagctaaatatccgcaattaagatttaaaggtttcactgatccttgggaagagcgtaagtttaaagataatatagtatctatacaaacagggactaatttattaggttctgcagttaacgaaggaaccccattgataaagatgggaaaccttcaaagagggtatttttctttcaagaagcttgaataccttgattcaaatagtaatgttggatcggaagatattgttaattacggagattttttgtttaatacaagaaatactttggaacttgttggtaaaggtgctacatggactggaataagtggtaaatatgcttttaatagcaatatagctcgctttaaatttgatggaattgatacaatattctttaactatttatataatacccaacaagttatctcccaagttcacgcaagagcggttgggacaaccagtgtatccgccgtgtatccaagagatctaaattcgttattatattacttacctagtattgaagaacaacaaaaaatcggttcattcttcaaacaacttgatgacactatcactcttcatcagcgtaagttagctatgcttaaggaacttaaacagggctatttacagaaattgtttccccagaatggtagtaagttcccgcaattaagatttgcagggtttgctgacgcttgggaacaacgtaagcttggagagcttggattgaatatttctgatggagactggattgagaagcaacatattttcgagaatggacagtatcggataatccaaaccggtaatattggtgtggatgagtacctcgataagccacaaaatgcaaaatattttcgtcaggaagactttaaccaattaaaggcaaatgaaatatttccaggcgatattgttgtttgtcgcttagcagatccggcaggtagagccgtgattttaccaaacatcgggaaacagatggttacttcagttgatgtcgcaattttgcgtcctagttcaaagatctcatttcgatttttggtttcacaactaaataatcctcgtaacctcaagcaagttcaaataatggcatctggctcaacacgtactaggattagtcgaaaaaacctagaaagggaaatcattcagcttcccaacatcaatgaacaaaaaaagataggaagcttcttttcaattttaaatagtaccatcgctcttcatcagcgtaagcttgaaaaactccaagaacttaaaaaggggtatctacaaaagatgttttgctgattcttaatttgatcaaatttaggatcctatgaaaccccatgacttaatttttattgtgcttggtcaacacttaattcacctgtataatggattacgcaggaagttttaagggcggtggctgtcttttcccttgcgaggtgaggcccatgggaacatggaataatcttcaggaaggtttcacagtcaatgagcgtcttccagacactctctcgttgatgttgctatttgcaatgtttattttagcgttgctaacgtacatcgacaaaaggaacaaataaaaaagccgccctgcgtaactttggccagttacagggtagcttaatgctgtcttattaacttcgccaccgctttgaagcggcttgcatgggaagtcctgttctagcggggcttccctttttctgtttacattatagcatgactttaattaactttcgaactattttaatcagctttctagcgtttttgggaacgtatgtttgctttttgcgctacaatacaggtaaaagctaacggaagtgatctaaatgttttttgacgatgaaaccgcatggcgtgttcttcttaatcgataacaagtccttttatgctagttgcgaagcggttgcccgggggcttaatcccttaaaagtccccttagtggtccttagtgaagctgaaaacaccaatggtgggcttattttagcacgtcacccgaagctaagcatgtatttcatcttaaagccaatgtctcccgtaaacgtgacttccccaatgaccccaggctttggtcgtgccaccgcgcatgaaccttttatattcacgtaatttgcaatcaatcagtcttcatcacaatttaccactgaaaaagaggtttggccgtattcgattgatgaaagcattcttgatatgacccatacttggcggctgtttggcaattccattcgcgaagtggcccgcttggttcaaaagacagtttcggcaaaagctaggcttgtataccaccggggaattggtgacaaccggtgcaagctaattagccttagacctttacgctaaacataatcatgaattgatcggtgaaatccattacgaactgtgccagataagatttggacaattgacgaattaacggacgtttggggattggcccccgt

SEQ ID NO: 62 - DNA, 9775 bp, Unknown
  Metagenome-assembled genome
caaactctttagagatagcttttcgaatataaataaagaatgagaatgctaataccaagtagacaataatcaggggaaaaaattcccccgacatgtcgtaatgctattctagatgtaaaaccgaacgaaacttctgctgagacactttcacaagattgctgacaactgaaaggcatgaagttgcatcagcaataaccccatacaatgaataatggaaaattttttatcgtcaaacttaaagctctaaccatcgataaaacataggagtccgatagcgcacgcacacatcattagcaaataaagcgtgctacaacagtacctagaaacagcacttaggataacatcataacgccgttcaacacgagcttaattgtgccatatgtaaagctggcccattccaaaagatccaatttgatcgagaatcacagatatcaaataggatacaatgaaagtgtagcattccatacaattaccgttaccggttccaactcattaaaaaactacgccaaaaaccagtgctaaactgcacaccacagcagaccacccatagatagccacgaggtttgccaatgactaaaattaaggtaagcaaaaaatagaaatagccaaaatacttccatgcaatcacaccgttgttttcttctaagtgcattttgttgcagccttatcttcatacagtttggatggcagacacagatttcctcaactttaacagttgatgtgtaaattcaagggaaactgttataaattttgaattcaatgatatgtgctgccacttgccatcttttgtgtgcatctactaatccccgccagtttgtatacgttcatatgatagaaagtggttggttgggttaaaatcaaaatgatctaaaattcggcaggcacgcattttaaccgcaagataacatgtccgaaatttcaaggcgacttgcgtcgcccattgctttgataaccatagcataatcttataattcattttttctctccttgaacacatgttctatcgtcctatatataatatagacatcctctattgttgtcactctaaatcaaaggatctgatttatgacagttaaaaatgaaacaactattgataattggcggtagccggacgccggtaatttcagcggcaatcagcgtaaagagtagtgagcctacactacaagttaaaataatccttgcgacgaataccctaatttatccatattgttggttttcctatgctgctattcgatgaagtaccagattggcattcaactttctcaccgtggctaaggaagctagatggcccttggaattgagtttgaacttaaaccactttagttaactcaatatacgcagaaaatcattcgtgtcagtgttcgactcgaatggtggctgttacttataatattaataaatgtatcgttgccacgggacaattcctaaagtagcgctttttcaaggtttttcatttaatgatcccaagaacaacaatagtaacgagttcacgttttaccacaatgtctgattatttgtcgtgtagaatacagcatctaacaaaagctaaaaacaccgggcctcatcggggctgggtatatcgtgttgagatggccgagctggtacgacgaaattaaacgtgcgctatatcacgtagtaatgatctttccacagtggaaaatgatttggatctatggctcaccagaactacacaaatcgagttagacagtactgactcgaccgcctaatttttgagtgttttgttagcctgctactagtgtaaaatttaaatctacagatttgggcatatacctgatgaacgactcgtttgatacggtccttaatttgttactgggttcagcccatacgcaattattagaagtagccttggtcccagactggtgcggccgggcaatttcagtttatgaattcatgcatacgactttccagatatctgggccgccgtgacttggtttgagctgaccatagattacttggaaaaaacataacctacccttaggactactgccacacaacaaggccgataccggatgaatgtcgtggggggcagcgatgccggtttagggggatcgttggaacccaattataagggttttcaatttaagttcgtgctagaactgggctattgccttaaagacagataaaacgctgtttttctctactgttatccgtacaagtacagtgttcgaccataactcatattttccaaatggcagataaaactcacattaattaactggctgacaaagaaacagacttgcctacttggttgccacgttattgggaactatggaagtgagattgcaaaacgaaatgaatattttttgcaaccgcaattttcaataaaatgactattaatgatctaacgacttagacttacattcaccgccaattgcgtcacgcttgggaccccctgttcacagtcatcaccagaattgggagctgtgttcgacaaatctaaataagctcattaaagcagtctaatataacaacaagcatccaacctatgaagaacttagaagttgcaaaatcctcttgagtaaaacaataccaaaacgctaagatcccattacatcgcaacgctatgatgataccttagcctttaatgtcatttctattgcggcgcttttgaagatctcaaacagtttttcaaccagctggccggaagtagccttaaaaccgtttgccatattggaaggtacctgggcgctattgagatccagtacggagaatatgagaacggcattaaagatctcgtagatatcaacctggtgtggatcgccgttgcatgggccacagcttctaaatcatatcgattagttcaattgggttaccgggtaatgtcgcttggatagctaattcattcttttaatgaacttatatcaaaaaactttcagctagcaaatattaaaaacaagactctagactttctaactgattgctgactcccttggcgtttcatcaaaccaaatataattgccatcatattgcattcttcggactgtttgggttatgggtggcccaaacacaaaggtgccccatcgcactagcttgtttttgctggcactagcggctaggacccatcgctggcaagttctcgccgcaagcagaccgataccttgactgaggtttcgactgctaatctcattggcagtttgctccttactgaaattttggtaccaaaaatcattagaatctgtctggtgttgaggtatcatgttgtaagatttgcaaacctgtaccgaagcaaaatgttatgaataatttgtaatgtaaaaaatgttttgttaataaaacaacctattaattaggagtaattatgaaaaatcatttcatcatcacaacttagcttttattgtgcttggtcatacttaatgtcacctgtataagagattacgcaggagttttaagggcgggtggctgtctttttcccttgcgaggtgaggcccatgggaacatggaataatcttcaggaggtttcacagtcaatgagcgtcttccgacactcctcgttgatgttgctgtttggcacgtttttatcgcgttaaatcgcgctcctcactatatcgacaaagcaccacaaataaaaaagccgccctgtgtaactttggtagaggtcacaggacgagctaaaatcgttttattaaattctgccaccgcctttgaagcggctgtatgggaagtccttgttagcgcaaggcttcccttttctattacattatagcatgaccttaaaaactggtaacgtttctgactttgatcaagtcggattctggttgtttgatctccggattgctgtttcagcaaatgcttgcagttgtttttgagttcgctcactgatttcttgggtgcacatcgtttatactgtttttttaaattgtgctttcctgttgtggactagttgcttgttagatttgttgttgcaagccttgataggactttattaagatcatgggctatagcttttttagatcatgctcaggttctttggtgcttcttgtaagcctaattgtttggttcgccatcactaatcatcaatcaactttgttgctcacttgcggggatctcacttaagcctatggatcacggctttatctttagcccaggtggccacgtaccgagtgagtatttgctgtatcaaccaatattttgcatggcaacatacgcaaccgcttcggctttggttcctgataggctcgtggccgatctttaagctgattttaagccgtgtagctggctatgcgcatattcgtggtataacgtctttaggtttcaaagcagttgtcgggctctcgccaccaatgacgatttcattagtgctgggttgaaatacccccttagccccattgcgtcgcaaactcaccttcactgactttcaggtcggtttgctgattcaaataatctttgaacgcgtttatagcttgtcacatctgatgatcgccaaattttctttgacaaagtctttaggcacttacacgggtcaccgctagtttgtgccacatcaagacgggtagatagcgataaccgacatggcgcgctcatcggtggtacaagaggcttcttttgctcgggctgtgttttactcttaatgatcgggccgcaatccgaatcgcttttgccccggttgacggtgcgttaaaaccgtctgccattgcttaaaccgcgacttgattgcttgaggattttgcgcataaataaaacaagtttctggcgctataacgatgaaattagccagggtattgagatactttttaaattggtcactatcagttaattttagatttgctttcatcctgggcgactaattgtgctttccaagcctaacatctgctttatttggcatagtcccctcctcatcttcaaaaatatcattcaatgttggcaatgatcttatttgaattgaggtcgtgccataagggcaacgtacctcgcaatttttgccaagccacttgatataagctctttaccagtatttctttaaatacttgtaggttcctttagctgcaaaacgtgtattcactcccaaggacttctaattttatccattatgatccctttgctttgctaatctcacccgttgttggtttacttttggtttaaaagtgaacctaatgacgggttcaccaaccgaacgtagtgcagggcggtaggcaggttctaatcaaatcaaaacttaatttatggccgtcaagctttaacttggcgtcaaacactttccttttttgctcttgaaaccctttattgctggtttccccttggtgaccaggcttatgcggtcttcccgagggtcttactctccatttcttggagggtaaatcttcccttgcttggtttacaataaaacttctgtttatttaaaacggtgcttggggtgtttctaagaagactcggcggctttggtgcttgctgttggtgattatttgttgcttaatggctgcattgccggttaattgtgtgggacatcatcatacttcgccacaaacttcttaattggctcaaaaattatcggggggtgcgttcttcggtactgattgctgtaagcttgctcccatttagccgtcatttctggactagttagcaagggttcgagttcaaccgctttacataaagtaatccggcttcactgacgtgagattgttcttttcagtaactaagcccgtttctttaacacttccagcacattggcccgggtgcacttgtcccaatgccttgcactctttagaatcgctgggctcttcatcatcaagcgttttgccgcgttctcatggcgtaatcagggtaccttcggtaaagggtaccggaggtgttgtttcttttgcggcgtttgcagattgcttgaacttggtcgccttggtgaacgagcggtaaagttgctctctttttgctgtcggctttgttcatcaaataaagcttgccaaccttgcttagttgggaccttaccggttgctttaaaattggcgtcaccaacttgggtataatgtagttttcctcgtactctacggatcacaaacatcgctaacgtcgttcttaaaaccaagtcatagacttgttgctgtaatttaggaaggcagctatttctttcgtcggacgattttagtcatgataatggcgtagtgttcttcaacctttttccattaacatagcgctattgggggtattggttaaagcgacttgttagagacaccccagatacttcgtcagattagccactaaatactcaaattcttcatcagtgattaagcacaatcggtgcggggataactagagacttggcttctataaacttgaatggccgctaagtttgctggcgctggcgtgataacgtttattcatgcaagctaactttgcagaaaggctcagctggtttttggttggaaccagtctaaaaacgtgctagtccctactttctaaccgttcagagtgcatgaataaacgttatcacgccagcgccagtcaaacccttagcggccattcagagttttatacgaagcaagtaccttaagttatcccgcaccgattgtgcttcatcactgaatgaagaatttgattttagtggctactctgacgatatctggggttgatctctaagaagtcgcttttaaaaccaatatcgcccctaataagctctatgttaatgaaagaaggttgaagaacactactccattaatcatgactaaaatcgtcccgacgaaaagatcaattagctgccttactaaattaaagcacaagaagtctatgacttggtttaaaacgacgttagcgattttgctgaccgaacgagtacgaggaaactatcattattaccccgattggtgacgccattaattttaaagcaaccggtaaggtaccaactaaccaagggtggaaagctttatttgatgatcacaaagccgaccagccagaagcagcaactttacccctcgttcagcctggcgatcaagtccaagcaaacctgcaaataccgcaaaaagaaacgaccccaccggtgccatttaccgaagggacattaatcacagccatgaagacggtcggtaaaacacttgatgatgaagaagctcaagcaattctcaaagacgtgcaaggaattgggacaagtgcgacccgggccaatgtgcttgatgtattaaagaaacgcggctatctcgtcactgaaaagaacaagctacacgtcagtgaagccggaattactttatgtaaagcggttgaactcgaacccttgctaactagtccagaaatgacagctaaatgggagcaagcgttacagcaaattagtaccgaagaacgtaccccggataactttttgaaccaaatcaaaaagttcgtggcaaagttgatcgctgatgttcccacgcaattaactggcagtgcagccattaagcaacaaatcgatcatcagcagcaagcgcagacagccgccgaagtcttcttagaaacaccgcaagcgaccgttttaaataaacagaagttttacattgtgaagcctaagcaaggcgaagactttaccttacccaagaaatggagcagcaaaaccctcggtaaaactgcaatcaaagccttagtcaccaagggtgaaaccagcaaattaaagggtttcaagagcaaaaaaggaaagtcgtttgccgccaagttaaagcttgccggtcataaattaagttttgatttcgattagaccttacctaccgcccgacactacgttccggttggtgaacccgtggcttaggttcactttgataaccccaaaagtaaacctaaacaacgggtgagattagcaaagcaaaggagagcatgaaatggataacaaattagcagtcattgggagtgaattaccggttttgcagactaaaggagcctacaagtatttaaaagaaattactggaaatggggcttattatcaagtggcctggcaaaaattagccgatggctacgttgccctttatgccacgaccccgattcaaatcaacgtagcccctatattgaatgatatttttgaagatgaggaggggtaacttatgccgaataaagcagatattaaggcttggaaagcacaattagtcgcccaggctgaacaacaaattctaaaattaaccgatagtgaccgatttaaacagtatcttaataccctggctaaatttcatcattatagcgccagaaacattgatttgatttatgcgcaaaatcctcaagccactcaagtcgccggttttaagcaatggcagacggcttttaaccgcaccgtcaaccggggcgcaaaagcgattcgaattgcggccccaattattaagaaattgacacccgctgagcaaaagcgatttaataccaccgatgaacgggctattgtcggttatcgctacctacccgtctttgacgtggcacaaactagtggtgaaccagtgttaagcgctaaagactttgtcaaaggaaacttggctgatcatcagaatgtaacgagtttgtataatgcattcaaggactatctcaaccaacaaactgatcttcaagtcagtgaagtgcctttagcgacgctaaatggggctaaggggtattttcaacccagcactaatgaaatcgtcattggtggcgatgagcccaataatgctttgaaactaaagacgttatatcacgaatatgcgcatagtcagttacatgggttaaaatcagcctttaaagatcgcccacgagcctatcaggaaacccaagccgaagcggtcacatatgttgccatgcaaaatattggggttgatacgggcaattactccctcggttatgtagctacctgggccaaagataaagccgtgatccatagtgctttaagtgagatccagcaagtgagcaacaaagtgattgagcttagcgacgggttaaccaaacaattaggcttacaagaagcacaaaaagaacctgagcatgatctaaaaaagctatcagcccaggatcttaataagtcctatcaaagcttgcaacaacaagttcagcaaacgactaattcacaacaaaaagcacaatttaaaaaccagttacatgagatacacgaagaaatcagtaatcgaacgcaaaaacagctgaaagcctttgctaaaaagaatccagaaattaaacaaccagattctgaacccgatcaaagtctaaaacgttagccagtttttaaagggcatgctataatggagacagaaaaaggaagccctgcgctaacaagacttcccatgcaagccgcttcaaaggcggtggcattagttaactaaacgatactgtcgtcccgtaactcgccaaagttataatcggggcggcttttttatttgttccttttgtcgatgtatgttagcaacgctaaaataaacattgcaaacagcaacatcaacgagagtgtctggaagacgctcattgactgtgaaacctttctgaagattattccatgttcccatgggcctcacctcgcaagggaaaagacagccaccagtgaagtgcggtttctgtatcacatttaaaaatattttgcaattgcaatccacaacgcggagacgccggactatggtgggtgggataggagcagggggtgaagaggggcaaaacgggaccagagcaaaaggagagaagggaagggggacacataaatggtgtgggtgtatagaactcagctggggcgggcgtgtggggggtgggcggaagtaaattaggagtaatgaaaatcatttcatcatcagcaaccttagcctttttatggtgctgtttgttccatacttaatcacctgtagacgattacgcaggagtttttaagggc

SEQ ID NO: 63 - DNA, 18371 bp, Unknown
  Metagenome-assembled genome
tatagatggcagaacagatcatattggtctcttcgggggtcgtgagattcagctcatctagtaccgttcgggcgagtgctgcgcccctgtgggcatggtcgctatagctgcccgtctcataagctgcgagatcatgaagcattgctgccatagaggcaagctcagcgttctgcccgcgcttctcggctatgagggtcgccgcaagggatgccccataaagatgtacatatgcgcttctcctggtcttctggtccagggcatcaagcctggcatcgacataagccctcagctgcttgagacgtgacatggtgcctccttaggacgaatatctccttgtatcgtacgctgaagcaggaagagggggcagcggtcccggcaaacggctgcaaagccttacaaggcctttggggctacgttcgccctcagccctgcatgtccgattgctgatggggtatatcatgtcatcggtcagctaacccctgagatctatgaggtgattgcagtggcacgtatcggcgcactcgaagcaggcggcacaaagatggtcatggcaatcggcgatgaggaaggacatatcctcgagcgcgattcggtcccgacgacagctcctgaggagtgcgtacctccgatggtcgaatggttccgtgagcgcaatatagatgctctcggtatcggtgctttcggaccgacctgcgtcgaccccgcaaacaagctcttcggctccatcctcgagaccccgaagacggcttggcggtactacaacttcaggaatgccttcgtggagggcctccatatccctgtcggctatgatacggatgtgaacgttgcctgcctcggagaggctgtctacggcgccgccaagggtcttgactacgtcgtctacgtcacgatcggcacaggaatcggtgctggcgtcatggtcgaaggcaagctcatgcacggcatgatgcatcctgaggccgggcacatccttctgaagagggatcctgaggatacagctccgagcagctgcccctatcatgatgactgcttcgaaggccttgctgccggacctgccatccagaagcattggggaaagccggcagctgagcttaacgacaatccgcgcgtctgggacctcgagagctactaccttgcccagggcctcatgacctacattctctgctactcgccgaagaagattgtcctcggtggtggcgtcatgcaccaggagcagctcttcccgctcgtccgcagcaaggtggcgcacatgatgaacggctatatcgtgacaccccagatgcaggatctcgacagctatatcgtgtctgccggctgcaatggcgaccagggcatcctgggctcgctcgagcttggcaaggaggcgcttgccgaagcataaagcaggactgagacagtgcgagatggagcatgcccgtaccggaaggtgcgggcatgcttatccttatctagactatctagatggcaagcgcgatgatgagcgatatgaggccaatgcctgcaagcgggaggcacccgcagacgaaggaggcgagcggtgcaagctcgtagtactttacatagcagacaaggctcaggaggaagccgatggctgcaagaatcgtgatgagcgcggcagaagcgatgcggtcctgcgctacgagccctgcggcgcagaagagctcgagtgccagccaggcacagaagaggacaagctcggtcgtagggacccggctgaagaggcgctcggttacgaagagcaggaccatgtagagcacgatgcctcctgcaagcgcgatgatgccggcatggggaggagcgaggatgcctgcaccctgggcaatgcgcgtagcgcccagagcgcccaggatgacagccagaatgatggctgcgataccgacatagcggagcggacctgtggcttcctggcctcccaccttcggccagaagaagattgcccaccaggcaagataggcgaggcagcatcctgccatctgtgcgtggccgcacctgattgctgccaatgctgcatccattgtgtgcctccctgcaactgcattctgccttgtaccttagcagcctttcgtgaaacttcctgcgcatttcgcgcatgcctgcttcccatgtcatcttcctatttggcaatgtgcagtttgcgtaacaatccgcaaacatagtgtacgggccagcaattggcacaattcagcctgccagtaggtgtattctcagcacggtatgtgcgcacggggcgcacttttgtgcgattgcaggaaggcgcggggagcgcccagatcctgcgtatcgaagggagaaccatgtcgaaaggtatcgtttcgtcttcgctgtcccgccgtcagttcctcggcttcgcagccgcaggcgcggctgcagcagggcttgctggctgcggcaactccagctcgagcagctcttcttcgagcagcgagtccaagacgatcgacacgctgcacgttgcattcgtgccttccaaggatcctgaccagatcatcacggctaccgatcctctgaagcagatgctcatcgatgagctcggcaaccagggctacaccgtgaacgatgtcgacatcacggtcggcacgagctatgaggcagtcggcgagggcctgacctccggtaccatcgacgtgggcttcattccgggcggcacctatgtcctctactccgatggctgcgaggtcctgctcaccgctacgcgcaacggcctttccatcgactccgacgatccgaaggactggaacgaccagaagccgaccacggcatccgaccagcaggtcacgttctaccgtgccctcctcatcgctggcccgagcgatgccggcaaggctctcggcgacaaggtcaacaatggccaggagctcagctgggacgacatcaacggcgccaactggtctgtcatgagctcgagctctcctgcaggctacatctatccgtgcctgtggctcaacgacaactacggcaagacggtcctcgacctcacgcatgctgtccagtccgactcctacggctccgccttcgcacgtctcgcttccggccaggtcgacgctctatgcgtctatgctgatggccgtcgcgactatgagtccaagtggacgtccgactacagccgtaccgccagcatctgggacgagacgaatgtcatcggcgtcacgaagccgatctacaacgacacgatctctgcctccaaggcctccaagacgatgaccgacgacttcaagaaggccttctcccaggccatgatcaacatcggcaacaccgatgaaggcaagaaggtcattgccatctacagccacaacggctatgtcgaggcacaggactccgactatgattccgagcgcgaggctcaggaaatggtcaagaagctcaagtcgagctccaactcttaaggcattctgaacgcgtcggtaccactcccggtggtccggcgcgtttttccgaacggggatgcgtctggcatccccgtttgcatgcaggtctcatgacaggatggatagatgatagagttctcccatgtgtcgatgcgctacccgaacgggttcgaagcgctcaaggatgtcaacctcacgatcgaggacggccgcttcgttgcaatcatcggccgctccggtgccggcaagtcgaccctgatccgcacggtcaaccgcctgaacccgatcaccgagggcacggtgaccgtcaacggcaccgatgtcggatcgctcaagggcaaggagctgcgccgcttccgccgcaagatcggcatgatcttccagtcgttcaacctgatcacccgtacaaccgtgctcaggaacgtgctgaccgccttcgtgcctgatatcccgtggtacagggccctgttcggcatcttcacgaaggaagagaagatggcggcactcgagtccctcgacaagatgggcatcctcgacaaggcctacgtccgctgcgaccagctctcgggcggccagcagcagcgtgtcgcccttgcgcgcacgctgactcagaaccctgagatcatccttgcagacgagccggtcgcttcgctcgacccgatgaccgcccgtcaggtcatggacgacctgaagcgcatcaaccaggacatgggcatcacgattctcctgaacatccaccacgtggacctcgcgctcaagtactgcgactccgtcctcggcatccgtgccggcgaggtcgtctactatggccctgcatccgatgtgaaccaggatgtgctcgacgaggtgtatggcaaggacgccgaaggcgacgaggcaccgcttatcgtgcccgagctttccaaggaggcggccgatgcccgctaagcacgccagcgccaaggtccccgagacgatctcgggcggcattgcgcttacctggtatgacaagatattcaagccgaagaccgtgacgctcggaaacggcaagaccgtcacgaggcgcgcttcccgcggccctgtcgtcgctgtcctcatcatcatcgtctccatcatctcgatccaggtcactggcttcgatatgacggtgctggcagagaatggcggacgcttctgggacatcctcttctcgatgttcccgcccaactgggactacatgccatccgtgtggcagccgctcttcgacacgatcaagatgtcgcttttgggctccttcatcggatctgtcctcgtgattccgtttgctgtcgccgcatcgacgaacatcgtccacagcaaagtcgtcgtcgccctcatgcgccttctgctttcgatcatccgtacgctgccgacgattgtcacggccctcatcgcgacctacatcttcggcctcggcacgcttgccggcacgaccgctatcgcaatcttcacgttcgcctatgtcggcaagatcctctacgaggagatcgagaccgtcgatatgggtgccttcgaggcaatggaagccatgggtgcgagcaaggtccgtgccttcacttccgctatcgtgccgcagatcctgccatcctatctctcgaactgcctcttctgcttcgagggaaatgtccgctacgcgtccatcctcggctacgtcggtgcaggcggcctcggccttgtcctcaatgagggcatcgcctggcgcatgtatcccgaggtcggcatggtcctcgtggcgctctttgtcactgtcttcatcatcgagtccatcagccgcgcactgcgcaggcgtctggcttaagggggtccgcatatggaagaacgcattctcaaggcatatgaggaccgcccgaagggctggctcttcgagcttgcctgcgccattgtcgtcgtcgccctgctcgtctggagcggctctgccgtcgaggcatccggcacgggccaggatggcggacagatcgccctcaacatccttgccggcatcgcacatcctgataccggcctgctcttcaaccttacgaccggaggcgtgccgtacctgctcgtcgagacgatctgcatcgccttcctcggcacggtcgtcggcgccatcatctcgatccctctggccttcctcgcttcgaggaaccttaccggcagggtcgtctcgaacatcgcccgtctcatcatcatggccgtccgtacggtgccgcccttcgtctacggcctcatgttcgtgcgtgtcactggccctggccccttcgctggcctcctgacgatgtcgctctgctctgtcggtatggtctgcaagatgtacatagagacgattgaggacctcgactaccgcatcctcgagtcgctcgacgcagagggtgcaacgacgtggcgcaagatccgcttcggcgtcatcccgcagctctcgagctccttcatctcgacggccatctaccgcttcgatatgaacctgcgcgacgctaccgtcctcggcctcgtcggcgctggcggtatcggcgctccgctcatctttgcaatgaacgcctaccgctggaacgaggcaggttcgatcctctgggggctcgtcgtcctgattctcattgtcgaatacatctcgacgcgtatccgcacgcatctgacgaggggtgtctaggtgtcaaagctccatatcgcatttacgtccgatacgcatgggcatatcctcgatgaggactatgcaacgggcagacgtgcacacatgggcatctgctgcctcatggaccccatccatgaatggtgctctcacggcgactccctcatcgtcgatgggggagacaccatgcagggcacgcctctcatgaaggtctggctccgcggcagccgcaggggcacgaatccctgcgcgcttgccctgaaccgtcttggctgcgagtatgtgacgctcggaaaccatgacttcaacttcgggcgcgacgtgcttcagcagtacctcgaagagctcgatgcagtctgcgtctgcgcgaacgtgcacgacgagcgcggggagcttccaatcgtcccgtcctctgtctgcacgctcccttcgggccttgttctcggtatcaccggcatcgtgacggactatgtgaatatctgggagaggccagatcatcttgagggcatcacgatcgaagatcccgtgtcggcggtgcagcgcgaggcagcgaagctccgcgaggaagcagacctggtcgtctgcatctatcacggcggcttcgaggaggaccttgccaccggcaggcggctctcgaagacgcgcgagaatgctgcctgcgaaattgcacgcacggccgatatcgacctgctcctcacaggccaccagcatatggcagtcgacggcgtgaagattgcgggcacctggtgcgtgcagccgccagcaaacgctacgagcttcattgcgctcgaaggcacaggcgatggctctggctgggtgtggagctcagatctcatggcggcagatggtgcacccgacgacgagctcagctccatgctcgcaccgctcgctgccaagaccgaagagtggcttgccgaatcggtgggcgagctcgaggctccgatcgggcctgaggagaagctctcctgcgccctctcaggctctgccgtcgcccatctcatcaacgaggcgcagatcgaggcaagcggtgcagatatctcgtgcacggcactgccgaatggcgccacgggccttccggcgaaggtcacggagcgcgacatctgcgctgcctatcccttcgcgaacctcctcatgaaggcagagatcacgcgcgaggtactgctgtcctcgctcgagcgctgcgcctcctatctcgagcttggtccagacggcaagcctcagatatcagacctcttcctgcgtccgaaggtcgagcactacaacttcgatctctatgaggggatccacgccgttgctgacttgaggcttcctgtcggcagacgcatcaccgagcttgcgatggcagacggaagtcccgtacccgagaagctgacgcttgccttgaacgactatcgttcgaccggcaccggcggctatgaggcgctcggagagtgtccgtctgagcctgtcggctccgacgaggtccctgacatcattgcggccttcctcaggaagaagagcccctatgtgcccagacgcacctgctcgctcgaattcatctggcaagactgagaagtgccgggaagagacgatcttcccggcacttctctctgcgtggcccctcttcctagcggagcttcaccgtgaagggtccttcgtcctcgacgggagcgatatccacgatatcgtcgatacggtagtcgatcgggaagtcgcggtaggcgttctggagcttcccgaagaaggaggagatggcatcgggcgtgccctggagctccatcctgaccgagccatcccattcattccggacccagccggtgaggccaagctcgagcgcaatcctgcgcgaggtccagcggaagccgacgccctggacctggcccacgaaatgcacggcgcagcgcctcaatgccttcctgccctcttcggccatggcagtctccttcctcttgcttcatgtcccgatgatacccaaatgtacgtggacacggccttgctgcggcccggtttcgtgccatttgcctgcttcccttcaggtatggcctgttccctctgcctatactgggaaggataatcaagggtgcagccgattccaggaggtggcagatggccttcgtcgagttcagggatgtctcgaagatataccgcatgggcgaggtggaggtcgctgcagtcaaggacatgagcttcacgatcgaagagggcgagttcgtcgtgattgtcggtccctcgggtgccggcaagacaacggtcctgaacatgcttggcggcatggatgcggtcacggatggcaagatatgggtcgcagggaccgaggtatcgggcatgggggagcgcgacctcacgttctaccgccgctacgatatcggcttcgtcttccagttctacaacctcgtccagaacctcacggcgcttgagaacgtcgagctggcaacgcagatctcgaaagatccgcttgatccggcgacggtgcttcgcgaggtcggtctcagcgagcggatggacaacttcccggcacagctctccggcggcgagcagcagcgcgtctccatagcccgcgccctcgcaaagaatccgaagctcctgctctgcgatgagccgacaggagccctcgactatgcgacgggcaagtcgatcctgcatcttctgcaggcaagctcgcatgcacacggcaagaccgttgtcgtgatcacccacaatgccgccttcacggctatcgcagaccgcgtgattagcatccaggggacacctgtggcaaacgaggttcaacgagcatcctctagatgcaggataccctgtctggtagccatgaaaggcgcattcagaaaggaggcctgcccgtcgcaagatctagggtcgtgggggcgcgtctcgcatcctgcggtattgtcgcgctcggctcggcttcttgccggcctaaacatggtcggcccgcgacattgcgcttggcaggggatgcctacttacgatgattctgcgctctacgatatccgccttgtctcggacgcctcggcttcactgacccgccagatggacaagatacgggataccgagggcgtcgaggaggtgatgcccttctctactgcgatgcgatggtctcgctcaaacaatgatgaatcaggtgaggatctcctccctgccggaaggtgccgcggaggggcactcctcatgaaacaaggcagagcttgtgagggtgcgtggcctgaggcagacgatgaatggcgtgatgagcgccgatgtgtcgatggggagaatctctcgatcggcgataccgtgacagtcctctaggggacaggcgatatcgactccgtgctcacgagaagttccgcgtcacgggcttgttgcgctcggccgactatgtggattacatcgcgttctggcacgacaaccttgggctcaggcagacgagcagtacctcttcgtgtgatgggagcctttccagcaatcttccaggggagtgtacgcaggtctatgtcacggtcaccggagcacgcgcaaaagatgccttctcggacgatgtcaaagacatgtcgatagtgtcgagacgagctcgaggacgaggcggatgaccttgcccagcgagacgtcgggctgaagtgaaggaatgcagcgcattttgagaggtcagacgagagagggcgacctacgagagcgcgacggcagacagcagagagccagtagatcaggacagtcgcagctcgacgatgccctgggcgacgcttgaggagaacaggaaggcactccaaggagggcaaggagaaggatgcagacggctggaccacgtactggaaaaaaaaaagagaggcccgccaggccgaagcacagccttgcctcggccaaggcccagatcgaaggcgagcccagtctcagcctagatgatgcggaaagcacagctcgggatgacggaggcggattgatgcggcacgccagagtcgagggggccaagagagagtcgaggctgcaaggaggacgagggaagagaagcgctcatagcttgtccagtcggcattgacatggacacgatccagggctgtcctcacgacgctcgatacgtgggcacagcgcacgggacgagccgaccgaggaggagattcttgccctcgcagcgaggtaaagggcgcggccgagctgcaaaggaccttgcctcccagaccttgtggaattcggcggaacgaggagacgaaggcggcgtcttgaagctcttgacggacgaggtggatctcgagttcgacggcatcgaccttttatagacgatcattgaaggctgtcctggatcagatacgcgatgacgcttatgcgccgataggcagaggtccaggaggctgaaccgaggttgagacccagattgcatccggcatagacggaaggcgattacgaagattgcagacgcgaagtacacaagtctggtgaggcaagggtccttttccgcctcggattgccgccctgttaccctcctgcgaggaagaaaatctcctcctcggtcggctcgtcccgtgcgctgtccccgtatcgagcgcgtgagacgccctaggatcgtgtcattgtcagtagccgcctgtgacaagtctgcgcgcttctcttccctgttccttgccagcccccctctcgagtgccgctcttgccctcttcgagcttctcgcgcgtgcgatttttgtttctaccacgtatttatttttccccgctctccgtcatcgagttttttgtgtttatctttcgatcaatctagctttgagatcccccccctggccgcttcgagcgggcttggccgaggcaagccccctcctctcgcttccctcctttcctgtacatttgcccccctgtagttctattttctcgtaatttcttctttcaccctcagacaccgtgttcagccgtgcagcctctctcctgccctcttcgagtgcctgccttgttctcctcaagcgtcgccggccagggaatcgtcgagctgcgcatctgtgctgctctgagagctatctggctctctgcgtctgccttctcgctctcgtaggtcgccctgctctcgtcgaccttctcctgcgctgcattcttcacttcagccagacggtcctgggcaaggtcatccgcctcgtcctcgagcctcgtctcgacactatcgacgatgtcgtgtactcgtccgagaaggcatcttttgcgcgtgctcctgtgaccgtgacatagacctgcgtatagggaagattgtctgcaaaggctccatcaggcacgaagaggtactgctcgatcttgcctgagcccaaggttgtcgtgccaagaagcgaggtattcacatagtcggccgagcgcacaagccccgtgacgcggaatgtcttctgcgtgagcacaggagtcgatatcgccgtcccatagaggactgtcacggtatcgccgatcgagagattctcccgcatcgacaacatcggcgctcatcacgcattcatcgtctgcctcaggccacgcaccgctcacaagctctgccttgttcatggaggaggtgccctccgcggcaccttccggcagggaggagatcctcaccgtgtattcatcattgttggcgagaccatgcatcgcaggagaagaagggcatcacatcctcgacgccctcggtatcccgtatcttggccatctggcggtcagtgaagccgagcgtcgagacaaggcggatatcgtagagcgcagaatatcgttgaggcatcccctgccaagcgcatgtcgcggccgaccatgttgaggccggcaagaagccgcagccgagcgcgacaataccgaggattgcgaggaagcgtccccacgacctgagatcttgcgaagcaggcttttctgaatgcgcctttcatggcaaccagaccagggtatcggcatcgagaggatgctcgttgacctcgtttgccacagcgtgtcccccatggatgcgaatcacgcggtctgcgatagccgtgaaggcggcattgtgggtgatcacgacaacggtcttgccgtgtgcatgcgagcttgcctgcagaagatgcaggatcgacttgccgtcgcatagtcgagggctctgtcggccatcgcagagagagcttcggattcttttcgagggcgcgggctatggagacgcgctgctgctcgccgccggagagctgtgcgggaagttgtccatccgctcgctgagaccgacctcgcggaagcaccgtcgccggatcaagcggatctttcgagatcgcgttgccagctcgacgtctcaagcgccgtgaggttctggacgaggttgtagaactggaagacgaagccgatacgtagggcggtagaacgtgaggtcgcgctcccccatgcccgatacctcggtctgcgacccatatcttgccatccgtgaccgcatccatgccgccaagcatgttcaggaccgttgtcttgccggcaccgagggaccgacaatcacgacgaactcgccctcttcgatcgtgaagctcatgtccttgactgcagcgacctccacctcgcccatgcggtatatttcgagacatccctgaactgacgaaggccatctgccacctcctggaatcggctgcacccttgattatcttcccagtataggcagagggaacaggccatacctgaagggggaagcaggcaaatggcacgaaaccgggccgcagcaaggccggtccacgtacatttgggtatcatcggggcatgaagcaagaggaaggagactgccatggcagaagaagaggacaggaggcattgagggctgcgccgtgcatttcgtgggccaggtccaggcgtcggcttccgctggacctcgcgcaggattgcgctcgagctcggcctcaacggctgggtccggaatgaatgggatggctcggtcaggatggagctccagggcacgcccgagtgccatctcctccttcttggaagtccagaacgcctaccgcgacttcccgatcgactaccgtatcgacgatatcgtggatatcgctcccgtgcgggacgaaggacccttcacggtgaagctccgctaggaagagggccacgcagagagaagtccgggaagatcgtctcttcccggcacttctcagtttgccagatgaatcgagcgagcaggtgcgtctgggcacataggggctcttcttcctgaggaaggaccgcaatgatgtcagggacctcgtcggagccgacaggctagacggacactctccgagcgctcatagccgccggtgccggtcggaacgatagtcgtctaaggcagcgtcaggtttctcgggtacgggacttccgtctgccatcgcaagctcggtgatgcgtctgccgacaggaagcctcaagtcacaacggcgtggatcccctcatagagatcgaagttgtagtgctcgaccttcggacgcaggaagaggtcgatatctgaggcttgccgtctggaccaagctcgagataggaggcgcagcgctcgagcgaggacagcagtcctcgcgctgatctctgccttcatgaggaggttcgcgaagggataggcagcgcagatgtcgcgctccgtgaccttcgccggaaggcccgtggcgccatcggcagtgccgtgcacgagatatctgcaccgcttgcctcgatctgcgcctcgttgatgagatgggcgacggcagagccgactgaggggcgcaggagagctttcctcaggcccgatcggagcctcgagctcgcccaccgattcggcaagccactctctggtctggcagcgagcggtgcgagcatggagctgagctctcgtcgggtgctgcaccatctgccgccatgagatctgagtccacacccagccagagccatgcctgtgccttcgagcgcaatgaagtcgtagcgtttgctggggctgcacgcaccaggtgcccgcaatctttcacgcgtcgactgccatatgctggtggccgtgaggagcaggtcgatatcggtgtgcgttgcaatttcgcaggcagcatttcgcgcgtcttgagagccgctgcccggtggcaaggtcctctcgaagcccccatgatagatgagagatcaggttgcttcctcgggagcttcgctgctcgcgctgcacgccgacacgggatttcgtcgtgagccctcgagatgctctggcctctcccagatattcacatagtctgtcacgatgcggtgataccgagaacaaggcccgaagggagcgtgcagacagaggacgggacgattggaagctccccgcgctcgtcgtgcacgtttcgcgcagacgcagactgcatcgactcttcgaggtactgctgaagcacgtcgcgccgaagttgaagtcatggtttccgaggtcacatactcgcagccaagacggttcagggcaagcgcgcagggattcgtgccctgcggctgccgcggagccagaccttcatgagaggcgtgccctgcatggtgtctcccccatcgacgatgagggagtcgccgtgagagcaacattcatggatggggtccatgaggcagcagatgcccatgtgtgcacgtctgcccgttgcatagtcctcatcgaggatatgcccatgcgtatcggacgacgtaaatgcgatatggagctttgacacctaggacacccctcgtcagatgcgtgcggatacgcgtcgagagtattcgacaatgaggaatcaggacgacgagcccccagaggatcgaacctgcccgttccagcggtagcgttcattgcaaagatgagcggagcgccgataccgccagcgccgacgacgagccgaggacggtagcgtcgcgaggttcctatcgaagcggtagatggccgtcgagatgaaggagcatcgagagtggggatgacgccgaagcggatcttgcgccacgtcgttgcaaccctctgtcgagcgactcgaggggatgcggtagtcgaggtcctcaatcgtctcatgtacatcttgcagaccataccgacagagcagagcgacatcgtcaggaggcagcgaaggggccagggccagtgacacgccacgaacatgagcgtgcgaacgaagggcggcaccgtacggacggccatgatgatgagacgggcgatgttcgagacgaccctgccggtaaggttcctcgaagcgaggaggccaggggatcgagatgtggcgccgacgaccggccgaggaaggcgatgcagatcgtctcgacgagcaggtacggcacgcctccggtcgtaaggttgaagagcaggccggtatcaggatgtgcgatgccggcaaggatgttgagggcgatctgtccgccatcctggcccgtgccggatgcctcgacgcagaggccgctccagacgagcagggcgacgacgacaatggcgcaggcaagctcgaagagccagcccttcgggcggtcctatatgccttgagaatgcgttcttccatatgcggaccccttaagccagacgcctgcgcagtgcgcggctgatggactcgatgatgaagacagtgaaaagagcgccacgaggaccatgccgacctcgggatacatgcgccaggcgatgccctcattgaggacaaggccgcggccgcccgcaccgacgtagccgaggatggacgcgtagcggacatttccctcgaagcagaagaggcagttcgagagataggatggcagggatctgcggcacgatagcggaagtgaaggcacgaccttgctcgcacccatggcttccattgccgaaggcacccatatcgacggtctcgatctcctcgtagaggatcttgccgacataggcgaacgtgaagattgcgatagcggtcgtgccggcaagcgtgccgaggccgaagtagtaggtcgcgatgagggcgtgtgacaatcgtcggcagcgtacggattgatcgaaacgcagaagggcatgagggcgacgacgaatttggtgtggacgatgttcgtcgatgcggcgacagcaacggaatcccgaggacgatccgatgaaggagcccaaaagcgacatcttgatcgtgtcgaagagcggctgccacacggatggcatgtagccagttgggcgggaacatcgagaagaggagtccacagaagcgtcccgccattctctagaccacacgtcatatcgaagccagtgaccgggatcgagattgattggagacgattgagatgaggaccatgcgacgacagggtcgcgggaagcgagccctcgtaagttattcccgtttcgagcgtcgcgtcttcggctgaatatcttgtaatcacaggtaagcgcaatgccgcccgagatagttctcggggaaatcttggcgctggctgagtgctctagcgggatctcaggcccggcctctcttggaaagctcgggcacgataacggggacgtctcggcttcggctgtccttgcccacaacactcgtcgtcgagcacatcctggttcaaatcggatgcagggccatagtagacgacctcgccggcacggatgccgaggacggagtcgcagttacttgaggcgagtcacgtggtggatgtcaggagaatcgtgatgccatgtcctggttgatgcgcttcaggtcgtccatgactggacgggcggtcatcgggtcgagcgaagcgaccggctcgtctcgcaagatgatctcagggttctgaggcagacgtgccgccgcaagggcgacacgctgctgatggccgcccgagagctggtcgcagcggacgtaggcctttgtcgaggatgcccatcttgtcgagggactcgagtgccgccaaatctattcctttgtgagatagacgtaacagccgcgcctgtacagggatatcagcacgaagcgcggtcagcacgttcccgagcacggttgtacgggtgatcaggttgataacggactggaagactcatcgccgatcttgcggcggaagcggcgcagtccttgcccttgagcgattcccgacacggtgcgcgttgacggtcaccggtgcctcggtgatcgggttcaggcggttgaccgtgcggatcagggtcgacttgcgccgggcaccggagcgccgatgatgcaacgaacgcggccgtccctcgatcgtgaggtttgacatcctgagcgcttcgaaaccgggttcggggctaggcatcgaccatgggagtaactctatatctaccatcctggtcctgagacctgctatgcaaaacggggatgccagacgcatccccgttcggaaaaacgcgccggaccacgggagtggtgaccggcgacgttcagaatgccttaaggttggagctcgacttgagctcttgaccatttcctgagcctcgcgctcggaatcatagtcggatcctgtgcactctacatagcccgtttggctgtagagtggcaagaccttattgccttcattcgttgttgccgatgtgatcatggctgggagaaggccttcttgaagtcgtccgtcacgtccttggaggcctggaggccgagtcgtgtcgtgtagacggcctttcgtgacgccgatgacattcgtctcgtcccagtgcttggctggtacggctgtgtagtcggacgtccacttggatcatagtcgcgacggccacttagcaatagacgcatgagcgtccgactggcgaggaagcgagacgtgcgaagcggagtccgtcggatgcggactggaacagcatggtgaggtcgaggaccgtcttgcgtccagtttgtcgttgagccacaggcccgaatagatgagcactcggagagctcgagctcatgacaggaccagttggagccgttgattgtcgtccagctgaagctctggcattgttgaccttgtgccgagagccttgccggcacgctagggccagcgatgaggagggcacggtagtagtagaacgtgacctgctggttcggattgccgtgagtaggctctggtagtccagtccttgcggatcgcggagtcgatggaaggcacgttgcgcgtagcggtgagcaggacctagcagccatcggagagtcagtagaggccatagtgccgccaggaatgaagcccacgtcgatggtaaccggataggttcaggcccgcgccgtactgccctctcgctcgtgcgaccgtgatggcgacatcgttcacgggtgtagcccgttggccgagtcatcgggatgagcatctgctagaggatcggtgtagccgtgatgatctggtaggaccttggccggccccgaagcaaactgcagcgtgtcgatgtttggactagctgctcgaagagaagaagagatgctcgacgctggagttgccgcagccaggccagccctgctgcagctgccgcgcctcggtgcgaacgccgaggaactgacgcgggacgcgggacagcgacgatcgaaaacgatacctttcgacatggttctcccttcgatacgcaggatggcgctcccgcccttcctgcaatcgcacaaaagtgcgccccgtgcgcacatcccgtgctgagcatacaccctacggcaggctgaaatcgtgccaattgctggccg

SEQ ID NO: 64 - DNA, 125472 bp, Unknown
  Metagenome-assembled genome
cggatacgcctcaaagcgtaacaccgcgctttcgtgcagatcgtgtcccttatgcgcaaatctgcagcttcacgggaaagtcggctgcagcgcggcccaggccttcccggcggtttcccttccgcgtgccagacctagccccaatgctcggaacaggccgaaggggccagcaccgacgataccgatatgagaccaggacgatagccttgatcgtggtgaagttcttctttggcgaagaggtagtagagaacattacgagaagcaaggatgaagagcttctggcagatgcgtcgaggacctttgcgatgtcgatggtgacaggagcgtggacggtgtcccatgtaggtgactttcgcgcatgccgttgccggtgttcttttggcgcctgcggttgaccttgttgccgtcctcgtcggtatcggtgagaggagtctcgccgtcggcggcgtacataccggagagcgtggtgccgtcgtcagcggaggagatgatagcgaagtcgtccgacttctcggtcggaacgacagcggctttgcgacataggcctgcgtcgtgggccgtttggggatgacaccttgatctgggtgccgcccattgtgacggtcaggccgccgcgatgaagcgccgatgatgaggcggcgtcggtgaagtccttcattggtccatgaaaagggatcaagcgccgtcatgcctcttgtagacatttcataggcgaagcgcagtgggcgaactggaccgcattgaagatgatgaggacaggatcagggccgaaaaaaaaacacgttccacgttgccatttgtcgagcaatgcctcggtgatcggcacgagcggccaccagaagagagcgtcagccgatgccaccgagcgggccctagagagaccacggacatcacggatgggtcgggaatgtcgacctccttctctcccttacagatgaatgcccattgcgaacgtgacaggaacgggtgatttagagaactccatgtttgcgctcatggacagggccaagtcttccttgtcgtccgcatggatcttctcgaggccgggaggatggaatagagccagccccggcctgcatgcgttcgtagttgaacagatgcctgcaggaagcaggagcgcatgccatcttgttgaggtcttctggtcgagtcgtgagccggtcgtgggttctgatagtcgtagcgccctcaagcggttgatctttgcctgcctcgttagagtgccatcttcctcacctccgtcgagttctgcggcagctgcgcccttgagctcagtctgctgctgatagtcccagtagcgatgccgaagccgataagagcaaggatcagcaggcccgggttgcaagtgcttttgatgttggaaacgtgattgcgaagccgaagcccatgaagtagaagccccacatatccttgtttcatcatgaacttcagaaggactgcgaagccgacgaagcgcatcatgcgcagctgcggaaagccctgccgtgagccaggtcgggattgccgcgacgacagctccgccgactgcagcaccgccgacagaagaagggtgacgacgacgccgaagatgaggccgagcgcacatggagaggtagttgatcctctcgatgcccttcgggttggcatcagctgcgtactgatcgcacttggacatgagcggggacatgaggtgaagataagggtgacgccatactgtcccagaaagggagaacggattgcggtcgcaaccgccacgttaggctcgagattcagcgtgattgccagaatgctgccatgatgccgccaacaactgcattggggcgctgagcaccgccaatcgcatgtttgccgattgtcatgagctgatacgtgccacaacataaggccggtctgcacgtcgccagatgatgccgatcacgcaggccggtgacgagcggctgatacgagactccaggaagctgaactggtcgatagccgcgatgaacgtgaccacgaagaccaggaagacctgcaattctgagtactcccatcttgttcccctttcaagagttacgctgaccaaaacgtacgctatcgccagcgcccttcccccaaagggcgtctcacgatcgaaataggttgtctgcgctgctgcgcaggaatggagtggtctactcgaagagctttctcgacgttctccttcgcgtggacgcacgcgctggatgaagagctcgacgccggcagcctggagatcctgaaggcctggacatcctcgtcgttcaggcgacagaggttgcgacctggcgcttgccctcgctcatgtgcatgttgccgatgttgagcttcttgatggcacgccgcccttcacgagacggagggcatcctcagggttctcgacaatcaggaagatgtgctggcgggcagcagccttgtggatgacatcgtggtcttctggatggagaaatagcgcgtggcaacgccctgcggggctgccatgttcatgagcttctggcgcatcgtgttccttgcgacgtcgtcatttgcgacgagcacaggtttgcgccgatcgtggaggtccactgggtagcgacctgcccgtggatcaggcggttgtccgatacgcgtgaggacaatgtttggttcagccatgtttgatcccttcccttcagttgcgcatgcggcacttgactctcatataagccggacttacaggcctctccgtcgtcttctccgtccggctcatcgacatcgagcgtcggatggatgacgccagtcttgcctgcttccagcgcttagcaagaagctcgtcgaccgtcgaggcttcggtgcgctcggccacgacctcgagaagcgggcagttcacgcccgcaacgacttccacttcgcacccatctcggcggagaggaccatcgtctggttgaagggcgtacctcccagaaggtcgcagaaacgcgatagcgccgctttccgtcggccgaggcacgctcgagcgcctccgtgagctttccgggaactcgctctcctccccccatggaacggaacgacctcgaagtggtcctgcggtcctgcaatcatctcgagggcgcttgcaacaccatcgcgaagtcgccgtgtcctgtcagaacaaacctcccatcgtgtgcttctcctctgcactcggattcgctttctgaacacagcctagaatcccgtctgtaacgttcacgcatcttgaatgtttcgaaagcattcgagtctgcaacttgttgtaaccacgtaccatgacttgtactttatcgaagtctttgccacccgggccgactttgcgaaaaatgtgtcctagtagccgtttgcgtcagaattcataccactcgcaccacgttttcccggttaatggtcacttttttgaaataccacccataaatctggtgctaccagatcccattattggtatcttctaactcagcgcatggaagacagaactggaatcgctttcagtacctttcagaaactggtatctatttacagtgccttaacgaggagccgtacatgatgtgcttgcgtcaccctcaatgcgtcgatcgacaaggcctatcgtctcgatcagcaatagagctcggacacgtctcacgtgtcgcccaggtgctcgactcggctggcggcaaagggctcagcacgctgccgcgctgccgtgcctccggcgcaagaggtcctggcgacagattcgtcggcggcaacaatggcccctagatcttctcgacctcctgccaaggaccatcgccagacttctccaggtggcaaacgagacgccgctcgcgtgaacctgctcgagcctgatgacgctcgaccgagttcaacagccgggacgtcccgtcacggcaaggagttcgagaccctgcgcaggaagcttcaggagattgccgagaaggcagatgtcgtgaccctgaacggcagccttccggcaggccttcccaaggacgcctatgccacacttatagaagacatccacgcagcaggcacgcctgtcatcctcgatacgtcaggcgcctccctcacgtgcggcatcgaggcagcgccggacatggtgaagccgaacacggacgagatcgcccagattctggggcatgaggtcgcatccatcaagaggcagcgcatgcggcccaggacgccacgagaagaagggcattgcctatgtggtcgtgtccttgggcggcgatgggtcggtcatggcatgcgacgaggcatcttccgcggccgtgccccgaagatcgaggtcgtgaacccggtaggagcaggtgacacccttgtcggctgctttgccgttgcgcttgcaaggaagctttccgctcccgagtcctgcgctttgccatgtcccgcgccacggcaaactgtctctcccctcccacaggacgcttcaatccgacattgcctcctccctcatgaagaagactgctgtggagcctctgtcctagcgctatccgggccagctgccccctctgccatctatgcaaaccgtttgcatcccgaaaggatcaggaaggagtacgaaatgctcgtcaccaccaagcagatgcttctggagcgcaggaaggccactacgccgtaggcgccttcaatgtggagaacctcgagttcgttatggctgtcatccgtgcagccgaggagagcgctcccctgtcatcatgcagacgacgccgggcacgatcagtacgcaagcctcgactacttcgccgctaggtcaagtgcgcagctgccgccgcccacggtgccggtaccctccacctcgaccacggcgatggcttcgaccgctgcatgcaggctctccgcgctggctatactacttccttcatgatcgcggctcccatgtccccttcgaggacaacatggccctcaccgagtccgtcacgaaggtcgccaatgctatgggcgtgcccgtcgaggcagagctcggcaaggtcggcggcaaggaggacgacggcccggctgtgaaggcgagaaccccttcaccgatcctgacggcaaaggagttcgtcgagcgcacgaagtgctcctcccttgctgtcgcgttggcacggcacacgcgtctacaagggcaccccgcacatcgagcaggagatcctgaaggagatccgctccaagtcgaggtcccgctggtacttcacacggccacgtccggcgtgcctgacgaccaggtcgcagaagccatccgcaatggcatctgcaaggtcaactatgcaaccgagctccgcaggccttcacccgtggcttcatggctacatggcagagcatccggagaacttcgacccgaagaagccgtccggccccggcatggacgagatcgtcgccgtcgtgtcctcccacatggacaacctcggctcctcccacaaggcatagagagcctcagatccaccgctttcccgaaggcggcatcccacacggatgccgcctttttcctgcgtctgtttgcgttcttttggcgtacacaccgaaccgccacacaccgaaggcaaatacttctagtgtggtatcgattccgcgcacatatgcccgcaccaagcgctcggcattcgtccaggtgtgcgccataccatggagcgtgcatgacttccacatcatccaagaacaaggcccccaagaagggcgctctttctcctgcattcgcagcgctcggccttgatgaaagactcctccgggcagtctccgacctcggctacaccgagccgagccctgtgcaggctgctgccatccctgaagttctggctggccacgacgtcgtggcggcagcccagaccggcacaggcaagacctgcgccttcctccttcctgccatgcagatgctgggacacgcccagcgcggacatggccccttgatgcttgtcctcacgccgacacgcgagcttgcccagcagatcgagaccgcagcatcccagatcgcaaagaggacccatcacatctgcacgtctgtcgtgggcggcgtctcctacgagcctcagaagcgcgcactggccgacggcaccgacatcctcattgccacaccgggacgcctcatggacctcatgaagcaggatgcctgccatctggatgaggtccagatgctcgtcctcgacgaggcagaccgcatgctcgatatgggcttcctgcccgacgtgaagacaatcgtcgccgacatgccggaagagcgccagacgctcctcttcagcgcaacgctcgacgaatccgtcttgaagcacacgagcacgctcgtgcatgaccccgtccccatcgagattgcccacaggggcaccgccgccaagacggtcgaacaatatgccctcgctgtgagccatgaagcaaagacgcaggtcctcatcgatatcctgaagaagcgcggccagaagcgtgtcatcgtcttctgcaacggcaagcaccgcgccgataccctctgcaagaagctcaggaaggccggcatctcctgccttccgatccacggcgaccgcagccagaaccagcgccagcgtgcgctttcccacttcgctgatggcatggtcgacgtgcttgtggccaccgacgtccttgcccgtggcatcgacgtctccgatgtctcctacgtgatcaacttcgacgtcccccacgacgatatcgagaactacatccaccgcatcggccgcacgggcagagccggcgaagagggctgggcactttccctcgtcgagccggacgactacctctatctgcgcgatgccgagcagctgatggattctgtcatccccgactaccccgacaccgaaggcctcgatctcggcgagaacccgggcttcctcgaccctgagcgcaatccgcaggacaagctcatgccgaagaagatccgtcgccgcatcgagcgccagcatgcccaggcaagccacgccgagtcgaagcgcacccagtccgagcgtgtccaggacgaggaggcagcgcttgccgagagcacgggcgagaagctcgagcacgaggcaaagcatgtcgccgccaggaagccgaagaaggctgagcatgctgcaaagccggcgcatgcccgcagcgagcgcacgaaggcagaggcatccgacgagcgccgtcccaagagccagaagagggaccagaagaaggaccagaagaaggaccagaagcgcgaccagaggaaccacgagcgtcgtccgaagaacgccaatgcgtcttccaagcgccagaagccgcgccagaagaagcgtacggacgaggagagggtctacgacggatctcccaagtcctttggcatgcgcaagctcggcaagcgtggcctcgatctcgccaagccaaagaagaagcatacgcgccacccgggagaccacggcggagcccgtgccagggcaaagtccaaggcgcatgcctagccccgaaacatatgctcatggcaggagcgccgcacccagaaggatgcggcgctcctcttctctgcctcagacctcttactccgtgacctcgacctggcggtacttgatgccgcaggagtcgagcacacggcagctgatctggttgtcgatcgtaccctcatacttgttgtcgaggtagacgacctcgccgatgcctgcctgcgccaggagctttgcgcactcatggcaggggaagagcgtcacatagaccgtcgcgccctgcatgtccttcaggctcccccgaaagttcagaatcgcgtttgcctcggcatgcacgacatagctgtgcttgtcattcagaggatcgtccgaggagccccacgggaaatcgtcgtcgttgatggcagagggggtgccgttatagccgacgctcaggatgcggtggttcgtgtcagcgatgcaggcaccgacctgggtattgggatccttgctgcggagctttgccgcgatagcgaccctcatgaagaactcgtcccacgagatgacatccctgcgcttgtccggcatggccagcccctctcctgctctgactctctatatagaggaaactgtggcgcttgagcgccttttgtgcaagagatgcggcgacacttccacaaaaggatgctccgacaggccaagatgtcatgcttctgtaaatgctactaattttataggatttagcgtctaaaggggtctgggcggggtaaggtatgagtcgtacaggaaagatcccccggcaggacaccatgagctctgctgaaggaatgaagattgttcgttttgccaaacttatctgccccagcaccttccccatcagctagggtagagacaacagtttcccgtctataacttaacgggatgcagaagaaaggatggtctgccatgagcaagattgccagcgtctacggccgcgaggtcctcgactcccgcgccaacccgaccgtcgaggtcgaagtcaccctcgaggacggctccttcggccgtgccatcgtcccgtccggcgcctccaccggcgagttcgaggctgtcgagctccgtgacggcgacaaggaccgctatcagggcaagggtgtccagaaggctgtcggccatgtgaacaacgagatcgcaaagctcctcgtcggccgcgaggccacagaccagcgcggtgccgacttcgcgatgatcgaggctgacggcaccccgaacaagggcaacttcggcgccaatgcaatcctcggcgcttcccttgctatcgcccgtgcagcagcagtatctgcacacgagccgctctacgcctatctcggcggcgccaacgcacataccctgccggtgccgatgatgaacgtgctcaatggcggcgtgcacgccgacaacaacgtcgacttccaggagttcatgatcatgccggtcggcgctcctgacttcaagaccgcccttcgctggtcgagccaggtctaccacacgctcaaggacgtcctgaagtctgccggcctctccaccggcgtcggcgacgagggcggcttcgcacccgacctcaagacgaacgcagagcccttcgagtacctgatgcaggcagtcgagaaggcaggcttcaagccgggccaggacttcatgttcgcaatggaccccgcaacctccgagctctacaacaaggagaccggcctctacgagctcaagggcgagggcaggacgctctcctctgacgaaatggtcgactactgggagaagctcgttgccacctacccgatcatctccatcgaggacggccttgctgaggaggactgggacggctggaagaagctgaccgagcgccttggcaagaaggtccagctcgtcggcgacgacctcttcgtcacgaacacggagcgcctcaagaagggcatcgagctcggcgcagccaacgcaatcctcatcaaggtcaaccagatcggctccctcaccgagaccctcgaggccatcgagatggcaaagagggcaggatatgctgctgtcgtctcccaccgttccggcgagaccgaggacacgacgatcgcagaccttgcagttgccacgaacgcaggccagatcaagacaggagcccctgcccgcaccgaccgtgtcgcgaagtacaaccagctgctccgcatcgaggacaggctcggctcctctgcagagttcctcggcaggaacgccttctacaacatcgcttaatcagaagcgattgcagagatgctgcctaagagccggtgcacccgcaccggctctcttcttgtgcagggacgagcgatatgcatggcaaggggacatgcggcagcctagacgtcgaagagcctctctgccgcttccgctatcccgtcgtggtcgttgtctgccacgacgagatcggagatctccttcacttcgggaatggcattgtccatcgcgatagcgcatcctgccacgcggagcgcttccaggtcgtttgctccatcccctgcaactgccatctccgaaagcgggatgccaagctcgcgcgagagcacctcgagcccctctgctttgctgatgccttccggcgagcactcaagcgaggtcgtctccgcatcggccaggcagagccccagtccttcgatccgcttccttgtccgggcacgtacagccgtatcccggtgatagacgagcaccttcacgatatctcttggatgggcctctatatagcctgcaagatcgtcctcgaaatggtagatgctctggtacatgctctgatagacgcccatatggaacgtgtccatatggtctgcatcctctttccggcagaggcagagatccggatagaacactaccgccatcgcctcttctgccttggcggcacgcacgatccggatggcagcagaagcatcgattgtatgggcatcgaggatgtctcccgtcccgaagtcatacgtgagcgcacccgatgcaaggacgccgtagcggatgggacctgtcgcccctccaagagaccagcgcgcctcgagcgcattccttcctgtgcagagtgccagggtcacgcctttgtcggcaagccggcccagtgccgcccaggtcgcatccgatacggtcttttcggatgtcagaagcgtgccgtccatatcgagcgcaagcagccggagccccacgatattccccttccagacgtttgccagatacatcgtatcagcacctgtccgcagaatgctgcaggctcctatctggcatggcggtgtcatttggatgcagcttcctccattcgggcgcatctctgcacactctcaggaattgcgggtacaagctactacgcaatggaaaagcaagcgagaggggtccgatcatggcactgaatgaaaaggttgcagacatcctgaacaagcagatcaacaaggagctctactccgcctatctctatctgaccttcgcagactactacgaggacaggaacctcaagggctatgcgaactggtacatgatccaggtccaggaagaggttgcccacgcaaagatcctgcgccgctatctgctggacaatgacgcaaaggtcaccctcgaggctatcgacaagccgacgaacgagtatgcaaacgacctcgagccgatggaggctggcctcaagcacgaggagtacatcacttcctgcatcaacgagtgctacgccgctgcctatgagatccatgacttcaggaccatgcagatgctcgactggttcgtgaaggagcagggcgaagaggagacgaacgcccgcgacatgatcaacgactacaagctctttgctggcacgccgcagggcctctacaacctcgaccagaagtatctgagcgaatccgagtgcaagagggaacacacgatggtaagtttttcgttctgacaggacacggcgacttcgcgactggtgttgcagcgccctcgcgatgatttgcaggaccgcaggaccacttcgaggtcgttccgttccatgagggggaggagagcgatttcccctggaaagcgcacggaggcgcttcgagcgtgcctcgggccgaccggaacggtcgcctgtcgcgttctgccgaaccttctgggggtactccccttcaaccaaacgatggtcctctcccgcctagatgggtggcgaatgtggaagtcgttgcgggcgtgaacctgccccttggtccgaggtcgctggccgagcgcaccgaagcctcgactgtcgacgagtcttcttgctacggcgcttgaagcagcaatactggcgtcatccatccgagcgctcgatgtcgatgagccggacggagaagacgacggagacggccctgtaagtccggctttatatgagagtcagttccgcactgcgcaactgaaggagaagggatcaaacatgggctgaaccaaacatggactccacggtaatcgtcgacaacccgcctgatcaatcccaacgggcaggtcgctaccccattgtttacctccacgatcggcgcaaacccctgctgctcgtcgcaaatgacgacgtcgcaagaacacgatgcgccagaagctcatggaaccaattgcagccccgcgggcgttgccaccgctatttctccatccagagaccatcgagtcatccacaaggctgcttcccccagcacctcttcctgaattgtcgagaaccctgaggaggccctcctcgtcgttcacggcgacagaggttgcgacctggcgcttgccctcgctcatgtgcatgttgccgatgttgagcttcttgatgggcacgccgcccttcacgagacggagggcatcctcaggtttctcgacaatcaggaaatgtgctggcgggcagcagccttgtggatgacatcgatggtcttctggatggagaaatagcgcgtggcaacgccctgcgggctgccatgttcagagacttctggcgcatcgtgttcctgcgacgtcgtcatttgcgacgagcagcatgtttgcgccgatcgtggaggtccactgggtagcgacctgcccgtggatcaggcggttgtcgatacgcgtgaggacaatgtttggttcagccatgtttgatcccttctccttcagttgcgcatgcggcacttactctcatataagcggacttacaggccgtctccgtcgtcttctccgtccggctcatcgacatcgagcgtcggatggatgcgccagtcttgcctgcttccagcgccgtagcagaagctcgtcgaccgtcgaggcttcggtgcgctcggccacgacctcgagaagcaggggcaggttcacgcccgcaacgacttccacatccacccatctcggcggagaggaccatcgtctggttgaagggcgtacctcccagaaggtcgcagaacgcgatagcgccgtttccgtcggccgaggcacgctcgagcgcctccgtgagctttccgggaactcgctctcctccccctcatggaacggaacgacccgaagttcctgcggtcctgcaatcatctcgagggcgcttcaacaccagtcgcgaagtcgccgtgtcctgtcagaacgaaacctacctcgtgtgctctcctctgcactcggattcgctttctggaacacagcctagaaccgtctaacgttcacgcatcttgaatgtttcggaagcattcgagtctgcaactgtgttgtaaccacgtaccatgacttgtactttatcgaagtctttgccaccctggggccgactttgcgaaaaatgtgtcctagtagccttttgcgtcgaattcatacccctcgccccacgttttccctgttaatggtcacttttttgaaataccacccataaatctggtgctaccagatcccatttattggtatcttctaactcagcgcatggaagacagaaactggaatcgctttcagtacctttcagaaactggtatctatttacagtgccaacgaggagccgtacatgatgcttgcgtcaccctcaatgcgtcgatcgacaaggcctatcgtcctcgatcatcaataagctcggacacgtctcacgtgtcgcccaggtgctcgactcggctggcggcaaagggctcaacgctgcccgcgctgtcgctgcctcaggcgaagaggtcctggcgacaggattcgtcggcggcaacaatggccgctatcttctcgacctcctggccaaggacggcatcgccgaggacttcgtccaggtggcaaacgagaccgctgctgcgtgaacctgctcgagcctgatggacgctcgaccgagttcaacgagccgggacgtccgtcacggcagaggagttcgagaccctgcgcaggaagcttcaggagattgccgagaaggcagatgtcgtgaccctgaacggcagccttccggcaggccttcccaaggacgcctatgccacacttatagaagacatccacgcagcaggcacgcctgtcatcctcgaacgtgcgcctccctcacgtgcggcatcgaggcagcgccggacatggtgaagccgcacggacgagatcgcccagattctggggcatgaggtcgcatccacaaagaggcagcgcatgctgcccaggagctccagagagaagaagggcattgcctatgtggtcgtgtccttgggcgcgatgggtcggtcatggcatgcgacgagggcatcttccgcggccgtgccccgaagatcgaggtcgtgaacccggtaggagcaggtgacacccttgtcggctgctttgccgttgcgcttgcaaggaagctttccgctcccgagtgcctgcgctttgccatgtcccgcgccacggcaaactgtctctccccctccacaggacgcttcaatccggacattgcctcctccccatgaaaaactgctgtggagcctctgtcctagcgctatccggggccagctgccccctctgccatctatgcaaaccgtttgcatcccgaaaggatgcaggaaggagtacgaaatgctcgtcaccaccaagcagatgcttctggacgcgcaggaaggccactacgccgtaggcgccttcaatgtggagacctcgagttcgttatggctgtcatccgtgcagccgaggagaggcgctcccctgtcatcatgcagacgacgccggcacatcaagtacgcaagcctcgactacttcgccgctatggtcaagtgcgcagctgacgccgccacggtgccggtagccctccacctcgaccacggcgatggcttcgaccgctgcatgcaggctctccgcgctggcttacttcctcatgatcgacggctcccatgtccccttcgaggacacatggccctcaccgagtccgtcacgaaggtcgccaatgctatgggcgtgcccgtcgaggcagagctcggcaaggtcggcggcaaggaggacgacggcccggctgtgaagggcgagaaccccttcaccgatcctgacgaggcaaaggagttcgtcgagcgcacgaagtgctcctcccttgctgtcggcgttggcacggcacacggcgtctacaagggcacccccacatcgacaggagatcctgaaggaatccgctccaaggtcgaggtcccctggtacttcacggcacgtccggcgtgcctgacgaccaggtcgcagaagccatccgcaatggcatctgcaaggtcaactatgcaaccgagctccgccaggccttcaccctggcttcatggctacatggcagagcatccggagaacttcgacccgaagaagcctccggccccggcatggacgagatcgtcgccgtcgtgtcctcccacatggacaacctcggctcctcccacaaggctagagagcctcagatccaccgctttcccgaaggcggcatcccacacggatgccgcctttttcctgcgtcgtgttgcgttcttttggcgtacacaccaaccgccacacaccgaaaggcaaatacttctagtgtggtatcgattccgcgcacatatgcccgcaccaagcgctcgcattcgtccaggtgtgcgccataccatggagcgtgcgacttccacatcatccagaacaggcccccagaagggcgctctttctcctgcattcgcagcgctcggccttgatgaaagactcctccgggcagtctccgacccggctacaccgagccgagccctgtgcaggctgctgccatccctgaagttctggctggccacgactcgtggcggcagcccagaccgcacaggcaagacctgcgccttcctccttcctgccatgcagatgggacaccgcccagcgcggacatggccccttgatgcttgtcctcacgccgacacgcgagcttgcccagcagatcgagaccgcagcatcccagatcgcaaagaggacccatcacatctgcacgtctgtcgtgggcggcgtctcctacgagcctcagaagcgcgcactggccgacggcaccgacatcctcattgccacaccgggacgcctcatggacctcatgaagcaggatgcctgccatctggatgaggtccgatgctcgtcctcgacgaggcagaccgcatgctcgatatgggcttcctgcccgacgtgaagacaatcgtcgcccgacatgccggaagagcgccagacgctcctcttcagcgcaacgctcgacgaatccgtcttgaagcacacgagcagctcgtgcatgaccccgtccccatcgagattgcccacaggggcaccgccgccaagacggtcgaacaatatgccctcgctgtgagccatgaagcaaagacgcaggtcctcatcgatatcctgaagaagcgcggccagaagcgtgtcatcgtcttctgcaacggcaagcaccgcgccgataccctctgcaagaagctcaggaaggccggcatctcctgccttccgatccacggcgaccgcagccagaacagcgccagcgtgcgctttcccacttcgctgatggcatggtcgacgtgcttgtggccaccgacgtccttgcccgtggcatcgacgtctccgatgtctcctacgtgatcaacttcgacgtccccccgacgatatcgagagactacatccaccgcatcggccgcacgggcagagccggcgaagagggctgggcactttccctcgtcgagccggacgactacctctatctgcgcgatgccgagcagctgatgattctgtcatccccgactaccccgacaccgaaggcctcgatctcggcgagaacccgggcttcctcgaccctgagcgcaatccgcaggacaagctcatgccgaagaagatccgccgccgcatcgagcgccagcatgcccaggcacgccgccgagtcgaagcgcacccagtccgagcgcgtccaggacgagaggcagcgcttgccgagagcacaggcgagaagctcgagcacgaggcaaagcatgtcgccgccaggaagccgaagaaggctgagcatgctgcaaagccggcgcatgcccgcagcgaacgcacgaaggcagaggcatccgacgagcgccgtcccaaagccagaagagggaccaggagaaggaccagaagcgcgaccagaggaaccacgagcgtcgtccgaagacgccaatgcgtcttccaagcgccagaagccgcgccagaagaagctacggacgaagagggtctacgacggatctccaagtcctttggcatgcgcaagctcggcaagcgtggcctcgatctcgccaagccaaagaagaagcatacgcgccacccgggagaccacggcggagcccgtgccagggcaaagtccaaggcgcatgcctagccccgaaacatatgctcatggcaggagcgccgcacccagaaggatgcggcgctcctctctctgcctcagacctcttactccgtgacctcgacctgggcggtacttgatgccgcaggagtcgagcacacggcagctgatctggttgtcgatcgtaccctcatacttgttgtcgaggtagacgacctcgcgatgcctgcctgcgccaggagctttgcgcactcagggcaggggaagagcgtcacatagaccgtcgcgccctgcatgtccttcggctcccccgaaagttcagaatcgcgtttgctcggcatgcacgacatagctgtgcttgtcattcagaggatcgtccgaggagccccacgggaaatcgtcgtcgttgatggcagagggggtgccgttatagccgacgctcaggatgcggtggttcgtgtcagcgatgcaggcaccgacctgggtattgggatccttgctgcgagctttgccgcgatagcgaccctcatgaagaactcgtcccacagatgacatccctgcgcttgtccggcatggccacccctctcctgctctgactctctatatagaggaaactgtggcgcttgagcgccttttgtgcaagagatgcggcgacacttccacaaaaggatgctccgacaggccaagagcatgcttctgtaaatgctactaattttataggatttagcgtctaaaggggtctgggcgggtaagttatgagtcgtacaggaaagatcccccggcaggacaccatgactctgctgaaggaatgaagattgtcgttttgccaaacttatctgccccagcaccttccccatcagctagggtagagacaacagtttcccgtctataacttaacgggatgcagaagaaaggatggtctgccatgagcaagattcagcgtctccggccgcgaggtcctcgactcccccgccaacccgaccgtcgagtcggtcaccctcgagacgctccttcccgtgccatcgtcccgtccggcgcctccaccggcgagttcgaggctgtcgagctccgtgcggcgacaaggaccgctatcagggcaagggtgtccagaaggctgtcggccgtgaacaacgagatcgcaaagctcctcgtcggccgcgaggccacagaccagcgcggtgccgacttcgcgatgatcgaggctgacggcaccccgaacaagggcaacttcggcgccaatgcaatcctcggcgcttcccttgctatcgcccgtgcaagctgttctccgcacacgagccgctctacgccattccggcgatgcaggagaaagagcgcccttcttgggggccttgttcttggatgatgtggaagtcatgcacgctccatggtatggcgcacacctggacgaatgccgagcgcttggtgcgggcatatgtgcgcggaatcgataccacactagaagtatttgcctttcggtgtgtggcggttcggtgtgtacgccaaaagaacgcaaacagacgcaggaaaaaggcggcatccgtgtgggatgccgccttcgggaaagcggtggatctgaggctctctatgccttgtgggaggagccgaggttgtccatgtgggaggacacgacggcgacgatctcgtccatgccggggccggacggcttcttcgggtcgaagttctccggatgctctgccatgtagcccatgaagccacgggtgaaggcctggcggagctcggttgcatagttgaccttgcagatgccattgcggatggcttctgcgacctggtcgtcaggcacgccggacgtgccgtgaagtaccagcgggacctcgaccttggagcggatctccttcaggatctcctgctcgatgtgcggggtgcccttgtagacgccgtgtgccgtgccaacgccgacagcaagggaggagcacttcgtgcgctcgacgaactcctttgcctcgtcaggatcggtgaaggggttctcgcccttcacagccgggccgtcgtcctccttgccgccgaccttgccgagctctgcctcgacgggcacgcccatagcattggcgaccttcgtgacggactcggtgagggccatgttgtcctcgaaggggacatgggagccgtcgatcatgacggaagtatagccagcgcggagagcctgcatgcagcggtcgaagccatcgccgtggtcgaggtggagggctaccggcaccgtggcggcgtcagctgcgcacttgaccatagcggcgaagtagtcgaggcttgcgtacttgatcgtgcccggcgtcgtctgcatgatgacaggggagcgcctctcctcggctgcacggatgacagccataacgaactcgaggttctccacattgaaggcgcctacggcgtagtggccttcctgcgcgtccagaagcatctgcttggtggtgacgagcatttcgtactccttcctgcatcctttcgggatgcaaacggtttgcatagatggcagagggggcagctggccccggatagcgctaggacagaggctccacagcagtcttcttcatgagggaggaggcaatgtccggattgaagcgtcctgtggagggggagagacagtttgccgtggcgcgggacatggcaaagcgcaggcactcgggagcggaaagcttccttgcaagcgcaacggcaaagcagccgacaagggtgtcacctgctcctaccgggttcacgacctcgatcttcggggcacggccgcggaagatgccctcgtcgcatgccatgaccgacccatcgccgcccaaggacacgaccacataggcaatgcccttcttctcgtggagctcctgggcagcatgcgctgcctctttgatggatgcgacctcatgccccagaatctgggcgatctcgtccgtgttcggcttcaccatgtccggcgctgcctcgatgccgcacgtgagggaggcgcctgacgtatcgaggatgacaggcgtgcctgctgcgtggatgtcttctataagtgtggcataggcgtccttgggaaggcctgccggaaggctgccgttcagggtcacgacatctgccttctcggcaatctcctgaagcttcctgcgcagggtctcgaactcctctgccgtgacgggacgtcccggctcgttgaactcggtcgagcgtccatcaggctcgagcaggttcacgcagcagcgcgtctcgtttgccacctggacgaagtcctcggcgatgccgtccttggccaggaggtcgagaagatagcggccattgttgccgccgacgaatcctgtcgccaggacctcttcgcctgaggcagcgacagcgcgggcagcgttgagccctttgccgccagccgagtcgagcacctgggcgacacgtgagacgtgtccgagctctatctcgtggccaagacggtaggccttgtcgatcgatgcattgagggtgacgcaagcaatcatgtacggctcctcgttaaggcactataaaaagataccagttgctgaaagttactgaaagcgattccagtttctgtcttccatgcgctgagttagaagataccaataaatgggatccggtagcaccagatttatgggtggtatttcaaaaaagtgaccattaacagggaaaacgtggtgcgagtggtatgaattctgacgcaaacggctactaggacacatttttcgcaaagtcggccccaggtggcaaagacttcgataaagtacaagtcatggtacgtggttacaacaagttgcagactcgaatgctttccgaaacattcaagatgcgtgaacgttacagacggattctaggctgtgttccagaaagcgaatccgagtgcagaggagaagcacacgatggtaggtttcgttctgacaggacacggcgacttcgcgactggtgttgcaagcgccctcgagatgattgcaggaccgcaggaccacttcgaggtcgttccgttccatgagggggaggagagcgagttccccggaaagctcacggaggcgctcgagcgtgcctcggccgacggaaacggcgctatcgcgttctgcgaccttctgggaggtacgcccttcaaccagacgatggtcctctccgccgagatgggtgcgaatgtggaagtcgttgcgggcgtgaacctgcccctgcttctcgaggtcgtggccgagcgcaccgaagcctcgacggtcgacgagcttcttgctacggcgctggaagcaggcaagactggcgtcatccatccgacgctcgatgtcgatgagccggacggagaagacgacggagacggcctgtaagtccggcttatatgagagtcaagtgccgcatgcgcaactgaaggagaagggatcaaacatggctgaaccaaacattgtcctcacgcgtatcgacaaccgcctgatccacgggcaggtcgctacccagtggacctccacgatcggcgcaaacctgctgctcgtcgcaaatgacgacgtcgcaaggaacacgatgcgccagaagctcatgaacatggcagccccgcagggcgttgccacgcgctatttctccatccagaagaccatcgatgtcatccacaaggctgctgcccgccagcacatcttcctgattgtcgagaaccctgaggatgccctccgtctcgtgaagggcggcgtgcccatcaagaagctcaacatcggcaacatgcacatgagcgagggcaagcgccaggtcgcaacctctgtcgccgtgaacgacgaggatgtccaggccttcagggatctccaggctgccggcgtcgagctcttcatccagcgcgtgccgtccacgccgaaggagaacgtcgagaagctcttcgagtagaccactccattcctgcgcagcagcgcagacaacctatttcgatcgtgagacgccctttgggggaagggcgctggcgatagcgtacgttttggtcagcgtaactcttgaaaggaggaacaaggatggagtactcagcattgcaggtcttcctggtcttcgtggtcacgttcatcgcggctatcgaccagttcagcttcctggagtctctgtatcagccgctcgtcaccggcctggtgatcggcatcatccttggcgacgtgcagaccggccttattgttggtggcacgtatcagctcatgacaatcggcaacatgccgattggcggtgctcagccgcccaatgcagttgttggcggcatcatggcagcgattctggcaatcacgctgaatctcgagcctaacgtggcggttgcgaccgcaatcccgttctcccttctgggacagtatggcgtcacccttatcttcaccctcatgtccccgctcatgtccaagtgcgatcagtacgcagctgatgccaacccgaagggcatcgagaggatcaactacctctccatgtgcctgctcggcctcatcttcggcgtcgtcgtcaccctcttcttcgtcggcggtgctgcagtcggcggcgctgtcgtcgcggcaatcccgacctggctcacggcagggctttccgcagctggcggcatgatgcgcttcgtcggcttcgccgtccttctgaagttcatgatgaacaaggatatgtggggcttctacttcatgggcttcggcttcgcaatcatcgtttccaacatcaaagcacttgcaaccccgggcctgctgatccttgctcttatcggcttcggcatcgcttactgggactatcagcagcagactgagctcaagggcgcagctgcagcagaactcgacggaggtgaggaagatggcatctaacgagcaggcaaagatcaaccgctttgagggcgctacgaactatcagaacctcacgccggctcccgatctcgaccagaagaccctcaacaagatggcatggcgctcctgcttcctgcaggcatcgttcaactacgaacgcatgcaggccgctggctggctctattccatcctcccgggcctcgagaagatccatgcggacgacaaggaagaccttgccctgtccatgacgcacaacatggagttcttcaacatccacccgttcctcgtcacgttcgcaatgggcatcatcctgtccatggagcagaagaaggtcgacatcccgaccatccgtgctgtccgtgtctccctcatgggcccgctcggtggcatcggcgacgctctcttctggatgacgctcgtgccgatcaccgcaggcatctgctcgaacatggccatcgctggcaacgtgttcggcccgatcctgttcctcatcatcttcaatgcggtccagttcgcactgcgcttcggccttatgaactggtcctacaagatgggcatgacggcgcttgattccctcatggaccacatgcaggccttcacccgcgccgcctccatcctcggcgtcttcatcgtcggctgcctgaccgtcaccatgggcggcacccagatcaaggctgtcatccccaacggcacgacgcaggcctatgtcgccaagacggctgtcgttccgaccgagaatgtcgacgacttcgctatcatctcctccgctgacgacggcaccacgctctccggtatgtacgccgccgacggcgagactcctctcaccgctaccgacgctgacggcaacaaggtcaccgcaggcgcaaccgacctcggcaacggcatgagcgaagtcacctacatggacaccgtcacgtctcctgtcaccatcgacatcgcaagcgtcctcgacagcatctgcccgaagctcgttcctcttgctctcgtcatgcttctctactacctcttcgcaaagaagaacttcaccccgatcaaggctatcgtcctggtcctcatcatcggtatcgtcggtgctggccccttcggcctgttcccgagcatctggggctaggatctggcacgccggagggaaacctccggcaggcctgggcgcgctgcagccgcttttcccgtgaagctctgcagatttgcgcctaaggacacgctactgcacgaaagcgcgggtacgctttgaggcgtatccgcgcttttccattctggggagggatcatgggccgcgcagcaaaaaggcagccactatatgaccagcttgtcgacctgctccagagcaagatcgagaacgagatgtcaccgggggacgtgctcccctcagagcgcgagctctgcgagacctatggtctctcacgcacgacggtacgccttgccctggcagagcttgagacccagggatatgtggtcagaaagcatggcaagggtacttttgtagctgacacttcacgtgaggccaccaacctcatgggtacctatagcttcaccgaacagatgcgcaagatggggagggtccccaagaccaccatcctcgacttcgagcttaggggagcgccgaagcatgtagcgtcctatctcgatatgcacatcggcgagcccgtcatccgcatgaagcgcctgagatgggcaaacgacgtgccgatgatggtcgagacgacctatcttcctgcgaatgagttcgtaggactcacccaggaagagctttcgacgacgccgctctacgatctcatggagaagacgtatcaccagacgatccgcgtggcggaagaggagttctgcgcaagcatctgccgccccgaagaggccgagctgctccagataccggaaggtgcagcagtgctcaggctctatcgcacgacgtacaacgaccgcaatacggccatcgaatatacgcgcagcgttgcacgtgcggaccagttccgctacaagatttcgcactaccggggatagcatcctcagaaagggagagagaaccatgttcgagaaggataccgagaccctgaagtcgatgggtgccgagatcacgacgcgcgagatccgccagcagcccgagctctgggaaggcacgctcaggatcttcgacgacaacatcgacgcgatcaagagcttcgtggagcgcgcacgcgtgctcggcggcacggacgagcgcacgcatgtcgtgttcacgggcgccggcacctccgcctacgtcggcgatacggtgacgccgtacctgcgccgccacggcgacagctccgccttccgcttcgatgcgatcgcgacaaccgatatcgtggcggcaccacttgactatctgcgtcctgaagacccgacggtccttgtctccttcgcccgttccggcaactcgcctgagagccttgctgctgtcgagcgcgccggccaggtcgtgaacaacattctctacctcaacatcacctgcgctcccgagggccaccttgcccagcagttcaaggacgacaacgagaacctgacgcttctcatcccgggcgccaatgaccagggcttcgccatgaccggctcctactcctgcatggagctcatggcggccctcatcttcgatacggcttcgcgcgaggacaagggcacctgggtcgcagagatcgcagccatgggacgcgaggtcatcgcccgcgagcctgagatccagaagtggatcgacacggacttcgaccgcatcacctacctcggctccggctccttcgcaggcgaggcacgcgagtgccagcttaagatcctggagctcacgcacggcctcatcgctacctccttcgactcctccatgggctatcgccatggaccgaagtccttcgtcgatggcaagacccttgtcttcgaccttgtccacaacgatccctacacgcgccagtacgacctcgatattctgaatgagatcgcaggcgacaagatcgctgcccacaccatcgcaatccagcaggaaggggagaccaagttcgaaggcgagtccttcacgttcggctctgcctacgctccgcttcctgaggcatacctcgctcttccgtacgtaatggttgcccagacggtctcgctcctcacctccgtcaaggtcggcaacacccctgatacgccctctccgacgggcacggtcaaccgtgtcgtgaagggcgtcaccatccacccgttccagatataagatgtagcttatgaggagcatgttttcataaggaggcaccatggcagcatatgcgctgcatgcacagcacttcgtcctcccgtcgaagatgacgggagagggatatctcgtcgtcgaggacggcaagttcggcaggttctctgaggagaagccagaaggagaggttgtcgagctcggcgatgcaatcgtctctccgggccttgtcgatacccatatccatggcttcttcggccatgcaacgaccgactgcgatgcagaaggcctgaacgctgcatcgctcgagcttgcccgccgcggcaccaccgcctggcttccgacgacgttcacggattccgtggacaacatcgcgaagcagtgcaaggccatccacgacgcccgcgcaagccgcgacgccgacttcatgggcgcacgcatgccgggcatctacctcgagggccccttcttcacctacaagcacaagggcgcccagaacccgaagtacctcgttccgccttcctacgctgcctacaagcgctggcaggagagctccgacaacatgattgtgaagagcgcctctttgctctgctgccgattacgacaggcggagagtacatctcgaagctcgccgccgaaggtgtcgtcactgctatcgcctccgatgcaacgtatgcagagacgctccgcgccgtccgtgccggtgctacctgcttcgtccacacctataacgcaggcggcctcccaccgcgagccaggcgttgtcgtgccgctatggtccacgaaggatacctacgccgagctcatctgcgatggccaccatgtggttcctgctgcctgcgaggcgctcgtccgtgccaaggctagcatgtcgtgctgattaccgactgcctcgcctgcggaggcctgcccgaggcgaatacatgagcggcggccttcctgtcttaatgaaggacaacctctgctacctcctgaacgaggatggcacgacgggctccattgcaggctctgtcctgacgcttgccctcggcgtgaagaacatggtcgactgggcatcgtctccctgagcaggcgctccgcatgggctccgaggtggcagcacgctcggcacatgtcgataatgtctgcggcttcatcctcccgggacgcgaagccgacttcaatgtcttcgctcctgatatgacccttgaggccacctatcttgctggccgcaaagtcgaggcctaggcgctccccattatcccttctggcgcttgagtcccatcccctttgaaagcaggcatcccgtatcgggtgcctgctttcatataggggagttcttcaaatggatgcagaaaacgaaagtgagtatgccggtaacagataaagcaacattcggacatggttggctggtagactcgcatcaaaagactgatctgaaggagtgtccatgaccatacgcgaacagcccacgccctgcgccttgcctctcctgccctcgctgcctctgcgctcgatgcgcgcaatgccttcatcgcagcgctcggcaaagagctcgaacccacaaggacgaggtctttgctgcaaacagagaggatatggcagatccccgaagcagggacttgcagccaccggcagaagcgccttcgctacgacgaaggcagcttcaaagtctctggcacagctctcatcgctcgagcagctgagcgaccctatcggtgtgacccttgcgcgcgagctcgatgaggggctcgtgcttcgccgcgtgagctgccccatcggcgtcatcgcgtcatcttcgaggcgcgtcccatgccctgatccagatcggctcgctctgcatcaagagcggcaatgcggcaatcttgaggcggcaaggagacgcagcgcacgaaccgggcgctcttcacccttgtcgaggctgcgcttgcagagcagtcgatcgaaggtgcttgcgcttgcagaatcgcatgaggagatagacgagctcctcggctgcgacggggatgtcgaccttctgattccgcgcggctccaatgccttcgtctcttacatcatgaatcacacgaagattcctgtgatgggcactcggcgggtgtctgccatgtctatgtggaccgttcggctgaccaggacatggcagcaaagatcgtggtcgatgcaaagacgcagtacccggcagtctgcaatgccgcagagacgcttctcgtcgatgcaccgattgcggaggagttcctgcccaaggcggcgcgtgcgcttgccgagaaaggtgcacgtctcagggcgtcaggcgaagcccttgctatcctctccaaagtctcaggcatacctgaggtcgagcctatgggcgaggatgagtatgggaccgagtacggcgactatgtaatgagctgtaaggttgtggatggcgtcgagggggcggttgcccacatcaaccgctggggctcgcaccataccgactcgattgtcgccacagatgatgcagcagctgcctacttccagcaaagggtcgattctgctggtgtctaccgcaactgctcgacgcgcttcgccgatggcttccgctatggcttcggcgccgaagtcggcatctcgacgggcaagctccatgcacggggaccggtcggccttgaaggcctcgagacctacaagtacctgctcgaaggcgaaggccacatcgtcggggactatgcggcgggtgcgaagcagttccacttccacgagctggactagcagaaatggtccccgcagcgtgcatgctgcggggaccttgctttggatggatgctattccactgagattctctggtagagccctgcatcctcgaagccgagcatgcggtagtattcacgggtgccaacagcgctcacgacattgagccactcatatccggcgtcatgtgcaatctcttcggcgcgtttcacaagggcacggcccaggccttggtgctgggctgcagcatcggtcctgccgagatgcgctgcctgtccatagacatgcacctcgcggatcatggcttcgcctggaccagttggcagagctgctgcatctattccgaggatgccttctttgagtctcttccatttcggaagcgacaggcgcaggaatcccgcaatgtgcccatcgggcgtgacccactggaggaagtgctcttcggtgccaagcgtctcgtaggcagcatcgtccagggaaagcgtcgagaggtctacctcgcgcccagcaatctcgcggaagcggatatcgtgcacaagtcccgcctcgcctgcagagatgattttctgctctaccatctggcgcaggttcgtcttcttgttgccggccatgatatcgtctgctgagatgtcgcggatcatgcgactgatgcgcacatagggaggggtcgcgagcgtgtctgcgaccagcacatgcagaagctcctcttcggtgtaggggcgccatctgccctcttcgtattccttcacaagggccgttcctgccacaagagcgcaggggtagagcttgatctcatcgggcaggaagcgcggatcttcgacaaaggtcctaaagtcctcgatgtcttcttgaggcgtcgatccttcgaggttcaccatcaggtgcgtatggatcttgaagccgaagaggcggatcaggagcatcgcgcgggcgatctcttcggtcgtcgtggcacggcggttgatatcgaggatgtcctggcgggtggactggatgccgatctgcaccttcgtgcagccaagcgcgcggaaggagtgcagggcctctggcgtgatggtatcaggccttgtctcgatcacaaggccgaccatgcggtgcgcggtgtgctcgtttgccttctggacagcgtgcagctcgccttcagtggcagacatccaggagagctgggcttcctttgtcccatagagcttctgccaggccgtgttgtagatctcttccccctgccagacccgttcctgctcaggtgcgacgaagcgctcgagggcggcgtccgagttcatatagccgaggtcacggtagcgctggtagcggcggcggagcgcctcttcgggtgcgggccattcgttcagagcgcggaagagttcgcacacgaaccagagctggtaagccttgggatagtcgctccaggtgccgccgaggatgatgagctcgaccttgtcggtcgcatgccccatctgctccagggccttgaggcgcagcgccacctgaagatacgggtcgaagaagttctgctctgccctctggcaggccggctcgtggcagagatagcttttcggcatcctcaggtctgccggacagtagaggcagttcgaggaacagggccagggacgggtgatcacggtgattgtggcgacacccgacgcggtgcgccttggcttcatctggaggcttgcatggaggcgtgccttgagggcagagtcgacctgccagcctgcccagagctcgggcctctcttcctcgatcctgatgcaggcaggaagaagactccgcttgctgaagcgcgcattcccgggaagatccctgctgtggcggcgcatgatgcggtccagctcggccggggataaggggcgctcgccggggatggcacgcagttgctcgattatgtcatgtatcagctcttccatggctctgcattataggggcaggagcagggcggaagggaatggatgcgcacttccatcctgaaagcggaagagggaattgtcagccgaagagcgagccgttgtacttcacgatggcgcggcaggcaagagccgttgatgcaagaagcacggtcaccaggatggcggtggcgatttcctggtacggtgcaggcagaaggagcgtcggtcccaggaggatgaccgagatgcctgtggcggcaagccagcgtccgctctcgagcgcaagcgccggacgtgcttcttcaggtacgttcactgtatggtagctgtggagcagacgcaccgatcctgtcttcatctgccagagagccatacccaggatgagggccccgacgatgatgctgacgatgcatcctgctgtgacttccatcgtggcctccctgagcagacgtctgaatggagaatattctaacggaaaaaggcgcacaggggcaggtgcctctgtgcgccttggagaggaggcaaagatccgagtcgctggaccttatgcggcagcctctgccttcttgttcgaaggaaggtggtaggcctcgcctccgttgtagacctcttcgtcgacgaggctttcggtgcgggcaacgatcagcgatgcctcggcagcgccgacgacgttcgtggcggtacggcccatatcgacgatggaggagatgggggcgacgagggcaatcgtctcgacgggcaggcccagtgccgcaagcagggcggttgccgtgatcgtggcagtgcccggcacgccgaccgtgccgatggagacgacgagcgtgaggaggaccaggaggacgtactggccaggcgtgaagacggtgccggtggcgttcagggcaaagagggcaacgagcgtcggccacatgccagcgcagccgggcatgccgaggttggcaccaaggccggccgtgaaggaagccacgtcctcatccacgccgaggttcttggtaagcgaggagacggtgacaggaatcgtgccgacagagctctgcgtcgtgaaggcggtcacggcagcaggggcgatgccacggaagaagcgggcgggattgagcttgccgatgaaggcgacaaaggcagattcgacgtcgaagaactggattgcgaggatcgcataggcgacgacaaggacgccgaccaggggcaggagcgtcgcgacatcagcgcggcccacggcacggccgatgagggagacgacagcgtacggcgtgaaggagacgatccagctcacggcgttgccgaggacggagttcgtggcatcgacgaaggccttgaacggcttcacgtccactgccttctcggacggcgcctccttctgcttctgaacgaggcggttgtaggcggcagcgacaatcagggcaaagacgatgatggggacgacggcgttgttcgtccaggaagtggcgaggttctgcgggaagaggccgacgattgtgtccgtgacggatggcacggtctttgcgtcgtagctcacagcgtcaagcgagaagccctggccgatgtggagcggcagcgcgatgaggagcgtgagcagcgttgctgtcagcgtgttgaggagcaggaacaggacggacttccagccgatagctttgatgtgcacgaggtcggagaggttcgtgatcgacgcgatgatcgagaagaagagcagcggcacgaccatggcagagatcacgttggcatagatagtaccgacgagagcgtagtaggtgtaggatccgccgaaggcaaggccgagcacgacgcccaggccggttgccagaaggacgcgtgcgccgaagccccaccggaagcgccgtttcaggacagcaagcagcgcgaagaaggctgcggcgacaatgagggcggcaaaggccgatgcatcgaattccatatcaggttcctttctgcgtcaataaaaaagggcaggtccataagggcctgcccgaaagagccgatctgtgcatgccagcagctagcgccgacatcgcgcagaggtcccggacaggcacctgtcacagcacatgcacatcgagctcgccatgatgctacgtgcgttaagcatggtgtgtctcctctccgggtctctcaattcctactgaactgcttggtgttacacagtaaagcgcttcttcccatggattgcaagaacaaattccgagcatcgtgataggaattgcagagggccaggaatctcttttcccgctagcgggagacgtcccgaagatgccggtgccctgcatgcgtagccttgcggaccaggaagcggaagaagcctatgggctcgatgccggcaaggccatcgtctccggatccaaagagctcggaatcgattcggcaggctggcacctggtctccttatgaccttattccaggtcctgtctgctgctcttcttcaaggcaccagagggcaatgcgtgtgacaaggtcggcatcgattgcgccgtagggaatccggatgctgcctttgctcgagacatatctgccgtccagctcgtccttgaagtgacggacggcagcatcccccggatagagcccgatatggtgcttggctgcagcgaagtggatgagattgtgtccctgccataaggtgggcatgctccaggagatcctctcctcggcgtcgggcagcgcccttctcagaatgtcgcgcatctgctcaagctccggacgtatgtcctctggctgccgggcaaggtattcatcgacgctcaggggctttttgccgcaccagtgggactggttcgtgcgggcaaatgtccgcccgcacttggggcatgtccacatcggctgctcctttcacatgttcgatgccggcgtcagcagccggctttccctagagccgcgtgacggtctcggagagctccttgcgcgagttgtggttgggaagcgggtgcgtgccttcggctgcatagcccagatcgattgcgcagaggaccttctcgttctccggcagtccgaagacacgcgcggcctcttcgggattgaggcggttcacccagcaggagtcgacgccttcggctgcggctgcaaggatcatgtgtgtcgccacgatgctcgcatcctctacgcccgaagtgcgttcgcttccggggtaggtatagacattgctgctgtcgaacgcgacgagaaggacggtcggcgctccatagcggcagggggtgaggctatcgagcttctcgagggcctctttggattgcagcacgtagatgtgctgctcctgcaggttctttgcggtcggcgctacgcgtcctgcttcgaggatctgcgtaagcttgtcctcctcaacggcgcggctgctgtacttcttgcaggaatagcggttcttgatcgtgtcagtgaattccatgggcaatccttttcgtactaggcgggcccgtgcgggcgcttatgcccagtgtagtggcattccgggtgtgcagcaggaagcatgcggcaggagagcagaagatgccgcctgcatagccggaccatgaggcggcccgctcttcgcaattcttgaagggccccttcgaggcaggctggcataatggagcaggccagaaaccagaaaggggccatgcatatggatcttgaagaggtcgaggagcgctcctgcgctctgagaaggcgctatcacgagctggagcaggagctccacgactcggtgtggagcatcgaggaggatgcgcttgccttcctgaccgatgccggcatcgtcggacgccttgcgatggaccatgaagggcgctggcccagcgccgaggcagacaggctccctgccaagataggcgagtgtgtctggtggcttgccgtgctggcagagcgcatggacctcgatttcgaagactgtgtcgacggctttctggcagagcgggaagaagcgctgctgaacgcatcggacagaagtggacaggacgcatgagcgaggatcctctgtcccggggccaggcagatccggcgcttgccagacgcctggtgcagctgaccgaggcattctatgcgcaggaagcgcagtctttctccagtacgagaaaagctgcctgggaaggctggagaaagatcttcagcctgctggctgccgaaggaaggctgtcgctttccgtgatcgatgtggcttcaggcaatggacgcttcggccgcacgctggcagaggcgcttcctcaggtccgcatccgctaccaggccattgactcctgtgcgccgctgatggacgaggcgccaggctggcctgcttcgatcgaagctgcctgcttcgagcaagatctcatcacgccgctcctcgagggagcaaaagcccttccttctggcatcgagccggcagaccttctctgctgcttcggcttcctgcatcatgtacccggcgcggggctgcgcctgcgcttcgtgcaggagctggtggacgccacggcagcaggcggcatcgtcgcgcttgccctctggcgctttgcggacagtccggcaggggcacagaaggcggaggcagcgacacggagagcctgccaggagcttggaattgcccgggatgcgctggagccgggagactatcttctgggctggcagggaaagccgggcgtctggcggtactgccatagcttcacggaacatgaggcgcaggagcttgcccatgcggtcagaggccaggcctctgttgtggcctcatatctggccgacgggaagacccatgaccagaactgctacctcgtgctcaggaagagggcataaggcgcagctgccatgcaggctctgccagaatgccgggacaggtccgatgcacgcaagaaggaaacaggcccgctgcagcggctgtgcagcaggcctgtggatgtctcagctcagagacgggatatcaggcttcgagcagcttctcgagctcctggcggacggcgacgatgaagcctgccgtatcgagcgtctgagggttcgggagcttcgtgatgcgggcgagatctcctgtcatcctgccggactcaatcgtggcaagcgttgcctgctcgagcttgtctgcaaagtctgcaagggcaggggtgccatcgagctcggcacgcttcctcagagcgcccgtccaggcaaagatcgtggcgacagagttcgtcgaggtcgtctcgcccttgagatacttgtagtagtggcgctgcaccgtgccatgcgctgcttcgtattcgaaatagccatgcgggctcacgagcactgatgtcatgagcgcgagcgagccgaaggcgctcgagagcatgtcgctcattacgtcgccgtcgtagttcttgcaggcccagacaaagccgccctcgctcttcatgatgcgtgccacgacgtcgtcgatcaaggtgtagaagtaggtaaggcctgcctcctcgaagcgctccttgtactccttctcatagacatcggcgaagatgtccttgaagcggtggtcataggtcttcgagatcgtgtccttcgtcgcaaaccagaggtcctggtgcactgacagggcataggagaagcaggagcgtgcgaagctcgtgatcgacgagtcgaggttgtgcatgccttcgacgacgcccggctctgtgaactcatggacgagcgtgcgggtttcggtgccatctgctgccgtatagacaagctcgaccttgcccggccccgggatgcgcatttcggcgtcgcggtagacatcgccgtaggcgtgacgggcaatcgtgatcggcttcttccagttggaaacgacaggctcgatgcccttcacgatgatgggggcacggaagaccgtgccgtcgagcatggcacggatcgtgccgttcgggctcttccacatcttgtggaggtcgtactccttcacgcgggctgcgttcggcgtgatcgtcgcgcacttgacggcgacgcccaggcgcttcgttgcctctgctgcatcgatcgtgacctggtcttcggtctcgtccctatgcttgagtccgaggtcatagtattcggtcttgaggtccacgaacggctccagaagctcaaccttgatgagctgccagatgatgcgggtcatctcgtcgccgtccatctcgacaagcggcgtcttcatctcgatctttgccatgttctctccttcgaggggatgttcaagccataactcaagattgcatctcttccagtctagatgctcctatctcttgggctgaaaatggatacgcactgtaaacgaaggcagcagaggcatcaggtatgcttgaagggtcaatgagcagccaaggagcgcagcatgtcggatatcctttcctatctcgcagagcctgagaccgtcgtcgtattcgatatcgatggggtgcttgcaccctatgagttcggcgagctttctcatgccgcctgcctcgacggagactggaagacctatgtgcttgaagagcacccctatgcccatatccgtcctgtccctcagatccagcgcttcatcgagaagaaggggcgcacacgcgtctttgcctgctcggtcgcagaagactatgaggaggaagggaagcgcgatttcgtcgttgcgaactacgggcttcctgccgaccacgtgaagctcgtccggagcaagggcgacaaggtggcggagctcagagccttggcaaaagagttctgcgcgtccgagcggcgcgtcgcgcttgtcgaggacacggtaaagacgctcgacgaggttgccagaaagaccggatgcacgaccgtccatgtctcgtccttcttctttgcatagaacgctgatccgtacgagaaaggtacgccaatgattctcgaccgaagcgaactcaagctcttccatgctgccatggccctcatcgagttcgaggggaacaagcggctccatatcgtgccatacagcatcaagtacgagcctcctgcaccggatgatgaggcagagctcctcgatgctatcttccattcgcctgaggtgctcaaggacatcgcggagcatcttccgtcccagacgccgcgcaaggtcgcagaccttatccagagctggcagcatccgctgacaggcaagttcacggtcgtacagcttggaccagaaccgctcttccttggcttcgatcgcgctttcgccgtcgcaggcatcacccattcgattgcaagcgtggtgggcaagttcccggctgtggtcgatacggtgcttctgcctttcggccgtttcattgtctacgacgcctatcttcagacctacgacatgggcttctcggaacgcatgaaggccatgtttgctgatgaggcagcacgctgcaagaaggaggggcttatcgtccgggatgggcgcgaacttgcaaagaacgcggagagctggatggaagatgcccaccgccatctcgaggagcatgagaggcatcagaaagagcttgaagagaaagatgagatgccggaaggctgccacaggggtgcgcttgccggactcgctcctgacgagcgcgagcgtgctgcgaaagccgcaagcgatgctgcctttgacagggcggacgcctcctctgctgacaagctgcgcatgaagctcctcggaaagctatcgaagaagggccagccggtgcatgcccttgcagagcagctttcctgcctcagcaaggcccgcctccaggagcttggacgcgcactggacctcacacgcctctcgaagctcaggaaggacgagctggtgcagctcgtggcagaagcgctcgagcagaacccgcggtttgatgaggtgctctccatctgctttccggaggagttcaaggcagtacgcgatgcagtggctgcgggcggcgtgaaggaattcgatctcgaggatcccagagagcttcatgctgcgtgccgcatgccggagcttgtcggtcttggcatgctcttcgtctcgggcacgaaggcgagctttgccctctccgacctgttcatgtctcaggcgccatcgcttgactgggatggaatcgaagcgcgggtgcagcagggacggcggatcttcgaccatatcggtgctgcggtctatctcagaggcatcatgctggctctcgatgcgaatgacgagttcggcgagggcctttccggcaacgaggtgatcgatatcattgcccgctatatgcaggcaggctacgcaggatttgcaatcatgtcgttcgagggagatccagatgagctctatctggtggatggctccctctgcgacagctgctatccgcctgatgaggacagcgaatggacggaaggccttctgctcgaccaggagatggatcctctgatagaggatatcctggacggccagcagggcaaagagccccggccgcttccagaaggtgtcgagaatgatgcagatgtcgaggaatggatgctcaggattcctgaggtccaggagctcaggagctatctcgacgcccatgtgccagacgatgcagatgactatttcttcgcggacgatgtgatagaggagttcctctacgatatgcgcttcggcatgcctggcacgaattccatccagcactacctgaatatccttgatgaatacggattcgtcccgaccgaggcggtgcttacgcagctcctgaacaggatcatgaagatgatgaatgcggtgccgatctggccgaacaacggctggtcaccgaatgagctgttccatcgcaatccggaaaaggactcagacattcagatagatacgacgcggatcgtttgatgggaatgcgggcaggagacagaagggcttgtctcctgcccgctctgccttactcgaggattatctctgcctaccgcttcatgcgctcttggagctcttcgctcatgctgtcaaggtcttcgagcgtgatcgctccttcggcaagaagcttatggagcacattgtccatggtcgagcgcgagagggtgcattccacgcatgccatcctccggtccttcctgatgcgcccgtcgagcttccagaagcgatcggatgctggcttggaatcatcaggcaggaatctcctggtactcatggcagagccgccccattgcctgcacctgccattggggaagcagcttccggaagagcttccagtccgattccttcacgcctcctgacattatccctcctctctttcatctggtacgagccagccaagatgctgctcgaccagaagcctcagcgatgctgtggcctcctcataccctggcactgtctcatgcagaagttcgggcaggtcttttcggccaggggattcgagccggcgtgttaccgcttccgtgcaggctagggctttgccggagcatggataagagcatgaagccatctgccgcgggtgacccttcttgccagtgccctgcatgctatggagaaactgtccagaagagaagtcttgtctttctcgtgttcctgacccgtatggacgagctgtggtcctgctgtttctgcaggaatccatgcgtgctctgcatgagcttcttgctcgtttccgaccattcggagctgatgcgtcgccagagcagaaaatgtggcccggctctcattgaccgctgaatcggcattttctatacttcttcttgaacatatgagcagacattcatatgcacagtaaagagatggtgccaaagggcactgggccgggaaagccatgctttccagaaaggagagggccatgggatgcagctgctgcggacatgacgctcacgaccacgacgaagacgagaagaagccctgctcgtgctgcgaggcagacgaggaggacgaggacgacgatgatgaggatccggaagtcctcaagaagaagatcctgatttcggcactgcttcttgttgctgccgtcatcgtcaccaaggtctgggaattcccgctcatcgtccagctcatcttcttcctgccgtcctatcttgtcgcaggaggatctgtcctcaaggaggcaggggagaacctggccgaaggccatcccttcgacgaggacttcctcatggcagtcgctacggtcggagcgcttctgatcggcttcattccgggtggcgagcccatgttcgccgaagccgtcttcgtgatgctcttcttccaggtaggagagctcttcgaggggattgcggaaggcaactcgcgccgctcaatctcccagctcatggatatccgccccgacacggccaatgtcgagcgtaatggcgaggtcgaggtcgtcgaccctgatgatgtcgaggtcggcgagaccatcgttatccgtccgggcgagaaggtgccgatggacggtgtcatcctcgagggctcctcgagcctcaacacggttgccatcacgggcgaatccgccccgcgcgatgtccttgcgggagatgcaatcatctcgggctgcgtcaatgtctcgggcgttctgcgcgtcaaggtcacgaaggccttcggcgagtcgacggcggcaaagatcttggacctcgtcgagcatgcaggccagagcaagtcgcgctccgagaacttcatcacccgcttcgcgaaggtctatacgccgattgtcgtctacgctgccatcgccgttgcattccttccgcctctcttctcgggagacttcggcgccagcttcgcgacatggcttctgcgtgccctgacgttcctcgtcgtctcctgcccctgtgcgcttgtgctctccgtgccgctcaccttcttcggcggcatcggcggcgcttcgaagcagggcatcctgatcaagggctccaccttcatggatgcgcttgcgacggctgacacgatcgtgttcgacaagacgggcacgctcacgaaaggcacgttcgtcgtgagcgccgtgcaccctgacaaggtggatgagaaggagctcctgcatctggcagcgcatgtcgagcagttctcgacgcacccgattgcggcagccctgcgctctgccttcccgtgcgtcggcgacggctgcgagatcaaggacacgaccgagattgccggccagggcatcgtggccacggtcgcaggcaagagggttgcggtcggcaatacccgtctcatggacgccgaaggtgcgaagtggcatgtgtgcgagcatgacatgggaacgtgcatccatgtcgcaatcgaccataggtatgcgggacatatcgtgatctccgacgaggtcaagccagatgcagcagaagccatccgtgatatgaaggcagaaggcgtccacaagaccgtcatgctcacgggtgaccgcgaggaagtggcgcatgatgtggccacagagctcgggctcgatgagtaccggagcggccttcttccgcaggacaaggtcgccgaggtggagaagctcctctctgcgaagccggaaggcacctcgcttgccttcgtcggtgacggcatcaacgatgcaccggtgctcgcccgtgctgatgtcggcatcgctatgggcgctctcggctctgacgctgccatcgaggcggcagatgtcgtccttatggatgacaagccgtcgaaggtcgctcttgccatccgcattgcccgccgcacgatcaagatcgcacgccagaacatcgtctttgccattgccgtcaaggttgcaatccttgtgcttgcgctcttcggtctcgcgccgatgtggcttgccgtcttcggcgatgtcggtgtcatggtcctctgcgtcctcaatgcgacgcgcgcgctgaagtagcagggggaaagtccataaatgcaggacaggggtccgcgcttcggcgtgggcccctgtctcatcatgcatcatcctatcgaatctgaagtcgccagcgattcagcatgtccatcgactcctcatgatacgtgtcgaagattgtgaagaagatcatatcgagcatgaacatcagcgaatacttgttggcaaaaggaagatgctgcgaatactcttccgtatcggcgagctcgccgatgagcttgaggtggcaatagggcagaagacgccccttgtcattgttggtgaccaggatgctctgctcaaagagtttcttggctggatcgagctcgcggaatgcgtcgtatatctcgcggcagttgccgctgttcgatacgagcagcaatacatcgcctggttcagcagaaatcactgcctgccgctgctgttccctctctcgtgccaggaagacattcgtacgtatctttgagagccggaacgacagatcgtatgcgatgttcgcggagttcgcttgcgccatgatgaagacgcgcgatgcatcgtgaatctgctgcgcgatgggcttcacgtgctcctggttcttgcaccatgcgatgaatatcgcattcgatatggtctctacataggagttcgatgagatgctgtagtacttggcagcgtatttcagctcgtcgaagcccgagaagccgaatttcttcgagaacttgatgaccatggctggagacacgctggcagtcttggccacttgggataccgagaaatcgctgatgttgtcgaagttgctcaagatgaccatcgcgatcgccttgttcgcatcgctcaggctccggaactgctcctgaatcattcgacggacattgatcatattccaccagccttagggagtaaaactatttactcataatgaatgattatcttagtgactcagagcaataatctcaagataaaaatgcagatatactggcactgcgcggcgcagagaaaatacatttacaaataggggatacgttatggtcaaagagaagcttcaacgcattggccaggtaatgctgattccgatatctgtcattacggtggcatcgttcctgatgggacttggcagcgtcatgtcttcgacgactaccttgaccgcgctcggccttcaggacactatcaccaaaggctcattctggtatgacttcttcagcgtgatgaacgcaagcggaagtctcgtattctcgaaccttcctgttctgtttgcaataggcagcgcctttggacttgccgacaaggaaaagggctgggcggctttttccggcgtggtagccttcatcgcaatgcataccatcatccagacgctactctccgcgcatggcatgaccccagataccacgacgcttgattatttcgagagccagggcatgaaccataccgatgcacttcgtactgcctctctctacaccaaggagctcggcatcttcacataccgcatgagcatctttggaggcctcatcgcgggcatcacgacctcatggttccataatcgcctctgggacgtgaagctgccgcaggtactttcgttctttgcaggcacgcgtactgttcccattgtcatgcttgtcatcggggcgcttctcggctgggtgttctattatgcatggcctcctctgggctacggtgtcagcgatctttcgctcttcatcgggaattcggggcttctgggaacagctgtctgggcttatctcgacagggcgcttgtgccattcggcctgcaccacctgctcacccagcctcttcgctacacagagcttggcggcacggcagtcattgacggtgtggcgtactatgggacgaccaacatcgctatggcccagcttgcaagcccgactgcagacaagattctcgtccgtggatactattctggacgcatgttcatcaacttcggtggcttccagggggcctgccttgcaatgtatctggcagcgccgaaggacaagaggaaggcgacggccggcatcctgataccgtgcgctctgacggtcatgctgtttggcgtgacagagcctctcgaattcacattcctgtttgtcgctccgtggctcttctatctggtgcatgcgcccctcactgcccttgccttcgttttggcagaagcctctcaggtatctacctttggcggctgcatcaaggacctgctgccgttccttctccagccacagaagctcaatctctggccgatgctctggggatgcccgctcttcttcgcgctgtatttcttgtcgttctatttcctcatcctcaagttcgatgtgaagacacctggccgcgaggatgacggagagatcaagctccatacgaagaaggaatatcttgccaaggaagaagcaaagaaggccgagggcggggcatctgatgctcagagtggtctgcttcctgagccgaatggagtgattcctgcaggaacggagctggctgaccgcatcatcgcggggcttggcggcgctgaaaacatcgaggttgcagaaaactgcatctcgcgcctcagatgcagagtcaaggatccagcgaaggttgtagacgatgactactggcgcagcgagctcgaggcaaagggcgttgtccaccaaggcaattccctgcagatcatctatggaacgcaggtaacgatgatcgccgccgatgtcagaggccgactcgatctcgactagcacaatgtagctcccgatgccgtggacatcgggagccatggaggtaaggagtttttcgtgagcaagactaccgtccatgtcatttcgcatacccactgggacagggaatggtatttcaccgatgatgactcgcaggtattcatggcaatggcgttcagtgagctgctcgacgccttggaagataatcctgccatcaagagctatatgcttgacgcacagacttcgatcctagaagaatacctgcgtatgaagcctgaagaccggcccagagtggagaagcttgtgtcttgcggccgtcttgtgactgggccatggtattcccagccagatgtcttcaacgtccagggagaatcgatactgcgaaacctgttgatagggatgaagcaggcagaatctctgggtcgttgcatgatggttggctatcttccggatacattcggcttcaatgcgcagatgccgctcatttttgaaggcgttggcctgaaacatgcagtcatcagaaggggatacgatccatcccggattccctcgaccgaattcaggtgggtggctctggatggcaaatcctctgtagtggctgcagtccagccgtatggatactcgatggctcatccgaagcgtggcggccgcatgaggaatttcagcagggagcagctgttcaaggaaacatatccgcttctcgaaagagtcgaggagctttcgaatgcgtcggatgtgatgctcacagtaggcggagatcaggtcacagtcgatgagcgcatcggcgatttcattggagaacttcagaagaacgatccgaacaaagacgatgtcttcatccaggacagcatcgaaggctatatagcagcccttgagaaggagcacctcgatctcggcgactattccggcgaattgcgtatgccgcgctttgccagagtgcaccggaccatcgggtcggtacgatacgacataaagcagatgaactatctggcagaaaagaagctgcttcgtgaggcagaggtcatgtctgccatctcttcaaagcttggcctgtattccgataccgtcaatatcgagcgggcatggaagctgatactggcctcgcaggctcatgattccatgggtggctgcaatagcgatgacacgaatgctaccgtgctgaagcgctgcaaggatgcctgcaataccgcagatggtgtgttctatctgcttgctcggctggtgagcgagaatgtctatggcggtggacatgaatcccatttccttctggtcaatggtggcttcgctaacaaggtatatgcacaacgctgcacagtgctcacgtccgctccagatttcgcgattgtcgatgcgcatggcaggaacgtggattttgctgttctttcgcagaaggcccatccttatgaacgcaaggtagagatcaacgtcgacggcgaatctgagtcggctgatgagcgcgtctactatgagaacgagattcttcttccagaagccgaggtgccacagctgggctatgcgaccttctatatcgatcctgtggactctggatcgaagcatgtggcagaaaccacgaatgcagcaatagaaaactccacctggagaatctcggcaaaggaagggcatattgcagtccggaacaatgtgacaggccaggagattgacgatgccttctggcttgaggactgtgcgaacgatggggacctctatgatttcagtccgctcgagcatgatgacacttcgatgctccgggtggacagagtgatcaggtgctgcagatttggggacgttcaatcgctggagctcgcatgcagggcagaagtgccctgccggctgaatgacgagcgcacggcccgtgttggaaaagcagtcgtgcccatcaatctgacgctgagcatatctggatctgacctcatcgatatgaaagtgcacatcgacaatacggcactcgaccacaggatgaggctcgttttcaatactcagattgcatcgaccgatacgcgtgcaggcgttccgtatggaacgatcctgagaaagaagacggtgcctgcatcagactgggctgatacctatggagaatgccccatagacatctatcccgtcgatggctttgtggagctgaaagatgggagtcgggctgcagccatctttacggagggctgcaaggaataccaggtgcttgaggagggcaggcttgcactgacgctgttcagtacagctggaagccttggcaaatgcgatttggcatggagaccaggacgtgaatcgggccgtccggttccaacgcctgagtcggagcttctggggccgcttgacttccatctgggattctggatgggcgagccggctggcgctgccgtgcagattgccgatcttgccgaggagttcaggtcatgctgtacttcctatcagacgcagggattcttcaagagtttccagaggatggattacttcgatgtgaacattccgcacgccgaggtccccgattcatgctcgcttgtttcaagcgtgcccagcggcattggcttcggatcgataacgcaggccaacggtagccttctgctgcgaatcttcaatcagaccgatactgccatcgcttgcagtccggaggaattgactggcgatggtgatgcagcggccgcagattgctggggaaacaggacagagcaatggtccctggtcctcccgaatgcattcgccaatgttctgattccggacaggaagtgatttcaatgaagccgtttgcaaatcctgtgctgaaattcaggcggctggttctgggcctcgatcctgagaagatgttctttgctttggattttctgctggcactttcgggagttgctgccatttgcggagcggcgcttgcagcagatgcagctctgcagggcattccctgcttgataggctcggtataccttggtcttgcagcaatgatctatttcatgctgcatcgcaatctcatgggaacagccctctgcaatgcacatcttgtcctggcatttacgatttcggtgatgctttcaaattggcttgccattgcagcgagcattcttgccctgatctgcgcagtgaatgccagcccgaatgatgagaagcagggaattccagtttgggcaggcttcgctctgtcttctgtcctgcttgtccttctggcgcttctctgccgtatgctcgctgcgttgtagagggagaccgatctgctattcgcaggggtccgcacttcggtgcgggcccctgtctcatgctgcagagcgaagaagcctaccggttgtgcacgaagtagccttcgccgtgcttcttcttgtagtccttcatgttcctgactgtgttctccatgccatacggcacgtagtccatattctccaggtcatgcggcaggtatctcgagagggagagctccgcggtctgcacaggattggtgggtgccggatcttccgggatggcgcagaggcccaggaccttcgcgccctgtgccgtgagcctctcctcatagcctgtcaccggctcgtcgggaagcttgcttctcgtatcgtctgtcttccagacgaggcggtagttcgcaagcggcaactgcgtgagcgtgaagtcgaagaagggctgggagtcggtcttgaggacgatcagggcgcctggagcaaggacacggcggtagtccatgaggcggtccaggattgtgaggcggtattcggcgaagcgcttcttcgggaagggcgtcgggaagttgatgtggatgcaggagagctcgccttctccaaagaactcaggcacatcgtttcccatgccaggcacgaagagggcgttggggagcttctcttccaaggcaagctgcgcggcataggcgatgcagacaggctcggtgtcgatgccgatatagagcgtgtcagggcgcatctttgccatcccgcaggcaaaggcgcccttgccgcagccgaggtcgagctctaccttgctgaagcgcccaagtccgctctcgtcgagcggatggcaggcttctgcccatctgccggcatatttccggggctcggtctcgattgcgtcggcatatctagcaagccgctcctcgagcacgaagtgcttgggcatgcgggcatggaccttgtgaagcttgtgcatgggactccttgtctggaacgcgattttccttctgcatgctaatgcacggaggagtgcctgagcttcttgttcctgaacgtacagagaaagaaccccgcagcggctgctgcggggttctggtgtggcatatgcgaatgcggcagctactcgccgtcttcctcctgcatggcctggagcgtgctcatgagggcagggatgacctgcttcttgcgggagacgacgcccggaagcgtggcgatgccgttctcgggcttcacgccgaaggcacgggagacgatggcctcggtgttcgggccggagtagaggagctccgtcgtctgggacttcacgtccgtgaacatgtagaacaccatcgggatatcgttggcggaggcgccatccggcaggtacggtccgacaagggcctctgcggccttcctcgatccttctgtcatgaacgagccctggccgacgccgaagcggacacggccgcggctgaagaccttgaagtcggagccgaagacttcctctgccgtgcggcccgtgaggtcggcaccggcatcgaacatctggtcagcatacgtgtcgatatcgacaccggcgatctttgcgagctccttgcccacatagacgtccctcggcgtgcaggtcggggagcggaaggcgagcgtgtcggagaggatggcagagagcatgaggccggcgatgttggccgggatatcgatgcccttctcctggtagatgtcgtagacgatcgtgcaggtgcagcccaccgggacattcctgaagtaggcgggggcctcggtctcgatcgtgccgatgcggtgatggtcgatgatctccatgatcgtggcctgctcgaggccgtcgaccgcctggctgcgctcgttgtggtcgacgaggatcacatgcttcttgcgcacagagaggagattggagctcgagaccatgccggagtagcagccgtcctcgtcgaggaccgggaagtagcggtggcgggaggaggacattgccttgcgggcgtcgtcgacggtcgtgttcacgctgaagcgcagaaccttgtcggccggaagcatcttggcgcggaccgggatggacatggagacgaggcgtgcggctgcataggtgtcatacggcgtcgtgatgatggcgcagctgtttgccgctgctgcctgctgcacgacgtggctcacctgggcgccgttgcagatgatgagaaggccgatgccagattcgacggcgaagcgctgggtctcgtagcggttcgtgacgagcacgatgtcgcccggctcgatgaggccttccatcatctcaggggaggtgccgacgcgcacgttgccccgggtcacttccccctcggggtcgccgagcacgagctcgcccttgagcgtttcgacgatgttggcatacttcgtcttcgcattgctcacgaccagcgtgtcgaagatgtccatgttcgcgttggcgatatccttgacggcgatgatgccgagcatcttcttctcgtcgtccgtgatgcagagggtatcgaccttgcccgtgcccatcgtgttccaggcagcgaacagcgacatctcggagtcgatgccgggcaccttctggtaggagatgtccttgatctgcggacgcacgctcgtgatcagaggcggctcctcgaagccgaagtgatcgagcacgaaggcggtctcgcggttcacggctccggcgcggcgtgcttcgtagtacgtatctccgagctggttcttgaggtaggcgtaggagattgcggaacagatgctgtccgtatccggatggaggtggccgattacattgaccttgcggatggtctcgggttcggacatgtgcgtgactccttgtcatcttgtgcggagcgggtaggcagatggcatatgctcagccctgctctgctgctttccagaaggcacatgattcaaggctcagtatatgtgtgtgctccattgttagcaccaactgcccgcgagcgggtcggcgtgcgtcccaaatggatgaggaaggaccaattatcacaacttgttcatgcagaacgtgcatctgttaaggggcttaggcagcaggcgtccggtcgtggttgatctcctgatagaagagctgtgcgatctcttcggtcgaggttcccgtgcccagggcccacatcgtctttgcgacaagcgcctctgtcgtcatgtccccgccgagcaatattcctggccggtcctggaatgcatggcccacctcgtagacgccgaggtcgagcccctcttcgggtacctgggtcgtgagcacgcaggtcctgccggacgctacccaggaaaagatcgcttcctggaaggcgtctccgtcgtagtcggggatgccgccgatgccgaaggtctccaagatcacagcgtcgtagtcgcgctcgaggagagggaagatcgaaggcctgagctcgggcgtgagcttcaagacgagcacacgctcgtcgagcgcgaagtagcgcctgaggtggagcccctccttcaaggcaggctttgcaaggccgctccagatgacccggttctggcggatgtaggcaagcgtcggatagttcatgctcgtgaaggcgttgtagctcatcgtgcgctgcttgtgggcacgcgtgccggcgatggccttgccattgaagacgatcgtgacctctcgggccgagtcgtctgtggcaaagaggacggactggtagaggttgagctttgcatccgtgaagggcgctgccatcggctgctgggagccggtgagcacgatcggcttcggcgagtcctcaaggagataggagagcgccgctgccgtgtatgccatcgtgtcggtcccgtgcagcacgacgaacccgtcatattcctcgtagtgcgcagctatcgtgtctgcaatctggagccagtcgcgcgggcgcatgttcgtgctgtctatgttcatgggctgcacgatatcgagctctgccagctctgcgagctgcgggacacgctcgacgagctctgtgcctgtgagtcccggggcaagtcccgtgtcgtgggggagcgaggcgatggtgccgccggtcgcgacgatgagtatgcgcttcatagcatcctttctggtagagccgggcccattctagcgggtttgcttccctcttgcgtgccttctgcgcattcgggagcagacgcttcaggctggatgtatggctcccgtacaatgaaatggatatcgatagacaaaggagcggtgcgctcctcagaaccggaaggacgtgatggtcctgtggcagagttcatctaccagatgcatcaggctcgcaaggcattccagggcaaggtcatcctggacgacgtgacgatggggttcttccctggcgccaagatcggcgtcgtcggcccgaatggcatgggcaagtccacgctcctgaagatcatggcagggctcgaggacgtgtctgccggcgaggcgcgcctgacgccgggctatacggtgggacttcttgagcaggagccgccgctcgacgaagacaagaccgtgatcgagaacatcaagatggcatacggcgacctgctcggaaagatcgaccgcttcaaccagatcggcgaggagatggcgtcgcctgatgccgacttcgattctctgatggccgagatgggacgcctccaggacgagatcgacgcggcgaatggctgggacctcgaaagccagctctcgcaggctatggatgccctccagtgccccgatccagacgagccggtcacgcatctctccggcggcgagagaaggcgtgtagccctctgcaggctccttctcgaggcaccggacctgctgcttctcgacgagccgacaaaccacctcgatgccgagtctgtcctctggctcgagcagtacctcaagaactatccaggagcagtcctcgccgtcacgcatgaccgctacttcctggacgacgtcgccgagtggatctgcgaggtcgaccgtggcacgctctatccctacaagggcaactactcgacctacctcgagacgaaggcagcccgcctcgagatggaaggcaagcagaacgcgaagcgcgccaagaagatgaagagcgagctccagtgggtgcgctccggcgcgaaggcccgacaggccaagagcaaggcacgtcttgctgcctacgagcagatggaggcagagtccaagaacatccgcaccgtcgacttcacggagatccatatcccggcaggcccgcgcctcggctccaaggtcctcgaggccacgcacctctcgaagtccttcggcgaccgtgtgctgatcgacgatctcaccttcagccttccccggaatggcattgtcggcgtgatcggcccgaacggcgtcggcaagtccacgctcttcaagatgatcgtcgggcaggagcagcctacagggggctcgctcgagctcggcgagaccgtgaagctctcctatgtcgaccagatgcgcgcaggcatcgatcctgacaagaatgtctgggaggtcgtgtccgatggcaacgacacgatcatcgtcggcgaggccgaggtgccgagccgtgcctatgtgagcgccttcggcttcaagggccaggaccagcagaagcgtgccggcgtcctttcgggcggcgagaggaaccgcctgaatcttgcattgacgcttcgccagggcggaaacctgctcctgctcgacgagccgacaaacgacctcgatacggagaccctggaatccctcgaagaggcgctccaggagtttgctggctgcgctgtcatcacgagccacgaccgctggttcatggaccgtgttgcgacgcacatccttgcctgggagggcacggatgaaaatccgggtgcctggtattggttcgagggcaacttcgaggcctaccaggagaaccgcgagaagaggctcgggcctgacgcctcacgcccgcaccgcatccaccgcaagctcacgcgcgactaggcatcgaggacagctgcaagaatgaagaaggccggcatctggagggatgccggcctttgcgtgtctctggacaggagtctagaaggagaggctccagaaggtggtcttcacctctggtgctgcatccacgatgaaggaatgctgcttcggatagaagcgcgtcgagaacgtgtacgggacgccttcgaggaagacctcgacagaagaggcgtccgtgacgatgcggaggcctgagagctcaggaagctcttcgaagcgctcggtcctgccggcaccgacagagtccatggacagatcttcgaatgccatcctgaacacatgtccgtcccaggagagcctgagctcatgggcaatggttgccgtgaagggctgatttgcattctcgatctcgcagtcgaaggcaggggtgcccatatcgacgaaggagccttgtgcggactgctcgtctgtgcggtgggcggcaagctcgcggatgggcctctgcacgacctggccatcctcgaaggagatctcgcgcggcagcgtgaagcagtgctgccagccgtcagcaatcgtgaggttcgtgatatcgggcgtatcgggcatgcccatccagccaatcaggatgcggcgtccgtcatctgccgcaaacgtctgcggtgcatagaagtcgaagccggcgtcccagagcgtgaagcccgagaacgagggatcttcctggatgggggcggagagctcgaagaagccggactggtagacattgcgcctgtcccaggcaccgccggaaaggccctgcggcgaggtcgagaggatgtggtgggtctcgccggccttgtctgtgagatcgaagtagtcggggcactcccacatgaagccgaaaggctcatcggtcgtcaggcgcttcgcgagcgtccagcgatcgaggtcgtctgcgtggaagaggaggatctctccgacatcgtcggagcgccttgcgccctgcaccatccagaagtcgcctccgtcctgccagaccttcgggtcgcgtacgtggcaggtatcgtctgccggatagtcggagttcctcatcacgacatgcttcggaccgaaatggagaccatctgtcgtgacggtgtggatcgtgttcgcctcgcggcccgtgcggatgtagtcgtagccatcccggccttcgagcttcacgttgccggtatagaagatatggatgccgtctggctggacaagcgcacttcccgaatagacgcccgagacatcggatggctggtcggggtagagagggcagccttcatagtgccactggagcaggtcggtgcttgtctgatagccccagcacttgacgccgccgttcacatcgaagggtgcgtactggaaataggcacggtagcggccctgatactggcagaggccgttggggtcgttcagccagcccacaggaggcatcaagtggaagagctcgccccattcgccgtgcgtggcgtcctgttccttctcctggcgcagcctgtcgagatcgcgttcaagtgcagtagacatgcggacactctccttgcgtcggaccaatgttcatgaccgttcatccacactatagtgaaatcgttctcatatttctatgaaaatgtggtacgtatcttgcaagcggattgttctggcgcaggtgccttcaggacatagaatggacgctcggaacggtgcgggaggacatgtggatatcaatacaatcgcgaagatggcgggggtttcccgcgccacggtgtcgcgctacttcaacaatggctatgtctcggaagagaagcgccgcacgatcgcgaaggtcgtcgagcagacgggatatgtcccttcccagcaggcgcagacgctgcgcaccggcaggacaaacctcgtcggcgtgatccttccgaaggtgaactcgtatgccgtcggacgcatgctggcaggcatctccctctcctttgccgatacgccctaccagatgcttctggcagacacgaacaacaacaaggacgccgaggtgtcatatcttcagctcttcgcgaacaagaaccaggtcgacggcctcatcttcattgctaccgttttcgaccaggcccatctcgatgcgatagcggccttgaagtgcccgcttgtcgtgctcgggcaggacctcgaggggcacacgtctgtctacaacgacgactaccgctccatgtactggctcgtcaggaaggtcctgaagcatggagagcatccagcctatatcggcgttctcgaagaggacgaatccgcaggcaagggccgtcacagaggctttctcgatgcctgccgggatgccggggtcgaggtgccgccccaagcgcaggccgtgagcgccttcacgcttgattcgggctatctgtgcgcggagaagatcttcgatgcctaccctgagtgcgacacgctcgtctgtgcctccgacaacatcgcatacggcgcaatgacgtgcgcaaaggagtacgggaagcgcgtgccggaagatgtgcagatcaccggcgtgggcgatggggacctgtcacgcgtcgtgacgccgacgctcacgacgatccatcaccactacaagactgccggcggggaagctgcccgcatcctgctccaggccatgcagggagcccccgaagtctcgcgcgagatccgcatgggctacgacatccagatccgcaattccacccgctcctagggttaacgttcccagctcttgggctcctcttaagcaatttcaagaccgattttccgttactgataccgctcgccgacgaaaacatgccgttcacgctcagcagtcaggaagctcgggtgttttttctgtttgtgcggtttcatatccatgtgagaacgattacacaaacgtgctcaagcaattggggatagggaagaagagaagggaagcacgcatggctcttgattacgcacaagctgccaaggaggccctcgaggccgtcggcggcaaagacaacatcgtgtctgccgcccactgtgcaacgcgtctgcgcctggtcatcgccgataatgacaagatcgacaaggacaagctcgagaacgccgtcggtgccaagggcaacttcgaggcgtccggccagctccagatcatctatggcacgggcacggtcgacaaggtctacgacgagttcatcaagcagtccggcgtgagcgcagcctcgaaggcagaggcgaaggaagcggcagccaagcagggcaacgccttccagcgtgccatcaaggtcctctccgacgtcttcgtgccgatcatcccggccatcgtcgcatccggcatgctcatgggcgtcatgtctgccatccagtacatgggcacgcctgtcgcagacggcggcgccggcttcttcgcactcgacaccacctccgtctggtggcgcatcgcatcgctgatcaacgcctgcgcactcggcaacctccagatccttctcggcttctctgcggccacggtcttcggcggcaacccctaccttggagcatcgctcggtgccctgctcatcagctccgacttcatcaatgcctatagcgcctccacggcaatcgccaacggcacgatgatcaccctcgatgtcatccccggcgtctactcgatcgactgggtcggctatcagggccatgtcatccccatcctcgtcggcgtctggatcctctgcttcttcgagaagcgtctccacaaggctgtccccgagatgttcgacctgttcgtgaccccgctcgtctctgtctctctcgctgcctacatcacgatcctcttcatcggcccgatcttcgtctggctcgagaatgcaatcctcggcctgctcatgtggctgctctctgtgcccttcggcatcggctatatcgttatcggcctcatctactctccgtctgttgtcaccggcctgcaccagatgtacaccgcaattgatgtctccatgctcgcccagtacggcgtcacctactggctgccgatcgcaagcgctgccaacatctcccagggcggtgcctgcctagctgtcgccctgcgcacgaagtccgagaagacgaagtccctcgccgttccttccggcatctcctgcctcctcggcatcaccgagcctgccatcttcggcgtcaacctcccgaagatgaagccgttcgtctgcggcatgatcggttctgcatgcggcgctctctgctgcttcatcttccacctcgccgcatccggcatgggcgtcacgggcatcttcggcatcctgctctgcatcacgcagcctgtccagtacatcatcatgttcgctgtcgccttcggcgttgccttcggactcacctcggccatctaccgggaggaagaggcctaaggccagcagtttcgtaccagaacgtacgcacggaagagccgctgtctttgggcatgcgtgccgatgagagcctatccttcctggagcaggtcctcgatgaagccgaccttgtaggccctgaagcggacctctccttcctcctgcgtgaggtcgaggtctacatcggcgaggatgccgaagtcgtggtcgccttcggtgtcgctgaatatctgatggacctgccagatgtggtcggacttctccctgtcctctgagagctcgaagaactgcgaggagcgggcatctgcatcgaggagggtatcctcgtgctcctcatggtagctttcgaggatgcgtcgccatacgacctcgcgatagccgtagtcggcatcgagcgcccccagcgcttcggcgtctcctgcctgggccaggcgcacccgctgccagagcgcattgcgcacgagcagcgtgaggccgcgccggtcgtggacaatctcgtccggggcctcgggagcctcctcttcgggaagtgctcctgatgcctcccattcgtcgaagagggaggagtcgatggagcggaccatgagaccaagccagctgatgatgtccttgagatagtcgtcgcgcttgtcgagcggcacggtgcggccaagcgcacggtaggcctcggagaggtagcgcaagagcgtgccttcggagcgggcgatgctgtagcgctggatgtagctcttgaagtcggaggcagattcgatcatgtcgcgcaggacgctcttcggcgagagctcgtagtcggcagcccaggggaccttcttgcagtactcggcaaaggcctgggagaggaggtcttcgagaggcttcgggtaggtcacttcctggacgcgctccatgcgctcttcgtactcgatgccgtcggccttcatctcggcgattgcgtgtgcccttgcttcgcgctcctgggcacggagaatctggtgcgggtcttcgagcgtcgcctcgaccatcgagatgaggtccatatcgtaggtgggagattcgggatccaggagctcgagcgctgcgagcaggaacggcgagagcggctggtcgagtgcaaagtcgtccggcaggtcgacaagcgtcgagtaggaatcgtggccgtcttctgtggtgcaggtgatgacgccggcatcgagcagcgtcgcaaagatctcgtcggtgcgctccgagagcttctccttctgctctgctgtctgggcagaatcctcgacgagcttgtgcatgcgcgcaagggcatctccgccctgctctatctctgcgagcaccatggagttcgtgatcctgagatgcggcacgagcgtctcaggctctgcgtcgatgagacgcttgaatgtctgctcgttccagccgacaaagccctcgggcggcgtcttcgtcttgatcttgcgggccttcttcgggtcgcctccagccttgaggagcgctcgtgccttctcgatgtcgtattcggtcgcctcggcgaggacgacgccttccgtatcgaagccggaacgtccggcacggcctgcaatctggtggaactcgcgcgcattgagcctgcgcatgcggcgtccatcgaacttcgtgagctgtgtcagaagcacggtatggatcgggacattgatgccgacaccgagggtgtcggtgccgcagatgacaggaagaaggccctgctgcgcaagcttctccacaaggagacggtatctcgggagcatgccggcatggtggacgccgacgccacagagcagaagccgcttcagcgccttgccgaagttcgtcgtgaagcgggtgcccttgatagcatcctttacggcatccctctgctccttcgtgctgacgccgtagctcgcaagtgcctgggcgctcttgaaggcagcatcctgggcgaagtgcacgatatagagcggcgcatcgccgctcttgagggcaagctcgacggtggcttcgagtgctgtgtccacgaactggtagtggagaggcacgggacgcggggcattggctataacgtcgacggtgcgtccggtcaggtcctcgatcttgtcgtggattgccgtcacatcgccgagcgtcgcgctcatgaggaggaagtggacatgggggagggtcaagagcggcacctgccaggcccagccacggtcgcggtcggcatagaagtggaactcgtccatcgcggcatagccgatatcggcgtcctcgccgaagcgcagggcatcctgtgcgaggatctctgccgtgcagcagatgatcggcgcctcgggattgatcacggtatcgcccgtgatcatgccgacattgtccttcccgaagatatcgaccatctggaagaacttctcagagacaagtgccttgataggggcggtgtagtagctccgctctccagcgcataatgccatgaagcacatgccgagtgccaccatggacttgccggagcccgtgggcgtgcccagtatcacatggtcgcctgcggcaatatcgagcagggcctcttcctggtgaggccagagctccatgccacgggattcgacccaggaaaggaaggtctcgagggattcatcggtcgggatatgggggtcttcttgcgaccagtcaggcccgagcctgccgagagagccaggtccgttcggtccttcatcggcctcttcgaccggaatattcatgtcagacatcaggggtgttgcagctccttggatggaagtagattgttcagcccttccattctaaggggtctggagtctgtcggtgggggacagcctagtccttgtggcgcttctcgaacttctgcgggtgcttggcatggcggagaaggatgttcttcacatccgcctgcacgacaaggtcgttgtcgagatagaggtcgatgatttcttcggcctcaggtttcacgaccctcagaatgcccgggagatctccctctttgctgtatccaaggatatcgttcggtgtgcagcccagcagttcggcagctttcacgagctggcttgcattcatatcacggcggccggcttcccagtgctccacttcccctttggtgacaccgatatagtccccgagctgcgtcgtggtgaggctgcgagctttcctgatttcacgcagattgttcggttgcttcgccggggcgatcggctccttcttgtcttcctgtgccccgtcttctgccatgtccgctcctgtatcgaatctggaatttcaatcacagaagaccagaaatgatgagcgaacgccagaacaaaagcctacgcagagtaggcaaacgcataaatatgctgcaaagcctacgcaaagtaggcatatgaatagaagagcggcaagaaagagcagccgcatgaaaagccactccgggctgagaatccagagcggccgtattcgttgccttgaatgatgcggctagaggcgcatgagcgggagggtcgagcctccgtgaggcataacgaggatgcggggtgcgcatccgagctcacggagcgtctttgcacgcgctgcatcgagggcttcctgtactgtcgcaaatggtgtcatgaacgcagctctgacctcggcatccggcatgtcggagacaagatagatgtcgcagcgctcctctatctgggccaccgctgctgccttgtggccaccgagcacgaacgtcttcttcaggcgctccgccacctcatgaggagtcgctgcttcgcgcatccactgctcgaaggtcggctggccgaagccttcctggcaggaacccacgagcacgatcgtcccgccgtcgcgcaccgggtgcttcgcgttgtcgagcgccttctggagctggtagagattgagatccttcggagctcctccctgggacacgaccacgatgtctgcctcctcgcggagttcgcacccgtagagatcgtcgagatggtggcaggcatcgcgctgggcagccacgaagtctcctgctgcggcatagacgatgtgcctgtcctcgtcgaggacgacattcacgatgaaatcgaggccgaccatgcggcaggcttcctcgagatcgagcctcacggggctctccatgttgccagcgtgggcttctgggctaagcatcagggaatggtttgcctggatggcttcgaaggtggagcagcccggcatgatggccttggcgccgcccgagtagccggcaaagtagtggtactcgacattgccgaggccgaccctcacatcggcgtctgcgacctcttcgataatgtcgacaggcgtgcccgctttggtcgtgccgaagtgcctgaaggacgtgctgccgttcacgacagcgatcttccccttccagggacccatgatgcaggcaagctcttcctcggtctggggcctgtgggagccaagcgctattgcgacaaagacatccttgtcggggatgcctgcctcgcggagctcctgcatgacgggagtgaggagctcgggcgtggggcaggggcgggtgcagtcgcttgcgatgaggcagaccttctgtcctggatggacgatgtccttgaggcgagctgtgccgacaggggaggaaagagcgtctctcacaagctcttcgccgggcttttctgcctcgaccgcattggcatgcatcacctcgatgagctctgcatcatctatctctatggtctggctgcgcgtgccgattccgagctctgtcctcatgcctcatcccttctgtcctgtttcgaccagcatacaggccgatcctgaggctgtcctggtggatgcgctgtgagtttacagaatgcttgccaggccctgcgtgaaacgggggccgtggcctcgctacaatgcaggaagaacaagaccataagaagctttccgaaggagacatccgtgatacgccttgccctctccgatatggacaacaccctcattcccttcgggaacccgcatgtctcgaagcacacgctcgaggcgattgcggatgcacgggcggcaggagtcgagttcggcccttccacgggacgcgactatcatgagctgctgcgctttttccagggcgatgcctctgccttccagacaggggtcatgtcgagcggcaagaaggtcatgatcgacggcgagatcgtctcgctgtccctgatcgagcatgatccgctcgagcgcatggccgagatgctcaagagcgtgccggatgtattcctcgtggcctatccggcagataccgatatgacgaatccggtctgggtcattgcggcagaccccgagcaggtgccggtataccaggagcgcttcaagttcacgccgcaggtggctgagcaggtgccggaggtgccgctcatcgcagcgacgcttgccgccacatcgggacgccctgcctgccgcttcatcgatacgaagctcagccccgcctttcccgagttcgatatcgtctcgccgacgcccaactggtacgatatcgtgccccacggcatcagcaaggcatcgggcctccatgtcctgatggacaagcttggactttccgacgaggaagtcgtcgtcttcggtgacgccgcaaacgatgtgcctgtcttccgcgaggtcacgaactctgtcgccgtcgcgaatgcaacgaaggaagtggcagcgcttgcccgctaccatatcggtgcctgcgcagatgacggggtagctgtggcgctcgaggatatcgcgcaggctgcagagagaaacaccctccccgagttcatgctcgacgaggatgcctgcaggaactgaagcttggcgcctgaagctagaggatgtgctccataccgatgaggtagggcttgaggcccaggtgctcgtagaagccttctgccttcgggttgcaggaccagacatggagcgtcacgcggtagcagccctgctctttcgcgtaggcacagactgcctcccagagatgctctccaacatgctggccgcggcagcgctcgttcacgcagaggtcgtcgaggtagagctcgcggtcctggcgcatgttgggggcgctggtcagatcctggagctcgcagaaggcatggcccagaagctcatgggtgccttcctgcctgttttcgtccaccgcgacgaagatgggatgtgcagggtccttgataagtgccttgagctcatcttccgtatacttcctcgtatccgggatgaagaggtcgggacgtccttctgcatggacattgcagacctggacgagcagctccatgattccttcgatatcctcttcggtggcgcggcgtatctgcatgtgcttctcctaacggtctgacagggcaatgagctcggtgtggtccataacggagtcgacgaaggcgtcgaagttcgtgctcgactcatggaaggtcctggggtgccctccaaggacgagctcgagcgcatgggacttctcgcgtatatcataggccacgatctcatcccagctgtaggaccttgtgcgcttgaggcagtttgtataggagacgcccccatctctgacttcgagccttctgttgaagtagttgaggacctggatgagcgccatgacctcgaaggcgcagacaagcgggatgccgatccagcggatccagacaagccagaccgagctcgagaacagcgggaagagaagaagccagatcgtgatggcgcccgaggcagcgacacctagtgcccacatgagattcgagcgtacgcgctcggtcacgacgacagctgctcctgtgctttcgctcgcttctgccatgtgtccatgcttcctttcttcgccactcatccgactcttcctcatgaggatgcccatgagcgggtatcactatccaaggactttgggattggctaccattctacagaaggcagcgtctgccgcaccaagcggcttgaaatggggttggatatggaactctccgtggagaagaggcactacaagcgccttgcagcagagcttcgcatggcattggtgtcgggcacggatgaggaggctctctctgccatcaaggagctcgtgccgctgcgcagctatgccacgccgaaggagcttgtcgactttctcgagcgtgcctgcgtctgggcgtcgcgggaggttgtcgatgcaatcattgcagacctcggtcccatcccgtactgcggctgggcacttgccctggcccttcgctgcgaccgcgaggacatcgcctatgacctcaaggcacgccgcgtgaacctgctcgaagatccagagattcccgagagccttcctgagcgctcgctcctgattcacgacctgacgcgtggcgacatgacggggtcctctcccaagctcttcgaagacccgcagggacgctcggtcacctctgagatcttccgtaccttcgggccatccgaggagctggtcggcgcagactactcgcgcggcaccgatgtgagacgttcctgcgagctcgtggcgaagcttgcaaacgaccagagcttcattcccgtcgtcttcgacgatatcttccgggcttcgcttgcctgcgcctcgcgtgcctatgcctatccggcctcctatgtgccgggcacggcagagtcctgcctcgagctggcagatgccctgctcgagctctggcgccagcatcttggcggcacggagcgcataccggagctcctgggccgcatggtcgtcccgaaccaggatgagcgcctgattgtctggatctgcgaaaaggcgccggaagtcttctatgacaggctgtgctcgcagagctggctcaagaagaatgtcgggctcgtgcgccgcatggtagcacacctcacaccggggacggagtaccagaatggggtgctcctctctgtgcttgcaggaggcgcctgcttcgaccagctcgaagatctccttggctggcagaatacctatacgcccgcaaacctcgaccgcgccatcgatgcggcatccgaggcggggcatgcagagattgcagcctggcttctgacgcttcggcaggatctttccgatacggccaagtctgtcgaggatgcaaaggccgaagaggagcccgaacagaaagaggcgcctcaggacgacgagggcgatctcggcgacctttcggatcttctcctgtaggctgccatggcagatgcgatggaggggctcaccccggaagagaaggcagccttcgaagaggcggaacagaagacacacgagcgctacgagcttgcgcgcaaggtcgtcgatctggctgaaggcctcgtcgtgagcgacagccatttccttgctcctgccataggccagctcaagagcgatatctcgcctgccctcatgatcgagccgtttgcgacggatggccagacgctctatatcgagccgacacgcgtgcttgcgacgttcgcgaagacaaggaagcctccgattcacgatatcgtgcatgtcctcatgcactgcatcctgatgcatcctttcgtcgatgaccgcgtggagcgcttcccctgggaccttgcctctgacatcatcgccgagagcctggccgccgagatctgcggtgcccgtgaaggggacaggggcgaggccatctcggtcgtgctcgagcacctgaagaaggacctccatgggccactttccacagacaggctctatagggcgctgcgccggggctactaccacgacctcatgagtgcctggggatccatcttccatgtggacaaccatgacctctggtatgcagcccctgcctcatctcctgaaagcgggggacagcagaaggaaggctcctcctcccatgcaccgacagagtacgaggagcgccatgcccccaaccagggttcgggagaggagcgcgaaggcagcgcacggaagacccggcagcagtcacagcaggcttcaaggaatggcggcgaagcggagaacgaggcgcttgtgcgccaagcaggcggcctcggcgagcgtgagcgcgagcatgagcgagacaagtggcagcaggtcgcaaagtccatcaatgtggacctccatacgctctcgcgcgagcgcggagagcagctcggcgacctcacgaacgagctcgagatcaggacgcaccgtccccaggacttccgcgagttcctgcgcaagtttgccgtgatgcaggaatccctgcatacatcggacgacgagttcgactatgtcttctatacgtatgggcttgcgctctacggcaacgtccctctgatcgagccgctcgaatatcgcgacgagaagaggattcgggagtttgcgatcgtgctcgacacgtcgggctctgtcgcaggggacacgatccagcgcttcgtggacacggccttcgatgtgctgcatgccgactcgaccttcacggagcgcacgaacatccacatcatcgaggcggatgccggcgtcgagtccgatacgaagatctcgacacccgaagatcttgcgaaatggtcagaccatgtcacggtcaagggcttcggcggcaccgacttccgccctgccttcgactacatcgacaggctcatccgcgaaggcgagttcttccctccaccctcgacgggatggtctatttcacggatggcttcggcacgtatccgaagaggaccctccttataaatgtgccttcatcttctacgatgagagctacccgcaaggaaagcgttccgccctgggccatacagcttgtgctgccgcagaggagctcgaacgcgaatctgacgaatcggaaagctaccgtgcccagaaggccgagaagcgaggatagggaagcatgaacatcaagacagcgacagagcagatcaagggcgccgtgcgtgcgtatctcgcaaaggacgagaacgggctctatctgatcccgccccaatgcagcgccctccacatcatgatgggcctccgggcatcggcaagaccgctatcgtctcggaggtcgcagaggagctcggcgtcaacttcgtctcgtactcgatgacgcaccacacgaggcagtcggcactgggacttccctatatcgccgatgcgacgtatggcgggaaggggtacaaagtctcgcgctacagatgtccgagatcattgcagccacctatgacgcaatcagcgcacggcattcctgagggcatcatcttcctcgacgaggtcaactgcgtgagcgagacgctcgctcccgccatgctccagttcctgcagtcagacgttcggccagcacaagctgcctgtcgggctggtcatcgtgacggccggcaatcccctgagtacaacaggagcgcccgcgagttcgatgccgccatgctcgaccgcatgaaaagatcgacatcgagcccgacctcgatgtctatggactatgcgacaacgcacggcgtgcatcctgccatcctcacgtacctcacaaacaaccgcagaacttctaccatgtccatgcgggcgtggagagcacaagcatcgtgacggcccgtggctggaagacctctcccgcatgatcctggcctacgagcatgagggactttctgtcgacctcaaccgattcccagtatctccaggaccaggagatcgcagaggacttcagcctctatctcgagctcttcgagaagtaccaggacgattaccaggtctccgcgatcctttcgggcgctgctggcgaggagctgaaagaccgtgcaaagaggcaccgttcgacgagcgagtcgccctcgtgaaccggctgctcgatgtgctcctggcgatgtgcaccgcctggctgcaaggaagaagcgctcctcgaggtgcgccagattctgcaaagctcaaggaggccgattccggcgtgtcgctcctggcatcgctcacagcacaggagaacgagtgccactcgagctcaggcgccttgtcgcatccggctttgcctcgggcgcccgccagatggcagaggcgaagaaaggggagattctcgaggccatcaggaaggcagtcgcccgcgccgtcgcacaagcaggaggctctctcagccaggaggatgcctacatgcggccaaggagagcttcaacgcgatggtgcgcacctcggcgctggctcgaagagttcgtctcgaagatcgactggaatcgacttcgtgaacgatgcctacggcgactcccaggagatgctgatattcatgacacgcctggcggtggatccggacttcatgcacttcgtggcggagcatgggtcgaagaagttcgtgagcacagcgcggcctcatgttccatgacaggagtacgcagcttctgaacgaggtagacaactggagggacttgcgtgagcgaaaacgagagccataccctggcagacgatctggcaaagtcgggctacaagatgtccgaggcgctcgaagaggcgcttgggagcagccagaaggacgaagcgtctgaatcgtctgtccacactttggggcatgaaggagcccgagggaagaaggaaggaacgcagacgaagacccgacccagacggatttcttctgtgcgatgaatgcctaccgcgcagcgaggaagtcaggcgatgagcaggccatgcgcgaagcggaggagcatctgcgatccgtcgtgcgctcagagcttacggaatcagaggactgcggctgctagggctggactgcctagcatatagttaagcgctgaggaatagcgaacaaagggagcctccctcaggctaagggaggctcttgtgtatggcgatcttcaatggtgtacgcacgctatgcaaaagtcctgctctgttttgcgggatgacaaggtcggcaacattgtgtgacaagtgccattcattcacgggactgcagcgacttgagctcatctgcttcaggacacgcatagaaaacggcagaagctccttttgcgaatagcagcttggcaatagcgtctatgccatcgatgctatcagcgaaggagacgagaacgctttggccgttgcttctggcttgattgaagcaccgctgtaccatcgaaatcgttgcaggactttcgaagccttgtatgatgaggccgacaaagtcagattccagctggctgttccctccgagagaaagctgacgggcagcggcgctgggctggtatccggttgttgcaatcgctttcttgatgcgcgctctggtcggggcagaaatgagattcatcttttcgttgatgaagcgcgatacagtggcttttgagacgcctgcagttgccgctatatctgagatggtcacttttgatgcgcccatgcagacgcccctctcaaaaagtcagataaaccggtttgaagattctcgcatatcacatccgaaatcatcgctaccatactagtgcaaatgaccaattgatagctggcataacctgcatatcatgcatctagtgacgtacttctatgggcatgcatgtttgtgacatgtgactatttgcagcaggatggaatgccgggtcatcaatgtttacatctgaatgcgaggggatacatatgccagctgtaatcggcaaactgcatgcgggagagcttgttcctatgaaagatgccgagagcggagctcatattgtccgcctgactgctgggaagcatgtctgccatcacatctatccgaccatgagagcaacaacaggagatgggaagttcctgctgtattttcgggaggtaaacggcagacgccagctgcatgcgatgaatctggacacaggtatatcgctgcagcttacagccggaaaagatgtcgatgactatcatgctgcattctcttccgatgataggcacgtgtattaccttcagaacaatgtgctctggcgtcttgacgtgcgcgatcttctacgtacccatgtctacaaccccgagcccggctggatgatgagagagttcagcttttcggatgatgaacgctatctcgtctctctggagaccatttcgagtgccgacattgataccctttcagggctgcgcgactggagcacctttgccctaggatcgctacttgccccgcgttgcaggctcgtctatgtagacattgaatctgggaatcgcagagtgctggtggatgaggactgctggctgggccgtccgagcatacgcccaggcgatggcaatactgtcatgtattgccatgagggcccatacaacatgattgatacgcgcatgtggctggtccagagtgatggatcagataagcgtccttgtcgcaatcaggataaggatacagtgcttacctgggaattctggttcccggatggcaggcagctcggctttttgtgctggaatgtgcgggacgacaaacctgaggagcttcatgctattaatcccgacacgatggaagaacggatcctctgcacctgccccccgttcgtccattgctcatgcagccctgatggtcgctacatagtaggagataccgcagggtccaccaagcccgtgcacctgatatctgccgaggacgctgcatcggcggctgacgactacatctacctgtgtgacctgcatactggtgagcagcggcgtatctgccaccatggatcgtctttcttgcccaaatatggaactgtgctcgattctgaacctcatccggtgttcgcacgagatggacgttcaatcatctacgtgtcggactgcggcggcattccgagcatctatcaggttgatctcgcccgtttcctttgggagatcgaagcgagagaagatgaatcgtatgcatatggccttgcctcgacgttcggcggcaaactgtaagcacttcctggaggcctgcttggtaccggtcgtgcgtccatttatggcatggtaaccggttacattcccttcagtcgaggcgccctgccctcttggcagaagcggaagtccatgcatggcaccttcgcatatcgtaagagccggtgatgaaccggttttcttgcgtaacagtctgacggagagacccgttgaggcggaaggactggcaatggcgactggttctgcaaaggggtgcatgggaaaaggagggccttatggccaaaagcaagactggcgactctaagctgtcgttgcgcgccaagattggctacggaactatcggattgggcagcatcggcttcacgatgatgtctacatggcagctgttcttcttcacgacatttgcgggcatcaacattgctacagctggctttatcgtatccatcggcgatatttgcgcggctttcatcgctcctgtctggggctacatttccgaccgtatgtatcgcacgaagattggccgcaagtttggcagaaggaagacgacacttgctcttacaatcccgggactctgcatcctgatggtcgtgaacttcactccggggcttccgcttccggtatatgccatctgcaacttcttgtactggtccatcaatgcaggcttccagaccattcagtatgttttgcctgctgagatgacaacggatagcgacgagcgcgcacatctggcaggcctgaaccagatcaccgttgcaatcgcaaccatctcgctttccatcatcaacgcctatctgtttactgtatggggagatacttcggcgctgacctacacgaacatggccattctttatgccatcgtcaccgccgtcatgacgctcattgctgtcttcactattcaggagcatccttacgatgagacgacggacttcaccaaggcagactccaataacaaggatggctcggttccgcctctcaagcgtgtcgctctggtcatctggaactacttctccgcttggagccttcgcgaattccgcaattacctgggcatgtacctttcccagattctgttccgttccgtccgctctgcaattctgacgtacttcctgctgtttgttctcggccttcagtcctctgatgtttcgatctctcagggcatgagctttgcattcggtattgccttcgttatgctcttcatgtggctcaatacgaagatcggtgcctacaagtcctatcgtatcagcgcgatacagtgcatcgtcaccttcctcatcatctttgggcttgttcagattcatgaccagattggtcatactgctacgattgttgcctggattgcactgtccatcattttgaacttcggcttgacaggcgtcttcaattcctgcgatttcgcttactcgttcatccccgatgtcgatgaggttctgactggcaagcgccgcgagggccagtacgcatccattaactcgactatcgacaatgtcttcaagtctcttgaggcaattaccattaccggtgtcctctctgcgatgggatttgtgtctggtgcaagcagccagcctcagaatgttatcaacggactcactatcatcttctgcttcgttcctatcgtcttcgctatcctcggctactggttcagctgccgcgtgaagctcaatcctgagacccatgccatcctgatggcagagatcaagcgtctgcgcgatggtggctcgaaggaagatgtcaagccggaagtcaagaaggtcatcgaggacctcaccggctacaagtacgagcactgctggggcaacaaccgtgtcatgaattactcccataaggttgtcgaagaggagtcgacgatgccgaagggcgcagtgagtgacgcttcatagcatgattggaacgtatatctgaagatagtgccgaattataaggtgcctttgcgatttgggacgggaccctctcgggttctgtctcttcttttgtcggtcttattagcctatgcggacgcagcgcggcacagaaagccacccgctcggcgggtggatggcaacgatgccatgcaacgaaactcctccctctctaggatggtgattgttcaggtcgccggccgcgagaggaaggagaacacaatggcacagaaggccaacagccttgcgcacaccaagtggatgtgcaggcaccacatcgtgtcttgcccaaagcatggaagaaaggccatctgcagccaataccgcgaggacctcgggacgatcctcaggcagccaagccaatggaagggcgtcgagataatagaggggcatctcgcgccggaccacgtgcacatgccggccgtcatccgcccaagatcggcgtctcgagcttcatgggccacctgaaggggaagagcgcgctcctcatgtccggcaaggcatgcgaacctcaagtacaggtccgggaacaggaagttctgggcagagggacactgcgtctcgaccgtcggcatgaacgaggtcacgatcgcgaagtgcatcagggagcaggaagctgcggacatcgccctcgacaagctcagcgtcaaggagtatgaggacccgttcagcaggaaataggccggcacatgcccgtctggcgggctagccacgagccaggcggccatgcggcctgaacgaagtgaagagcagggacttgagtccctgctggcttcttggggcgtgtcccaagagcaagctgactgttaattggacagccatgattgaggggaggagagcaagtctctctgattcaaagaatgtaaccggtaacaataccattggtcgaggcatcggcttatctgggcgggcagatgagacgtcccagatgattggtgcatatataatcgaataagagcaaaccggttttgctttcaagggcttacgaaaggtctctcgtttgacattttggagaggtaaatgtcggcggatttagggaggacgcttcatggtggaaaaagactctgttggcaatcttaacaggaagctgtcaatgcgggcaaagcttggctacggtacgattggtctcggtacgattgccaacacgatgcttgcaacctggcagaccttcttctacacggcattctgtggcatcgacattggcgttgctggcctgattgtttccgttggcacgatcgtggctgcatttacggctccggtatggggatacatctctgaccgcatgtatagcactggcttcggacgcagatttggccgccggcgtgctacgctgctccttaccatgccgggccagtttatcttcatgcttctccagttcgttccggggctgcctgttgctgtctatgcagttgccaacctgctgtactgggtgttcaatggtggctattctactgtccaatatgtccttccgtccgaaatgagcgataactcttctcagagggcacagcttgtcggcgtgaatcagatcagcacggccattgcttcaattgccctcgctacggcgaacactttcctctttgttgtctggggagacaagaactggactacatacttcaatcttgcgctcatctataacatcatcatggccatctttacggtgatcggcatcttcacaatcgaggagcgaccttacgatcttacgaccgacttcagcaaggttgattcagttgccggtgaaaaggtgccgctggcaaagcgcattgtcctgattgtctggaactacatctcgaccttttcggttcgggagttccgcaactaccttggtatgtacctttccgaggtcttgttccgcaatgttcgtggcgctatcttgacctatttccttattttcgtgcttggtctcaactcatctcaggtctctcttcagagtggcatctcctttgcggtcggcatcgcgcttgttgccttcttcatgtggctcaataccaagattggtagctccaagtcctatcgcgtcggtgctggcgaggcgattgtggtcttcttgctaatgttcggccttgctcagatacacgagcagattggccagactgctaccatcattgcttggattgtacttgcactggcgctcaactttggtataaccggcgtcgtgaatgcgaccgacttcgcgtactccttcattcctgatgtcgacgagatgctgaccggcaagcgccgtgaaggccagtttgcctcagtcaattccactatcgataacatcttcatggctatcgagaagattgcaattacctcgatactgtcgatgggtggctttgtcagcggtgctgaatctcagccacctcaggtcataagcctgctgaccaacatcttctgtttccttcccatcctgttctgcttgctggggatattcttctcattccgcgtgaatctgaacgagaaaaatcgtgtgatgcttgctgctgaaattgcccgtctgcgcaatggcggctcgatggcagatgtcgatccggctactaaggcgctggtagaggagctcaccggattcccatatgagaagtgctgggggaacaatcgtgtcgtgaacttctctgcccgcctcaagggctcgagcgagaagattcaccaagaagcttcggtccattgatgagagatgcctgctatcggtaattgcgagacggcgtgcatcttccggaatggatttgtgactgatgctttgccgatagtgtttcgcccgtatctgcaaagggtgtccagtagctgaactcaataaggagttattcgctatggtttcgtttaaacgcaatggccttgcgtgcaaacttgagaatgattatctgtctctgacgatgtctgacgaaggcaaggggacttctctggtagtcgacggccgtgagctcatggggaagctttcaggagcagcaggcgatccagaccgcagccatagcttctactgcgactatcatgtggctggcaagacaaaaaatctggttccgacacgcttggagatcatagaagatacgccgcagagggtccatgttgcctacgttgatgaacagagtgactttaagcttgcctatcatcttgtgcttgtcgacggtgagcgctgcatctatggctatgtcatcgcttcctgcgacgttgacaaccttgtgatcaatgagctccgcacagtctatcgttttgattccagcattttcacaacgggatatacggcgcgccgcgaggggctccagcctcgtgctgagtacatggcagagaagggggagcggctgcaggatgagacttatcgtattcctgacggctgccgttactcgaattcagatgtctattcgaagtatgactatgccggaactttcgcagagaataagatatggggacagtattctggcgggcgcagtgacgatgaatggggcgcctggttcattccgctcgacaagagctgctaccctggaggccctctcaagcaggagctcctggtgcactatgacggcatcatcctgaactatatgacaggcgctcatttcggtacgggcgattttaaggtacccaagggctggaagaagctctatggaccatggtgcgtatatttcaaccatggcgaggatgtcatcggcgatgcatatgactttgcagccaaagcagaagcacgtctgccgcttccttggcttgaggagtcaggactttacacgggcaactatggtagccttgagggcttgctgaagcccgtatcaatgctctcggaagaggagcggtggacgattgttgcgacagacagtgctggcgaatactttaggcagaaagcaggtcgcatctattgggcgcagtctcgtgatggaagctttaggattgacaagatgcagccgggcatctaccacctctatgtgcatatttttggtggtaccgattgccatgaatacaagctcgggacatattcagtcagacctggtgaggctactgacgtaggcgagctgcgtgtagaaaatgcagcctctgaactgatatggtccctagggcaatacacgcagacaactactcccttcgctttttcgaatcagctcaggaactatatatggatgggcctgactcctaagaatcttgagttccatatgggtaaagattgcgatgccgattggtactacctgcagcgtcgtggcggcatatggaagattgtgttcaataagccgattaagaaatccaaacattacttgttgaccgtctgcctggcaggcacgacggctgctgcaatgagcccgggggagagcagcgtaggtttccgggtaaggctcaatggaaagacgctggctgaagagcatttcgaaaatgatcgggctgcttatcggtcgtcggtcacgggaggaagacctgcgattctctcggtcgagatagacgctgactattttgatgatgagaacgagctgtctttcatgactgatgggttcgtgatgtatgacatggtgaagcttgaggtgcttcgatagtgaacagaaagaatctttcctcggatgaagcggacatcgctggagcggaacgcattcctgcagtattcattgcatcggattccctcgcccagacatacgatgctgcacagaggcctcagacaggatggggagaatatatagctcgctatcttggtagtggcccctgcgtgatttctcacgccgatggcttcgactttccggctgccatgcgctatgactgcccagatattgctgtcgtgaatgcttcgatggcagccagaagcacaaagacctacatagaagaaggcaagcttgatcagattctggcagaaatcagcaaaggcgatgtgctgctgattcagtttgctgccaacgatgctacaaaggcacggccccagagatatacgacgcccgttcagttcgttgaaaatctcggccgctttgtggacggagcaatgaaacgaggagcagttcctctgattttgacgcctactcctcgctgcaacttcagtgcagatggacattacagagcagattttgaagagtatgcatttgccgagcggaagttctgcagggagaagggggtagggctcatcgaccttgcggatattggtggcaggtacatggaagaacttggcgagctgcgcgcccgtgcactctacatgaagctttcagctggactctatcctgcctatccggatgggctcgatgatgcaacgcatctttcgtaccttggagctcggacctatgcgcgaatgattgctcgcgaggcggtgacactggctcctcagctcagttttcatgatgacaatgacagcagcttcacggggcggatcgaaggcatagaggcgcgtgtggatgaagacgcttctgctgtggtgctctcttgggacagggctgcaagtgctgactgctacaccatttcctgcgacaaagatggacagagctttgtgggagtgtccttggaacctcgcttcatggatgctgcggtgccagatcagtccgcagatatcaggtatgaaatccgtgcgtggcatagagatgcctctggcgagccaggaacggtggaagtggagcatgaatttgccctttcatcgaaaggggaagcgaggatatccggcttcaatctctatgagatcgaccagacagtcgcagaccgtatttccttctctgtccggttctccccgttcgaaggagtgcagagataccgcgtttcggcaaggaatgcgcagtctggccagatccggattctcgattccattcctgcatccgatgtcggtttgctgcatggctactttgttactcgagagcctggatggagggtgcatgtcgaaggagatcttgggggcacgacttgcaccagcgaggaatgcgaggttccctgcagcccgctgagtgcagattcacgacctagttgggaggctggattctgatggaagtcgatttcacttcatgcggtcctgatttctgtcccgcgatgatcagccttctcgatcgggagtatcccgagcctgcagaaggatgggtcgacggagtgtataacagccgtcaggcagtagaaaccgcattgcccttgcaggcttcgcctgaaggcattcatatgcgggggaactcttttatcgaagagtcagacatgctcgatggggacccgaatacgattgcacgggagacgtacatatgtgggtccgtgctgcatatcgatgcattctcagtggaatatcgcgtttccctcagcctgaagggcacgcaggaaaatcaggaactcgagcttctgatcaatgggatgccaaaagtgcggtttgcacttcaggcagaatcgacaagagcggttgacttctccgtggaggtggattgccactgcatcgagattgctgtcgtgcctgcgcggacaggaagtacgagcaacgcctgggcagaagcaagcatcctgaagcttgcaatccagaaagtgtcgaagcagccagccgcatcgccccggatattccttctgggagattctattgtccagacatatttcgaaagcgagcgcccgcagtctggatggggagaatggctctatcgctatctgcttgatggcagatcggctgcgattgagcatgacgatacgaacgatgtagttcagtcgaggatctttgcaggcgaaggccccacaatctacaacaaggccttgggtgccagaagcttcaggagctatcgggaagagcataggcttgaaaaggtcctctcgcttgtgcggccgggagatgtggctcttatccagttcggtgcgaatgacgtgtcgaagacgaggccgatgcgctatataccgccagaggagtaccatgcatggcttgaacgttatgctacggctttgacagatcgcggcgtcaagccgatcttcgtcacgtcgacgcctccgtatcgtccgcatgcagcggagagcctttcatctccgaccgacctctacgcagacatcacgcgcaagtttgcgtctcaggaaggcatagacctcatagatcttcgcgagctggctgatgagatgctctcagaagcgccagatgaaaaccgtgcggcctattatctgcgctgcgagcctttccaatatgccagccatcccgatggaatccaggatcctgtgcatctttcggtctatggggcgcaggaaatggcacggattgttgctgagaagcttgctggaattgtcccttgggttgctttcagagatgacgattcgaatgcacggccaagcactgtaacggagctccgtgcattggtcgagagagagccggtaggccagatggtgcatctgcgctggagagatgccggtcagatggtctattactccatcgagaaatgcaatgcagcaaatggcaggcgctatgcgcgatatctttcggtcaagccggaatttattgactggccactgccagggcagagtcgtcaggtccggtatgtagtgcgggcatggatgggcggacatgcaggtccggagtccttcataagcgtcgcaatgccggcagacgatgacgaggtcgtgaatctcgaatgagtgcttgccctacgtcgcaataaatcactcactgcaatgtgccaaggatagtcagaaaggcttagacaatggaaaccacctacaatcctgctgtgaagctccctccgaaggagacgctcgagaaagacattgctcttctcctcaactgcctcacgaagatcgatgatgcatccggtgagtatcttctcgatttcgacggtctcaaggtggatgacaagagctggtgtgtctggaactggcctcagggcataggtcttttcggaacgtacatgaattaccgcatcactggcaatgaaaaggcactccgcatcgtgaaggactggttcgaggccaggatgcaggaaggcgcgccgagcaagaatatcaacacgatggctccgcttcttgcgatggcgttcctgtatgaagatacccaagacagccgctatgtgccctatctcgagcgctgggccgaatgggcgatgaatgaccttacgcggacggaggagcggggcttccagcacgtgacctacgggcctgctcatacacagcagctctgggatgacacgctgatgatgactgttctgccgcttgcgaagatcggcatgctgcttgggcgcgatgaatacgtgcaagaggcacgctaccagctcatggtccatatcaagtatctggccgaccgcgagacgggcctctggttccacggatggagcttcgagcgccgcgacaatttcgccgatgcactctggtgccgcggcaactgctggataaccatctcgttccctctcttcatcgaggtgcttggtctcaagaaggacgacgcgctctacgagctgctggtgcagacgctgagagcgcagatcaaggctcttgcggaataccaggacgagagcgggctctggcataccctgatcaatgaccccagctcctatctcgagaccagtggatctgcaggcatggcattcggcattctcaaggccgtccacaagcgctatgtggatccgagctatgagaatgttgcaaacaaggcaatcaacggcgttctttcccagatgggagaccatggccagctgaagaacgtttcggtgggcacgggtcttgaagacaatctcgactactaccgcaacatcgcgacgaccgacatgccgtatggccaatcactctcggtgcttgctcttactgaggcgcttgtctcgtattgctagccggggatgtctgtgggaagggttgagatgattagtctgggagccagagggcatgatgtcgtgccaggcccaacaactcctgaagagctcggtgcggctgcagagcagaagggcatcaggaatatccagctggcactcggtatctcgtttccccaatggagcagcgctgaccagatcaatcttggtcttgggtcgcagattcggcggacgcttgctcggcatggagtcgagattgcaatcatggggtgctattacaacatgattcatccggaccatgccgagcgcgaggctggaacgaagcgctttgaagcatatctgcgctgtgcacactctttcggctgcggcatcgttgcgtcggaaacaggttctgtcgacccgtcgtttgcttataccgaaaggaacttcactgatgatgccttcacacaggctgagcagaccatagagcgtctggtgcgctgtgcagagcatatgggtgtcattgttgctatcgagccaggagtgaatcatcccatacatgatgtggaaaccagcatgcgtctggcctgtctcattgactccgataatctcggcttcattctggatcctacggcacttatcacgcctgagctggctccgcgacaaatggatatcgtgcgagacatgctcgatgcgcttggctctcggatagttgcaacgcatcttgttgactatcggattgatggcggaaaaatcgttcggtgcaacttgggcgagggccaacttgacgcggaaggcatcatctctgcagttagcgacaggcgtccctacagctatgtcatcacggaattcacgacaggcgacgcgctcggccgtgctgtaagggagtatggtgccacagcttaattgctggatgcgctggggaggtatcagaaacgatgggcattggatatatcgtccacaatcattttgagtcatacatagacaagacaactggcgccaaggttgagcgtctgaccgatcctgcaatcacttgccatcacatgtatttctatgcgcatatgacgacacgcgatggcaagaagctgctgtactcgccagaaatcgatggagagcggcaagtattctgcatggagctcgcgactggcgatgccgtacagctgacagaaggcgaaggtgtcgatgactggggcgcggagttcacggcagacgagaaatcggtcatctatcaccaagggcaagatatctggctgctgtctcttgcggacctcacaagaagacgtatctatgccgcaccggaaggctggcatctccgtgatatcggagtatctcgcgatgaacctgttctcgcgctcattgagatggctgagaacaccatggctgcagccatcggcggcacgaactggaatttctttgccgagaactgtcgtgcgaaaccgctctgccgcatcgtctgcgtgaatatcaagaccggtgaacgtgaagttgttcacgaagaaagatgctggctgggccatcctcaaattcgtcctggcgatgctgacaccatcatgtattgccatgaaggtccgttcgatatgattgatgcacgcatgtggctcatcagcagaacgacgcatgtgccgcgctgctgccgcgagcagccagacggcataatccttacccatgaattctgggaacccgatggatcgaagcttgcttttgtctatcgcgagctggagaaggacggcgtcgaagagattcacgagataaatccggacacgcttcatgagaatgtgctcatgccatgccatacctacgcacattgtatctgcgaccacgcgggcaggttcttcgtcggcgatgcacagggggacacaaccccgattcatctgcagaaagaggaggatatccaggcacggaaggattccggaaaggtgctggatgacaatctctatctcatcgaccgtgccgggaggcaggaaataaagctcgcctaccatggcacaagctggtcagcacgttggggcactccacaggatgctcatccacacccctgtttttcggaggatggacgctacgtaatcttcgttacagacagatttggtcatcctgcaatacaccgaatcgaccttgagtcattccttgccagctatggcagatgatctgcatgctgagacttcgtcgtgacatgatgctttggccgaatggtcgtgacaaatgctgcacactgtccttcgatgatggaacggtcgaggataggcgaatctgcgaaatgctgcgcagccataatcttcgggctacgttcaacattaatactggccttctagggcatagcgatgaactccatcagtcaggcattgacgttgttcacgaaaagctgccgctgcaagagctggccgaagtctacgatggattcgagctggctgtgcatggctattcgcatgcacatatgggtgaagagccaccttccatggcagcgtatgagatcattcgctgcaaagcagaaatcgaatccataacgcatactccggtacgcggcatggcctggccaatcagctatgacgggtattggatgggagatgcgaaaaagctggcaaaggcttgtggcatctgttatgcacggacaaccagacgctcctatgactgcgtcggtgtgccatctgactttcttgcatgggatgctgcatgcagcttcgttgaggatgagatgggacccattgtcacgaagttcctgaagcctcgaccggtaggctgtaccaagccgtacctgctctatgtgtgggggcatggctacgaagccacagggcgtgatgcatggaacaggcttgaatggctcttcgaccaggtgagcttcaagccggacgtgtggtatgcctcgaatatcgaggtcttcgattatgttcaggcgtatcggaacctggtctactcagctacaggcgactacatcttcaatccaggaaggatggatgtctggctgcttgtggatgacaagtcggtctgcattccatcagcacggactgtcgagattggagcatgggagcgctgatcgaacccatgcatgctgcagaacaaggcgtagggggaatttgaactaatcgttccgcttgcgatgaaagagggttgtgaatatgactgctcggaagacggatatcggtcgttttgtctccggttttaagatgaaactctatccaggctttgctgccgaatatgaaaagcgacacaacgagctttggccagagatggctgacatgattcatgaatatggcggccacaactattcgatcttcatagatgaggaaacaaacactctctttggatatatcgagctagacgatccagagcgctatgcagagtctgccaagactgaaatatgccaaagatggtggaagttcatggcaagcgtgatggagacagaccccgacaattcgccagtgacaactaatctgcactgcgctttccatctggactgagcttttgcaagctacggcggctcgtcttgctaacagcgaggccttgaatctatgtcgcaatgttcttaggagtcaaagatgtcgatgactatcagcatggatgacaacctcaaggaggaattcacggatatctgcagaaagattggacttcctccctcgacggcaatcgggatcttcgttcggacggttgtccgcgagcggtgcataccctttgcgctgtctgctggaaatggacaggcgacgtcaggccatgccgatggcctgcagcgtgaaagcgttccgaagagcaaggtcctgcaggatttggtagatgtctcttcaagagacatgctctcgcgtgaagacagcaaggcgcttcgttcgatgtgggcacgagcgtaaagtctcgccagtctccaagcgatctgtctacgattgcagaccggcgcaagcttcaagaaagaatgtctgccccgatatggctgaaccagggggcttggttttgcagctgcaattgaatgtgatgctgagagaagcgtgagcttctcagccaggattctggttacagagcaagcctgataagagagacatttatattcaagaatccaacagcaataaagggagaatatgaacaccaggaatgtacagtgcgcaacattgatggtttctgcgtcgcgagttattccggcatcttcatccccgacagcaggtgccaagcgagctggtagggtgactggaagaattgatctcacggggatgacagaatatcacggtgtgaagattgcttcaggcgccgatatttctaaaaacgcgttgctcaaggaaaataacaagctcaatatcgaggactatggtgccgtatctctggaggagcgtacgaaggatgatgcggatacgcatgctgtagagaatacagaagcaatcaacaaggctattcgggatgcagctgcgcagggtggcgggacggttgtcgttccgaagggaaccttccgcttctatacgatacgtctggaatccaatgtcaatctctatctatccaaagacagtgtcgttcaagctgcaaaacccaccattgtcgatgaagatggcaagaccatctcaatagccgaggacaaatatccggatggcagagatggcaactacgatcagcctgaaatcgctccatatgccgggcttcaggatggcggacatacctattttgccaatagcctgttctatggtgccgacaagaagaacatcatgatctacggtgacggtcttatcgacggcagccagatgaacgacgagggcactctcgatcaggtattgcagggaggggatcctccaaatgccaggatcagaactggaaaagctgacgtgtggtatggcaataaaggcatttctctggtccgctgcgaaggcgtcgtgctggatggcttcaagatgctcaactgtgggcattttgccatcatcaccgctggtggcagaaatcagctggtcgatggactcattgtggataccaatcgtgatgcatatgacattgattgcacgcaggatgtgacgattgaaaactcaactttcaattcgctcactgatgatgcgattgttttcaaagcgtcctatggtgctggaatcaagcagccggtccataactgcctggttcgcaactgtacggtcagtggctacgatgcagggtcggtcatggcaggggcatatacaacggacaagcaggttgcaacggacctgtgtggacccaccgcaagaatcaagtttggaacggagtcaacaaatggatacgataccgtcaccatcacggatgtagctttcaagaggtcaaggggcttctgtattgagtctgtcgatggggcagctgtccatgacatcatcatggtgaatgcagagatggacactgtcagcagcagtcctattttcatcaggcttggaaacaggggcaggtatcccgttacgggcaacagcacagatcagagcctgaatccggcagacaatgtccgcgttactaatacagaatggattcttccgctcaatagcgacgaggtcagctatcagtggaccgaatatccgatcaagcagtatttcccagcatataggacagacaacgaagcgacaatgccaaacggcataaaggttaagacggtcaatcagactgcgccggccatgctcaatcccaataactattgtcatgatgacagcaccggaaagaactatgcctatgtctggaacaatgagacgcaccgatatgatgcgagcacaacagaaattccggaggaccagtccagctggtatggcaatgctgtcggctatgagagtcttgctagcgcatacaatatctgcgtagcgaatgcaaatatttcgaatgtcgatccccgctatcccatcattctcgcggggatggttggcagcaggatccgcaatgtggttttccaggatatagatgtgacataccgtggtggcctcaggatgcgggatgccgttgaacagcagcagctgaacaccgactgggaatatacgcagtacatgaccactccggcgaagcagacgctgccttggctggtgaatgcgttcttctgcaagaatgcggcgcttcttccccgagtggattgggatgccagtgccggtgcctggaaagatgacccttacaatgttcctgaaatggacgaccagtatccggaaccctcgaatttcggcattctgcccgcttatggattgtacgcaaggcatgttgatggtctgaagctggagaatgtccacattggctatgaggtggaagatggaaggcatgcagtcgtcttggacgattgccataatgcagatttctcaggcagcacattccaatgcagcagcagcgtgaagccggttgctctggtgacggatagctacaagagaagggcagggttcgaatatgtattgaacgagccttaccaaaagacggcatgctctgacatcgaggggatagatggcagcagcattgccgaagtgaccgtaaatgcaccggagcccagcacgcccaaggacagtctctatgggcatgacaccattgcgagtgccgagaacggattcggctatggtcctaatatctggactgtgaatggacatcagcatcctcttccggtcaccgtataccgccccttccttgaaggtatcggagaccaggcggtaaaggttggcgatacgctgatgctgactattacagcaagaaaccctgcggccgaaacatcgggtgcaagagatgaggcagcatcagatcggtcgcttgtctatagcgcagaagatttgccggatggtgcgacgtttgacccggagacgcatgtctttacctggacgccatctgaaacgggaacatataaggcatctttctcggtggatgatggagcaggcaaggtgatgcagagctgagctgcgatcctattgcaggggaatgccttcgaatcgagttcgcggagtcggaagactgcggctgctagcagcgaagaagagtaagcaaggagaaggcacctcgaggacatatcgtcccgaggtgccttccttctgatctggttctgcaatcttctgctattccttggcgccgtactgtgcatagtaggcatcgagcgccttgtcgagctcgggcgtgatgagggtgccggtcagcgcctcgcggacatctttcatgctcacgatgctggcgacagggaagccatagcgctcttggatctcgtcctgggcgctcttgacgccgcccttgccgacctccatgcggttcagggagacgatgaggcccttcacatccacatcggcagctgccttgagcttcgggtaggtctcgtcgatggacttgccggaggtcgtgacatcctcgacgatcacgacacggtcgccgtccttcagggatgctccgaggaagttgcccttgtcggcaccatggtccttggcctccttgcggtcggcgcagtaggcgacctccttgccatacagctcgtccaaggcgatggcggtgacgacggccagaggaatgcccttgtaggcgggaccgaacacgacatcgaagtcgaggccgaagttgtcgtggatggccttcgcatagaagcgtcccagctcatggagctgggcgcctgtcacataggcaccggcattcatgaagaagggggattggcgcccgctcttcagggtgaagctgccgaacttgagcacgtggctgtctaccataaagtcgatgaattcgcgctgatagtcttccatgaatgccttcctcgcttgcacttcctgccatgtcctgcccattgtctcacatatggagctctgtgcatcctgtgctaccgggcagggtcctcctccgttgccggtatcacggagacgccgacaagttcaggcccggtgtggatcagaaggtcgggggagatgagcgtgcgctggatgtcaggaagcgcgttggggacagccgctctgagcttctcctccatctcgtcgaagacatcgagggcattcgtgcagcagatgccgagacggaccttatcgaagaagacggaccattcgcgggcaagcttcacctctgtcgcaagggccttctcccagccgcgggccttcttgaccgcgaagtagtagccctgcttgtcgcagctgatgacaggcttgatgttgagcatcgagccaagacggtaggtcgcctcgttgatgcggccgcccttgcgcagatactcgagcgtcttgcagctgaagaagacacgggtgttctcggcggctttcgtgaggcgcgcttcgagctcttcgaagggcacgcctgactcgatgagctcgaccgcacgctgcacgaccatgccggcagcaaggccgatgttcttcgtgtcgatgcagacgattgggaaatcgtccatcatatgggctacgagctcggccgtctggaaggttgcagaaaggcccgaggagatcgtcacgatcacagccttctcgtagccgtccgccttcgcctgctcgagcgcctggcgtattgcctcgggtgtcggaagcgacgtcgtcggtatctcgtctttgaagcgctcgatcacctcgtccgccgtgatatcgacaccgctctggtagcttgtgccatcggaatagttgatgcgcagcggcacgaccctcacgtcgtgtgcatgcacgaatgcttcgggagtatcggttccgctgtcgcacaggaccgcaatacgctggtcgttcacggatgcctccgatgattgcaggttattgcttggttcctacccgttcctgggacgcgcttgcctggcagctgcatcgcatggagctgctatgaaatgtacaccttatggacagactagcctgcgccgacacctgtccctttcttcaagcggttccggtaaggtatatatgtgtatatgacaatcagtatcggataccgcatatggaggcgaacatggccgaagagaagctggatcagacacggcagaacgaatcaactgccttttcccaggatgggtccctgcctgaggcgctgtctcctgtcatagaggaagagcaggtcctgcgccgcctcggcgtcaggagcgcattccaggagatcacgtcgaacagcacgattgccgctggcgccatggtcatctgtgcccttttggccgtgctcgttgcgaatacgcctgcctacgaggtggtggagtcggcgctcaggtggccggtcgagatacgtctcggcagcttcgtgggcgagctctcgctcgaaggcttcgtgaacgactttctgatggcaatattcttcctcgaggtcggcatcgagctcaaatacgagatgacggtaggggagcttgcaaatccccgtcaggctgccgtgccgatgcttgcagcggttggcggcgtcgcctgccctgcgctcatctatcttgccttcaatgcgcagggcggcgctccccatggctgggctgtgccgatcgcaaccgacattgccttcgcgctcggcgtcatgtctcttgcaggagatcgcatcgctgtctcgacgaaggtcttcttccagacgcttgctattgcagacgatatcctcgcaatcgtcgtgattgccctcttctatgggcagtcgcccgatattgcctggtgcgcagcttccgctatcgtcgtgctggtcctcatggcgctcaaccatgcaaaggtctactcggtgaagccctacctgattgtcggcctcgtgctgtggttttgcatgtacaactccggcatccatgccacccttgctggcgtcatccttgccttcacgcttcccggcaagagcgacatccgcctctcgagtctgggagactggctctcgcaggagtcggcagcgcttgatgatgtatacgacgatgagtcccacatccttggccagcatgacttcacggagcatgcctacatcgcagagcgcgtcctccatcatgcgacgccgcccctgcgccgtgtcgagcgctacttctccgtcttcacgaacttcttcatcctgccggtcttcgcgttcgtgaatgcccaggtgcgtcttgtcggtgtcgatatggcagccgtgcttgcaggctcggtcacgcgcggcgcctacttcggtgcggtcctcgggaagcccttgggcatcatcctcgtgacgctcgtgctcgtgaagctcggcttcgcgaagcttccccgcggcatggatgtgaagcaggccatcacgatggggcttatgggcggcgtcggcttcacgatgtcgatcctgatctccggccttgccttcgcagatgcacaggagcagctcgaggccaagtgcgccatccttgccgcttccgtgacatcggcgcttctgggtcttgccttcatccacatcgccgatgcggtcacgaagggaaggaagaaggagcccgacaaggcctccgagagagcctcatagatagagatgctcatgcagaaggggcgcaccggtacagccggatgcgcccttcgctttctcttctgatggcaagatatatatgcaggcctactccacggtgccgtacgtgtagccccagccatgtgccgtgatgatggagttcagctggtcgcagaggcgtgcccgcttgtaggagcccgaaggcaggagctccaagacctccatgaggtcggggccaaggtcgtccacctcgcctcgcgtgatcacatcgatgctcgagacggagccgctcatgttgccctggtagagctcgtctaccaggtgctgcagctcgccgtattcatccgagcgctcgttcgtgcggagcgtcttgtgtgtgctgtggcccctgtgcggggcagatgcatggtttctcatatgtgacatgatagcaaggaggatgcatctgtcatccagaatgcacctatacttgaaaagcatgcatcacgtgcagggagatgcaggactccctgtgcagcaacgatgagggaggcctcatgggcaacgtatatgaaagcatggagaccgaagagctcgaccgcaccatcgcggagctcgagcaggaggttgaagatctcaaggcgcaggggcttgcgctcgatatgacgcgtggcaagccgtcgcccgagcagactgacctctcccgtccgatgctcgacctcgtgaattcccattccgatctgatggatggcacgctccaggtgaacaactacggaggtccggatggcctgccgtcggcacgtcgccttgcggccgactaccttggtgtcgatcctgccaatgtcgtcgttatcggctcttcgagcctgaacctcatgcacgacgtcgtctgccacgcctatacgcacggcatcgcagggaacaagccatggtgcgagcagggcaaggtcaagttcctctgcccgtctccgggatatgaccgccacttcaaggtcacggcctactacggaatcgagaacgtgccggttcccctgaaggaagacggccccgacatggacatggtgcgccgcctcgtcgagggcgatccgacggtcaagggcatctggtgcgtgccgaagtacgagaacccgactggcatcacgtactcgaacgaggttgtccgtgccttcgcgaacctccatccggcggcacccgacttccgcatcttctgggacaatgcctacgccgtgcacgacttctacgaggaaggggaccatctcctcaacatcttcgaggccatggcagaggcaggcacgaccgacctcgtctacgagttcggctccacggccaagatcacgttcccgtcgaatggcatcgccttcatggcagcatctcctgccgacatggcagagatccgcgaggccttctccgtcatgcgcgtctcgccggagaagatctcccagtatgcccacgtgctgttcctgaaggacatgaagaccatccacgagcacatgatgaagcatgctgccatcgtccgtccgcgcttcgagctcgtcgagtcgaagctcacggagggcctctccgacctcggcgtcgcgacgtggacccatccgcgtggcggctacttcgtctccttcgatggccccaagggctcggccacaaggatcgtgtcgctctgcgcagagatcggcgtgaagctcacggcagctggtgccacctggccgtatggacacgacccctacgatacgaacatccgcatcgccccgacgttccccaagatcgaggacctcggccgtgcactcgatgtcttcgttgtcgccgtgaagctcgtctcggcacgccttgcccgcgaagcgcgcgcatagctctccggagaatcttcacactctttggcacctcccgcacaacctgcgggaggtgttactttaatatgggtgttccatcaacaattgctggatggcagcaaacatagtatgtatggcggacgtatgatggctgtcttggacagcgtcgtatgatgcttgggagccatgcaatgaagaaggagctcgtcgcaatgccgaagaagacacagggaagcgcacgcaaggccaagggtgctgctacgtctgccacgcagaagacgtcgcagaagagcgctttggccgcaaagagcgcgaagaagtcgaagggcgcgcactggaagcccggagagcctgtgagcctgccggtccgcattgtcctcatcgtcttcatcgtcctcatggcgctctccatgatgctgccgtcgctcacctatctggcagcgggaaattcgagtgcagactcccaggacagctcccagacgtccgatacatcttccgacagctcggactcctcgtctgacgacagctcggccggtgcaatcgattcacgctaccaggcgcttgtcgatgcgcagcagaagaagctcgattccgaccccaacaatcttgctgctcttctcaacatgggcaatgactatatgaagtggggtgtcgcgctcctgcaggcgagctcggcagatgccgacacgagccatgcctatgacgtgctcgacaatgctgtcgccacctatgacaagtatctggcactcaacgactcctctgccgtgaaggtcgaccgggcgctctgccagtactatgcaggcgacacggacgatgcgatctcctcgctcgaggcgctcacgcaggaagatccgaactatggtcccgcctgggcgaatctcggcatgctctatcaggtgaaaggcagcacggactccgcgaagaacgcctacaacaaggcgattgccgtcgagccgaatgacgagtacggctcaaagtcgtttgcgcagcagcagctctcgtccatcgccgcctccgaatcctcgtcgtcttcgagctcgagctccacatcttcgtcttcgtcgacgtcgacgggcctctcgaacacgctctcgaacgagtcgggcaccggcctctaaggaattcatccaggagaaaagaaatctctcatggcactctctatagaaacatccacgcaggaaggcgtggccaaggtcagcgtgacgggcgaagtcgacgtctcgaatgcgcctgagctcaggcaggccctcgaggccgcccttgcttccggcgccaaagaggtcgctgtcgcaatggagaacgtcccctatatcgactccaccggcattggcgtgcttgtgggagcggcacacgctgcaaaggatgcaggcgtgcgcttcacgatcgtccgcccgcagcgcaatgtctcgcgcgtgcttgcgcttctcggcgtgaacggcgagctcaatgtcacggagtaggtctgttctcttgttcgatccggcgtttatggaggtatgacgcgtgtttggcataagtgaaaccgagcttgcgctgatcttgatcttcgcattcctcatcttcgggcctgacaagctgccgggcatgggacgcacggtcggccgtgcgatccgccagttccgcgatgctcaggacagcgtgacgaaggtcgtgcagtccgagatcgtcgacccgatcaactcgggcatgaacgagccggctgcaaagaagcgtgccgagcaggcaaaggctgcccaggccgaggatgcagatatcgaaggtgccgagggtgcagaagccgctgctcctgcaaagaagcccgagacctttgccgagcgcaaggctcgtctcgaggcagagcgcaaggccaaggagtctgctgctgccgacgagaagaagcaggctgccttcgacgagaacgagaaggacgaggtcggcgagtcctttgctggcgccgattccgacgaggatctgcccgaaggcgaggatgaggctccgaaggagcccgatctcgctgcgctctatgccatgacgcccaaagaccataaggcagagaaggccgagacgccttccgagcctgccaaggccgatgaggctcctgcttccgcaactgcagaggcagcgcctgctgcatctgccgccgattctggaaaggaggagtagggatgcctatcggaccagcgcgcatgccgctcttcgaccatctcggagagcttcgccgccgtctcaccatcattgtcgtatccgttcttgccacggccgtcatcatctatttcgcgacgccgaccttgattgagttcatgctcgatcctctgcgcgacatcctcggcgacgacgcgaagctccaggtcctcacggtcctcggcggcttcacgatccgcttcaaggtcgcgttcttcttcggcatgatcatctgcacgccgatcatcatctgggagctcatggcattcttcctcccggcactgaaggagaaggagcgcaagtgggtcatcccgaccgttgcagcacttgtgatcctcttcttcctcggcatgatcttctgctacttcgtgatcgagaaggcggccttcggctggctcatccagcagaccaatgacttcgcctcggctatctacaacgcagaggactatctcgacatcttcatgaagctcgagatcggcttcggcatcgccttcgagattccgctggtgatcttctatctgtccatcctgcacatcgtgccgtacgcgacgttccgcgcccagtggcgctatatctacgtcggcctcatgacgctctccggcatcgtcacgccggatgcaagcccggtcacgatgctgctcatgttcgcagcgctcatcggcctctacgagatcgctctggccatcgcccgccaggtcatcactgcacgcgatggcaaggaagccctcaagtggacacgcgaggactatgaggagcacgagttcgacaaggaataggtgaagagcttgaaactcgttatcaccgagaagaatgatgcagccacgcagattgcgcggctgctttccgaatctggcaagcccaaggcagacaaggtgtattcgacgcctatctatcgcttccagcatgacggggaggagtgggtgaccataggcctgcgtggccacatcatggctcccgacttcccgcctgagctcaaatacagcaagaaggagggctggtacggtctcaccgaagacggcgagcacctgccggcccatctgcctgatacgcttgccaagccgcctttcaagaagaagaagccgtttttggaggacggcgtggacgtgaagggctggaagattccggccctgccatatcttgtctggtcgccgatcgagaagaagccggcagagaaggagatcatccgctcgctcaagaacctcgcgaagaaggccgactccatcgtgatcgccacggacttcgaccgcgagggcgagctcatcggctccgatgccctgcgccaggtgcgccaggtcgcccctgatacgccggcgcttcgcgcccgctattctgccttcacgaaggcagagatcgaccatgccttcacgcatctcgtcgagcttgaccaggatctggccgacgccggcgagagccgccagtatatcgacctcatctggggcgcagctctcacgcgctacctcacggtcgcacgcttcggcggcctcggcaacacccgctcggccggacgtgtccagacgccgaccttggcgctcgtcgtcgagcgcgaacgggagcgccaggccttcgtgccgaaggactactgggtcatctcgggcgagctgtcgaaggacaaggattccttcaaggtcgtgcatacgacgtcgcgcttctgggacaaggacaaggccgatgctgcctttgccgccgtgaaggatgccaagcacgcaacggtcacgagcatcgagaagaagtcgcgcaccgtgcatgcgccggcccccttcaataccacctccatgcaggcggctgctgccgcagagggcatagcgcccggacgtgcgatgaggattgccgagtcgctctacatgaagggcctcatctcgtatccgcgtgtcgataatacggtctatccgaagtcgctcgacctcaaggaatgcgtgaggaccttgaaggctgtgccgcagtatgcaccggtctgcgacaggctcctcgcacagccgaagctcgtcgcgacccgcggcaagcaggagacaacggaccacccgcccatctatccgacagccgctgcagacccaggagacctccagcctgccgactggaagctctacaacctgattgcacgccgcttcctcgccaccctcatgcagccggccacgatcgaaggcacgaagcttgtgttctcgatcgagggagagccgttccaggcaacgggagacgtgctcgtgaagccgggcttccgtgccatctatccttacggcatgaagaaggacgagcagctcccgcagcttcaagaaggcgatgtctgcgacgtcgagtcgctctctatggacgcaaagcagacggagccgcctgcccgctacagccagggcaagctcatccaggagatggagaaggcaggcctcggcacgaagtcgacacgtgcctccatcatcgaccgcctcttcgaggtcaagtacctcaagaacaacccgatcgagccctcccagctcggcatggccgtcatcgaggccctgcacacctatgcgccgcacatcacgacgccggagatgacaagcgagctcgagcaggacatgaacgaggttgccgagggccgcgagacccagcgcgaggttgtggaccattcccgtgccctgctctcgggcatgctcgatgccctgatcgatcatacggaagacctcggcaatgcaatcgccgatgcggtcacagccgatgcgaagatcggcgtctgcccgaagtgcggacacgacctcgtcgtgaagacgtctgccaagacgcgttcgagcttcgtcggctgcacgaactggccggactgcgatgtcacctatcctctgccgaagggaaggatcgagccgatcgagggcgaggcaggcgtgtgccctgagtgcggcgctccccgcatcaaggtgcatccattcaggagtcgtgcctacgagatgtgcgtgaacccgaagtgcccgacgaacttcgagccggatgtcgtcgtcggcgagtgtccggcctgcaaggcagcaggcaaggatgccaagctcatcgcacacaagtcggagaagaccggcaagcgcttcatccgctgcgagaactacgacgagtgcgggacgagctatccgctccctgcccgtggcaagctcgaggcgacaggcgagacctgccctgcctgcggagcgccgcttgtcgtcgtgcatactgcccgtggtccctggaagctctgcccgaatcctgcctgcccggaaaacgagaagaaggcagcggcgagaacggctggaaggggcggcagcaggacaaggagcgcctctgcgagaagcactgcatcgaagtcctctgccaagaaggcgccggccagaaagacggctgccaagaaggccacccgcaagaaggcggcagagtagcatgggcgcattcatcagcttcgaaggcatcgacggctgcggcaagtcgacgcaggcgcagattctcgcacatacgctcgaggcagcaggcttcgaggtcgtgctcacgcgcgagccgggcggaacgaagatttccgagaagatccgccagatcctcctcgatccggagaacggcgagatggcagatggctgcgagctcatgctctacgaggcatcgagggcgcagctcgtgtccgagtgcctccgtcctgcccttgcacgcggtgcctgggtcatctgcgaccgctatgcggactcgacctttgcctaccagtcagccggcaggaagatcgctcccgagactgtgaagcgtgccaatgagctcggcacgctcgggcttcagcccgacctcacgatcctgctcgatatggacccggtgcatgcgcttgcccgcgccacgaagggcggtgccgaccgccttgaggctgaaggcatcgcattccagcagaaggtccgcgagggctatcttgccctggcgaaggaggagccggagcgcatccggtgggtggatgccgaagggacagaggatgcctgcgcagagagatgccgggcagtgcttctgcacgccttccccgagcttggaagacgtggcctccatgtctgagaagctgagcacgcctgcagcgcttgctgcgctcgagatgcaggatgcggtcagggacttccttgcacgctccgtcacagagggccatatcacgcatgcctacctcttctgcggagccccgggctgcggcatggaggaggcagccacggcgcttgccgagtgccttgtctgcccgaacggaggagacggtgcctgcgatgagtgcatcagggtacgccaccgcacgcatcccgatgtccactggctgcatcccggctcttcccagggatacctcgtctcggagatccgtgatcttatcgcagatgtgcagcttgcaccggtgcgtgcaaagacgaagctctatatcctcgagagcgcggcgctcctcaagggtgccgctgccaatgcccttctgaagacgctcgaggagccgcccgagcatacggtcttcatcctgcttgcacgctcttcggaggcggtgctttcgaccatcgtgtcgaggtgccagctcgtgccgttccgtgccatccccgagaaggcggccgtcgcccgcgttgtccagaagaccggcgtctctgcccaggatgcaaggatcgcgctctctgttgcagggacgcccgatgcagcctctgcctatctcggcgagccctcgaagcgggagctccgtgcccgcacgatccagtgcctggacggccttgccgaggatgacatgtgggacgtgctcgtggcagcgcgggggctctcggagcttgtgcgcgagcctctgaaggacgtgaagaaggaccagaagaaggagcgcgaccgggtttccgactacctttccgcctctgccatccactcgctcgaggacgcacagaagcgcgagctttccgcccgtgagcgttcgggtatgatggaggtgttcgcagtcacggaatccgtgctccgcgatgccctgctcattgcggatgggtgcgcggaagatgccgtgaatgccgatattcccgggcttcaggagcgcattgccgatgccggcacccctgccatcatggcaggatttgccgcagtcggcgaggcacgccagagccttgcccataatgtctcatcccagctgaccctggaggtcatgctgtgtgccatcaaggaggcacttacgtgaccaccatcatccctgtcaagttcaagtactcgctgcgcgagctctggttcgatccgaaggagacgggtgcccgcgaagccgaccatgtgattgtcacgacggagcgcggcaccgagatcggccttgcggttggcgacccgtgcgaggtggacgacgagacgctcgaagccacgatcggcacggcgcctctccagaatgtgctccgcatcgcgacagaggccgatcttgcccacgcagagcatcttgccgagctcggcgagaaggccatgccgatcttccgcaagcatgtccatgagtccggtctcgatatgaagccggtcggcgtcgagtatctcttcggcggcgagaaggtcgtctgctacttcgcggcagaggaccgcgtcgatttccgccagctcgtccgcgagctctcccatgagctgcatgcccgcatcgatatgcgccagatcggcgtccgcgaggaggctgccattgtcggtggctatggccactgcggccaggagctgtgctgccgccgcttcggccatgagttccagccggtatcgataaggatggcaaaggagcaggacctgccgctcaactcctcgaagatttccggcgcctgcgggcgcctcatgtgctgcctgcgctatgagttcgaggcctaccgcgacttcaagagcagggcgccgaagaggaatgccgtgatcgacacgccgctcggcaaggcaaagatcgtcgagtacgatacgccgaaggaagagctgctgctccgtgtcgagaacggcaagtcgttccgcgtgcccctgaaggacatgacggcaagcgaggctgcctgcaagaagtccgaagagctcggatgcgcctgccgtcccgatacggtgacgcgcgccgtcctcgacaagctcgattctcccgatatccagatggcgctggcagagctcgaccgcgagcacggcgtgctgccgcctgagccgacgcttcccgaggcagacatcctgcccgagacgaagaggagacgtcgccgcgccgagagcaagacgcagggccaggacagcgcacatatggtgaaggtcgagattccggatggaagcccggctcccgccacgccgaagccgcgccgccgccgcaaggtccgcatggacgcgccgcagcaggcatcagaagccgcatcccaggagcgtacgtctgcgggagaggcaccttcccgtacccgtcgccgccatcatcacgtcgaaggcgctcctgaggcttcccaggagcagcagaagcagccgaaacagaagacagagcagccgcatccccagcgtcgccgccatgccgcaccggagcagggagagggtgcagctgctggcaatggccctcgtcgtacccgccgccgtcccggcgacaggggaggtcaggcgcaggatgcgcagaagggcagaggctcccgccaggaggcatcttcccagaagggctccggcaaggatggagcctcccgtccgaagcatctgcgtcctgaagggcagaagggcggcgagcgtccccgccgtcgccatcgttccggcggcaaggggcagggtggcgccgagccgtcctctggcgctccttccgccgagtgattcccggattcgaacgtaatataaagaacttgtgttcggcctttccgctatgatggagaggccgaatttctgtcgttcccctctggcatactacgaacagatgttccatactggatgcgaggaggagcgatggaagaaaagcatgcatgcgcccgcgcggcgcacatcgccttcggcggtgcgatcgatacgagccgtgtcatcatccacagcgacatgaatgccttctacgcaagcgtcgagcaggcagagcaccccgagctgagaggccttcctgtcatcgtcggcggcgacgaggaggcccgccacggcatcgtcctcacggcaagctacgaggcgaaaaggcgaggcgtgaagacggccatggcgctctgggaggcgcgcagggcctgtcccgaagcgatcgtcgtgccgccgcactacaggctctatcagcgctattcgcagctggcccgcaagatctactacgactacaccgacctcgtggagccgttcggaccggatgaggcctggctcgatattacggagtcggcccatcttgcaggaggcgatgcgaccctcatcgcccaggagatctcggagcgcatcctctccgagctcgggctcacggtctcggtcggcctttcctggaacaagatattcgcgaagttcggctcggaccacgacaagccgaacgggttcatggagatcaggccggagaatgccgggcgtctcgtctggccctatccggtggaagacctcctctatgtcgggcctgcgacagcgcgcaagctctcctgtctcggcatccgcacgataggcgagcttgcggcatcggatgaggagctcatacgccgcacgctcggccggatgggccttgtcgtgcgctcgtttgcccagggacgcgacagggatccggtgcggccgttcgtgccgaccgcctccgatatcgcacgcgagatcaagagcgtagggaatggcataacggcaccgttcgatgtcacagacgagagatgcgcccgccagatcgtctggctcatgggcgagtcggtcgcacagcggctccgtgcgctcgggttcgcagcgcaaggcgttgccgtctccatgagggacgcgagcacgctcatgcaggagacacggcaggtccgcctggcccgtccttcctgccttacgcaggagctctgcagcacggcagccgatctcttctgtgcgagctgggatgtcgagagccgtccagcacgcggcatcggggtgcgcgcgatcggccttgtgccggcagaggggccgatccagcttgatcttgctggcacggagctctcgaggatacgcctcaaggcgctcgacgacgcaatcgacgggctcaggtcgcgcttcggcaaccacgccgtgcgcaggctctcggagctcgccgattcgaggctttccgctctcgatcccgagaaggacaacaccgttcatccggtatcgtatttcgcgtaagggaggcagcactccatgaggggcgtggtagagcgccagaagcgctatgtcacagtcatatcgaagaccgatgaggatggcagggtgacgccactcaccgtcgtgtgggaggacggagtgcgctacgatgtcgaccgtgtgctcgacgtgcggcaggcctgctcgctcaagaccggcgggtgcggcgtacgctacaccgtaaaggtgggagggcatccgacctacctcttcttcgaggggccgcgctggttcgtggaggcaaaggtcgtgcctctgccatgactctggcgggcagatgctgcccgggaaaggcaatgccatgtatcagctcaagaccgaagcaagcttcgacggtgcccatttcctgaccgactataacgggaaatgcgagaacctccatggacaccgctggcgtgtcgtcgtctatatcaggcaggaggagcttgggaaagagggcgccatgaaggatatggtcgtggacttcggcgtcttcaagaagaaggtgcgcgacgtcgtgaacagcttcgaccacatgttcctcgtcgaggagggctcgcttgctcctgccacgatcgaggcgctcgaaggcgaaggcttcgtcctcaagatgctgccgttccgcacgaccgccgagaaccttgcgcaccacttcgcagacctgctccaggccgaggggcttcccatatatgaggtcgacgtgtatgagacgccgctcaactgcgcaagctacttccctgagggctgaaggctgcgttccgttcggacaatgcagctgttcataaggggcggctctccagcttgagggtataatttcaggaaagcgcaaccggagatgaggtggcaggcatgacagaggagaccaggtaccacggggtgaatctgaccgggtggctcacgctcgagtcatgggtgacgcccgagctgttcgccgattccggaacgctcaccgagagagatctggcacgggtgctgggacctgtccactacaaggacctgattggcgcacacagacgctccttcatcacggaagacgacttcaggaacatcgccgaccgcggctacaatgccgtgcgtctgccggtgccctggtatgtcctcggagcggatggtcctgccgctggtccctatatcggctgcctttcccaggtcgacgatgcgataggctggggaaacaggtgcggcctcaaggtgctgctgtccctggccatatctccgggagcttcagagttccgtgacgacccgatctctgcggctgccatgtcgcaggaccgcaggagcgaggtcatcgatcttctggtcgagctggtccggcgctacgccgtggaggactcgtttctgggcatcgagcttgcagacgatccggtgccgcagaagcgccaggggctctggcagatgtcggacggcgtgccgctccatatgctcaggaactactaccgcatggcatacgaggcaatccggaacgaggcgggggatgcccctgtgatcgtgctgcccgacgccggcatgccggcgtcgtgggacttcttccttgcccgcagccatgacgggaacgtgtggctcgactgccacctctaccagtatctcgacgatctcagcagagcatcgacggctgtcgatgtgcgggcgctcgcgaagcgctcggcgaagactctggcgcgcgaacgccgctcgaagcttcccgtcatggtcggcaagtggtcggcagcgctgccgtattccgattctgtcacgacgcccgaagggcgcatcgccctcgagcgtgtctatgtttcggagcagcttgctgcctacaaggactgcccagcctggttcttccagacctggaagacatcgggcaggctcccgaactgggatgcacggattgcgctttcgagcttcgagaggaggctcctcgattgatggcaggcatgctctccatggtggggacgcccatcggcaacctccaggacgtctcgccgcgtgtccgggagacccttgagggcgctgatgccatcttctgcgaggacacgcgcgtcacagggaagctcctcgctgtgctcggcatccatgtgcggctcgagcgcgcagacgagaacatcatcgcccagaagatcgcttcgacgctcgggcggctggagagcggcgagcgcatcgccttcgtctcggatgccggcatgccgggcatctccgatcctggccagcgtctcgtcgatgcggcactcgatgcggcgctgcccgtcgaagtgataccggggccatcggcggtcatctgtgcactcgtggcatcggggctctcgtctgaccatttcttcttcgaaggattcctgcccaggaaggccggcgaccagaaaaggcgcctcgcggagcttgcacagattcctggctctcttgtcatctacgaatctcccaggcgcgcgctccagacagcagaagcgctcgccgaggcgttccctgagcgcaggtgtgcccttgtgcgcgagctcacgaagatccacgaagaatgcgtgcgcgggcaggcgcccgagctagcggagaagcttgcggcacgtccggagatcaagggcgaatgcgtctttgtggtcgaggctccgacacaagaagagctcacggcgcggcgtgaggcagaaggcacgcggctgccgctcgacaaggcgattgccgcgggacttgccgagggggagccgaagagcgctcttgcgaagcgcctcgcaaaggaatacgaggcctcccggcaggacatctatgcacagattcttgctgctgcacaggaggatgcaggctgaggggctcactgccgcaccgattctttcaggttcagagaatgcagagccgcccgcagacagtttcctgccgtctgcgggcggcgtttttcttgtgctctcccgctgccagacgcctgagctgtatatcgatgcggtcctgtgaggtctgtgccagaatgctgtaagaacatatgttcctgtttcctgctatcctcccagcattgcaggcgccatccagaaggaggaaggatggacaggaggcccatctatgattccgtcttcaagaccatggcagagaaaataccagagcttcttgtgccgctcgtgaacgaggctttcgggactgcgtatccggaagatgctcccgtgacgcggctgggggaggaacatgccggaaagcggaagaggattgtcgatgcggccttccgcatagagggcaggaccttccatatcgagtgccagagctcgtgggacccgcatatggccatgaggatggatgagtacgaccacgagattgcacatgaggaggcagaagccagaggcgaagaccggctgctcgtgcttccggcctcttgtgtcgtcttcctgagagatgcaaggagcacgccggatttcatctcggttgaggccatggaattcgatgggacgatattcgagcataggtctcgtgccatatgggcaaagcagctatcggcagacgagatgttcgcaaagcatctcctgatccttctgccattctggctcatgcgctatgagggaaggttcgcagcaatcgcgcgggacagcgcactcgaggaggagctgctcgccgagtgccgagatatccaggaacgcctggcggaagctgcggcagataaagtgccggccaggaagcgtccttcgggtgctgcggagggcggctccatattctggaagcgcatgaccgagcttataatcgaggtatcagaccatctgctccgggactatgtgcccctgcagggagaggtgagggaagccatgggcggaaagatcctgaagtttgcggacgaacggtatgcagaagcggcagagcggcatgccgaggagatgcgcgaggccgaagagcgctgtgccagggcagaagagcggtatgccgaagcagaggagcgatccgccagggcagaagagcgatatgccgaagcagaggagcggcatgcagaggagatgcgcagagagagtgagcgcattgccaaagggctcgccgcacatggtgtcgaccagtccatcattgatgagatattcggtgccgattggaaggacgagagcggtgaagggtcttctgagcagacctgatttcgtcctgtcctgagcaatgcatcgggactttgggtggatggcaagaggtggcagtataatggcttggttctgccggcacatcaggcctttgccttccgtcatgaggagagatccatggcacagaagccttcattcttcatcaccacgcccatctactatgtgaacgccgctccgcatctgggaactgcctactgcacgatgctctgcgatgtgcaggcacgcttccgcagggctgccggctacaacgtgaagttcctgacgggcatggacgagcacggcgagaaggtggccgaggcagcagccaagcacgggatgacgccgcaggagtggtgcgattcccaggcgccgctcttcaaggacctctggcgcgagctcgagatctcgaacgacgacttcatccgcacgacggaggagcgccagtaccatgccgtgcagtacctctggaaccgcatgaaggagtccggctatctctacaagggctcctatgacggctggtactgcgtgccggaggagacctacttcaccgagaaccaggtcaggaaggccgacgaggagaaccacaccgagggacagcacctctgccctgactgcggccgtcccctcgagcgtgtccaggaggagtcctacttcttcaagctttccgccttccagaatcgcctcttgaagctctacgacgagcatcctgacttcgtgcagccgtccttccgcatgaacgaggtgcgctcgtttgtcgagggaggcctccaagacctctctgtcagccgtacgagcttcgattggggcatcccggtaccgttcgatgacaagcatgtcacctatgtctggttcgatgccctcctgaactatatgacggctgtgggctacggcgtcgacacccctgaagccaaggccgagcttgcctaccgctggccggcacagtaccacgtcgtcggcaaggacatcatccgcttccactgcgtgatctggcctgccatgctcatggcgctgggcgagcctctgcctgagcatgtctttgcccatggattcctgacggtcaggaatgccgagaccggcaaggccgagaagatgtccaagagccgtggcaatgctatcgccccgcaggatgtcgtggaccttctaggagtcgaaggctaccgctattacttcatgaccgacgtgatccacggcgaagactctgccatctcgttcgagcgcatggagcaggtctacaatgcagatctcgcgaacagctggggcaacctcgtgtcacgatccctcaacatgagcgcgaagtacttcgacggcaagaccccggtccttgcagatggctgggagaagaaggacaatccgctcaaggcaatcgccgagggcatctgcgggcgctactccgaggcaatggagcgcttcgactatgtgggcgcaaaggatgtcgtgatggagctcgtgcatgcggcaaaccactacatcgaggattccgctccctgggctgtcgcaaaggatcctgcccgtgccggcgagctcacgggcattatcgtcagcctcctcgagtccatccgcatcgcggcgcacctcttcgagccgttcatgcccgagacgtcgcgcgaggtcctgcgccgtctttccatggaggacgaggcagatgtcgagctcgaggaagcctgccagtggggacgcctcgcaagcgatgtgccggtgacgaagggcgaggcgctcttcccgcgtctccagcacaagtaggcccatgcattcctatctcgcaaagacctcggccaccaaggacgtgcttgcctgcttcggcctccagacgaagcatcgcctggggcagaacttccttgtgaacgacgatgttatcggccacatcctggacctcgccgagctcgatgggcatgatgcggccctcgaggtggggccgggcatcggcacgctgacggtcgcgatgttgccgctcgcaggagcggtctgtgcgctcgaggcagaccggagcctgcccaaggtcctggccgagacctgcggagactggtccgagcgctttgccctcatcgaaggcgatgcgctcaagatctctcctgccgagatctctgaggccattgccgctctcgggcgcgaaggtgtcccgtcagagccgaccaagctcgtctcgaacctgccctaccaggtggcggcgacgattatcctgcggacgctcgagacgatgccgtcaatcacgcgtcttgtcgtaatggtccagaaggaagtggcagaccgcatctctgccgctcccggctcgaaggaatatggcgcctacacggcaaagctccagatcttcggccgtgttacaggccgcttcgaggttggccctggcaacttcatgccgcctccgcacgtggattcggcggtcgtgcgcatcgaccggagcccccttgtcgatcccatgacaggcgctccctgcatgccggagaagatctcccgcctcgagtctgtgatcgatgcagcattctcgcagcgcagaaagacgctcaggaatgcgatggggaagagcgggtttgcgaaggagacgctcgcaagcgccttcgaagcttccggcatagaccctgccgcccgggcagagacactttctgtcgagcgcttctgtgcgctcgaagaggcgctcgaggcagccggtgccttcagcgaggagccccatggagcgcgctgaggaagaccagtggacgctgacgctcgaagacggcgtcctcttccacgacaagaaggggaggccgaaggattatccgcgccctccctatcctctgatggatacgcatggccatctcacggccttctgggaggctcagccggcgcacgccgtcgctcgcgcggcgtttgcaggcgtctgccgccttgtcgtgccgctcgaccctgcagacgatgcacatgacgcagagccgacgcttgcctcgcttgaaggctggctcgctgaagcggagagcctgatcggcgagcttggcagcaggtggcagattcctgcattcgaggagccgggcatctctgccgccacgcttcccgccgagaccaggatcgtcgcaggcgcacatccttatggggcagccgattacctcgaagacccgtctgtgaaggcggcgctcggggtcctgctcaggagcccccgctgtgtcggtatcggcgagatcggcctcgactatacctgcgatgtggaccatgggcagcagaaggaggcattccgccagcagctcgtgcttgcaggcgagctcggccttccggtggagctccatatccgcgatgcaaagggcgatgggtgcgcagaggcgcaccgcgatgcgcttcaggtgctcgaagaggcaggcgtgcccgaagcgggggcagaccttcactgctatacgggagacagggaaatccttgcgccctatctggcgcttggctgctctgtcgccttcggcggcgctctcacattcaggaagtctgacgatatccgcgatgccgcgctgagcgcccccagagagtgtctcctctccgagactgactgcccgtacatggcgccggtgccgatgaggggacgggaaggcgagcctgccctggtaggatttacggcagcagcgcttgccgaccttcgccttgctgcgggcctggcgaagaccaaagaagagacctatcaggcactctgggagaacggttcccggctcttctatcggtagctgtcagattggccttgatgctacgcttggatatgtcggatgatgcagcgtggcttggagagcgcaatggaggcagggcacatcgaggcagagggctggaaggcgaaggctgcttcggctctccgcttcatgcgggatgcggcagaagagacgctctggccgacccgctgcgtcggctgcggcaggcccgagaccctgctctgcgacgagtgccggctctcgcttccctggatatcacagagagatgcctgcccggtctgcggggcaccctatggagcgacactctgcacggaatgcaagggcgactggtgcgtgcgcacgaccatctgtgccatgagcttcgaaggcacggcagcacggctcgtcaggatctacaaggatcagcatgagacgaggcttgcccgcatcatggcagcagcgatagcgacagcgctcgacgaggcggaaggctgcgtcctgccagacggcgagccgcgcttcgatccggatgatatcgatgcgatctgcttcgtgccggcaacacccgatgcgctccgcacgcgtggcttcgaccatatggagcttgttgcgaagcatctgacctacgagctcgggcttcccctcgcagatgtcttggtgaaggattccgtgaaggaccagagagacctcgggcgtgaagcgagaagggaaaacctcgaaggcaccgtcgaggcgatcgaggatgtctcggacatgcatcttctgcttgtggacgacgtcgtgacgacaggagcctcgatcgaggcctcggcagaggcgctcctgcggcgcggcgcccgtgctgtcacagctgcagcatttgcccgggtctggtaggctctgctggatacggtctggcagaaaagagggcatatggcacgtctaggcatcatctcttccggaggtccaaaagatgcattcgtggagcggctggagcagctcctgggagaggatgtggcagatatcgctgctgccgaggcaggcgtgcctatgcaacagcttgccttcgaaggcagggacgaggagctcgtgcgcgagcttgcctcaccgctcgaagatctggcgcaagctggagcagattgtgcgcttctggcatcggtgagcgcgcactgcgtgcagaaggctctggcagatgcaggcacgcttccactactgggcctcgccgaggcgctcaggcaggatgtccttgcccagggctggagaagcgtatttcttcttggaagctaccggaccatgaaggatggcttcctgaagcgtccgctcatcctctcgcacacgatcgtgatcacaccgaacgaggaagagaagctgtggctccagcatgctgtggatgctgtgcagggcggaactggcaaaagagaggagatgcaggagcatcttctggagatcgtctcgaagggcagggaagagggcgcccaggggctcctgctcgcgagcacggcgctcgagacgcttgcggagggcctcgagcttccgcttccggcagtcatgccctctgtgtctgcagcgcatgcattcacggcgttccgacatgtgtaagttcctgcccgatgctgctgcaatatgcagcaaattacggctaagtgccggctattcattcaggcggctgcatagtttattgccagacatggacatttctgcagcgtagagcctatttctcgcgtgaatcgagagtggaagccgtataatctctctgtctcttccaggtctgtggttgcggaggcaccgatctgcctcctagtccatgacagacgaggtcaaagggatccacgtaagccagcgtgtgggcatgctggcgatcatggctcgtcctagaagcaagtcgcactgcctgattggctttggggcaaagagccccacaggcaagagggctttgagtgggggtgcctgagcatccgaagcggaggccccggtgcgcgggtgtggggccaaagaccaggtcagctggaagagacggccatattgtcggctgagcgaaggatggacccatgaagctacgtatcgcgatctgcgctgccgttgcagcgctcgcatgtgccgttctggcagctgcttctggattgcccttcgtctcctccctggagcatgccttcggcagcgatgaggagtcggtggctgaggctacgtcttctgcccaggcgaagatggagcccaaggtcagcgcctctgccctccacgaggaaggcacgctcacggtcggcatcaagcaggacgtgcagctgcccatgagcaccgtggacgattcgggcagcttccagggcctcgatatcgatcttgccgcagatatcgcagagcatctcggcctcaagatccgctttatgagcgtcgaggatgcagctgatggcttttcccagggctgcgatatcgtgatggacatgacagacggcgaagaggacggcatcacgatcgtcggcacgtatgcggagtcgacacttggcgtcttcggcaggaatgtggatggcacggtcacagccgacgatatgagcggcaggcgggtggcagtccagatgggctccgaggcgcattccgagctctcccgtgtcacgccttcggtcacctttgcctatgcgacgaatctgaacgactgcttccacatgctcgaggcgggagaggcagactatacagtctgctcggcctatcagggagccctcctctctcgctatatccagaagatctcctactgcgggacgattggcgacatctcgaagatcggcatcggcgtggaagctgcgaacaccgagcttgccgcagctgtgggtgacgccgaggcggaggccgagcaggatgggacctatgagctcatccgcgacaagtggcttgacggcctgccccatctcgatggaaccaccgccatctcaggctttgcggcaaagcagtccccgtctgcccttgcagatgctgcctaggaatgcgcctcctttgcgtccattcgcagatatgaacggcacgagcgtcggctcgggccgacgaatgggtatgagtcctgtacaagcggagcgtggagcgcgctccgggttctgatgggaggcatttatggtcgatatcaagctttcgggccgcaagatccagattaccgatgccctcaggagctacgtggacgaaaagatcgggaatgccctcaaggtattcgatatccagcccatgaactgcgacgtcgtgctcagggtagactacaaccgctccaatcctgaccgcaggacctgcgaggttacggtcttcgtgcgcgattctgtcgtgcgtgtctccgagagcgccgatgacatgtatgcggcaatcgatcttgctgcagacaaggtggagcgccagctcaggaagtacaagacgcgcatcgtcgacaagaggcagcatgcccagaaggcagcccctcctgcccagaccgcagaagagctcgaaaagctgctcgagcccctgccggaagaggatgacgacctcctggtgcgcgagaagtatatcgacctcaagcctatgacagaagagcaggcgctcgtcgagaccgacctcctcggccatgatttctatgtgttcctgaatgcggagaccggcctggtgaatgtcatctaccatagaaagaatggcgggtatggcatcatcaaaccgaagatagaggagctggatgagcagtaagcgcgcacagcagccgaaagacgatgcagaagctgcatctctccagacagatacagacaccgtcgcgacgccagtccccaatgtgaccggcgccgcggcgcttaattcttacgtcaaggcctatcagaagcgtctcggcgtcacgatcgtggccgatacggcagccgacttcaatccgtccgtagcccaccagctcggcatcgaggtcattccgttccactacgtgggaccggacggcgagcatgcagacgacatgtggcagagccggacgccccacgagttctacgaatacatgcgcaagaacccggaagcccgcttcaggacgatggcggtgacgccgggcacctacatggaggtcttcgagcggctcttcgaggaacgccaccagccgatcatctatctcgggctcactggcggcctctcctcctctatcgatgcggcagagcagggcgcccagctcgtgcgtgacgagcatcccgatgcagagatctatgtgatcgacaatctgtgcccgtctgcggcagcagagcttcttgcaatcgaggtcgtgcgccaggcagcaaatggcctcgcagcagaggagctcgttgcctgggccaaggatgcccgctacttcatccagggctatttcacgctcgattccctccactggcttgcagcaggaggacgcatccctccgacagcagcgcaggtaggtggcaagctcgatgtgaagccggagctttcctacgacctcaacgggtcgcttacgctcaagggcatgtgccgtggccgcaagaaggcgctgcgtgcgatcctccaggagttcaaggacaactacgcccacgatacgtctcttcctatcggcatcatggacgctgacgcgccgaaggacgccgagtggctcgagaaggagatccgcaagatggatggctgcgaggacctgacggtcatccacagctccatctcgccggtcattggctcccacgtcggcccgggcatggtcgcgctcgtattctggggctctgaccgccgcgagaagctctcgctcacggatcgcatcgcacgcaaggtgcgcagcaggtaagacagaaaggcaaggtatatggccttgggaacaattcgctcggtcgccttcatcggcacgggcatcatgggagcgccgattgcagcgcatatcctcgaggcgggctatcgcctcacggtctatacgcgcacgaagtcgaaggcagaagaccttctggcaaagggcgcgaagtgggcgaagtctccgtccgatgctgcgcgtgacgccgatgtcgtgttcacgatgctcggctatcccgacgaggtggaagaggtctatctcacgaccgacggcctcatccgtgccacgaagaagggcgcctacctcatcgacctcacgacgtcgtcgccccagctggcgcgcgacctgcatgactctgccgagatcgaggacaagcatgccttcgatatcccggtgacaggcggccaggctggtgcccaggcaggcaccttgacgctcattgccggcgcgacggagaaggatatcgcgccgatccgtcctgtcctcgagacattctcgagcaagatctactgcttcggcggtgccggcaagggccagattgcaaagcttgcaaaccaggttgcgctggcatcggcgcttcttggtgcctctgaggccatggcgctggcagagcagggcgagctcgaccgcaatgaggtcctcgatatgatctctcatggcatggggtcttcccgccagctcgaggagcttacgccgaaggcgcttgccggagacttcaagccgggcttcaaggccgtgcatctgaggaaggacctcgcgcttgcgctcaggcttgccgaggaggaggacctgacgcttccgggcacggataccgtcttcaacctcttcgacgtgctctgcaacatcggcggcgcgcagatgggcacgcaggccctgcagctgctcttcgaggatgatacgcagacgcagaaggcaggcctcgactggtcgcttcttgaccaggccgacgattcgggagatccagacgatgaggctgccgtgcatgcagcgcccgaagtctcgaagaaggctgccgaggcggcagaggaaagcccgtacctgaggtcccgccactgacaggcatgtccgcggcatgcggattcttgacacagcacagatatatggaggtagtcgatggatagctctctggcaagcgccctgcctgcgctcgtaggcggccttgctgcccattcacgccgccagcgccaggctgcggcacagaaggtctacagcgtcgcaaaggaggatccttctgcgatcctgccgtatctgaacgaccttctcgatgccctgggacgtcccgaggcgcagacgcgctgggaagtgcttgatacgctgacgcttgtcgcccaggcacatccccaggaggtgcagccgggcatcgatgcagcggagacgtcgctctttgatgaggattccgctccggtgcgcctggcggccttcagattcctcgcagcatatgggtcgacttctgaagctcgctcggatgaggtgtggcctctcttggacgaagccatacagtgctaccatggggatgccgaatacagggacatgcttgttgccctctatgatatggcacagggtccgatatcggagaagtgcgctcatgagcttctcgaccggattgccttcgatacgaagagtggagccagctacatccaggcgctctccgaaaacattgcaaaggaactcaaaggaaaggttcattgagcatggcagaaaagaagccggaaaccgaactggacacgaagaaggccgatgctgcaaaggatgagaaggccgagaagaagccttccaagcctgcacgcacggtgccgcctgtcgcaaccatcgtcgcggctgtcgtctgcctcgtcctgggcggtgtcgtaggacacttctgcttcaacggcacgagctcgctcggctcccagaccctgcaggaagccgatctcgacacggttgtcgcacgttatacgtacaacggccagacctatgagatcacggccaaggacgtgatcacgcagtcctcctcgctcgacagcgccgcaaacgacgatggcagctacacggtgccgaccgctgacaacatcatcgaccttgcccgcaaccagatcatgcagaaggtcgtcgatgcccagggtatcacggtctccgacgacgatatggatgcctacgcgcagcagtatctcggctccaccgactacgcgacaatcgcttcgaactacaacatggacgaggactccgtgaggaaccttgtccgccagtcctgcgctctttccaagctccgcagccaggtcgtgacggccgagattccgtcccagccgacggctccttcgaagcctgctgacggcgccgaggatacgccgacggccgactacgcgacctacatcatcaacctcgcaggcgatgagtgggactccgagaccggcatctggaaggactcctcctcgacctacgcctccgctcttgccgactaccagatcacgaacgattctgcgacctacgctgcagcacaggctgcctactatgtggcctaccagcagtactccacggcttcccagactgcatcgcagcagtggacgaactacgtgaatgaccagctctcgaaggcaagcatcgagatctacacgatggaagcctaagaggcagatacaagcgctacgatggacggacgggcatctttgcctgtccgtccttttctatagcggaaagaggtgtccctcatgcatattgcggtgagcgcatgccttctgggggagcggtgcagatacgacggcggcacgaagccggatgaggccgtcatccggctctcaggcaaggcggagcctgtgcccatctgcccggagaggctctcgggactgcccataccgcgccctcctgcagagatcagggatgggcatgtctatctcagggacgggcgggatgtgaccgaagagttcgagacaggggcgaagtgtgcgcttgcccgcgtgagggagcagcccgtgccgcttgccgtcctgaaggcaaagagcccatcatgtggtgccggtctcatctacgatggtagctatagcggaaggaccatagagggggacggggtctttgcccgccttctcgaagaggaaggaatcaccgtggtaagcgaaacgactgtcgaatccgtgcatccgtctgtagagcatcctgtggcaatcatccttggcaccggtctgggacatctcaaaagcctcgtgcatccggtgcgccgcatcgactatcacgatatcgagggattcccggatgaggcacagccgatgccgggccacacgttcgaggcaacgatcggcacgatcgacaatgtcccggtgatcgtctatccgggccgcatccatctctatcagggctacagcgcctccgagatctgcgcccttgtccgccatgcccaccgcctcggctgccgcgacatcgtctttgcctgcgcaacgggtgccgtctccggcatggcaaacatcggcctcggcatcatcacggaccagatcaacctcacgggcagaaatccgcttgccgaggatgaaggactccgcgatgtggagtctcccttcgtcgatatggcggatgcctatacgccctacctcaggacccttgcaaggggcgtcgcagacgatctcggcattgcggtcgaggagggtgtccttgcaggtgtcatcggtccctgcacagagacgcctgcagaggtgcagatgatgaggacgatgggcgtgtcctatgtcggcatgtcgaccgtgaatgaggtcatcatggcgcacgctctgggcatgaatgtcttgggcctcacgcttgctgccaaccagagcggaagcgcaggcttcggccacgacaaggtcctcgaagaggcgaagctccatgcagacgacttcgagcgtctcgtgaggggcgtgctgcgcctgctgtagatacagacagctgtatagagcactgacgctggggcctgggatgaagctgcattccaggcctctttcctgatacaaagatcagatgctgaggagagagcagatggaatagcgccctgccaaggcacagaggcacagagaggctgcctgaggcagcgggaagcgtcttgctgcagcgaaggcctgggcagaaagcctctccgagatagagatcgcaaaggagatggaggggctcacgctcaaggaggcaaaggatatgaggccgcgcgaaaaggggctgcttgattgaggctgatggacagccattcatcgaagcttccctggaatagccgatatatcaggaggaggattccggcttcgggagatacgaagagcgcctgggtgcatctctgcatcccaggcgctcttctgtccagcttctgtcttgcgggattgtgctacttcgcggcagcgtccttctcgagcgtctcccagatgccgttgatgtaggtgcagccaagcgccctgtcatagaggccatagcccggacgcccggtctcgccccagatcatgcggccatggtcgggacggatatagccgtcgaacccgttctcgaagagcgcccggcacatgcgccagacatcgagcgagccttcgcgggacaggtgcggcgctgcgcctcgtagaagtcttgcctttcccggcttcagatagcggatgttgcgcatatggacgagtgtatccgcgcgcaatcgagaactaccgaggaccataggaactcttcgcgggctcctcgcatctgctgcacaacttcatgccggtcttcggctgggtggaatccgaaccgactatcgcctcccgacggatccgtcagcgcctcttatggcggggaagggaacatccccgacgtacccggaggatgcgtcgagcgcactacgccacggccggacgctatgtccttcccggctgggagcccgagcgcctcgcccactgaaggagctcttcgagctctacagggacgtcgacgagcaggccctgcgcgacaacctcgtctacttcctcaaggccatcatcccacctgcgaggagtgcggcgtgagatggcgatcctccggacgatcccccctactcgatgttcggccttcccgcatcatcaaaccgcgacgacctcgactggctctgccgtgcggtcgattcccccgcgaacggcatcacgctctgctgcgggtgctcgcggaggagcccgcaaacgacgtctatgcatcctcgacgagttctcgaggcgcggcaggatacacttcgtccatatgcgcaacatccgctatctcgagccgaaagagcaaggacttctacgaggcgccgcacctgtcccgcgaaggctcgctcgatgtctggcgcatgtgccgggcgctcttcgagaacgggttcgacggctatatccgtcccgaccatggccgcatgatctggggcgagaccgggcgtccgggctatggcctctatgacagggcgcttggctgcacctacatcaacggcatctgggagacgctcgagaaggacgctgccgcgaagtagcacaatcccgcaagacagaagctggaacgaagagcgcctgggatgcagagatgcacccaggcgctcttgtatctcccgaagccggaacctcctccggatatatcggctattccagggaagcttcgatgaatggctgtccatcagcctcaatcaagcccccttttcgcgcggcctcatatcctttgcctccttgagcgtgagcccctccatctcctttgcgatctctatctcggagaggctttctgcccaggccttcgctgcagcagacgcttcccgctgcctcaggcagcctctctgtgcctctgtgccttggcagggcgctattccatctgctctctcctcagcatctgatctttgtatcaggaaagaggcctggaatgcagcttcatcccaggccccagcgtcagtgctctatacagctgtctgtatctacagcacggcgcagcacgcccctcacgagacgctcgaagtcgtctgcatggagcttcgcctctcgaggaccttgtcgtggccgaagcctgcgcttccctctggtggcagcaagctgaggcccaagacattcatgcccagagcgtgcgccatgatgacctcattcacggtcgacatgccgataggacacgcccatcgtcctcatcatctgcacctctgcaggcgtctctgtgcaggaccgatgacacctgcaaggacaccctcctcgaccgcaatgccgagatcgtctgcgacgccccttgcaagggccggaggtagggcgtataggcatccgccatatcgacgaagggagactccacatcgcggagtccttcatcctcggcaagcggattttcgcccgtgaggttgatctggtccgtgatgatgccgaggccgatgtttgccatgccgagacggcacccgttgcgcaggcaagacgatttcgcggcagccgaggcggtgggcatggcgacaagggcgcagatctcggaggcgctgtagccctgatagagatggatgcgcccggatagacgatcaccgggacattgtcgatcgtgccgatcgttgcctcgaacgtgtggcccggcatcggctgtgcctcatccgggaatccctcgatatcgtgatagtcgatgcggcgccccgatgcacgaggcttttgagatttcccagaccgtgccaaggatgattgccacaggatgctctacaacggatgcacggattcgacagtcgtttcgctaccacggtgattccttcctcttcgagaaggcggcaaagaccccgtccccctctatggtccttccgctatagctaccatcgtagatgaccggcaccacatgatgggctcttgccttcaggacggcaagcggcacgggctgctccctcacgcggcaagcgcacacttcgcccctgtctcggaactcttcggtcacatcccgccgtccctgagatagacatgcccatccctgatctctgcaggaggcgcggttgggcatcccgagagcctctccgggcagatgggcacaggctccgccttgcctgagagccggatgacggcctcatccggcttcgtgccgccgtcgtatctgcaccgctcccccagaaggcatcctcaccgcaatatgcatgagggacacctctttccgctatagaaaaggacggacaggcaaagatgcccgtccgtccatcgtagcgcttgtatctgcctcttaggcttccatcgtgtagatctcgatgcttgccttcgagagctggtcattcacgtagttcgtccactgctgcgatcagtctgggaagccgtggagtactgctggtggccacatagtaggcagcctgtgctgcagcgtaggtcgcagaatcgttcgtgatctggtagtcggcaagagcggaggcgtaggtcgaggaggagtccttccagatgccggttcgcgagtcccaccatcgcctgcgaggttgatgatgtaggtcgcgtagtcggccgtcggcgtatcctcgcgccgtcagcaggcttcgaaggagccgtcggctgggacgaaatctcggccgtcacgacctggctgcggagcttggaaagagcgcaggactggcggacaaggttcctcacggagtcctcgtccatgttgtagttcgaagcgattgtcgcgtagtcggtggagccgagatactgctgcgcgtaggcatccatatcgtcgtcggagaccgtgataccctgggcatcgacgaccttctgcatgatctggttgcgggcaaggtcgatgatgttgtcagcggtcggcactgtttagctgccatcgtcgtttgcggcgctgtcgagcgaggaggactgcgtgatcacgtccttgcgtgatctcataggtctggccgttgtacgtatacgtgcgacaaccgtgtcgagatcggcttcctgcagggtcgggtggaccgagcgagctcgtgccgttgaagcagaagtgtcctacgacaccgcccaggacgaggcagacgacagccgcgacgatggttgcgacaggcggcaccgtgcgtgcaggcttggaaggcttcttctcggccttctcatccttgcagcatcggccttcttcgtgtccagttcggtttccggcttcttttcgccatgctcaatgaactttcctttgagttcctttgcaatgttttcggagagcgcctggatgtagctggctccactcttcttatcgaaggcaatccggtcgagagctcatgagcgcacttctccgataatcggaccctgtgccatatcatagagggccacagcatgtccctgtattcggcatccatgtagcactgtatgcttcgtccaagagaggccacacctcatccgagcgagcttcagaagtcgacccatatgctgcgaggaatctgaaggccgccaggcgcccggagcggaatcctcatcaaagagcgacgtctccgctgcatcgatgcccggctgcacctcctggggatgtgcctgggcgacaagcgtcagcgtatcaagcacttcccagcgcgtctgcgcctcgggacgtcccagggcatcgagaaggtcttcagtcaggcaggatcgcagaaggatcctcctttgcgacgctgtagacctctgtgccgcagcctggcgctggcggcgtgaatgggcagcaaggccgcctacgagcgcaggcagggcgcttgccagagagctatccatcgactacctccatatatctgtgctgttcaagaatccgcatgccgcggacatgcctgtcagtggcgggacctcaggtacgggctttcctctgccgcctcggcagccttcttcgagacttcgggcgctgcatcacggcagcccctcatcgtctggatctcccgaatcgtcggcctgtc

SEQ ID NO: 65 - DNA, 8364 bp, Unknown
  Metagenome-assembled genome
acagcatcagatgaaggggacgcctgcagatgcagacgccccgcctctttgctgctttcattagtgctagaccggacggtgcggcgcccgatacgatatcgtccgccttctcggcagagatcctgctccggtgcctcggcaagcacgcggatcagaggctcggtgccggatgcacggacgagcacgcggccattgccctcgaggaagtgctcctgcctcggccactgcttcctgaatctcgggagcctccatcacggcattcttgtccttgacctcgacgttgatgagaagctgcggatagcgcttgaccggacgcgtgagctcggagagcttctccttctcggcacgcagaacctctcatggcctcaagcttcatcacgccgtcacctgtcgtctcgatatcgccgaagatgatgtggccggactgctcgcgccgagcgagtagccgttctcgcagcagcggcatagacgttcttgtcgccacagccgtcgcctcgtacttgatgccagcatcgtcgaaggcacggaagaggccgaagttcgacatgacagtcgggacgaccgtatcatgggcaagcttgccatgcttcttgaggggtgccgcagacatagaggatgaggtcgccgtcgacgacacgcccttctcgtcgaccgcgatgcaacggtcagcgcgcgtcgtagggcgaagcccacgtcgaggcgattgtacatcacgaagttctggagcgtctcaatgtgcgtggagccgcagtcgacattgatgttgaaccatcaggagcattgttgatcacgtagtatcggcaccgagggcgtcgagaagacgggcgggcgacgctcgaagcagcaggccgttggcgccagtcgagacgaccctcattcccggaggctgaagccgcaaggaggcgatcagatagcgatgtagcggttcctgccgtgcatgtagtcgatcgtgcggccgatcgcattgccggtccgcaagcggcacctcgacctttccatcgaggtagtcctcgatcttgaggagcacatcctcgtccatcttgtagccctcatggttcacgagcttgatgccgttgtccgtgtagggtttgtgggaggccgtgatcatgatgccgcagtcgaaccgccatcgagcgtctcatagcagagtcggcgtcgggatcacatggagcatgtagactggcgcccgatgccacgaggcccgagatgagggcgctctcgaacatgtaggacgaacggcgggtaccttcccgaggacgacacgggccttcctgccctggttcgctccgtagtaccagccgacatagcggccgatcttgaacgcatgctcgacattgaggccttcattggccctgccgcggaagccgtccgtaccgaaatatttcatcgctctctccttgcatcggcgcctgctccacagcaagcaggccagatcgcttacaagctcgtttccccattgtaacggtatcgctcccgtctgccgtctgccgatgactgcccacacggaagaagtaggacttatatggtagatatcacctcatcatcgcagcagaaatcggagcacgctatgcccagacattcacagcagaggacgcagccttctcagcggagacgaaccctcacggctggcggctatatcggattcacgatcctctttgccattccgctcgtaggccttgtctcttccctcatcttgccttcgcgagcaagaacatgaacaggcggggctttgcgcgtgctgccctcttctggcgcatcgtgtgctacgtgcttgtggccctctatttcttcgtaccgttgtgccatgccatgaggagcctgccggcaatcgcttccgaccttgcaaccgtcttgcggcactcctgccttctcgcttacgtagccgcgcccagaaaggagcttctgcatgcggaccacacgcttccctcttcctcttgatgaagcttgtcatctctgccctgtgcgtcctggcgcttgcctgaccttcggctggagaagcggctcctggcatttcgaggggctccactacttcgctgtcctccattgccgccgcttcgcttgccatctactggctctgcgaggcgatctttgtcctcgtgcatcgcaaggaggaccgtggcggctctgtcatcgagccgagcctcaagtatgcgctcacgatgtgccttgtcgtcacctgcaccgtcacgcacttcctctgaaggtcgtcccttctggggttaggctgggacttcccgtttttcgccctccattacctgattccggcgcttgccgtcgccgactggccctcttcgaccggaagggctcatgcatggtgggggaccctgttgactgcgtctggacctgctgctttgatatctcctgatcacggagtctcgttgccggccacaagcatcgatcttgccggagacttccagatctcgggcgctcacgctaatccctatctccctgctcgattcacgcagattggccaccgagcatgtccttctgctgtcggctgcggctatgccttcttcccgcggcactcggctacgtcgtcctttgccctcgaccgcctgctttcgacggtcggcagggatgcccgtgccgcccgaggcccggagaagccgaaacagagtgcgatctgcgtggacatcgaagcaggggatagggatagcgtgagacgcccgagattggaagtctccggcaagatcgatgcttgtgccggggccaacgaggagctccgtgatcaggagattagatagaagcaggcaggtcccgacaagcggggtcccccacccatgcatgaggcctccggttcgagaggaagccagtacggcgacggcaagcgccggaatcaggtaatggagggcggaaaaaacgggaagtcccagccgtaaccccagaagggacgacctcagaaggaaggcgtgacggtgcgggtgcacgacaagcacatcgtggcgcatacttgaggcctcgggctcgctgacagagccgccacggttcatccttgcgatgcacgcgggacaaagatcgcctcgcagagccagtagatggcagaagcggcggcaatgaggacagcgaagtagtggagcccctcgaaatgccaggagccgcttctccagccgaaggtcagggcaagcgccaggacgcacagggcagagatggcaagcttcatcaagaaggagagggaagcgtgatggatccgcatgcagaagctcctttctgggcgcggctacgtgagcgagaagggcatgcgtgccgcaagacggtttgcaaggtcggaagcgattgccggcaggctcctcatggcatgggcagcagacggtacgaagaaatagagggccacgagcgcgtagcacacgatgcgccagaagagggcagcacgcgcaaagctccgcctgttcatgttcttgcttgcgaaggcaaagatgagggaagagacaaggcctacgagcggaatggcaaagaggatcgtgaatccgatatagccgccaggcgtgatgggttcgtcatccgccgagaaggctgcgtcctctgctgtgaaatgtctgggcatagcgtgctccgattctgctgcgatgatgaggtggtatctaccatataagtcctacttcttccgtgtgggcagccatcggcagacggcagacgggagcgataccattacaatggggaaacgagcttgtaagcgatctggcctgcttgtgtgcggagcaggcgccgatgcaaggagagagcgatgaaatatttcggtacggacggcttccgcggcagggccaatgaaggcctcaatgtcgagcatgcgttcaagatcggccgctatgtcggctggtactacggagcgaaccagggcaggaaggcccgtgtcgtcctcgggaaggatacccgccgttcgtcctacatgttcgagagcgccctcatctcgggcctcgtggcatcgggcgccgatgtctacatgctccatgtgatcccgacgccgggactctgctatgagacgctcgatggcgggttcgactgcggcatcatgatcacggcctcccacaacccctacacggacaacggcatcaagctcgtgaaccatgagggctacaagatggacgaggatgtgctcctcaagatcgaggactacctcgatggaaaggtcgaggtgccgcttgcgaccggcaatgcgatcggccgcacgatcgactacatgcagggcaggaaccgctacatcgcctatctgatcgcctcctgcggcttcagcctccagggcatgagggtcggcctcgactgcgccaacggcgctgcttcgagcgtcgcccgcccggtcttcgacgccctcggtgccgatacctacgtgatcaacaatgctcctgatggcttcaacatcaatgtcgactgcggctccacgcacattgagacgctccagaacttcgtgatgtacaatcgcctcgacgtgggcttcgcctacgacggcgacgctgaccgttgcatcgcggtcgacgagaagggcgatgtcgtcgacggcgacctcatcctctatgtctgcggcacctacctcaagaagcatggcaagcttgcccatgatacggtcgtcccgactgtcatgtcgaacttcggcctcttccgtgccttcgacgatgctggcatcaagtacgaggcgacggctgtgggcgacaagaacgtctatgcctgcatgcgcgagaacggctactcgctcggcggcgagcagtccggccacatcatcttcggcgatatcgagacgacaggtgacggcgtgatgacaagcttgaggctcatggaggtgctgcgtgccgagaaggagaagctctccgagctcacgcgtccggtcaagcgctatccgcagcttctcatcaacgtcgaggtcaaggacaagaatgccgtgatggaggctcccgagattcaggaagcagtggccgaggcagagcacttcctcgagggcaatggccgcgtgctcgtccgtgcatccggcaccgagcctctgatccgcgtgcttgccgaggcaccggagcaggatctctgccagaaggcggacgatatcgtgatcgaggcgctcgcaccgtaccgcgtctagcacgaactgaaagcagcaaagaggcggggcgtctgcatctgcaggcgtcccgcttcatcttgatgctgtcgttctgtgatcaggcgccgaccttctgcttcgtccagacaaggatgtcgcgcatcacatcgtccgcatcggtctcgttcaggatctcgtggcgcatgtgctcatagatgtgcacggagacatcctttacgccggcatcgcgcgccatcgaggccgcatgctcgacgcccttgccgcaggagccgacggggtcctcggcgcctgccacgaagaagacgggcaggtccttgtcccacttcgcgaagcagtcaggagagcagacgaagcgggtgatggcagagaccgtcgcatagccgccacaagagaatggaaagccgcaggcagggtctgcgatataggcgtcgacgttctccgtgttgtagctcagccagtcgaagtcggtccttgcattcttgatctgctttgcataggcaccgtcgccgagcgaatggagcatctcgaggtaggcatcctcgccgtggcgccttgccgcctgcgcagcgaggccatgcatgaaggcagaggctgcaggcgggacgtgtcccgtgccggaaaggatgcaggccttgaggtcagggtcgcggtaggtcgcaaggtaggcacgggcaagataggatccgagcgagtggccgaagagcacatgcggcacgcccggcaccctcttctccatctcctttgccatgcgtctgatatcgtcgaccatgatcttgtcgccgccctgggcaggaagcttgccccagcgctctggagctgcgctctcgccgtggcctatctggtcatggccgcagacgacgtatcccgcatgggcaagatactcggcaaagcgctcgtagcggctgatgtgctccgccatgccatggacgatctggaagatggccttcggctcgccttctggccacacgatctttgcgtggatctgggtggtgccgtctgcactcggaaacgtgaggctctctttcctgagccctgcgctcgtggatgtatccattgcgtgcctccctgcaatcgctcacggacccatcctaggccgaagcctctgatgcatacacggaaggctggccagacggcacaaaagacggcgcatgcggaaggaaggacaggtaggaaaaaggcctggaaagagcttccaggccagaaggaaactatgtgtgcttggctagagcgcgaggtcttccggacgcgccgcgtcgtctggtgtacgctcctgcacgtagcggatgaactcgcggcgctcctcgtctgtcctgagctttgctgtgtatgccatgtctcccatatcgtcggcaagggcaggggagatgcggtctgcctcgacgaggcgctctccataggtccgcctgatatcggcatccgagtggacatagcggtggcagtcgcgctgcgaggcatagacacagaagaactgctcgccttgggtcacgtcagtcgcatccttcgtgaccatgtcggcccagatctggtagacatcgcaggagtgcgcatagttcatcatgttcggcgtgttggatccgggcggacgcaggttcacctcgaggccgacatagtcgccggcatctcccaggccttccttggccttgtcgagccggaagaattccatgtgggtgaagcggctcctgatgccaaaggacttgccggcagcgcggccgagcttctggagcctcggatcgatcgcaggaaggcaggtataggccatatcgagcttctcttcggccacgcgtgccatgctcctcgggaacccttctatgttctcgaagaggggattggcgtggctgtcgaagatggcatcgtaggagcagatgcgtcccgagacgaactcctcgatcacatagctgcccttcggcctgtctgcaaagaaggtggcaagagctgcctcgtctgcaatcttgcgggcaccgagcgagcccatgccgacctcgggcttcgcgaagaggggatagccgacctgtgaggcgaactgctttgcatcgtcgagcgtcgaagccttgatctggcgtgctgtcggaatggaccccatcgcatagagcggcttcatgccggccttgctctgccagacggccatctgcgcggtcgatgctcccgtcacgatatggaagtcatcgcgcaggcgtgcatcctgcgcgagccagaattcgttgttcgattcgagccagtcgatctttccgtatttgtacgagaagaaggcgacggcacggaagacctggctgtagtccgcgagattcggcgtgtagtagtactcggtgagcgagctcttgagctctggtgccagcccgtcatacggggcatctccgataccgaggacggtgacgccgtttctctggagcctgttgcagaactgccagaatacaggagggaactgcggggatatgaagacgaaattcatggactacctctgacgaagcattcaggacccattcatgctagcgcgtgcagagctacaggcttgttacaggaagacattacgcaatctttgcaggaactgccttgcagatgaaaaagggcctgtcccgaagggcaggcccagatgcatgcaaccgagaagagctactttgcgcggcgcgtggaagacctgcgggtcgtggtcttcttcgctgcgggctttgctgcggtcttggaagcggcggcagccgtcttcttcgctgcgggctttgcagccttggtggcaggctttgcagcgggctcagctttcttggcagcgggcttcgcctctgcggtcttggcgggtgctgccttctttgcgggagtcggcttctctgctgcctttgcagcagtcttcggtgctgcctttgctgcgggctcagccttcttggtggccggctttgcctcagctgctgcaggagctgccttcggctcggccttctttgcggcaggagctggcttctctgctgccttgacagccggctttacagctgccttgggagcaggctcggccttattcgctgcgggctttgcagccttggcggcaggcttcgctgcgggctcagccttcttggctgcaggctttgcagcgggagcgggcttttcggccttcggagcctctgccttcttgggagcaggctttgcctcagccttcggtgctgctgcaggcttctcttccttcttcggcgcaggtgcagcttccttcttggcctctgctgcctcttcggcaagctccttcttcacgtcctcgaggacgatcggcaggaagtagcgcatctgcttcttccaccatggccagtcgtggttcacatcgtagccccagaaatcgcaccaggcactga

SEQ ID NO: 66 - DNA, 16367 bp, Unknown
  Metagenome-assembled genome
tgcggtgcagacgcttgccgagtccaatggctacggctcgtccgcgactacgtcggccaggcatcggccacgatatgcgcgaagataccgaatgtcccgaattgggcaagccgggaggggtgcttctgcaggtcggcatgttcatcgcgatcgagccgatgattacgctcggctccgcgcgttaagaagcccagcaacggctggacggtcgtcacccgtgatggcaagccggcagcgcattcgagaaagtgtcgcaatcacaggaggatggtcctgtcatcctcccgagatgagaccggaccctggtgcgcatgttcggcggagccgactacgtcgagctcaaggtcgacgagatgcgaatgatgaagctcccgaagaggagaagaaggaagacgccgaatagcggctcgatgagagcgggaacaagagccccgagcgcagatgcgccgggccgttctcccgaaaatttgtcctgcttatggacattgcattgtgctctatgcggagcagatatttttgctatgataatatgccgctgtcactgtggaaacatcgtgcgaggagaaggtagacaggttgagtaagcaagatgcaatcgagctcgagggcaaggtcatcgaaccactcccgaatgccatgttcaacgtagagctggagaatggcaagaacatcctgtgcaccatttccggaaagattaggatgaactacatccgcatccttccaggcgacaaagttgtcgtagagatttctccgtacgatctgacacgtggcaggattacctatcgctacaagtaagccggtaattcacgcctgcggctgggcgattacatagtaagggaacaaccgaaaggaattgcaatgaaggtacgtccttcggtaaagaagatgtgcgacaagtgcaagatcatccgtcgccatggcaaggtttacgtcatctgcgagaacccgcgccacaagcagcgccagggctaagagaggagcaccaaattggcccgtattaacggtgtagacctcccgcgcgagaagcgtgtcgagatcggacttacctatctttatggcattggccgtacgtccgctaccaagatctgcgctgaggttggcattgaccccagcacgcgtgtccgcgacctcactgaagaggaagtcgcaaagattcgcgattacatcgatgctaactacacggtcgagggtgacctgcgtcgtgagcgcaggcagaacatcgcccgcctgatggagattggctgctaccgtggcctccgtcaccgcaagggtcttcctgttcatggacagcgtacccacacgaacgcccgcacccgcaagggtccgcgtcgtcaaatcggtggcaagaagagggcctagggagtaagacatgccgcagaagaagaacgtgcgcaacgtccgcgtcaagcgctctgagcgcaagaacatttccgtgggccaggcccacatcaagagcaccttcaacaacaccatcgtctccatctccgactcccagggcaacgtgatctcctggcagtccggtggcacggtgggcttcaagggctcccgcaagtccactccgttcgctgctcagattgctgcagaggctgcagcaaaggccgctatggagcacggtctgcacaaggtgaccgtcttcgtgaagggccccggctctggtcgcgagacggcaatccgctcgcttcaggcagcaggcctggaggtttcgggcattcaggacaagacccccattgcgcacaacggttgccgtccgcgcaagcgtcgtcgcaactaaggaaggacagtagctatggcagttgataggacccctgtccttaagagatgccgccagctcggcatcgagcccgctgtgatgggcatcaacaagaagtctaatcgtcagccgaagcagcgccgtcgtcaggaatccgagtacggccagcagctccgcgagaagcagaaggccaagtttatctacggcgtgctcgagaagcagttccgtggatactacgacaaggccaagaagctcgagggcgttacgggcgacaacctcatgatcctgcttgagacccgtctcgacaatgtcgtgttccgtctcggcttcgcccgtacgcgcaaggaggcccgtcagaccgtccgtcacggccacatcaccgtgaacggcaagcgtgtcgacatcccgtcctaccgcgtcaaggccggcgacgtcgtcgctgtcgctccgaaggcaaaggagctcctcccgatcaaggagtccctcatctcctccgagcatatggtcgttccctcctggcttgaggtcgacatcgagaagcttcagggcaccgtgctccagctcccgacgcgcgatcagatcgatcttgacatcgacgcacagctgatcgtcgagctctactccaagtaacaggaacggttggaggtttacatgtccgaattcatccggccgaatgtgtcggtagaagaggtcaacgacagggtcgcacgcgtgaccgccgagccgctcgagcgtggctacggcgatacgcttggcaactccctgcgccgcgtgctgctctcctccctcgagggcgcagccgtcgaggccatccagatcgatggggtgcagcacgagttcacgactgtcgagggcgtctatgaggacgtcaccgatatcgttctgaatgtgaagggccttgtgttccgctccatggacacgggcgacaagggcacggcaaccatctccgtcgacggccccatgaccgtcacgggcggcgacttcaaggttcccgctgagttcgagctcgtcaatcccgaccatgtcatctgcacgctcggcgagggcgcacacctcaccatgcagatgcgcatcgggtgcggccgtggctatgtctccggcgaggacaacgagcgtgacgatgatcctatcggaatcatccacgtcgactcgctctattcgccggtgcgccgctgcgccaaggtcgtcgagccgtgccgtgtcggccagcgtacggactatgaccgtctcatcctcgaggttgagaccgatggctccgtcacgccgcgcgatgctgtcgtcgaggccgcgaacatcatcaaccagcacatgagcgccttcatgggtctggctgaggaggcagagccgcaggaggacacctccatcttcgcagtcaacactgaagacgacaatacggagctcgacaagaagattgaggacatggacctctccgtccgttcctacaattgcctgaagcgtgctggcatccactcggtccgccagctcgtcgagttctccgagaacgatcttctgaacatccgcaacttcggcgtcaagtccatcgaggaagtcaaggacaagctcgagtccatggggctcggactcaagccttaaagacgccgcgtcttcaataggagcaataagaccatgagacacaacaagaagcatggcatgaagctcggaactgatgcgagccataccaaggccatgaagaagagcctcaccagcgctctgcttgccaatgaccgcatcaagaccactcagccgcgtgccaaggccatccgcacggacgttgaccgtgtcatcacctgggccaagaagggcgatctgcactcccgccgtctcgctatcgcgaagctcggcgacaaggagctcgtccgcgaggtcttcgagaagaagcaagatgcaatcgagctcgagggcaaggtcatcgaaccactcccgaatgccatgttcaacgtagagctggagatgagaaggcaagaacatcctgtgcaccatttccggaaagattaggatgaactacatccgcatccttccaggcgacaaggttgtcgtggagatttctccgtacgactgacacgtggcaggatcacctatcgctacaagtaagccggtaattcacgcctgcggctgggcgattacatagtaagggaacaaccgaaaggaattgcaagaaggtacgtccttcggtaaagaagatgtgcgacaagtgcaagatcatccgtcgccatggcaggtttacgtcatctgcgagaaccgcgccacaagcagcgccagggctaagagaggagcaccaaattggccgtattaacggtgtagacctcccgcgcgagaagcgtgtcgagatggactacctatcttatggcattggccgtacgtcgctaccaagatctgcgctgaggtcggcattgaccccgcacgcgttccctatgtccgtttgcgcttctgctctcgctcatgaagaagctctatcggtatgaggatgaccagagggcgcatgtgtggggcgaagaggggaatgtgtcgacgcttgatggtgcctctgtccttgttatgggcgcaggagatattggcgagcacttcgctcggctctgcactgccatgggggctacctgcactgcctataggagccacgtgccagccgagccttcggattcataccgggcagcgtttgcccataccattgcgggcagagatgcactcatggaggcgctgccttcctcccagatcgtggcatcctttctgccaagcacgcctgagacgaagaggctcgccgatgaggagttcctggcggcactcccgaggggcgcctatctcgtgaacgccggcaggggagacctcatcgactatgcagcgctcaaagaagcgcttgagatcggggcgctggcaggtgcagccatcgatgtctcggatcctgagcctctgcctgaagagagtccgctctgggatgcgccgaacctcctcatcacgccgcatgtcgcagggttctggcatctgccgaagacgaggaagctcgtgttctcgcgtgcgaaggagaatcttgcgcactatcttgcaggggagaagcttgtgcatgaggtgaagaggtagatttctgcctccaattatgaattcgctccataagctgcgattcttctggcaaacctcgtgaagaactcgtaagatatcaatttgtgtctctatgtcggggagatttctgtctcggacatgagatgcagctggctcctgggtggaccaggaggcgtgaggacggaaaccccacgctcaaaaccccaagatcgaaggagtaccttcatggcagacaagtatgtgccgcgcctcaaggagaagtactacgcagaggtgcgtgacgctctccagaagcagttcaactaccccaacccgatgatgatcccgaagttcgagaagatcgtcgtcaacatgggcgtcggcgaggctgcaacggacgccaaggcaatcgacggcgctgtcgctgacctccgcgccatcaccggccagcagccgatgatcacgcacgcccgcaagtccatcgctacgttccaccttcgtcagggccaggcaatcggtgccaaggtgaccctgcgcggtgaccgtatgtgggagttcctcgatcgcctgatcgcaacggcaatcccccgcatccgcgacttccgcggcatctccccgaagagcttcgacggccgtggcaacttctccatgggcgtcaccgagcagctcatcttcccggagatcgagttcgacaagatcgaccacacccgcggcatggacatcaccatcgtcacgaccgctgcaaccgacgaggagggcaaggctcttcttgacgcctaccacttcccgttcaaggccgagtagcattttcgttgggcactgagacgtgcccttgagttcagagacgcgccccggataagagccggggctgctcaagttaggaggatctgtggctaagacatcgatgatcgtcaaggcttcgcgtgagccgaagtactctacgcgcactcagaaccgctgccagcgttgtgggcgtccccactccgtgtaccgcaagttcggtctgtgccgtgtgtgccttcgcgagctcgcaagcaagggcgaacttcctggcgtcaccaaggctagctggtaggcgagggaagaccacgacgaggcgctcgggccacgggctcgggtgaaccggccgtgcagtttcatcacgaactaaggagaaggatcaatgaagattaccgatcccatttcggacatgctgacgcgtatccgcaacgccaactcggcaggcaagccgacggttacgatgccgtcgacgaaggtgcttgtcgagattgctcgcgtcatcgccgaagagggctacatcgagggttattccgttgaggacaccaagcctcagaagaccctccatatcacgctgaagtacggcaagcgcaatgcccgcgtcatcaagggcatcaagagcgtttccaagccgggcctgcgcatctactcttccgccaaggatcttccgcgtgtcctgggtggcctcggcactgccgtcatctccacctccaagggcatgatgtgcgaccgcgatgccaggaagctcggcatcggcggcgaagtcatctgcttcgtctggtaagtccgcgacaggaagaagaagggagacacaatgtcccgtatcggcaagaagcctgtcacggttccagcaggtgtcaccgtgaccatcaatggcaacgaagtcaaggtcaagggccccaagggcgagcttgaccgtacgttctccgatctcgtcaccatctctcaggagggcgaggagattcacgtcgtccgcaacgacgagaccaccgagtccaatgcgcagcagggccttacccgcacgctcatccacaacatggtcgtcggcgtgtccgagggcttcgagaagaagctcgagctcaccggcgtcggctatcgtgcacagctcaagggcaaggatctcgacctttccctcggctattcacacccggtcatctatgcgtgtccggagaacatctccttcgaggttcccgacaacacccacatcacggtgaagggcatctccaaggagcaggtcggccaggtcgccgcagaggtccgcgccaagcgtccgcccgagccatacaagggcaagggtatccactacgaaggcgagcacatccgcaggaagctcggcaaggcagccaagtagtgagctaacaagaccattaccccgtcaggtaatggcacgactaaggagcaacaatgaacaagttccagaagaagaaggctggtctcaagcgccgcgaacgtcgtgtccgctccaagatcactggcaccgccgaccgtccccgtctctccgtccatcgcaccaatgcaaacatctatgcacaggtgatcgacgacgtcgacggcaagaccatctgcagcgcttctacgctgagccctgagttccgcgctaccggcaagatcggctccaacaaggaagctgccgagttcgtgggcaacctcattggccagcgcgccctcgagaagggcgtcaccgcagtcaggttcgaccgcggcggccgtatctatcatgggcgcgtccaggctctcgccgatgctgcccgcaacgccggactgaagttctaggaggaatcagatgccacgtgatcgcaagcgccaggaggaatccgatcttcaggagcgcgtcatctttattcaccgcgtgtccaagaccgtcaagggtggccgccgcatgtccctgctcgctctcgtagcagtgggcgacggcaagggcaatgtcggcctcggcatcggcaagtccgccgaggttccccaggccatctccaaggctgtcgtggatgccaagaagaacatgttccacgtccccgtcaccgagacgggcaccatccctcacgatgtcgagggctactatggcgcgggccatgtcctgatcaagcctgctatcgagggtaccggcgtcatcgctggcggccccgtccgtccgctcttcgagcttgcaggcatcaccaacgtcctgtccaagtctctcggcacctccaatgccctgaacatggtcaaggctgccgtcgagggcctcaagcagctcgagatgcctgccgacaccgcagagcgccgcggcatcacggtcgctgagatgtttgccgggaaggagaactaacgatggcagaggagaagactcttaccgtcaagctcgtgcacagctcctacgcctccaagcgcaaggacatgacggccacgtgccatgccatgggccttcgcaagatcggcgacacgtctgtgctgcctgacaacccgagcgttcgtggaatgatcttcaaggtcaagcaccttgttgaggtagaagagaactaggagtcatcacatgcagcttcacgatctccgtcccgcagagggctccaagaagtctcgcaagcgcatcggccgcggcaattcttccggccacggcacgacggcgggacgcggcaccaagggccagctctcccgcgcaggccgcggcaagggcgctggcttcgagggcggccagacgccgctcgccatgcgtctcccgaagctcggcggcttcatcaaccacaaccgtgtcgagtatgcaccggtcaacgttgcacgcctcgacgcactgttcaacgacggcgacaccgtcgactctgactccctgtatgccaagggcgtcatcaagcgcaactacattcctgtcaaggtcctgggcgacggcgagctcaccaagaagctcacggtcaaggtagacaaggtctccaagtctgcacaggccaagatcgaggcagctggcggaaaggtcgaggcagcgtgctaaagggaattgcgaacgcgttccgcgtagcggagctgcgtaacaagatccttatcacgattggcattctcgtgctttatcgcatcggggcctacatccccgtaccgggcatccccttccaggggatgctctccgcttatgaaacggcggcatcgggctccggtgcgctggctgttctcaacctcttctcgggcggtgctctttcccgtgtttccgtcttcagcctgggcatcatgccgtacatcactgctcagatcatcatgcagatgatgcaggctgtcgttccttccctcggcgagatggccaaggaaggcgaggcaggccagcgtaggatcacgcagtacacgcgctatctcacggtcgtgcttgcgctcatcagcgcaatcggctatctgttcctgttccagtccagcctgtatggcataacgttcgccaacgccggcgcgccggtgtggctcatggatgtcatcgtaatcttcacgatggttgcaggcgccctcatcatcatgtggctcggcgaagtcatcacacagcgtggcatcggcaacggcatgtcgctgatcatcttcgccaacatcatggctgggttcccctcggcgctcatcagctccgtgcagaactcgacgacgggcgtcctcaatacggtcatcacgatcatcgtgattctcgctgtcatcccgttcatcgtctacatcgagcgcggacagaggcgcatcacggtccagtatgccaagcgcgtcgtcggccgccgcgtcatgggtggccagtccacgtatctgcctatcaaggtgaatacggcgggcgtcgtgcccatcatcttcgcttccgcaatcctttacctcccggctcagattgccgtgttcttcccgacggtcaactggatgtccgtgttcgcgaatgcggtctcatcgggctggctgaattggatcctctctgtggtcctcatcgtgttctttgcatacttctatacggccatggtcttcaatcctgaagagactgcagaccagctgcgcaagcagggcggcttcattccgggcgtccgtccgggacaggctacggccgactacatcaagaacgtgattgaccacatcacgctgcctggtgccatcttcatggcaatcatcgcagtcgtgccttccatcatctttgcctttacgagcaacactctcatccaggcattcggcggcacgtccatcctcatcatggtcggcgtggcaatggatgccctgtcttcccttgagagccagctcaagatgcacaactacgaaggcttcttcaagtagacctcaataacctacggagcaagggagttcgcatgaagatcgttctgctcggtggtcccggtgccggcaagggcacgcaggcccagcgtcttgttgctgaatacggagtggcgcacatctctacgggcgacctgctccgtgctgccatcaagaacggcacggagctcggcaagcaggccaagtcctacatggacaagggtcagctcgttcccgacgagcttgtcgtcaatctcgtgaaggagcgtctcgccgacgacgatgcccagaagggcttcatcctcgacggcttcccgaggaatacggcccaggctgttgtcctcgattccgagctcaaggacatgggtcttgcactcgatgcagcagtcctcgtcgatgtcgaccctgatgtcatcgtcaagcgtctttcctcccgccgtacctgcaaaaactgcggctatacggcaccggctggcgtcgatgtgtgcccgcgctgcggcggcgagatgtaccagcgcgacgacgacaagcccgagacgatccagcgcaggctcgatgtctaccagacccagacggcaccgctcatcgagtactacaagggccatgggcttctgaagaccgttaacggcgagcaggcagtcgacgacgtctacaaggatatgaaggaacagctcggactatgctgaagatcaagacggcagaagatatagcagcctacaaggcaggggcaggaaagctctccaaggaggtcctgcgccatgtcgggctcatggtgaagacgggcgtcacgacgctcgagcttgaccgcgctgccgagtccttcatccgcgcacacggtggcactcctggcttcaagggctatggaggattcccggctacgctctgcacgtcagtgaacgagcaggtcgtgcacggcatcccgtctcccacgacgcagctgcgcgagggcgacatcatctccatcgataccggagccaatgtggatggctgggccggagacaatgcctggacattctatgtcggcgaggtatctgacgaggtgcgtggcctctgcgaatgcacgcgcgactgcttgaaggctgcaatcaaggaagctgttcctggcaaccatctgggagaccttggccatgcggtgcagacgcttgccgagtccaatggctacggcatcgtccgcgactacgtcggccatggcataggccacgatatgcacgaggacccgaatgtcccgaactatgggaagccgggacgcggcgtcaagctccaggtcggcatgatcatcgcgatcgagccgatgatcacgctcggctctccgcgcgtgaagacgctcaacaacggctggacggttgtcacccgtgacggcaagccggcagcccactacgagaacgtcgtcgcaatcacggaggatggacctgtcatcctttccgaagatgagaccggaccctggtgcgcgatgttcggcggagccgactacgtcgagctcaaggtcgacgagattgccgaatcagatgaagctcccgaagaggagaagaaggaagacgccgaatagcggctccgatgagagcgggaacaagaggcccgagcgcagatgcgcccgggcctttctcccgaaaatttgtcctgcttatggacattgcattgtgctctatgcggagcagatatttttgctatgataatatgccgctgtcactgtggaaacatcgtgcgaggagaaggtagacaggttgagtaagcgagacatgcggcggccacccttgacggtcttggacacgcggtgaataaagatgacgcgctcctgaagatcggattcctcctgggcttgcgatcacgtggcatctgattcctcctagaacttcagtccggcgttgcgggcagcatcggcgagagcctggacgcgccatgatagatacggccgccgcggtcgaacctgactgcggtgacgcccttctcgagggcgcgctggccaatgaggttgcccacgaactcggcagcttccttgttggagccgatcttgccggtacgcggaactcagggctcagcgtagaagcgctgcagatggtcttgccgtcgacgtcgtcgacacctgtgcatagatgtttgcattggtgcgatggacggagagacgggacggtcggcggtgccagtgatcttggagcggacacgacgttcgcggcgcttgagaccaccttcttcttctggaacttgttcattgttgctccttagtctgccattacctgacggggtaatggtcttgttagctcactacttggctgccttgccgagcttcctgcggatgtgctcgccttcgtagtggatacccttgcccttgtatggctcgggcggacgcttggcgcgacctctgcggcgacctggccgactgctccttggagatgcccttcaccgtgatgtgggtgttgtcgggaacctcctcgaaggagatgttctccggacacgcatagatgaccgggtgtgaatagccgaggaaaggtcgagatccttgcccttgagctgtgcacgatagccgacgccggtgagctcgagcttcttctcgaagccctcggacacgccgacgaccatgttgtggatgagcggcggtaaggccctgctgcgcattggactcggtggtctcgtcgttgcggacgacgtgaatctcctcgccctcctgagagatggtgacgagatcggagaacgtacggtcaagctcgcccttggggcccttgaccttgacttcgttgccattgatggtcacggtgacacctgctggaaccgtgacaggcttcttgccgatacgggacattgtgtctcccttcttctcctgtcgcggacttaccagacgaagcagatgacttcgccgccgatgccgagcttcctggcatcgcgggtcgcacatcatgcccttggaggtggagatgacggcagtgccgaggccacccaggaccgcggaagatccttggcggaagagtagatgcgcaggcccggcttggaaacgctcttgatgcccttgatgacgcgggcattgcgcttgccgtacttcagcgtgatatggagggtctctgaggcttggtgtcctcaacggaataaccctcgatgtagcccctctcggcgatgacgcgagcaatctcgacaacaccttcgtcgacggcatcgtaaccgtcggcttgcctgccgagttggcgttgcggataccgtcagcggtccgaaatgggatcggtaatcttcattgatccttctccttagttcgtgatgaaactgcacggccgtgttcaccgagcccgtggcccgagcgcctcgtcgtggtcttccctcccctaccagctagccttggtgacgccaggaagttcgcccttgcttgcgagctcgcgaaggcacacacggcacagaccgaacttgcggtacacggagtggggacgcccacaacgctggcagcggttctgagtgcgcgtagagtacttcggctcacgcgaagccttgacgatcatcgatgtcttagccacagatcctccaacttgagcaccccggctttatccggggcgcgtctctgaactcaagggcacatctcagtgcccaacgaaaatgctactcggccttgaacgggaagtggtaggcgtcgagaagagccttgccctcctcgtcggtttcagcggtcgtgacgatggtgatgtccatgccgcgggtgtgatcgatcttgtcgaactcgatctccgggaagatgagctgctcggtgacgcccatggagaagttgccacggccgtcgaagctcttcggggagatgccgcggagtcgcggatgcgggggattgccgttgcgatcaggcgatcgaggaactccccatacggtcgccgcgcagggtcaccttggccaccgattgcctggccctggcgaaggtggaacgtagcgatggacttgcgggcgtgcgtaatcatcggctgctggccggtgatggcgcggaggtcagcgacagcgccgtcgattgccttggcgtccgttgcagcctcgccgacgcccatgttgacgacgatcttctcgaacttcggggatcatcatcgggttggggtagttgaactgcttctggagagcgtcaccacctctgcgtagtacttctccttgaggcgcgcacatactttctgccatgaaggtactccttcgatcttggggttttgagcgtggggtttccgtcctcacgcctcctggtccacccaggagccagctgcatctcatgtccgagacagaaatccccccgacatagagacacaaattgatatcttacgagttcttcacgaggtttgccagaagaatcgcagcttatggagcgaatccatatggaggcagaagtctacctcttcacctcatgcacaagcttctcccctgcaagatagtgcgccagattctccttcgcacgcaggaacacgagctctcctcgtcttcggcagatgccagaaccctgcgacatgcggtgtgatgaggaggttcggcacatcccagagcggactcccatcaggcagaggctcggatccgagacatcgatggccgcacctgccagcgccccgatctcaagcgctctttgagcgctgcatagtcgatgaggtctcccctgccggcattcacgagatagcgcccctcgggagtgccgccaggtactcctcatcgacagccttttcgtctcaggcgtgcttggcagaaaggatgccacgacctgggaggaaggcagtgcctccatgagtgcatctctgcccgctatggtatgggcaaacgcggcccggtacgaatccgaaagctcggttggcacgtggctcctgtaggcagtgcaggtagccccatggcagtgcagagccgagcgaagtgctcgccaatatctcctgcacccataacaaggacagagggcaccatcaagcgtcgacacattcccctcttcgccccacacatgcgccctctggtcacctcataccgatagagctctttcatgagcgagagcagaagcgcaaagattgctcggccactgcagggccgtagcagcccaccgagttcgagatgcgcacatcctcccccagcacgcctgtcttcacgtaggcatcggcaccggcacttccgagctggatccacttggacgtgctgcgcccaaaagacgcgctgcgggcacattgccgatgatgatgtccgcagcggcaatctcctcatccgtgagctcgaattcaggcgtcgttgcaatgcctcagatctttgaccagcgccttgaacatgaaggtggcctgaggtgctgtctctttgagctcttgtgcttcctcttcgcttactggcagcacgaccaggatacgcatttcggacataggtggccctttctctcgatgaatccactcagcgccgcctgagccctctgcctataagaaaagcgccccgaaccgtatggctcggagcgcttgggcgtgctctggaagcaggcttagaactgtgcgccgcacttcttgcagacgcgaaccttcttgccctcgtcgtttcttggcatggccaacgcgggtcggcttgccgcaggacgggcagataagcatgacgttggaaacgtcgatctttgcctcgcgggtcacgaagccgccgttctggccctgagcgtcaggacgctgagccttcttgacgagagcgacgccctcgacgacgaccttgcggtcagaggggaacgcgcgcaggacttcgccctgcttgccgcggtccttgccagagatgatctggacctgatcgcccttcttcacttaatctttcgggccggtttgcgcgtggctgctccgcgatcgcagttacatgaagatcgctcgctcgcacctgagacgctgtaaggagacgattagtcattgcaaagatgaatgtgaagaagggcgatcaggtccagatccatctctggcaaggaaccgcggcaagcagggcgatcctggcgcgtttcccctctgaccgcaggtcgtcgtcgaagggcgtcgctctcgtcaagaaggcccgcgtgccctgacgctcaggccagaacggcggcttcgtgaccctcgcacaagatcgacgtttccaacgtcatgcttatcttgcccgtcctgcggcaagccgacccggttggccatgccaagaacgacgagggcaagaaggttcgcgtctgcaagaagtgcggcgcacagttctaagcctgccttccagagcacgcccaagtcgctccgagcctacggttcggggcgcttttcttataggcaggggctcagcggcgctagagtggattcatcgagagaaaggtccacctatgtccgatatcgtatcctggtcgtgctgccagtagcgaagaggaaccagagctcaaagagacagccctaggccaccttcatgttcaaggcgctggtcaagatcccgagcgcattgcaacgacgcctgaattcgagctcacgatgaggagattgccgctgcggacatcatcatcggcaatgtgcccgcagcgcgtcttttgggcgcagcacgtctcaagtggatccagctcgaagttgccggtgccgagctacgtgaagacaggcgtgctgggggaggatgtgcgcatctcgaacctcggtgggctgctacgccctgcaagtggccgagc

SEQ ID NO: 67 - DNA, 10465 bp, Unknown
  Metagenome-assembled genome
attcgatggtgcgggcgaaaggacttgaaccttcatgagggaaccctcatacggacctgaaccgtacgcgtctgccaattccgccacgcccgcgtgctgtgcaataatacatccaagcaggcagacgatgcaagacggaagttcatctgttttttatggaggggagcgtctgcacccctttccgagccggggcttccgctctatattcgcctccacacggtatcaatgcactcgaaacgaaaaggtagagccgtgccgctgacagatcagacacccgagccccctgaggggacttctgcatactctcagccaaagcctgagccagcgctgcttctgggccgctaccgcattgtcgagcagtgcggcacgggcggcttcggccgcgtgcttgtatgctgggatacgcgcctgcagcgccgcgttgccatcaaggtcatccccttgcgcatgggagtcgacgaggcaagcgccgagacgacgatgaaggaagcgcttgccgaggctcgcacttcgagcctgcttgcacatccgaacatcgtgaccgtctatgacttcgaaagcgacggccactacgcctatcttgtcatggaatacgtcgacggcctcaatctcgcacagctcctgaagcgtgtcgagggagggaccctcacctacgaggagtgcgcacatctcctccagtccgttgcctcggctctcgagtttgcccacgagaacggggtcctgcacctcgatatcaagccttcgaacatcatgatcgacagaagaggccaagtgaagcttgcagacttcggcatgtccacgcttgcctctgctgcaggctggggaggcgcccgtggcggcaccgtcggcttcatgccgcccgagcagatccagggcatgctcgtggacgagaggaccgatatcttctctctcggtgtcgtcatctggcttgcgctctgcggcgagaacccgtttcaggcagccacccccgaagagtcgctcaagaagatcttccgcggagctgccccgtcgctcaccgagaaccatctcgagctcgaccagaacatagagcttgtgcttgaacgcacgctcgagcccgaccccacaaaccgccttgcctcggcagagctcctctcgaagaggctcgtgccgctcctcggcagcccgaaggaagggcaggagtctcttgccgccctggtccagcaggcagaggacggcaccgaagacgaagagacctggaccgagcgctacgtcgagaagacgcccgcacgcgagcgcttcccctggctcgaaggggcgcttgtgcgcacagtgacagccctcctcgcaggagcggtcctctggcgcatcctcccctgggtcgtgcccgcagataccggcacgctcgttctgctggcgctggccggggcaggagctggagccgtgtggccgcctttagggagcctcgctgtgcttggcgccttcgtcctggcacttgcagaggctggcacaggcgggccttccatgctggtggcgcttggcactgctgccatcggctttgcgtggtggtgggcagcaggcaggaagcagaagctcgcaggcgcctcgctccttctggctcccgccttggggatcggcttcggctcttcggcccttgcaggctttgcgctgtcgcctggtgcagcagccataacagcagcgcttgcaggcctcttcgagcgcttccttcttgccgccatcgccacaggctttgcgccggaggcgctgctttcccgtgctggcgcctggctggcgctcccctcgtcctggatccttgtcttcagctggggcacagccgcttcagccgcgagcctttgtgcaaagagcggaaggcggggccttgaaatcttcgggcagtgcctctgcgctgggcttctcgttttctttcaggctctctctgtgcgggtggagaatagcggcatatgggctgctccggatatgactgccatcctcattgcgatattcttgagtgttgttatgtgcataatttcggtcctcatggggcctgaagcatatggaccagaagggtagcaagccatgaacttcctgaacatctttgaagagcgtgtgagcgcgattttcgatgccactcctcagggctatacggcccccttctccttcaagaagctcgcgaagcatgcagcccgcgagatggaagacgagacgttcctcttcaatggcgcgaacaccgctcctgccctctatacgattctcgtatcctccgaggatgacgcggtcatgcgtccgctctatgcgaacctgaccgaggagatctcccagttcatcgagggccaggcaaacaagaagggctatgtcttcgtcggcaagccccttgtccgcttcatggtcgacccctccctcaagagcggcaagttctccgtcttcgccgagaacgtcgatgcccgcacgctcatgcgcctgcgcgaggaggagtctgccttcatcggcggcatcgcacgtgttggcggcgcccatcccgcccccatcgcagaggcgcctcaggcatcggttgccccgggcgcttcccaggcagaccgcaggaaggccgtgaagagcaggccacgcatggcaacaccgctcgcaacgccggcatctgccatctcccctgacgattcctcgatgcagggcctcgacgtgatgcccgtctcctccgatctcgacctttccgcctctgctgctcctgcccccatcatgcaggagccgttccccgaggcaaggcgcattccgccccagatgcccgcatctgccgcacacgtcgctgcttccgcaccgcgcagggcagcatctgctgcagcggcaagcgctgcagccgcagcccctgctgtggatgagccgaagacgatgctccgtccgcaggtcgctgcaacgccgctcgtgaatgcccgcgccgcagctcctgtcacggtgcagccgcctgcaccgacgcagccaagctgcaccctcatcgacacccagagcggcaggacctataccgcctatgcacctgagtgcccgatcggccgcgagcgcaactccggcggcatcgttctcagggacccgaatgtctcccgccaccacgcccgcctctcgtatgacggaacgcagtggcacatcaccgatctcaactcgacaaacggcacgctcgtgaacgatatggatatccagacgtgcgcgctccataccggcgatgtcataaccatcggccttgtgaatctcacgttcagggagggctagatgatcgacctcatcctgttcttcgggcgcatcctgctggtggtgcttctgtacctgttcctgttcgcagccatgcgctcgggcatcggcctcgtacgcggccagcgcaccgacgcagccatctggagcgtcgacgtggagaagggagccaagagcctgcgcggcctttccgtcgatatcctgggaccggtcgtcgtcggccgctccccttcctccgatatcgtgatcgacgagcccttcgtctcctccacgcatgcccgcttctccctccagggaccggcactcgtgctcgaggaccttggctcgacgaacggcaccctcgtcaatggcaagctcatagaccagccggtcaccctgcgcgacggggatgaggtgcagatcggcgatacgatcctcaaggtcggacgtcgatgaggcttcctttctcgaaaaagcagcaggcagacaccggcgaggagcgcaggccggagccagcgcctgcaccaggacatgagtctttgcctgtcaaggacaggatggatgccgatgtggtcacaggccacagcgctcatctctcctggggctcccgctccgatgtgggccttgtccgcggccacaacgaggattccttcctcgtgcaggacccggtctttgccgtctgcgacggcgtcggcggccatgccgcaggcgaggtcgcctcggccatagcagtccgcacgatctcgcagcttgcccccgataccgcagacgatgcacgtctcggtgctgccatcgaggaggcaaactctgccatcatctctgctgcccagtcgggacagggcagggacggcatgggctgcacggcttccgctgtcgtgatcgacggcagccgcatggccgtggcgcatgtcggcgactcccgtgtctatctcctgagcggcggcgtccttgtgcgcatcacgcacgaccacagctatgtggaggagcttgtcgatgccggagagatcacggcagacgaggcaagggtccatccttcccgctccatcatcacacgtgccctcggctcggaccccgacatgtatgcagaccacttcacgctcgatgtccatgcgggagaccgcatcatcatctgctccgatggcctctcatccatggtgcccgatgccaagatcgaatctgttgccatctcctgcgcaacgccgcaggcagcagccgacacccttgtctctgcagccctcgaaggcggtggccacgacaacgtcacggtcatcgttgtcgatgtggaggacgacgggacagcggcacgccatgccaagatcaggaagcgccaggcgctcgtctgggtcatcgtgcttgccatcctcttcggccttggcgccttcatcggcgtgaacatcgtcgactcttcgtggtatctcggcaacaacggcgggactgtcggcatctaccagggcatcgatgcccagatactgaacgtgccgctgtcgcatctcgtcgagacgacctcggtcgaggtcgatgacctcccccaggctgtccagtcccagcttgctcagggcggcattcgcatggagtccgaggagcaggccctctctgccgttaattcctaccacgagcagatcgacgcagagaagacaagcgctgcagccgtcgcctccgacgtgaagtcctcgacgaccgacacaacgcaggagagcacgtctgctgacacgaacgcatcccaggacacatccacgacagacacggcacagagcagcacacaggaagggcagggtgagtagccatggcataccagaggagcaaacagggcggcagccgccgcacgaccgagctgcttcttctcatcgcagctgcgataccggtcaccctcatctatgcgatgtatgtcatgaacacgggaaccgagctcacggcaagctcgctctccatccccatcggcctctttgctgcctttgccgtcgctcatatcgctgtgaggaagctcgctccaggcgcagacccggtgatcctgccgatcgtcttcctgctttcgggcataggcataacgttcgtgcagcgcttggcgcctgatgcagcgacaggacaggtcgtctggctcttcctctccgtcatcgccatgatcttggtcctcttcttcgtgaagggcatcgacgatctggctcaatacaagttcaccttcggcatcgcaggcgtcgtcctgctgctcctgcccatggtcatcggcacggagcactatggatccaagctctggatcgaattcggcggcttctcgttccagccgggcgagatcgcaaaggtcctgcttgtcatcttccttgcctgctacctggcagagaacagggagcttctctccgcctccacgcgcaagctcggacctctggccctcccccagccaaggatgcttgccccggtctttgcgatgtggggactcagccttcttgtcgtcatcttcgagcgcgacctcggcagcgcccttctcttcttcgtgatctttgtcgtcatgctctatgtggcgacaggacgcctctccttcgtcctcatctcgttcgtgctgctcgcaatcggcgcggtcttttgctaccacttcttcgaccatgtccagatccgtgtcgccatctggctcgacccctggtcggatgcgcagggcacgggctaccagatcgtgcagtcgctctactcgcttgctgacggcggtctggtgggcaccggcatcggccgcggtcttgccgactacgtgcctatcgtcgagtccgacttcatcttctctgccatcggcgaggagatgggcctgcttggtgcttccgccatcctcatctccttcatgctccttgcagtccgcggctatgccacggcagcacgtgcaaagtccgatgtcgcaggattcatggcagtcggccttacgacggccatctcgttccaggcattcctgatcgtcgcaggcgtcacgaagttcctgcccatgacgggcgtgacgctgccgttcatgagccagggcggctcttccctcctctccagcttcatcgctgtcggccttcttctcaagtgcggtgacgaggcgacaggacgcgagcaggagatgacatcgctcacgacgtcccagacgcctgtcgtcgaaggcaatgcggcacatgcctctgccgtcgtgcagggcagccatgcccgtggccgcttcaagctccagacggctgagtccggcgtcctcggacgtgttgccctcggcaagcgcctcacagcgctcatcacggtcttcacgctcctctttgccgccctgatcggcaacctcacctatatccaggtcgtcaaggcagagaccatccagtcgatgccttcgaacaaccacacgatcgcaaagagctcacacgtgcagcgcggagcgatcatgacaagcgacggcgtgaccttggccgaaagcatccagcagtccgacggcgcctatgtccgcacctatccgaacggcaacctcgcaatccacacggtcggctacctctcgacgcagtatggctcgaccggcatcgaatcctcgatgaacgagacgctcacaggccacaaggactactcgacctggcagtctgccctctactccctggcaggcgtctcgcaggcagggtcctcggtcgtccttactatcaactcgcagatgcaggagatctgcgaggaggcgcttgacggctggaccggcgcagtcgtgctcctcgatccttcgaccggcaaggtcctggcatcggcctcctccccgacctatacctacgacgaggtcggcgaccagctgagctctggcggaagcgccctcgtgaaccgcgtgacgaactcgctctatgcaccaggctcgaccttcaaggtcgtgacactctcggctgcactcgatacgggcgcctattcgctcactgacatgatcgatgctgagtcctcgatcgatatcggcggcgcggcggtcacgaacttcaacaacaacaattacggcacgatcacgctgaagcgcgctctgtcgatgtcttcgaacgttgccttcggccaggtcggcgccaatgtcggctctgcgaacctcgtgagctatgcgaacgccttcggctacagcacgcagatcggccaggacttctataccgtcgcctccctcatgcccgacccgagcgagatgacggaatgggagacggcatgggcagcctgcggccagcctgtcggcgaacacgcaagcccggcaggaccccagaccacggtcatgcagaacgctgtcgtcgcagccaccatcgctaacggcggcgtcgcgatgaacccctacatcgtcgatcacgtcctctctcctgagggcgtcaccacgacgacgacccagccgcgctcgctcggccagcccatctcctctacgacggcatccgaagtcgcagaagcgatgctcggcgtcgtggatgacggctacaccgcggcaggtgcccgcgtctccggcgtcaaggttgccggcaagaccggaacggccgaggtcggcggcaatgtctacaattcgctcttcatcggctttgctccctacgactctccgacgctggcgatctccatctgcctcgaaggagacggctcgaacatcgagggctctgcagccaagatggcaggttccatcatcaggcagtgcctccaggtccaggcagaagggagcgcatcatgaggaagctggcctgtgccttcccccgatgcttccggggccgaggcgcgataaccgggagcctttcccgatccggtccgcaggaagaggcgcatcttcctgcatccggcactgacagaatcaccgctcgaagcatttaggggtcatatatggcaaacagagttctcggtggccgctatgcggtccaagacaagatcggcacaggcggaatggcgacagtgtaccgcggccttgaccaggtcctcggccgtactgtcgctatcaagaccatgctgccccagtacgcagcagacccgtcgtttgctgcccgcttcaagcaggaggcacaggcagcggcagcgctccagagcccctatatcgtctcggtctatgactggggcaaggacggggacacctattacatcatcatggagtacctgcgcggcacggacctgaagaacggcatcaggaagcacggggcgctggactgccgcaaggtcgcacagatcggctcccagattgcccaggcgctctccgtcgcccataagcacgacatcatccaccgcgacatcaagccgcagaacatcatggtccagcctgatggcaacatcaaggtcatggacttcggcatcgcccgcgccaagaacagccatctcacgactgacaactcggttctgggaacggcccactatgtctctcccgagcagacgcagggcaaggagctcgggcccacctccgacctctattccctcggcatcgtcatgtacgaggcagcaacaggacgtgtccccttcgacggcgatgacgcaatctctgtcgctatcaagcaggtgaaggagcagccgactccgcccagccagatcaacccgaacgtcgatcccgcccttgaggccatcatcctgaagtgcatgcagaaggacccgaaggaccgtttccagacagctgacgagctcttccacacgctcagggactacctcgcaggcaggcttggcgctgtctccgaggcaacctctgtcatcggcggcacccagacgaggaacatgggcaggaacaacgccggcaggacccagcagatgggccgtgccgtcgctccgatctctgctgtccctggcggcacgacccgcttccgccagcagtctgcaagggccgaagccgcagagcaggagaagaagcgctcgaagcacaagcgcaatgtcgctatcggcatcattgtcgcaatcctcgctgtggcaatcgctgcctatgaagaaaaaagaaaggaagagaagtaaggctctcgccacacagcaacggctgtttggtatagatagctatctgcgctagggccctcatagctcaggggatagagcacaggttcctaaacctggtggcgtaggttcgaatcctactgggggcaccagcaccaatcgcccgtatctgcagcaatgcggtacgggctttttcatgaccagaaggcagctgcatacgatggcagccctgcagacagagcccgctttcttcttcatgcgccccagggaatctgtgccgccagtaaaaccgggctcatgcactcgcgtgccccaagggtctgtgctccgaaaggtgcaccacgcctggccgagccgtccgtcctggatgggcacgctgcttaaaggaagagcgggtttaaagcgctcctttctaaaagggcgattcccactgcctttctgtgttttgggtgtttgaagaactatgcagcttcgtgcccttatctcagaagcccccgtcccaagcggaatgaaaaaaaagaggcagaccttttggatctgcctcccaggaaagcggcgtgccttccgctctactgcccgtgccgctgctgtgcgatgaagtgccgcagtagagccgtcgtatccgattcggcagtcggagagctgagctgcggtgttcgaggagctgctggagcctagttgctgccatggcggcgctgctggtgttcgtgctgttcgaagagctgttggaggagttcgaggaattggaggtcgtggagctctccgccggcgctggcttcgggccaagagagagcgtgatctggacgcttgagcccttctcgagggagcggaggtcgggtactggcggatgacggaaccggctgcgaccgtgccgagtatcggacgtcgtgcgcacgaccgtgaatccagcagactcgatctcctgaacggcatcggattcggtcatgccgacaacattcgggacggggaggtctggaggtccgagggagaggtgtgattactgtgtctcctgcttggccgtggagcggctgccggtcctgggatgcgacatggcccacatcgacagagctcgagtagacagagtcgcctgcctgggctacaagacccagagcagagcatttggcgcttgcttccttcggcgtgcagttcgagaggtcgggcacctcgacggttgcggcaggctccgagcccttcgagacctggactgtgatggtcgtgccttcagaggcgctccttcctgcatcgggatcctgatcgatgaccttgccctcttcgacggagtcagagtagtcataggtgacagatatcgtgaagaagccatcgtatttgtctattgcagagcgcgcttcggtctctgataggcgcgacgaggttcgggacatccttcgtctgcacggtctggctgccgagataggtgacggca

SEQ ID NO: 68 - DNA, 37159 bp, Unknown
  Metagenome-assembled genome
agatgctctccgggcaggcggcccaggggcgctacaggctcaccagggccgaggccgtctccaggccgcagccgctctggagctggtgggagggtgccgacgtgtcaacggaggtctaacataggcttacaaaatggtgaagcggctatcctctgcttccatctcttgcgtccgtgtgatggaggaagtccgtggcagagcggaaggtataggcggggccgcaggtgatgagacggtgccaggcttccgagatgagctcggggatgtaggcagcgttcgagatgccttcgtcggaaagccccagaacgcggcagaagaggcgcttggcggaaggggagatgtgcctgtcgccgagcgctatggcagggtcgagcctcaggaaggagcgcagcagcgcatcctcgacgccgggatagtccatgcccacagcttcgacggtgatgccggcataggtgaggcagcgcttcgtctgggcaaagagcacagattcatcttcgatatcgagacggtcgatgatgtcttccatatcgttccagcgctccatgagaaggagcggatgcttctttgcgaaggcgaggctctcgttcgtcgtgtcctcgcggtagcagtagtagcacctgtcgatatacgcgatgctcggcgtctggcagagcgtctcgatcaggaaggggttgtctgcccagccggcacccggtatctccatgaaccgaatccgcttctcgtcgagccattccttccggtagagcgcagaccagatggcagggtggtggagcagaagctccggtgcctctgcgatagcgaagggctgatgcctgggatgcacgcgtcccttgtaggcgcagggcaccttcatcgtgtgttcggggtcttggtcgaagacgcgccagtaggctgacttgatcacatcgacgtggctctcgagggtgtctgcaagggcaagaaggtctgcaaagaacgcaggctcgatccaatcgtcgggctcgacgattgcgatgtagtcgccttcggccatatcgatgccgcggttgcatgttgcgccgtagccttcattctgcttgtctatgaccctgatccgggggtctcttgctgcatgggcctgcatgacggcgagagtgccatcggtcgagccgtcattcagcgccaggatctcgatgtcgggataggtctggcgctcgatcgaggagagtgccgcatcaagcgtgcgctcgacattcatgctcggcacgatgacagaaaccttgtgatgcatgcatcctcctcaagaaggcgacagatgcactcatgatacgccttgcacatgcaggcttatggatgctcagctcccagagggcaggccttcttcctgaatgcagctccggcgtataatgggctgacagatgacaggagctgaggagttgggtatctgcatggagcgccttgcaatggtgatcgtcacatacaagcgtcaggagctgctcgagcggctctttgcctccatcctgaagctcaccgaagccccctggcgcatcgtcgtcgtggacaatgagaactcggaacgcacctctggcatcgtgaagcagttcgggcaggagtgcacggagctctggggtacgacagagcctgatgaagagggtggcacggcgcgtgtcgtctacttcccgcagacagagaacatcggcggttcgggtggcttctcccgcggtgtcggcaaggcctatgccttaggcgcttcctggttctgggtcatggacgacgatgtgagcgtccttcccgatgcggtgacagccctgggcaaatggtccaagcgctttggcgccatccagggacagcgctacgatgcagacggcggccacttctactggcagtaccgcttcaataccgctcttgctatctacaaccccttctctccttcaggctggaagccgggagaggagtacaaggagtgcaatgcgctctgcttcgagggaggctgcttcagccgtgaggtcgtctcaaagatcggccttccggatgagcgcttcttcatctatctcgacgatgcgctctatggttacctcgcaagcaaggtgacgaccgtggccttggtgccggactacgtcgtgaagcgcgagcgcgaggtgcagaaccagagcatcggatccgtccgccagctcaactcgacaagcgacatgacgcgctactacatcacgaggaataggggctatcttgcccgctacttccagctctatggggactacagccccgtgggctatgcattgggcacgctcctcaactttgcaaaggagctcatccgcctgggacttgtggacagaggccacttctcctcgagctgggcgaggctctgggctggctacaaggattccaagacgattctgcatgacaaggactggaagccaatgccgcctctggcatagcctgaaacgggctctcagaagctctgggagctatttctgttccttctctgcctgtgccgtctttctcatccaggcaaagatgtactgctgctgtattccgccgtatgcggggtcccattcgatgctgtagcgctcctctgccttcttgatccaggtatccctcggcaccgcttcgaggtatcccagcccatagaggcagatgcagcttgcgaccttggggccgatgccggggatgctctcgagctcagccatctcatcctcgagcgtggcgctcgaatcgtcgagacagacggggcgccaatggatggacgcacgcgtcagcgcttcgagataggggagacggtagccgagcttcaggcccttcgcataggattcgtcggccagaatcttcgcaagctggcggggacgcggaatcgtgccatgcgctgcgtccatgagcatgtccaccgcatgctggatgcgtgggatgctcgagttctgggagatcatgaacgagaccgcggtatcccaccagtcctgggaaagcacgcggatgcctgagcagaggctcagctgctcatctgtgagcggaaggctctggaggattgctccatagtcttggtcgagcgcaaggtagtgcttccagtatgcaagcgcggatggcgcggggttcgcgcctgaaggcgtgagaatcgtgaacatcgatcccttctgcgaggcaatgcagcgcttcgtgccggaggagatgagatagcgggcatctgtgcgcccacgctcaagctcatgccaggtgaagacctggcccgatgctgcaatctccctgagcgagagattgtctgtcacaaacgtagccacgctggcctcctttgcatctgctccatcttctgccaagagattcccgtgcgcaatgggcgaggatgcgtgcgcgcctgtctgctctgagttgctgcaagatgggtcttttccctatgcttgtcctcaagaaaggagctttccatggatgctatcagggatacggccattgcccgcgaccttatgggtcgcctcatcgtgcctgaggcaaagtttgcccgctatcgcctccgcgagtatgaggatggaaggatcctgctcgagccgctcgacccgagcgagaaggtggaggcagaagagcgggccggcatgcgtgcagccttgggcaggctcggcctcggcaccgcctcggtgccctctgcgggcgcggaaggggcagcagctgccggcacgcagtaagagaaaaggaggccgcccgaaggcggcctccctgaggtgctttttgcttgtgcgtctgccttactcggcaagcggtgcaagcttcttcgtgatgtcagctgctgcagacttgccggcacccatagcaaggatgacggtagcagcgccggtcacgatgtcgccgccagcccagatgcgaggatcggacgtctggcccgtagcctcgtcggcgacgatgtagccccacttgttgatcttctcggggccgatgagcttggcgatcgggtttgcgttcgtgccgatggcagagatgcccagatcgcacggcagctcgtcgatggagccctcgatggggacaggacggcgcctgccggaagcatcgggctcgccgagcttcatgttctggaccttgacggcgcacacagcgccatcctcgccggcgatgaactcgataggagaggcgagctcgtggatcttgacgccctcggcctttgcatgctcgacctcagcgcgacgggcaggcatctcagcctcggtacggcggtagcagagcgtgaccgtctcggcgcccagacgcagtgccgtacggacggagtccattgcgacattgccgccgccgaagacgacgacgttctttgcgcgcttggtcggcgtgtcgtactcggggaagcggttggccttcatgaggttgacacgcgtgaggtactcgttcgcgaagaagacgttcggcaggttctcgcccgggatgttgagcatcttcggcaggcctgcgcccgtcgcgatgtagagggcgtcgaagccctgtgcgaagagctcgtcagcatcggtgatgcggccgacgacagcgttgtactcgaacttgacgccgagcttctcgaggccgtcaatctcgcgcttcacgactgccttgggcagacggaactcagggatgccgtaggcaaggacgccgccgcccgtgaagaaggcctcgaagacggtgacatcgaagccgttgcgggcaagctcgcctgcgcaggtgatgccggaaggaccagcaccgatgacagcgaccttcttgccgttcttcggagccatcttcggctcggaagcgagctcaggctggtcgcccaggaagcgctcgagctggccgatagcgacaggctcgcccttcttgccacggatgcacttgccctcgcactggttctcctgcgggcagacgcggccgcagatggcggggagcatggactgctcgtggatgatgtcgaggccacggccgaactcctcgttgcggatggcttcgatgaaggcagggatgttgatgttgaccgggcagccatcgacgcagaacggcttcttgcagtcgaggcagcggtttgcctcggcgagagccatctccttcgtgaagcccttgtcgacaggacggaagtcctttgcgcgctcgacggggtcctcctcgttggcaggcgtgcgcggagacttcatatcagggatatagcggccatttacctgtggcatgcgcagatcgcctcctcataggcgtgaagtgcctggccttcctcggtacggtatgcagcctggcgtgcgcgcaggtcgttccagttgaccttggaggcatcgaaatcgggaccgtcgacgcaggcgaacttcgtctcgccgccgacctcgacacggcagcagccgcacatgccggtgccgtcgaccatgatcgggttcagcgatgcggtgatcgggcagtcatgcttcacagccgtgagcgttgcgaacttcatcatcggcacaggaccgacgcagaagatgtggtcgatctggccagcctcgagcaggcgctcctccggtgccgtgacgacacccttctcgccgtaggagccgtcatccgtcgtgatgtggatgtggtcatccggcaggatggagcggaactggtcctcgagcaggagcaggtccttcgtgcgggcacccatgattgcatggacgtccttgccctccttgacgagcttgcgggcaatcgggaatgcgatagcgaggccaacgcctccgccgatgacaccccatttgccatcggcgaactcgctcggctggccgagcggacccgtgacatcctccagcgaatctccagcctcataggtggagagcatcttcgtggtcttgccgaccaccatgaagatgaactcgacccagccctcttcggggttccagtccgcgaacgtgaacgggacacgctcgcccgtctcgttggcgcgcaccatcaggaactggccagcatgtgcatgctttgccatctgcggtgcctcgatgcggaacttgaacaccttctcggagaactgcgtcttttcgaggatcttgtacattgatgaactcctctccaaaaacgtccataggatggtctgggcctcttcccttgggccgtcccatcaattcaccaacatgcccattgtagcggtcagataagcatgtcttctgcatgatttgcagcaatcggtgccatatatgcagagcatggcatcaatcctgggcacttcatccaagccgtgcggactctgctgcaaagcccttctggatcacgcgctcaacgacgtctgcggcgtcctgtgcctcgatctcgaacgactcgagctgggtgcccttcaaggggcgcagcgcatactgcgcgacgctcatgcgtccgggaggcctgcccacgccgaagcgcagacggcagaagtcgcggcttcccatcttctggatgatggagcgcaggccgttgtgcccgtcgtggccgccgccgaacttgagaacgagcttcgtgtccggcacatcgacatcgtcgtgcacgacaaggagctcctccggtgcgatcttgagctgtctcacgagcttcgagataggtcctccgacctcgttcatgaaagtctggggacgcgcaaggaagacgtccttcccggcaatcttcgtctctgccaccatcatgcctgcctggctcttccagtagcgtgttcccgcatgttctgcgagcacatcgatcgtggcatagccggcgttatggcgggtcttctcgtattcggcgcccgggtttccgaggccgacgacgagacgtatgtctttgggttctggcatggcaacctttcctgtgggtctggggccatcatctcaagcatatccctgcagcgggagggaggaagaggagcaagtgccttcccactttctcctgcagaagataaaggcatcagaggccatattctggaaggaagcttgtccagccgtcctcccaggcgaagcgccctcctgccgctgcggctccgatctcgaagtggagacggacgatgccgaggtccacggcagagaagggccctcccttcgagcgcagggagacgagaggcaggccgtccggactgctcttctcgcaccagccgatggcaaggctctggatgtcgaattcaaagataccgtctggcagcgctggttgcatcgttcagaaggaacttccatagcaaaatgccaggagagctcgaggctttcctggcgctgaagacggtggagggatacgctgccattgactggcagctgcccgtgacgttctctaggccctgccaactgcctgcctgacatgaccatgcgctttgctgagcgccgatcctgcctcttcagcgctacagcccagaagaagcatgacgattgcgagcttgacgctgccgcctgcgctgccgagtgccttttctgcctgctcgcggctgcagccgcatgcttccataacgatgttctgggcacgggtgacaagcttctcgttgctctgcttcacgtcgaccataaggttttcatagaccttgccgatgccggtcatggcaccagtggaaatcatgttcaggatgagcttctgagcggttccggccttgagccttgtggatcctgaaagcacctccggaccggttgcgggctcgattgcaaggtcggcgacagcgccgatctcagatcccctgttgcaggcaatggctaccgtgcgggagccgacagatgaggcatagcgtagtccgccgagaacatagggggtacgtcctgaggcggctaagccgataacgaggtcatctttgacaagactgtgggcccgcaggtcttcctcgcctccttcggcgcggtcttctgctccttcctcggccttcacaaaggcgtgatcgcctccggctatcagccccacgaccgtgtcgtaggagacgccgaaagtcggtggacattcgacagcgtcgaggacaccaagcctgccgctcgttcctgcccccagatagataatcctgcctccacaggatagggcgtctgctgcccatgaaatggcggttgccacttgaggcagaactgcacgcactgcctcgactgcatgctggtcctctcggttcatggattctgcaatctggagcggcgtgaacgtgtcaagattcatcgtcgccggattcctctgttcagtcgcaagcttggtgaggtcaatcattgctggggctccctgtctttcatgccaggccgcaagatatgggaaatcatttctctgcaagcctctgatagagttcgatgatctgctggatgagctcgacagcgagaatcgaagtcatgagatggtcctgagcatgcaccagcagcacatcgacagcggtatgcttgccctgcgcttctttggtaaggagttcagtctggatgttatgggcctgcagctgtgcctcctcggctgtcttcatcagctctgcggcctcatcgaattttcctgccttggccttctccaatgcatcataggctgcgcttctcgcctggccggagtaggcaatgagcccaaacgtaatctcttccgccgaattatccattgatgcctcccatgcattcggtttcaggttcttcacgagacacagaataatcagcttgcatggcggcttcaaattgtcccggaacgggtttgagccatttgcacgcatgtctccgcatgccttcgaagaacgggggacaggcatgccctgccgcagctgaagaaccaagaaactgcagttcatgagggtagattgcaggaaactatggacttcgtttccagcgatatcttttccagcgagtcgtgatggcagtgaaataaaacatggcagacgtccaccgtttgtgacgctgtagcaaccgtctggaatcaaaaaacgccaataactgaaataaaatttcgtaatatgcgataatgcatgacataagaattccataccggtacaactatgggcgaaggagaggcatatggagcctaaaagccttcttgttcttttaaaagagaatagggactacgtgagcacaagcgagagggatgtcattgacttcgtcctgaaggatcccgagcgcgtcgtgggtgtaacaatccatgagctggcctcaatgacatttgtctcgccctccactatatccaggctctgccggagcatggatatagggggatacaaggagtttcaacgccagctcgtctatgagctggcaactctgcgcgattcagagcgcaccacgattgaggatatcaagaagggcgattccacgaagcagacgatgttcaaggtcacgcatcgcaacatggaatcgctcgccatcacagagaagctcaacgatccgacagtgatagacgcctgcgtcgacctcatgaccgatgctgatacgatcaatctgtttggcatggggagctcgctgctttcggcacgtgatctgcattacaaactgatacgcgcaaatcttcactgcaacacgagcgatgactggcatatgcagctggtggcggccaagaatatgggtccgcatgatctggcaattgcattcagctattcgggacgcacgcaggaagtcatcaaatgcgtcaaggaagcgcggcgacaggaggggaaggttatcgtagtgacaagagcggggcatgactcggagtttgtccggcttgctgatcatgcactctatgttgcttcgaccgagccggttctcaggagttcggcaagcgcttcgcgcatatcgcagctcgggctcgtcgatatcttgtttacggcttttgtgaacaagaactacgaccgatgcgctgccgcatttgaacagaactacattgagcgatagggtaaacggggatgcaatagagaggagactggcatgaagagctacaagattctgcttgtctgttcgggaggaatgtcgacttccgtactgatgaacaagatgcagaaatatggcgaagaaaacggtatcgatatgaaggtcgatgcctgcgggaccaacaagtacgaggatgaggctgcaaagtatgacatcatcctgctcgggccccagattgcatacagaaaggcacagattcagaaaactgttgggattccggtcgttcccatcaagccgcaggactatgcattcggcaatgttgccaatatcctcgcgggggtcgatgagattctggggacaaatagctagctgaacaacagaccaagtcgaaatatcggtacacaggcatcacgattctgctgcactggcagcgggatcgtgatgcttttacaagaagggggaacaggtatatggaaaagcttcagaactggctcgaggagcatctagcgcctgcaatgggcgcactcgggtcgaaccgctatctccttgccgtgcgtgacggcgtggtcggagcgcttccgctgatcatcgttggctctttctttatgattgtcgcaaatccgccgcttccgtctgattggggtatctaccagttccttacggcaaacgccgcaaagattctcctgccataccgcatgacgatgtacatcatggcgctctatgctgtctttggcatgggatacagcctttcgaagtcatatgacctcgatccgctttccggcgccattctctcgatcatggcatttatgctgaccatttctccggtgaatgtctctaaagatgcgaatgcaggggttgccggatttgtccttccgatggccagccttggatcgggcggactgtttgtcggcattatcgtcacattcattgctgtgaacatcttccgtcttacctcgaattccaactttaagatcacgatgcctgaccaggttccgccctcggtcgctcgttccttcgaggcgctgactccgaccctgcttgtaatcctgctcatcggcagcatcacgtatttcttcggcttcaactggagcgcagcaatcactgcctgcataaagccccttgtcaatgctaccgactctctgccgggcgtccttctgatttcgttcctctatggcttcttctggttcttcggcatccatggtgcctcgattgtcggctccatcgcacgtccgctatggctgacgctgcttgaggcaaatgcaaccgccgctgccaatggaacgcccatgacccagcttcctgccatctcccctgagccgttctatcagtggttcatcttcatcggcggtgctggctgcacgattggcctcgctctcctgcttgtgacggtctgcaagtccaagtatgccaaggatcttggccgcatcggattcctgccctgcctcttcaatatcaatgagccccttatctttggtgccccgatcgtcctgaacctgaccctcgctatcccgtttgtcctgacgccaatgatctgcggcgtcgttgcttggttcgcgacttcgctcggtctggtgaaccgcgtgatcgtgaatgctccttggactcttcctggccctataggcgcattccttgcttgcggcggcgactggagagcaatcgtgctgaacctcctgctcatcgccctttcctgtgtgatctactatccctttgtcaagatctgggacaagcaatacctggcacaggagagcgagaacgtagctgctgaggcagagaagtagttcacgcagtccctgttcttccggatggcacgcccgtccggagtctggcaggactctcatgtgcgctgcatctttggcgcggagagtcctgtcttcttcttttttcattcgtgtgcactcgggagggatgcatcatatgaagcgtttgggaatatcgatctatcctgagaagactaccaggcaggagatcttcgactatctcgaaaaggctgcagatgcaggatgttcccgcatcttcagctgcctgctttcggtgcctgacaaccgcgaacagatcaagcatgattatctcgaaatgaacaagaaagcacatgatctcggattcgaagtagttcttgactgcaatccacacgtcttcaatgagctcggcgtttcctacaaggatctatcattcttcaaggaaataggagcggatggcatccggctcgacatggggttcacgggactcgaggaatctctgatgacgttcaaccctgaagggctcgacatcgagatcaacatgagcaacgatgtgcattatctcgataccatcatggattaccagcctgatcctgcacatctgattggctgccataacttctatcctcatgaccattctgggcttgggctcgatttcttccgccgctgcactgaacgcttcaagcaatatggactccagacagcagcattcgtgacaagtcaggctccgcatacctttgcgaactggccagttaccgacggacttccgacgctcgagatgcatcgccatcttccgctcgagcttcaggtcgagcatatgattgcgctgggcagcgtggacgatgtgatcatctcgaactgctatccctccgatgaggaactcagcgctctcaaggaacttccgcgcaatcttgtgagcttcgaggtttcactcgtaccgggcatccctgccatagaacgcagcatcgtgctcgatgagctccacttcaatcgcggcgatgtctctgaaagctatctgcgttccacgcagagccgtgtcaagtacaaggggcatgacttcgagctgttcaatgcgccagcccagatcaagcgtggcgacgttctgattgagagttcgggctatggtcattatgctggcgagctccagattgcacgccgggacatggcaaactgcggtctgaccaatgtcgtcgggcatgtcagagatgacgagctgttccttctcgatgcaatcaagccttggcagaagttccgttttcacgaggcacgtgaatcgtgatgcagtggcttggagttgatggaggaggcaccaagactgccttctccatattcgatggaaatatgcagaggcttggcgataccattgaattgggcacatgtcactttgcacaggtcggctattccggcatgaagaaaattctggaacggggcatcatcgctgccgaaaagacgggattgcttggctgcgattggggcatcggcttcggcctggccgggtatggacaggagcttaaggtccgccggaatatcgaagaagcagtggacctatgcatgaaggatgtggctccagcccatccctacgagcttgtcaatgatgtcgaagctgcacatgcggctgccctgggtgcacgagacggcattgtcgtggtggcaggaaccggatcgattgcatatggcgtgcatggcgaaatgcattcgcgctgtggaggctggggatatcagataggagacgagggcagtggctggtggatcggccgggaaaccgtacgtgccttcagccgacagagcgatggccgctctgcacgcggacccttgatggatgtggtccgcagagagcttaatctgatggaagacgccgacatcatcggctatatgcgcgacactgtgaaaggcgacaggatgaagactgcccagctgagcaggatagccttccaggcagcatccatgggagacaaagatgctctggatatcttctgccgggcggcaaaggaggatgcccttcttgtacgcgttctcatgcaacggctctttccagaagccatggcgtctgccggtcgcaacgttgacgtctcatatgttggtgggacattcaaggcgggggacatcctgctggatccgttcgaacgggcactcccttcctgcagccatcttcaggcacctcaatatgagccggctgcaggggcatgcctgcttctgcgcaagagattggaagtgaatccaagatgctagcagttggtcttatgagcggtacgagtcttgacggggttgatgctgctctcgttgatatcgatggggtcgactacggcacttcggtccagcttgtggcgttcgagacgttgccgatgccccatgagaccaggaagcggattctcgctgcggtgaagccgggagggggaacctctgctgagctctgcgcactcaacgttgaactcgggcatcttttttctgatgcggttggtgcagtctgcagaaaagcggaagtgaaccccaaagatattagctttgttgcttctcatgggcagaccatctggcataatccggttgccggtgggggactccgcaatcccggctgtcctacaggtgacgaggttcgctattctggaacacttcagattggtgatgcttcgattattgcctgggactacaacgtgacggttgtctatgacttcagatctatggatatggccgccggcggtcaaggcgcgccactggtgccgtattccgaagcagtactttatggcgacaaggacgcaaatgtcgggctgctcaatataggcggcatcggcaacattaccgtactgcccaagggtggcgacatggcgaagatttttgcatttgatacagggcctggcaatatgatgattgacgaggcttgtagaagatactttgggcagggctttgacagagatggcgcgatagcggcttctggcatagctaatgaacagatgctggcagcccttatgcgcacgccgtatcttttcgaaaagccacccaagagcacgggacgtgagctattcggatctcagatgcttgatgccttgaagagctcctatcctgatgtgtcaggaaaagatctggtcgcgacgcttactgcattcaccgcaaagagtgttgcacattcggtgaagcactttgttctgccttctctggatggcggattggatcggttggtcataggaggcggaggagcgcacaacagcacgcttgtgcaggagctggcaagctatctgccacagacgcaagtcctgactcaggaagatctggggctttcgagcgatgcaaaggaagccatcgcttttgcggttcttggaaatcagacactgaaaggacgcgcctcgaatgtgccgtcggcgaccggtgcctcgatgccggcaatacttggcagcgtcatctatcctccgcgtacagaggtgcactagaaggggttctcatgggcaggaagaggaagcagggctatgcgggcaaggctcagaagcggacagaaaaaaccaagctgcacggcgtgatcacggagcagatggttcctgaacaggtcgagcgttcgggactctatccctttacgttctcaagcgctgccatactgatgggatgcgctcttgctggtggcattctgattccctggcaggctcagggaatcggcgtttcagtcgaccttgcaatgcttgtggcacttccgccgcttctggctttcgggctttccatatcacggtatttcgtggattcgccgagggggctgtgccgtggtttctggattatgttcgctgtcacttgggctgtgtcagcactgattctctacctcatgcttttctgcggaatcttgctgacatgaggtaattcagttatctgtggcaagccattggaagacgcggggcagctgttcctgccagcttgtccacagatgctcccccgggcattcttcataggagatgctgatgccgagcgatctggcgtgagctacgaaggcacgcgattcttccagcaggatatcttcggttccacatatgcagttcagagcggggagaacctgcttctgagctgcatttttgtcgagcagtgtcagaaggtcgtttgccgtgccggaaatcctgagatcgtcgccgaatgctggacgggggtcgaagccgttaagatggaaagtctcgacaaaacgctggatatcgagtgcgcctgaaagggcggcggcacgcgagaaacgttcgggatgggtgagtgccagcttcattgcaccgtatccacccatggaattgccgcatacataggtatcggcccgttcctgggacagcgggagaacgcttgcaagatagagtggcagctcttctgcaacatagctaaaccagcgctctccgcgtgccatatcggtatagaacccatggcctacttggggcagcacaacggcaatgtcggtattccggataagggagtcgattgcggtgtggcgaatccagccccaagaatcatctccgagaccatgaaggagatacagcacgcggtatggcttcagggaggaagcctgctggaactgttctggcctttcaggcaaaagcacgtttacctctgcctgtgaagcaagtatcggactcgaatagcgcagagtcagaagagccatctatatcacctcggcatccattataaggtcttggaagcagggtctttcatgaatggcggggcattctggacgtaagcttggcagttctcacagctgtgctttgcagaaggaccgggaacggcgtggcgggcgttgcactagcgatgatgtgacgtacagaagcggccagatggtggctggcagatgccgcatcatcggtcatggcatagcctgcactgcggcagaccttcctgtagacagtatccggattctcgagactggcggaggggtgtatgcctttggacgtgggtatggaagcctttccactttggcagacagaggcatcagaggccatattctggaaggaagcttgtccagccgtcctcccaggcgaagcgccctcctgccgctgcggctccgatctcgaagtggagacggacgatgccgaggtccacggcagagaagggccctcccttcgagcgcagggagacgagaggcaggccgtccggactgctcttctcgcaccagccgattgagaagctctgctggttcagggaagtgggagcaaggagggctgcagtgacgccttcatcgaaccaggcgggaggctctgtcccttcggggatggatgtgacggcctctttatccttcgagcggtggggatgtccctgatctgcactgtggcccagggcacagaccaggacgaagcggtcatctgtgtcgagcatcctcttcacgaggcggcgcttgaaggtgccgcccgcccagcaggtgcgaaggcccagcttctgtgcggtgagcacgatgcgctcgccgaagtagccgcagcgctgctcgagcgaaggggctggggttcctgcgaggacgagatagttctggacatctctgaacttgccgtagtgggcaagaagcgagccgaaggcctccggctcgtcgacgacaaggcgcatatggagattgcctgcctcgttcgactgtgctatctcctgaccgaggagggagcgctcctctgctgtcagcggagatgcggtgtagctcctgaccgaatgcctttcttccagtgcgccatggaaatccatgaagttcctttctgctgagtatctggatgatgtctacccgcaaggttcttctgccatgcggacgcttactgaagcatctgaatagcgaaagacatggaaccagaacacatgaaatgaagcagaagacgaatggcggcatgcagacagcatgcagtgttcatcaggcgttttcaggtttggaacgtgctaggctttgaaacgaatgtgtcttatagagtgaaacttatgattaagacataacatatacaaaattgacggaaacatgctgggagcagcctgttgcaacgatgggtggcagcaggctggagcgcagggacaagggggacagatgccttcaaggtatggccaaggaacgcagggagccaaagtccgttctgagagcgggtctgcaatccgcggcttccgtgtgcacctcgaagagtaccgtccccttgcaagctcggccgagcgcaacatcgtgaacttcctgctcgaacatccggggaatgccgtgggcgtctcggcacaccgtctcgcggagctcacctacacctcgccctcgacggtcgtgcgcctgtcgcgcaagcttggcttcacgggctacaaggagctccagcaggcactgctctatgagcttgcggtagcggagaagagcagaaacatcgtctccgagggggtcatgtcgaccgattccacgcaggacatcatcgacaaggtcacagcccgcaatgcctcgacgctttcgctcacgcgtgacggcctcgaccccgctgccatagacaggacggtcgagctcatccgcacggcaccgcgcatcagcctctatggaatcggcgcctccctcatggttgcccatgacctgcagctgaagctcctgcgcctggacatccatgccgatctgatcgatgacctgcactcgcagctggtctgtgcgaagaacgagcgtcccggcgatcttgctcttgtcatctcctattcgggcatgacagaagacatgctgcgctgtgcccggacggcaaaggcaaggggtgccacgatcgtctccatcacgcgcggcagcttctcgtcgccgctcgtgaagctctccgatgtcgtgctcggggtcgcggcgacagagctcgtgctcagaagcggcgcgatgtcctcgaggatcgcgcagctgaacgtcgtggacgtgctcttcaccgcctacgtgagcagcaactacgagaagagcatggagcgtctctcgaagaactggatcaagaggagcgaagtgccggaaaaagaggcaggcaccgaagagggtgccgggcttggatagaagacagaagtgcaaggagaaaggagcggaaagggcaatggcagaggaagagaagcctgcgatcgacctcgggaagctttcgaccgaagcgcgcaatccccggaccatgcatctcgacgagatgagcccgcgcgagcttgtcgaggtgatgaacgcggaggatgcaaaggtcgcaactgccgtgcacgacgtgctcggcgaagttgccacggccgtggaatgggcacgcgatgcgcttgcggcaggcggcaggatcgtctacttcggggctggcacctcgggcaggctcggcgtactcgatgcggttgagtgcccgccgacattcggcgtctcgcctgatagggttgtcggcctcatcgcaggcggggagcatgcattcgtgcgtgctgtcgaaggggcggaggattcgctcacgctctgtgcagaggagctcgatgcgctgcatctgggaccgcatgaccttcccatcggcatcgctgcctcgggacggacaccctatgtgatcggcgggctcaggcatgcgcacgagctcggctgccgcacggtggcgattgcctgcaacaaggggtcagatatcggaaagtgtgcagacctcgcaatcgagccctgctgcgggccggaagtgctgacgggatctacccgcctgaaggccggcacggcacagaagatgatcctcaacatgatctcgaccggagctatggtcggctgcggcaaggcatacgagaacctgatggtcgacgtgcagcagtcgaacgagaagctcgaggtcagggcacagaacatcgtgatggccgccacgggcgccgaccgcactgaggcggagcgggcgcttcaagaggcgggcggctctgcgaagtgcgcgattgtctcgatcctggcagatgtttcggcagacgaggcgaagcgcaggctcgctgtctgcggcggcaaggtccgccaggctctcagggagagctgaacatggcatacggcggacggcagatggggactgtccgctcggcaaagcaagacaaggaggaacaatgagcaaggatttcgaagggattgccaagggcgtcctggccgctgtgggcggcaaatccaacgtcgtgggcaacatggcgtgcatgacaaggctgaggctcaaggtagccgatccttccaaggtcgacgaggcagcgctcaagcaggtcgaaggcgtcgtgggccttgtcgctgatggggagcgctacgaggtcgtcttcgggccgggcaccgtgaacaaggtcctcgagccgttctcgaagctcaccggcatcaagccggacgatatggccgacgtcgtgaacgatgctgccgcgaggaacaaggcagcacagaaggcaaagcacgacaagccggtacagcgcttcctcaagaagatcgcgaacatcttcgtgccgctgctgccgggcatcatcgccgccggcctcatcaacggcattgccaatgtcatcaacgtctcgaccagcaatgcattcgcaggcgtctggtggtaccagtgcatccgtacgatgggctgggcactgttcctgtatctgccgctcttcgtcggcatgaatgcctccaaggagttcggaggatccggcatcctcggcgccatggcaggtgcgctttccatcgcgaatgcttccatgccgcttctgctcaagactgctgacggcgctgcagccgtgaacctgccgattgccgtgccggttccgtccttcgcccaaggcgccttcgcgatcaacttctcgacggtctacaacccgtctgcaggcggccttctgggtgccctcatctgcggcatcttctttgcatggctcgagaagaagttccataaggtcatgccgagcgcgctcgacacgttcctgacgccgctcttcacggtctgcatcggctcggtcgtctccgtgctcgttctgcagccggtcggcgccttcctcacccagggcatcttcttcgtcctgttcttcttctacaacgtgctcggcgtcgtcggcgcctatcttctgtctgcaacattcctgccgctcgtcgcggtcggcctgcaccaggcacttaccccgatccatgcaatgctcaacgatcctgcgggcccgaccggcggcatcaactatctgctcccgatcctcatgatggcaggcggcggccaggtcggtgccggccttgccctctacgtgaagacgaagaacacgcgcgtgaagacgtacctgcgcgagtccatccctgtcggcatcctcggtgtcggcgagcctctgatgtatgccgtgacgctgccgctcggcaagcccttcgtgacagcctgcctgggatcgggcgtcggcggcatccttgcctggctcttccatctcggcacggtctcccagggcgtctcgggcctcttcggccttctgatcgtcgttccgggcacgcaggggctctatgttgttgcgatgcttgcagcctacgcagcaggctttgccctcacgtatttcttcggcgtggacgaagaccgcatcaacgatgtcttcggcagcgaggcatagatttctatctgtaccgaaacaggttctggcatgcggacctgcaggagcaatcctgcgggcccgctttctgaagaagagcgcttccgctcctggatggaggactgttcatggaaacaggcatttccctgtattttgcatcgggctatctggcaaacgccgcggtcgtggagaaggcatcgcttgcaggagcgaagtatgccttcacctcgttccatattccggaggagtcgggcctcgattttgcgcaggaggcaaagaggctgatcgctctgtgccgcgaccatgggcttgccctgattgcggacgtgtcgccggcaacgcttgccaagctcggatgcagggacttcggcgatgtgggccgtctcggtgtcgaatatatccgtctggacgatggcttcgatgcacgtcagacggtcgagctctcgaacttcttccatgtggtgttcaatgcctcgacgatctccgaatccgacattgcgcagtggcgcgcggcaggtgcagacttcagccgcttcgctgcctgccacaacttctatccgaagcctctgacagggctttccatagaagatgtggtgcggaccaaccagaggctcaaggcactcgggtttgaggtgatggggttcgtgcccggcgacagggagctcagggggccgcttcatgaggggctgccgaccgtcgaggcacataggggagatgccggcgacaggctcttcctcgatatgctcgagcttgcatcggcaggctgcgatgcggtgctagtcggggatccggatgtctccaagacggtctggaaaaggattgccggcatctcccagaatgtgattgacctcgcagcagagctctcagagccctatcagtcgctcttcggtcgcctgcagcatgaccgccctgactcctcgccctggatcgtgcgctcgcaggagtcgcggcgctggaaggatgtggaggcaccaaagccctcccaggacgtacgcgatacggacgttcatgcaggagacatcctcatgagcacgacggcatatggccgctatgcaggcgagctcgagatcgcacgccagagctttgcgctcgacaggcgcgacgtcaagatcggccgcattgcggagccagatctcgcactgctgccctatatcaggcagggtgctggcttcaggctcgtcaaggacaaggcataggctttctctgcagggcgctcctgccgccagtgctgctgctctgtggcgagccgaccagcctcgtcaggcgagatgcagaagtccggcgccgctcagggcgctgccgaggcagcagcgccccacgagcatgtgcggctgtttcgtccggcgagatgcgcggactgagcacgcaagggcgcattcgtcctctgctgagctgaaagacgggcacgctctcactccgcctcgaggaagccgccggtctggcgcttccagagctctgcgtacgcgccgccttcctgcacgagctctgcgtgcgtgccatcctccacgatcctgccgccggcaagcacgacgatgcggtcgagggctgccacggtggagaggcggtgggccaccacgatcgaggtgcggccgcgcatgaggtttccgagggcttcctggacaagggcctcggattcgctgtcgagggcgcttgtcgcctcgtcgagcacgaggatcgggcagtctgcgaggatggccctcgcgatggccacgcgctggcgctgtcgcggtctcgtgcaggcaagtctgcctcacaggcatgtcaacgtcgcgttgcgccaaccatggtgtcgagcccggtgggcaggcggtctgaattcagtactccgcctgtgccctgttcccgagcttcaaagctacgtttgtccagtacctgagcagctacgcatgacccgcgcatcatctaattctctcgacatgaaagcgcacaagttcccggctgagagcgcaaaacagttgtctatttcacgtccacccgattgatgatatggcaatcttgctggcagtccgccatccattctgcttacgacagttgatataattgcagaaaaaatgtaaacttgcattgaagatgaaatattgcaatgtatgtgtgggggtcaatggtggagtacctggaatacctcagcgatgcactcggtctcgcgctgagacgaacttcctgggaccgagcaaggacgctcccgctctacttgggcacggcagcagactacgagctctgtagctgcgatgggacggacttcctagttgcgctgccgaggggaggccaatccctgccggagctcaagcgtgtcgtcgcgcagatcgcacggttcacggagctgcccgtcgcgctcgcgtcggacctcatcgactcccgccagcgccgcgcgctcgtcgcgcggggcatcccggtcatcgttcccggaaggctcgcgtacctgcccttcctggggtttgccgcgcaggcggaggcgaaaaggcgtgcgcttggcggcacgctcacgccaagggcacaggcggcgcttgtcacgatgatggcaaaccctgcgatctcgacctcaatcggcctgagggaggtgacgcgtatgacagcaagctccgcaagccgtgccatcgatgagctggcccagcatggtctgatcgagcgcggcaaagatggccgcgaggtcactttcgactatgacagagggaggaacgccctcctgaagcaggcgatgccgctgctcaagagcccggtcgcggctacaatctgggctcggcacacggatgccctggcggcattgcccgatgctggcgagacggcgctggcggatcgttcgatgcttcttgcccccgccatcggccagaaggcggtggccaaggcccgcctcgcggagctgggggtggatgaggtcctggaaggcgagctgtcggacggggagaccgtcgagctacagctttggtcctacgacccgctggtggcaggcctcgggcgcgtcgatgacgtctcgcttgccctgtccctcgcagggttgggagacgagcgtatagatggtgagctggacgatctcttcggcgaggaggggctatggcgatgagcggtgtctacgggctggggcgattcggcgagtacatggcggggcttgaggagcactacgccgtcataggcggcaccgcttgcgacatactgctgaacgcgtcggacctgccgttccgcgcgaccaaggacatagacgttgtgctcatggtagaagatcgtccagcagaagtcggtcgggcaatctggaagctcttgtcggacggcggctacgctgtggcgcgcaggggtacggaaaacgcgcacttctatcgcttctcgaaaccggccgcatccggctttccctcgatggtggagctcttcggcaccgagccgaacttcatcacggagcccgacggccttgaaatcgtgccagtgcccatgggggaggacgtgtcgagcctctcagccatcctgctcgatgccgactactactcgtttatgtgtggtggacgcaaggtcgtggatgggatctccgtactaggtgaggcctatctggttccattcaaggcgaaggcgtttctggacctccgagaacgcagagcgtgtggagagcacgtggatagtaaggatctgcggaagcacaagaatgacgtcttcaggctgctgcagctcttcacgcccgagacgactgcgccccttccagactccataagggacgacatgtcccacttctgcaatatcatgagcgaggaaggtgtgcctctcaggcagattggcgtaaggatgaccttggacgaggcgctgggacagattgcccgctcatacggtctatagaagaccttgttcattatcggagtcagcgctctgggaggttgggccccatttcaatcactgccatctggcaaggaatggccagaatgcttgtagcgtgggaatctcaggccgcacttttcgggctcccatgcctttaggcggcgaacagtctgaagggtgatttgccgccgcctaaagggactcggttgcagcgtgtgctcactccgcctcgaggaagccgccggtctggcgcttccagagctctgcgtacgcgccgccttcctgcacgagctctgcgtgcgtgccatcctccacgatcctgccgccggcaagcacgacgatgcggtcgagggctgccacggtggagaggcggtgggccaccacgatcgaggtgcggccgtgcatgaggtttccgagggcttcctggacaagggcctcggattcgctgtcgagggcgcttgtcgcctcgtcgagcacgagaatcgggcagtctgcgaggatggcacgggcgatggcgacgcgctggcgctgtccgcccgagagcctgacgccgcgctcgccgaccatggtgtcaaggccctgggggagccgctcgatgaactcgagggcattggcctctgcggcagcacgcctgatttcttcctctgtggcctctggcctgccataggcaatgttttcgcggatggaacggtggaagagaaggggctcctgcggcacgtaggcaacctggcggcgcagcgactgctgcgtacaggcgctcacatcctggccatccacaaggacctgccctccctggacatcgtcgaggcgcagcaggagcttcgtgagcgtcgtcttgccggagcctgagcggcccacgaggcccacgcgctggccgggagcgatatcgagattcaggtcctcgaagacataggagcccttcggggcatctgcataccggaagcggatgtgctcgaagcggatgcagccctcatgcacctcgaggggcttggcatcggacctgtctgcgacgagcgtcggctcgtccagcaccttcgtcattgcagccgcgtctcctagtgccctgttgatgcgctgcatcatcgagttgaagtagttgaagcgcatcgtcaggttgtacgtataggtgaacatcatgaccagcgtgcctgcgctgatgccgaaccaggcattgccgccgctcacgaagatcgaggtcacgaacatgatgatcgtgatgagggcgcttgtcgtgaagctgcgtttcatggtcgcatgcatgttcacgttctctttgtccatggcctctctgtctgcttcatcgaagaggctgcgctcatagtcttcgcggccgcaggtcttgacggcgaggatgttcgtcacggcgtccgagaggatgccggagaggcggttctgtgcctgggaggcagcagaggagagcggaagtatcctgcggtacatcgtgtaggcgtagatgacatagacaacaagcatcgctatgagaatgaggacgaaggcaggggcagcaggcgccagcatcgcgatcgtgaggacgaccgaggcgagcgtcggccagaggctgtaggtcaggacatccacaaggcccgagtagccgctcacgaagcgggaggtctgacttacaagagaccctccgaaccttcctgtgtggaaggtcatgctctggttcgagagtgtgtcgaagcagaggcgcgagagctggtagtcgccgttgatctcgagcttgtagaccgcatagtcctggagcttcgagagcgtctggcccacggcgttcacgataaggagcgccaggatataagggccgaagacagaaaagacctcgtcgggtgtgacgggggaggcctggatgcggtcgacgatgaggcccatcacgtaggtattcgcaaacgtgaggagggcaatgtagcccaccgaggctatgacagaaagggtgaaggcaccgggcttctgcttcgtcacccaccagaagtagtggagggtgcgcctgatggtcgtgcggtcattcgaatcggttgtgcttctgagtgccatgtatgctccggaatctcatgctgcctgaaggcgtgaattgcagtcttatcagttacatttaagcaggcgatgctccagagatgtggcagaaaccacactctatgaggattccatgaaacgctaaccctgttagacaaacagcatggctgcgggtagagtatcgtccgttcactaacagggttagcaataaggagagctatggaagagaaagaggagcttacggaggaggaatgggaccgtcttgtgcgtgagcttttccgcacttggcatggcctgcgtccttccgggcacgaccgtccggacatggagctcctggggcagaagcagatcatgcatgttctggcacagaacgaggaccccgtgacgccaggtgcgcttgccgatgcctgccacgtcacgagcgcacgcatcgcgcgtgccctgaagcagctcgaggcacaggggctcatcgtgaggacggaagatcctgaagatggcaggcgcacgctcgtgagcctgacagagaagggccaggacgtcatcgccgagaggaagaagcggattggcgagaccatgaaggagttctgcaaggagcttggcgcagaggacacccaggagctgctgcgcatcatgagacgggttgccgagcttgcccctgagatccagaagcgcttctgccagaagcaggaagaggagggcacgcgatgaataccctccgctatctcaagggccatattccagcggtattggctgtcgtggcgcttctcgccgtgcaggtcacctgcgagctcatgctgccgcgctacatggctgatatcgtgaatgtcggcatcgtccaggtagcgggcggcgacatgggatatctggccagcatggcaggctccatgtttgcgctctgctttggttcggtcgcagcggcggctgctgcgggataccttgcctcgcgtcttgctgcgaccattgcgcgcgacctgcgtgcatgtctcttctcccgcgtcatgcagctttcgccggcacaggtgaaccatttcacgccgtcttccctgatcacgcgctcgacgaacgatatcacgcagatccagatgacgatcgtgatgcttctgcgcatcgtgatgctcgcgccgatcatggcaatagttgcaatcatccaggtgctggcactgggaagcggactcatctggattgtcggcgccgcgcttcttgcggtgcctgccgtgatctctgtcctctatgtgcttgcgatgccgcgcttcaggaagatgcagtccttggtcgaccgcgtgaacctcgtagcccgcgagatgctcgacggcgtcatgagcatccgtgccttcggcagggaggaccatgagctcgagaagttcgatggggtatcccgtgacctcatgcagacgcagctcttcgtgaaccgcgccatgatcctcatgatgccggcactgacgctcatcatgaacctcgcgacagtggcaatcgtctggttcggcgcacaaggggtcgctgtcggcacgatgcaggtcggcgacatcatggcattcatcacctacgcgatgatgatcgtcatggccttcctgatgatctcgatggtggcagtcctgctgccccgcgccgagatatcggcaggcaggatcgacgaggtgctctcgtgcgaccctgccgtgcatgagccaaagagcccgaagtcgcttgatggggcggctgcgcacggcgagctctctttccaggatgtgggctttgcctatccggatgccgagggcatggtcgtcgagcatgtgagcttcaggacgcatccgggaaagaccgtggcgatcattgggtctacgggttccggcaagtcgacgctcgtgcagctggcgccgaggctctatgacccgacggaaggctcgatctcgcttgacggcacagatctcaaggacctttcgctctccgagctcaggcacaggatcggctacgtgccgcagcagagcttccttttcacgggcacgatcgcctcgaacgtggcctatgggacagaggggctcacagatgaggagctcaagcgtgcaatccatctggcgcaggcagacgatcttgtggcagcaagccccgagggcacggactctccgatcgtccagggaggcacgaatgtctcgggtggccagcgccagcgtcttgccattgcccgtgcgcttgcgatgaagccggaagtgctcgtgctcgatgattcgttctcggctctggactttgcgacagatgcacgcctcaggcgtgcgcttgcagagcatgcaggggacatggccatcgtcgtcgtggcgcagcgcgtcgcctcgatcatgcaggcagacgagattctggtgctcgacgacggcaaggtcgtaggccagggcacgcatcaagagcttcttcgtgattgcccgacataccgcgagattgcgacaagccagctctccgcgaaagagcttggccttgaagaggaggtgtaaggacatggcagaagaaacgagcctcaaggagcagcaggagagaagccgtcagaggcgcccgcatggtggtggacgcttcgctcccgtggagaaggcaaaggacttcaaggggacgctcaggcgcctcattcatgcgctctcgaaggaagcgccgctcatgatcttggccgtcgtgcttgcgatggtatcggtcatcttctcggtcatcggtcccaagatcttgggccaggcgacgaacgaggtcttcctcggcgtcgctgcgatgggaagaagggatggcggcatcgacttcgcgaagatcgcccagattcttgccttcctcctcggcatctacctgatctcgtccggagcccaggccatccagggctggctcatgacaggcatatcgcagaggacggtcttccgcttcaggaaggagattgcagataagatctcccgtgtgccgctttcctacttcgatggggaggggacctcgaagggcgacgtgctctcgcggatgacaaacgatgtagatacgctgagccagactttgaataccggcatcgtccagctcgtgacttccttgacccaggtcatcggcatcgccgtcatgatgctctccatctcgctccagctcacgggcgtcacgcttctcatgctcccgcttgccggcatcgtgctcttcttcctgatccgtgcctcccagcgctacttcaaggcccagcaggcacagctcggcgccgtcgacggaaagatcgaggaggatttctcgggccaggtcgtgatccaggccttcgaccagacagggcgtgccgagcacgagttccagaaagagaacgatgcgctctatgagtcggcatggaagagtcagttcctctccggcctcatgcagcctctcatggggcttgtcggcgaccttggctatgtgggcgtcgtcgtggtcggcgtgggccttgcggttcagggcacgatccagccaggcgacatccagtcattcattcagtacgtgaggaacttcacgcagcctctggcccagcttgctgccgtatccaacacgctgcagcagatggcagcctgcgcagagcgcatcttcgagttcctcgatgcaccggaggagacagagacggcgaagatcgatccggaaacgggcaagacagagcagctcgggaaggcgaaaggcgaagtcagcttcgaccacatctccttcggctacctgccgggcaagacgatcatccacgatttcacggcagaggtgccagaaggcaggactgtcgccattgtcggacctaccggtgctggcaagacgactctcatgaagctgctcctgcgcttctacgacgtggataaaggtgtcctcagggtcgacgggcatgatgtgcgcgacatcgagcgggaggacctgcgccagaacttcgctatggtcctccaggactcctggctcttccagggcacgattcgcgagaacatccgcttcggcaggctcgatgcgacagacgaggaggtggaggcggcagcacgctctgcccactgcacccacttcatcgaaacgctccccggaggtttcgacttcgagctcaatgaaggggcgacgaacatctcccagggacagcgccagcttctgacgattgcccgtgccgtgctggcagaccgttccatcctcatcctcgacgaggcaacctcgaacgtggatacgcgtaccgagtggcgcatacagcgcgccatggacaagctcatggcaggccgtacgtccttcgttattgcccacaggctctcgaccatcaagggtgcagaccagatcctcgtgctccaggatggagacgtcgtcgaggcaggcacccacgaagagctcctggccaagcagggcgtctatgcgaagctctacgagtcgcagttcgaccaggtggcataagcagccatgggattcagatagaggtccggctggcagagcgcatctgccagccgggcttctttcgtcagcaggatggcggtctcttgatcaggcctgatgccttcgctgtacgaaaaaaagaggcgaggctcttaggttctgcgcgaatacttcgtgcctctgccccgtccgctgcgctctacgaggcctttctgttcgagggaggcaagcagcctgcctaccgtcgaaaggctcgtgccgcacttctccgaaatctgctttcgagtcatgagcattccttgaggaagggcgtccagaactgctttctcttctaccgttgttgctggatgcgattccaagacggggagggtcacgcggatgcttgcgtccagaacatcgaagctgggcggcagctctcctgctggatatgcttcccgaatgcgggggacgcccgatccaaagagctcgatatagcctagccggaacatgactgtggcaagaattggatttctcggcacagatagaccgcctgcaaggtaagcctctctctcgattccgggaggaagcgagccaggagatgtgaccacagcgtggtcaggatgcatggcaacagtaatggcggatggcacatcccatgcacgatgggcgattgcgttggcaagcgtctctctgaaggcatccaggggcagcttctcgactcgttccctggtcgtcgaagttactttttcgaatgcataggtcctttcagcaacatctgccgttctgtcgagctggtcgagcaccgaacatccgtctatgtgcactctttcgagaatctcagacgtgcttctgccaaacctcatgatgtcgattccggggaacgggttcgaatccgaaaggagggcagctgcattcacgagctggccatctgcatttgtgaggccgagcgttcgcaaggtgttcctgtcgaattgatcgactccgagcctcgtgtgcagacgctgcttgagggatccgaactccatattttggctgtctgcaggaagctgatcgaaagacatgtgattgccggcgagtatgagccgtttcaattccagtgaatccgcctctgtggtcgaagagtcgtttctgatgtatgcctttcctctgcagaggtagggcttgtctggtccctcgaacacagtaagggtcaccgtcccggcctcgctgtcgacctctatcgaataccggggctgtgggtgaatgcggtcatggatcatgtgctctatgcgtaggcattctttatcgatgtcggggagaccttggacagtgccatcgtcagccattccgaaaatgatgctgcctgttccataattagcgaatgcactgacggtcttgaggaaagactcggataccgaggccttgagttctcgatcattggactcgagcagtgccatagcagaacctcctatgtacctggaattgaccgtcgaatccgcactccgagtgcaacagaatattacgaggtagccgcccaggcgcgacctatatgatgctggcggacatgcatcattggaggcaccatggacggctacagccatcttggcattgcggagcgcgaggacatcatggtccgctggaagggccatgagggggtcagccagatagcgagggagctccacagggacacgtcgaccatatcccgcgagatcaggcggaacggctggcagggccctgcagggcgccgctaccgcgcgcctgcggcacagaggaaggcggacaggaggaggctgcgctgcaggcgccccaggctcatggacgatccggagaggcgcgccctggtcgtggagctcatgcgcgacgagcactggtccccggaggagatatcgggccgcatcgcgatggagcatccgagcctcgccgtgagtgacgacagcatctaccgtgccgtggagtcgggatccctggactgcgggcttccggggcaccggaaggccgcaaggctgctcaggcaccatggcaagcgcaggcacaggaagggaagccaggagcgcaggggcagggtgcgcataacccatgacatctccgaggccggaagaggcatcgtccaggaaccggacaggcgactgggaaggcgatacggtcgctggcaggcagggcggtgcatgcctcgtcacccaggtcgacaggatgagcggataccttgtcggcggcaaggccgccgaaggcccatgccgaggtcaacgaggccacggagagggcgctcgagggagaggccgtccataccgtcactctcgacaggggcaaggagttctcggatgcagagggcctccaggaggcgctgggagcgccgttctacttctgccatccccaccatccatgggagcggggcacccacgagaacaccatggccttctcagggactggttcccgaagggcgagagcctcgacgatgtcagcgacagcgaggtgcaggaggcatacgattcactcaaccggagaccacgcaagcgtctcaagtggaagtgcccctgggaggtctaccacccaccgtcgttcacttgctctgaggattcgccccagaaaaattatctgttcaattaagtcattacatggccatactattggtcagtaattgaccagttaaatgtatctggtcaaaatggctgaggacctccggcataaccgcaggaattcctgtcgccgctccgctgcatcatatggatgaacggctgatgcatccggaagagggaggaagcaaggcgaagggccatgcaggcggactgagcaggaaggaatgcgagagcaggggcacgctcctggagtttcctggagagatatcctgacgaggagtcgtgcgagaggaggctcctcgaggagaagcatcccggagcttcgtctgccccgcatgcggaaaccgcacctgctccaaggtgcacggcatgcccacaaatggcagtgcaccaggtgctcccaccagttcagcgtcaccgcaggcacgatgatggaagggacccacctcgagctcaggaagtggttcgtggcgatctggctcatgtcgagccagaaggcaggcatcagcgcatgctccctgcagcgccagataggctgcagctacaagacggcagggcgcgtccttgcgcgcatccgctgcgcgatggccagatcggagtgccttcaacgtcctcgctgctgactgcatcgaggcggacgacttctatataggcgcgagggcggaggcacgaggggaaggggcacggagcagcagccgatgcttgccgccgtcgacagggcccctgccgggaggggctcctgcgccatccggggcgcgcaggactgctcgggagactcatggcgccagttcgggcacgaccacctctgccatgcatcgaggataagggcggatgcctggagcggcatagctgccgggctctcgtccttccgcggcctcgagcagaaggaatacgacagctcggacggcgatgcctcgctccccatggtccacagggtcatctccaacttgtggacggtaaggtgttctacaggcggtgcggtaaggactctttccaggtccacggtaacgactttttcctgacccgcgataaggaatagtcccctcggcccggtaagcatttcttccacccgcctcggtaacgactttttccgtggcgagcatcgggaggaggccatcatctggcatccttgcagccagtcctaccagagacgaggctgcaaggagcaagaccgatgataaaggatggcatgatcgatgagatccaggagctcaagctctccggatattcattcccggaggcgagggacgagctgaggcgcaggcacacgaaggtgccctgcgagaagacgctcaggaagtactacaacatggatgccgcgcctgacgacagccatgcgaaggtcaggaaggcgcatgccttcgacgaggagccgttcaggaccgagatactctgcatactggagatgaaccccggatgctacatgagctcggtctacgacgttctcatcgagaagttcgtcgagagcggccagtacgagatactgccgggcaatgagcagacgctgaggaactacatccgccacctgcgcgagagcgggcagatagcagcgaaggaggagcaccgcaggctctacgacgtgatgcccacgcccgacccgggcaagaaggcccagatcgacttcgggcagtacgactgcggggacggcctcgtggtgcacttcatctgcatcgtgctctggcactcgaggctcctcggggtgtatgcgcaggaccacaagttcagctcggaggagtcctgccgcgcgctgcaccgcttcacggtgaagtgcggagggcgcgtcgaggagctcgtgatcgaccaggacagcgtgttcgtcacggacgagatctacggcgaggtcttcgagacgaaggccttcaaggacttcctccatgagcaggacatgcggctgtgggtctgcaggaaggccgacccggagtccaagggctgcatcgagaacgcggtcgggttcgtgaagaagcgcttcttcagcgcgcgcaggttcaagtcgatagacgaggtgcagaggagcctgcctgcatgggtggagcgcgccaacaggcgcatccaccaggggacctacaaggtcccccaggaggagttcgagaaggtcgagaggcaggcgctgcgcccgatgcttccgagcgtatacgaggcggcgccgctcgacctcagggaggcgcctgtcaacggacagccctacgtgctgtacaaggcagtcaagtactcggtgccctggagcatgtgccataccactgcctacatcagggtcatcggggacaagctgcacatctacgactcggagaggcagcatgtctgcacgcacaccatctgcacggttaagggggccttcatcaggctcgaggagcaccggagggagcctgcgagcgactggatcgacacggcggagcgcatgcggaagaggtggaactgcgtggagttccagcatttcgtgaacggcttcaagaaggagaaccaggagcgcagcctggggaggcagctcggggccgtcgagcgctacctcgacgaacggagccctgacagggcgttcgtggcggaggtgatggccgaatgctgccgcggcttccgctacacgttcacccagttcaaagaggtatatgagcgctgccgcgagcgcgaggatgcggagggcgcactgctggaggcagatgcaggtgcgaagcccgccccctccggggacgtcgcgacccgcagcatgcagagctaccaggaggcattcgaaaggaggtgcgcatcatgagcgcgcaggggacgcagataggccagctctcgtcgtcgctcgaggcgttcggcctcaagcatgccgcgaaggcgctgcccgaccagctggagatcgcggagaggaacgagctctcgagcaggcagttcctcgcatcgctgctcgccgtcgagtccgacggccgcttcgccaggaagcgcaagcgcaactatgcgtccgcgcacttcccgccgaacgtgcggccaatcgacgagttcgactgctccgagctcgaagggggcatcacgccctcccagatcgaggagctgaaggagctcgcatggctcgacgcccacggcaacatcgtcctggcaggccctcctggcctggggaagaccatgctggcattggggctgggcctgcaggccatagacagcggctacaccgtcgcatacgagaagatggagtcgctcgtgtccgtcctggatgacgcgtccatagaccgcaaggccggattccggctgcgctacctgcagaaggcccagctcgtgattgtggacgagatcggctacacccccatcacgaagatccaggcgagccgtttcttcagcttcgtctccgacgcctacgagcgctcatcgctggtgttcaccaccaacaaggagatcacccagtgggacgagctgatgaacgaccagacgctcacgacggccatgctcgacagggtcctgcatcatgcccgctgcttctcgctgcgcggggagtcctaccgcctcaagcatcccgaggtgttcgcgctgcctgtgcccggaccaagcccagaagcggaataggcggacaggcgcgccagctgccaggggccctctgcggagggcccctcttcgtgcatggaaaaagtgcctaccaaaggcagggaaagagagcttaccggagggccggaaacagtgcttaccatagctatggaagaagtgcttaccctaccaatggaaaatctgcttgacattcaca

SEQ ID NO: 69 - DNA, 77922 bp, Unknown
  Metagenome-assembled genome
gccgtggttgccctggacatcctcctcgtcgcagaggatgacaggaagcgtcttgttgacgatatcgtcgccctcgacaagcacggtctcgagctcgttgcccttggagcccttgccgccatgcacgaggtcaatcgtctcgcgcagggtcttcttggcagcgtctgccagaaggccggaggcgttcatgtcgcagcgggtgctgcagccgcgctggcgcaccgtgtgggtgaggtcgagctcctcatgtccgcgcacgaggtagcggctcacaaggtcgaaacgggcgttgtcctcggcaaggtcagcggccaggccggcagcgacctttgcgccgccgagcgcatactggcgcacatcgacgacagcgttccttgcagtacggatgccgatgccttcgagatgctggtgctcttcaggcagcgccatgatctcgatgatatggacctgggcatcgtgctctgcaacgacgcgcacgaggttcgcagaggtagctgcatctgccttctcgccacgggagacgacgacgatcgtcgcctcggcgtgatggcggaccatgatgccggtatcggctacctcgcctttgtcgccgtcgacgacgcagacgatgggctcttcgcgcttatggtgtgccggcacctcgatataggtggcgtccttggcagcgtcctcgatccaggagacggcctcttcgccgatgccgcactcaagggcatcgaagagacgggggaggcgtgcatagacatcgcctgtcgccttggcggcagggaccgtaagcgaggtctcatcgatcttgaggtagttccacgtctgcgcaggcggaacattgatatgggagagcgtggtgagcgcttcttgcgtgtctgccatcagccgatcgctccttccatctcgagcttgatcaggttgttcatctcgacggcgtattcgagcgggagctccttggagaccgggttcgcgaatccgttcacgaccatggtccttgcctcctgctcggagcagccgcggctcatcaggtagaggatcgtatcgtccgagatgcggccgatcgttgcctcgtggcctacagaagcggagctgcagcgcacgtccatggcaggaatcgtgtcggagcgggagatgtcgtcgagcatgagggactggcaggagaccgtagcccttgcatgctctgcgtgcctgccaacgacgaccgagctcctgaacgtgttgatgccgccgtccttggagatggacttcgtctcgacggaagcggtcgtatcgcggccgttcaagattaccttgcagccggtgtcgaggtcctgcgtggcgcctgcgaacgtgatgcccgtgaactcgcagtgcgagcggtcgcctgtgaggatcgtcgtcgggtagaggtaggagacatggcttccgaaggagccggagacccactccatcgtggcgtccttgccgatcgtcgcgcgcttcgtgttgaggttgtacatgttcttcgaccagttctcgatcgtcgaatagcgcagacgtgcgccatccttcacgaagagctcgacggcaccggcgtggaggtttgcctcatagtacttgggtgccgagcagccttcgatgaagtggaggttcgcgccgggctcgacgatgatgagcgtgtgctcgaactggccggcaccggaagcgttcaggcggaagtagctctggagcggatactcgaccgtgacacctgccggcacatagacgaatgagccgccggaccagactgcgtagtggagcgctgcgaacttgtggtcggtgggcggaatcagcgtgccgaagtactgcttaacgacaggctcccacttcggattgtggatggcatcctcgatcgtcgtgtagacgacgccgtacttcgcgacctcgtcgcgcatgttgtggtagacgatctcggagtcgtactgggcgccgacgccggcgaggctgtcacgctctgcctgcgggatgccgaggcgctcgaacgtgtccttgatgtccttcggcacgtcgtcccagttcctggcctgctttgtcttcgggttcacatacgtggagatgtggtccatatcgaggcgggcgatggaggggccccagtttgccggcatcttcatgtcctggaagagctcaagcgcttcaaggcgcttcttgagcatccactcgggctcgtccttcttctcggagatggcacgcacgatatccggcgtcaggccgttcgcgtagcgctcgtagccctcctccggcttcacgaaatcatagagggagcggttgatatccgctacctgtgtcttcttctcgctcacagcctcacgcctcctgggacttctcggagttctcgagtgcctgctcgaagcggccgaagccgtgggtgtcgatttcggtgatgaggtcggcggggccctcttccacgaggttgccgtggaccatcacatgggtgcggtcgacagagagcttgtcgaggatgcgcgtattgtgcgtgatcatgagaagcgcgccgtcgcagtccctgcggtaggcttcgatgcccttggagacgatcttcagggcgtcgacgtcgaggccggaatcggtctcgtcgaggatggccagcttcggcttcaggagcaggagctgcagcatctcgatcttcttcttctcgccgccggagaagccgacgttgagctcgcgcgtcaggaacgactcgtccatatcgagctcatcggcaatctcgttcacgcgctggcggaacttgcgtgctgtcgtcttgagctcggggcgcatctgcgtgattgtgcgcaggaacgtgtagagaggaacgccagggacctcgaccggtgcctggtaggagaggaagatgccggcaagcgagcgcttgtcagcagcaagctcggtcacgtcctggccgtcgaagacgatcttgccttcgctcacgatatactgcgggtcgcccatgatcacatggccgagtgtggacttgccggcgccattcgggcccatgaggacatgggtctcgcctgcacccacctcgagcgagatattgtgcaggatgggcttgtcttcggtgcccgctgaaagattgctcacctggagcagagtctgggacatagttctctccaaaacgctcgcgaggccttccggtctctttccggctgcggtgtgcagccccctctgaccaattcatagtactcgtaggggtatttaggagacaagctccgaacaaagcctgcaaagtgctgatatcatggtccctgcacgccttgtacggggcgtctttcataattcctaccgtactgtgggtattttaccgcctcattccatttctataccggccaattgcgaccaattgaggacacattctccgaatgtgcacaatgcaggggctttgacggaaatccggccatctggatgggtcccgaaacgttgcagtgcggttgcagcgtgcggatgtccgctccttccgctatagaatgttgaagcaatcagaacgcacacgagaccgaaaggcaggaataccgcatggctctttcgagagaagatgtggcagggattgcggactatgcccgcatccatctgacccctgacgagctcgacgagatgacgcagtacatgaacgatgcaatggacatgcttgcgcctatccggcaatacgacctcgatggggtggagccgaccttccaccccatcggagacctctcgaatgtgatgggcgaggatatcgtcgacgattccgtccgccatctcgatatcgatacagcgctccagaatgccggctcggtgcatgagcgctacttcagggtcccctcgatcctgggcgatgaggaaggagaccgctagtggcagacatcgacgagctctcggcatcccagattgcccagggcgtgaaggatggctccttcagcgcaaccgaggtcgcgaaggcgacgctcgacgcagtggacaagcgcgaaggcgatatccaggccttcctcgagatctcggcagacctcgcgcttgcagctgccgagcgcacagacaaggcacgtgcgaagggggagcctctcggcatccttgccggcgtcccctgcgccttcaaggacaacatgcatcttgtcggcacgcacacgacgtgcgcctcgaagatgctcgagaactatgagtcagtgttcacggcaacctgcgtccagcgcatgctcgatgcaggagcgacgcctgtcggcaagacgaacatggacgagttcgcattcggctcttcgacggagtcttccgccttccaccgcacgaacaatccgtgggacacgacgagggtgccgggcggctcctcgggcggatctgctgcagcggtcgctgcaggcgaggtcacgctctcgctcggctccgatacgggtggctcgatccgccagccggcaagcctctgcggcgttgtcggcatgaagccgacctacggtgccgtgagccgctacggcgtcgtcgccttcggctcctcgctcgaccaggtcggccccttcggcaggagcgtcgccgatgtcgcacttgcgatgaatgcgcttaccggtcctggacgcgacccgtatgactcgacgagccagaactgcccggtcgacttcctcgagcatctcgaggacccgatcgagggcaaggttgtcggcatcgtccctgagcttatggatgctcctggcctcacgcaggaagtgaaggatgcgcttgccggtgccatcgcagcgctcaaggaccagggtgcctctgtcgtcgaggtcgatcttccgaacatccgctccgccattgccgcctactacgtgatcgccccctgcgaggcattctcgaaccttgcccgcttcgacggcgtccgatatggctaccaggagccgaactgcgcaacgcttgccgagcagacagccaagagcaggagccatggcttcggggaggaagcgaagaggcgccagatgctcggtgcctacctcctcgcttcgggcgtctacgacaagtactactatccggcgcagcaggtacgcacgctcatcacccaggactatgtcaacgcctacaagaagtgcgacgtgatactcatgccggcggcaccccgcacggccttccgcttcggcgagatgagcgatccgaccgagatgtatgcctccgacatgttcacgatttcgaacaacattgccggaaatggcggcatctccgtgccgctcggactcggcgcagagtcgaagcttccggtctcggcacagctccagggacctgccttctccgacagaaggctcctgcagtttgcacgcgcgatcgagcgcgccttcacggctgaaggcaccgtcgcgcctgcatttgccgggaagggaggcgagctcagatgatgacgctcgaagaggtgctcaaggactgggaacccgtgatcggcctcgaggtccacacggagctcacgacgctcgatacgaagatgttctgcaactgccgcctctcgcacaacgatccgcccaacacgaatgtgtgcccggtctgcctcggcatgcccggcgccctgccggtcccgaacaagaaggccatccagtccattgtcatggccggccttgcgacgaactgccagatcatgaagcactcgatgttctaccgcaagcactacttctatccagacatggcaaagaactaccagacgacgcagggcccagttgccttctgcatgcatggacatctcgacctcaccgtcgacggagcaggcgcgaaggagcgccctgcctgggaggatatggcagctgacggcacaccgatcgagcgcgccgaggacggctcctatacggcaccgatcaggatcttgcgtatccacatggaagaggatgctgcaaagatggtgcactcgggcggcgaggaaggccgcatcacgggtgctgccgagtcattcgtcgactacaaccgctgcggcacgcccctgatcgagcttgtcacggagcccgacctcaggactcctgaagaggcccgcctcttcatggagaagctccagcagacgttccgcacgctcggcatctccgactgctcgctcgagtccggctccatgcgctgcgacggcaacatctccctcaggcgccgcggagagacgaagctcggcacgaagaccgagatgaagaacatcaactcgttcaagagcctccacgatgcactcgagtacgagatccgccgccaggcagaggtgctcgaggagggcggcattatctatcaggagacccgccactgggagccctccaagcgccgtactgtcgtcatgcgcgtcaaggagacggcagacgactatcgcctcatgcccgaccccgacctggcacccttcgaccttaccgacgacttcatcgacgactgccgctcgcgcatcccggagctgccggatgagaagtgtgcacgctacgagcgtgactacggtctcaagcatgctgacgccgcgcagcttgcaggagacccggatgtctcgaagttcttcgaggaggcgcttgacggcgccgacaagaagacggtccccacggtcgcgaatgtgatggtgaacctcgtgccagggcatgccgacgtgaagcctgcccagctccagagcctctccaggcttctggcagaagatgcaatcacgttcgcacaggcacgcgaagtgctcgatgcggtcgatggaacggacaaggatccggcagctgtcgtcgacgagcgcggcatgcgccaggtctccgatgcgggcgctcttgagcccatcgtcgacgaggtgctttcgcgctgcacggaccaggtcgcccagtatcagggcggcaacaagaaggtcctgggataccttgtcggccagtgcatgaaggcatctaagggcaagggcaacccgaagcgcttcaacgagatgctgagggaaaagctcggctagctctcaggacagaagctcatcgaggggctgctcttcggggcagccccttttcatggagttcacggcttgtccatgagccggccacgaacaaaacagatggaagcgggaaatcgaccgtctgcggccgaatgtggccgttcacgcgggcgcaagatttggaacgctttatgcgggcatcatatgagtgcgcaagggcagacaggacaaggaggtgtactcggcacctcagaggttctgccaagagcccggaaagtgggggtcccgtgatttcgtccggggcccccgtcaagtctgaagacatatataagagatggagcgctaggcttccttcttctcctctgctgcaagcgcatcggttgagacatggcggagcatcagggcaagcgtgacggccaagcccttcggcaggctcgtcgcatcgatccattcctcgcgcgtatgggcaccgccgccgacgatcgtgccgaccgaggtagcagggattcccatggagagcgggatgttcgcatcggtcgaggcaggggaggtatcgggtgcagctcctgcaatctctctcagcgcatcgaggcaggcgtgcgtgagctcttcctcatcctcctccgggatatcgccgttgccggggcggctgccgatgggggagatgtccatcgtgcagccaggcacggcaaatgaggcgacgatctcgcggagcttctgctcgagctctgcgagcacgctctcgtcggtcgaacggaactcgaagagaagcgacgcatcctcggcgatggaattcacggtcgtgccgccttccatcctgccgatgttcatcgtcgtgcgcggatccttcggaagctcgagcgcatagaggcgctccgtgagcgcacagaggcgctcgagcgcattcggcgttccgaaatctgcccaggagtgtccgccctgtgtatggcagctgatgcggaagcggcgcgatcccacggcgacagagcagcactggggcatgtagcggtcgaatgagatgtattcgtggatgcgatggccgagcttctcgaagacctggcgggtgccgtcgaggttgccgaggccctcctcgcaggaattcgcgacgacgaggatgccgcagtcgagatgctctgcaatctctggatggcggatgaggtagcgtgccgcaagaaggagcccggcaaggcaggccgtgtcatcgccgatgcctggcgccatgatcttctttccattcacttcggggtggaaggaatcgcggtcagggaacacgacatcggtgtgtgcggcaaagaccgcaaggtcgcgaggcgagccatccttgtggcgggtggcgatgggcacgataacgtttttctgggaatcgatgtaggcctggggcgcgccgtttgcatggaaccagctgcagacgaactgggcacgcctgccttcatggtgggagggggcaggaagcgaggcgagggcgcttgtcagcatgatctcctcgtcgtagacagtgcgtgcatatgcctttgcaagggcggtgagcttcgcgtccatatctgccttccggtccggttctcactggtcggccccatcgtagcagagggaagcttttctgccagttagcctaggcgtctacctgtccaagctcctgcaaaagcgcataggtctcgttcaggatgccggtgagctcttcgagctggtcctggccgatgaccgctccatagtcctcgatgatcttctggaagctctggcgcgtaccggcaacgagcttcttgcccttgcgcgtgatcgtgaccctgatcttgcgggcatcatgcggatccttcacacgctttgcgagcccctgctcttcgaggtcgtcgatgatctgcgtgatgcgggggcgcgtgaggccgacctcttctgcgatgcggacagcagaggtgtcatgcttatgggtgtcgagatagaggagcacggtcgcattgccctgcgaaaggcagcgcagcagcggtatcgagatgcggtagaggctctcgaatgtctcgaggcaggcctttgccgcttcggctccgctgtcttcggaaggcgcattctctgattggtctgcgcgcagtgcttctgcctttgcagacagttcatcagcatgcaggaccttggaagcaaccgattcgatggaagacgtgccgctgtatctcatgtaaacctctttagcggaaactgggcagagtgccatttggaactccgtatcataatagggcagagatattgaacgaaaaccgtgttttttgcagtgagtgcattatttggcactttgtttcggcaaacgtgctttcggtgtgcccaaggtgcatggaccatctacgtttcatccctatttccgatagggtgcatccctttttcagcgccattctccgtgctaccatgcgctcaaggtagaggcgcggacagatgatgcccaggcgagccggcaggcaaagaccttgggcggaggcggaatccgccgaacctcctcggcaggcatgtcgaaggggtgggccccgcgggaatacggcggggactgtctgcgggaatgcctgcaggagcgctatgtcatgtggccgaggtcgccagcaaagtgctctttgctggcgattgctgtattgggcaggatttatggaaaggaagaccgcatggatcttcggaagctcaccggctccatcgtcgctcttgtcacgccgttcaatgaggacggctccatcgattacgcttcgctcgacaagattctcgaattccaggtcacgaatgggacggatggcatcctcgtgctcggcacctcgggcgagtcggcgaccatgacagacgcagaggatatcgccgtcgcgaagttcgcggtcgagcatgtcggaggtgcggtgcctatcttcggcggcgcaggatcgaactgcacgcgcgagagctacaacaagtcgctcgagctcgagaaggtcggcgtcgatggcctcctcgtcatcaccccgtactacaacaagtcgaatgaagaaggcatctaccagcacttcaagaccgtgctcgatgcaatcgatgtgccggccatcctctacaatgtgccctcccgtaccggctgctccatcagcgtgaagaacctcgagcgcctctcgaagcatccgcgtgcccttgctatcaaggaggcgtcgggctccatcggctatgcgaccgagatcgcgcactgcctgggacctgacttcggcatgttctccggcaacgacgatatggtcctgccgctcatgagcctcggtgcccgcggcgtcatctccgtctgggccaacgtcatgcccaaggaagtgcacgagatgtgcaagaactaccttgctggcaacatcgaggaggccaggaagacccagcttgcctgcctcgacctcatccatgccctgttctgcgaagtgaacccgattcccgtgaagcaggccatggcagacatggggctgctccaggcgaactaccgcctgccgctctggccgatgacagacgaagaccatgcaaggcttcgccgtgcgatggagggagtgggtcttcttggctaaggcagtactgatcggcacggggcgcatgggtaccgtgctcgaaggcctcattgccgagcgtgaaggattcgagctcgtgggcaaggtcggcttcgagaacagggaagacctgcccgatagcctgcctctcgccgatgtcgcgatcgacttctctgcaccggcgctcacagccgatctctgcacctatgccaggaactgcggctgtgccgtcgtctcgggcacgacgggcctgggggagcaggagctctcgcttctcgaggagctcgggaagtctgtcccggtcgtccattcaggcaactactctctgggtgtcgccgtgctccgccgccttgtcgctgaggcagcgagtgcgcttcctggctgggatatcgagatagaggagacgcaccacaagaagaaggtcgatgctccgtccggaacggcgaagatgctcatcgaagcggcagaccctgaaggcgcgtgctcgcttgtctatgggcgcgaaggcatcgtgggcgagaggcctcaacgtgagatcggtgtccatagccttcgtggcggcactgtggccggtacccacgaggtgcatttcttcggcacggacgaagagctcgtgctcacgcatcgtgcccagagccgccagatctttgccgagggcgcgcttgccgcagcggagaagctccttgcaaaggagcccggcttctattccttcgaagatctcatgttcgcatagcatatttcccgatatcagcaggagccgccgttcgccgatgggcgagcggcggcattttcgatatttcggcgattccaatctcgtgaatcgcagcatctggacaggaaatgcccagaaagacacatctgcgttcagaatgcgggaacagaatatgcgcaatattgcgaattttcatgtacgcgatttggggcacgattggtctgaccctgtacacggcagcttggaaaggactgtttcatggtcaatcgtttcgtgctcaacaccatctcctatcacggcgctggcgctatcaaggagattccgggcgagatttcccgtcgcggctacaagaaggccttcgtctgctccgatcccgacctcgtgaagttcggcgtgacctccaaggtcaccgacctgctcgatgaggccaagattccctggagcctctattccgagatcaagccgaacccgaccatccagaacgtccaggacggcgttgccgcctacaaggcttccggcgctgacatgatcgtcacgatcggcggcggctcctccatggataccgccaaggccatcggcgtcatcgtcgagaaccctgagttcgccgatgtccgctccctcgagggcgtcgctccgacgaagaagcatgccgtgttcacgatcgcagtcccgacgacggcaggcactgcggccgaggtcacgatcaactacgtgatcaccgacccggagaaggtccgcaagttcgtctgcgtcgacacgaacgatatccctgaggtcgctgtcgtcgaccccgagatgatggcttcgatgccggcaggcctcacggctgccacgggcatggacgcactcacccatgctatcgaaggctacacgacgaagggcgcctgggagctctccgacatgttccactacaaggccatccagctcatctcccagaacctccgcgatgcctacgccgaggccaagagcggcaagcccgcatccggccgcgagggcatggcgcttggccagtacatcgccggcatgggcttctccaacgtcggcctcggcatcgaccactcgatggcacacacgctctctgcgcactatgacacgccgcacggcgtcgcctgcgcaatgctgctcccgatcgcgatggagttcaacaagccggtcgtcacgaagcgcctcgctgaggtcgctgtcgctatgggcgtcgacaccaaggggatgacggacgacgaggcagcagatgccgccatcgccgctgtccgcaagctctccgaggatgtcagcatcccgaagacgtgcaagggcctcgtcgaggaggacctcgaccagctcgcaaaggatgccctcgccgatgcctgctatccgggcaacccgcgcgaggccacgccggagcaggtcaaggacatgttccgcaagatcatggcataaggattcagccggaaaccgaaatgctgcatgtgcgcccttccggaatttccggaggggcgctttcttctgctacgatgctctgaagcaccggatgcggatgggggagctatggggacgatcgatgactatcttctgtggcggggagacctctcctttgcggagcgtcccttcaacgactgcgacaatgtcatctgctcctgcatctcctacctcgaccttgcctcgttcgtgccgaaggagggggaggctggctctgcttctgtgcatgatgccctccgcggccttcttgcagcgtcgggcggtgacatctcgccctatgtgcggtcgatggcaaacatcacggctgagacgctcgagcttctggcagaatcccgccgcttcgggcctcttgccctccacgatatggtcgatgtcttcgtgccggagcgcttggtccaggcatcggcggtcacgatcgatgtcacgccgcacgagagctatgtgtccttccgcggcacggactcgacgcttgtgggatggcaggaggacttcatgctgagcttcactgtcacggaagcgcaggagatctctgcagaatatcttgcacgcatggcgagatgggcccagaagaagggcaggcgcctctatgtgggcggccactcgaagggcgggaacctggcttcctatgccgcatcgatgctgccatccgaccttgcgcctgaagtcctcttctgctggagcaacgatggccccggcatggatgcagaggtctcgccgaagagcgcctgggatgtgctcggacaccggttcctgcggattcagccgacctactccatcgtgggcgagctcttcgacaggcccgaggagccgcgcatctatgtgaagagcacggcgcagggcgccctccagcacgatccgacctcctgggagatggggccttcaggcatggtcgcagcagaagaccttctgccccaatgcaaggtcacgaaccagatatttgcggactggatcgcctcggtcccgaaagaccagcgccgctccttcacggaggagctcttccgcgtgcttgctgcaggaggagctgagaccttggatgaagtgacggcgacgcctgatggcatccagaaggtcgtgcaggcactggccggatcgagccctgccacgaaggatgccatcatgaagcttgtggcatcgacggtcacaaacacgatgtcctatgcccgccacgccgcaagccgtgctgtggaggcagccgccttgaacgcggcaaagcttgcctcgcagctgccacagggacgtctacgcgatgacggcattcaggatggcagagacgacagagatcacgagggcgccccagaaggcagcgccgaagctcgtgcaatagatgccaaggccgaaggccgagactgagagccagcttgcaatctcgagcgcgacggcgttcacgacaagcgagaacacgccgagcgagattatcgtcaggggcagcgacagcaccttcatgatgggcttgatcgtcgcgttcacgagggcgagcgcgagcgctgcgaagatggcgctcttcacggtatcgcccagaggcacgatgccgggcacgagatagatggcaagggcgatggcaagggcacagacgaaccagctcttgagaaaatgcatgggagacgctcctttcctctttcctcgagtctacccgagaaggctgcctgtcttctgaagcgctttcctgtttcgcttcctcagagctcttcccatcctttcttcacagctgctactttagtgtgctaaagtagacggacgtcgtccggagggagagacatgggcaccgatatgggaagagcaggggagaccgaacgtctcatggaggcattctgcctgctcgagactcctgacgaggcacgtgcgttccttctcgaccttctgagcaagcgcgagatccaggatctcgcccagcgcctcgagatggcgcgccttctggattccggatcgtcgtataacgccgtgtctgaggcgacgggcgcctcgtcgacgaccgtgagcagggtctcgaaatgcctcaatggccctgaagggggctataggctcgtgctgggacgcctcaagggcaaggggttcgcctaggccaggcattgctgtcgcctccgcgcgctaccatagatggggacaccggaagcaaggagcagcaatgggaatgcatatcgtgcatacgcacgcagagggcgtcgtgtcggcagacgtcgtggcagcgcttcacgaggccagcagcaagggcgcagctgtccttgtcgtgccctcattcgaggcacagattgcagcgcagaagcagcttgcaggcctttccgacccagcccttttcggcatctcggtcacgacgctctccgcgtggatcaaggagcgctgggatgtgtggggagacggcagacacctcgtcgagaagccggtccgcacgatcgcaatcgagcgggtgctcctcgatgctggccaggcagagccgcttccgggcatgctgcgcctgctctcgtccttggcagaagaggcgctgccctggcttccgctcatgccgaacagcaaggtcgatgaattccgggcaaagcagtatggccttacggctgccgaagcctctgcaatagggcttgtcggcgcctacgcagacatgatccatgggcttggctatatagagcctgcagaggcttcagccgagatcgtccctgcgatggagcgtgcaggagcacaggtgcccgcgctcgtcgtgagcggcatctcgaagctgggacgcagccagcgcgagcttctggcggcagctgcacgtgtatccgacgtctggttcattggcaccgagcgcaatgcggaggcagaccgcgggctcaggagcctcgaggaagagcttcttgcccttgcgggcgacaatcatgtcgcatgcgaggagacggagcccgaagcaccggagtccacggcacgagccgaggagctctcgaagctcagacgcgccctcttcacggaggcagagacgatgcatggcaccggcgctgtctttctggccgagccggaagggcccctggccgaggcagagcatctggctgcaacgatctgccgtcttgctgatgcaggcgagaagaagattgtcgtttccacgcccgatcccgagcgtgcctggcgtgagcttgcgccgaagcttgcttgccgccatatcgccgtctcggccaggcttgagcgccctcttgcgaagaccgaggcgggacatgccttcatctcctatgcggagacggtagcagagctcgccgagcttgcaaagacgtggcccaagcctgagacgctcgaggatgggacggagcgcattcgcctcggcgacatgtcctggtggccgccccggggcctcacggatttcctgctctccgatatcagccacatcacgacggggaaggcacagacgctcgacgcaaagtggaggtctgacaggctccttgtaccggaagacgtgcttgcgacgctccagaacgagcgcgaggtcggcgcttcctgtgcccgtgccactcaggagcttctgcgcggccgcattggcacggcagcacagaggctgctcacgccctatatcgcaggtatcgagacgcctgacgatcttttcgtggatgaagaccgggacatcagcatacgcacggagaggctctccgacacgctttccgacactttcgaggcaggcacgctcgaaggcatcctctcgcttgcggggaccttgaaggagcttggcatctcggccgacccgaaggcagagcatccggtatcgctcaggctcgtcgtggccctgatgaagcaggccatgggggagaaggcgcttgtgacgaggcctgcctggagcgagaaggacgcccttgcccaggtgcgcatcgcgtctcagtccgaggtggcaggcatggagccctgctcggcagatgccctcatcttttgcggacagacatcgcaggaaagcagcatcggcaccggcgatgatgtgctctctgctctgctcgagcgctgcggcatcgagccggcacccgaccccatggaggatgcacgtgcccggttcgtctcggccatctcggtgccccgccatctccttgtgatggagcgcgtcagaaacgatgcagacgcaaaggagagctacccttcggtcatgctgacagagctgctctctgtctatggatttgacgacggcaagaaggccaaggcggggaaactctgggaagaccgtgcccgtgaagcaggagtcggtgcctcgtctgcagacgagcagcatatcgtggaagagaccatgcctgaaggcagggcccccaggcaggccgccgcagaagagattgtgcctgcaggcacaatcagcgaggcatcgaagcatgccatcgtcgtgccgccccctggcaggatcgacctgccggatggcaagccgctcctttctgccacccagatcgagacctatctcgagtgcccgctcaagtggttcagcctgagaaggctcaagctcgagaaccaggatgccggattcagcggcatggagatcggcacgttcgtccacggcgtgcttgagagcctgcacaaaaagatgctcgatgatgcgctggagcgcgcgggcatgagcgaagaggatctcaaagctgtgtcttgggcttctcttccagattcacgcgtcgatgtggagcgcaaccccgagcgcatggactttgcccttgcgcttgcggacaagatcttcgacgagaggctcgaaagccagtatgtcaggaagcatgagcggcagccgctcataccgcataccgaagcggacctggggacgattcgtcggatcaggcacgatatcgagaccttcatcgggtatgaggcagggctcttcgatggcttcgagccgcgccacttcgagtgggatttcggcagcagggacaatgcagtcgagtatgctggcgcctatatcacgggtacgatcgaccgcgtggatgtcgacggacatggcctggcctgcgtgatcgactacaagcagaagtctgcaacgggcttcgcaaaggagtatgcggtcttcccgaacggggcgcctgcgtcgggtgcaggcttcgtgctgccgaggcgtgtgcagtcgctcatctatgggcaggtcgtgcggcgccggcatccggatctcaaggtggtggctgctgtctatctctcgacacaggacccccatgcggtctctggcgcggtctcggcaaacctcgcagaccgcatcttctggaagcatgctcccgcgaagcgcacgctcgagacgatggccgtgagcgaccaggagagcttcggcacggatggacggggcatggatgccgtgctcgatgcgacagaggagcttgtcagacagaagattgcggagctcatggcaggaaatatcgaggcggctccgtgcgacgccgaagcgtgcatgtattgcccggtgcttggatgcgaaaagaggcttggatgacggcgaaggtcgatatctcgaaactgaatcccgaccagaggcatatcgtcaagaagctcgacgagccgctcttcgtcgaggctggtgccggttccggcaagacgttcacgctgacgcagcgcattgcctgggccctggcgccagggtcgggcaaggacggcaagcccttcctcgacgatctctcgcaggcgctcgtgattacgttcacgaatgtcgctgcccgcgagatcaaggagcgtgtgcgtgcaaagctcaggagctccggcatgaacgagcatgcgctcgaggtcgactctgcctggatatctacgattcacggcatgtgcaagaggatcctgacccgccatgccctggatctcggcatcgacccagcgttccgcgtcgcttctggcaacgagacagaccaatatctgaacgaagccctcgaggaagtcatgggggaggagcggcagtcgggagatcctgccatgaaggaactcctctccgcctacaggctgggttcgcggaatgaatcgggcagctataccggcatcatgggccttgtcctctcggcgaggcaggctgccattgcggcgccgggcggcttcaaggacctcttcgtgcctgaagcggcagattccaatgaggtgatggaacgcttcatttctgcttacggatctctcttgagcagcgatgtgaagctctcggcaaagagctccgataaggtcaaagcgacaatggagctgctcgatgaatacaagaatctggccccaggagcaaggacaccggagaagactctcgagattctgggccaggtgcagtggcctggatcgtccaagaactacaagaccatactcgacgacgcaaaggatgcgaaggagcatgccgaggaggagctcctgcttgcccagtcccgcagcacgaccgagaccctgatcgctcttgcgaagaaggtggacgagcgctacttcgaaaagaagaaggcacattcgctgctcgacaatgacgacctcgtgacgcttgcgcttcgggcgctcgaagagaacgaggaggtgcggcgcgactatgccaaccgcttccgccttgtgatggtcgacgagttccaggatacagatgagaagcagcttcgcttgatcagcctgctttcgggcgaaggtgcccgccatcttgctacggtcggtgacgcacagcagtccatctaccgcttccgcggtgccgatgtctcggtcttccatgggaggggaaagggacttcccgacaaggagaagatccgtcttgcaatcaactaccgcagccacagagacatcctctcgtttgtggatgcagtctgcggaggcaagggaggcaggaagggagtccttgaccacttcatgcatctcgacccggcagaagagcatacgggcacctacgatacacctcagatcccccgtatcgatatcgagatctgcgaggatacttcgcggccttcgaaggcgcaggctgccgtcgaggcggccatgatcgcgaagcggttccgcgcgatggccgatgccggtgcgaatccgggcgacatggtgctgcttctgaggggaatgacgaacgcagcgtactacatcgatgccatccgcaaggaagggctctcctgcatcgtctctggcggctccggcttcacgaagacggcagaggctgccatcctgcaggcgctcctgcactaccttgcgaacagccgggatacggaaagcggcctcttcccgctcctgtcgtctgcagtcttcggcatccccgcagatgatttcgtgcagcttgccacgacgacgcagaagaaggcagatctcccgacgaagcgctcgatcgagaacggcttcgtgaccatgcagttcagaggaggctacgagccgacggcgcgtctcgcgcgtgcccacgagatcctcgtgcgtgcccgccagattgcgaagcgccacaatatcgcagatgcctgcacctatgtcgtgcgggaatcgggctggctcacacggctttcctcccagggcgcccagggcgaggcagtctgtgccaatgtgcttgccggacttcgctatatccgcgggctcgtcgaggatctggggcttggaagctcccgtgcagcctgggaatacgaccggtggctccaggtctcgaagattccgccagcttccctttccggaggcaaacagggtgccgtgaggatcatgaccgtgcacgcctcgaagggagccgagttcaagattgtcgccgtggcagagtgctgggcaaacccgacggcggagtccttctgctcgggctccgtcccgggccgtggtcgtgctgtcatcgtcccgcccgaaggcttctcctatacgccgccccaagaggtgccagaaaatcccgagacgctcggcgagtggtatgagcacctgagggacgagaacacttccgccgatgctgcagagctgacccgccttctctacgttgcgctcacgcgtgccgaggaagctctgatcctgggcattgcacccgtcaggagcgcaagcaagagcacgccgaccaaggccacaaggccccagaacgagcttgctgccaaggtgatgggagcgctcttcggcgatgcgacgcccgagccgggcgagcaccggatagagtatggcggaacggagcctgcgctcgtgcatgtggcaaagctcgcaacccaggaagtggaaagacagaaggtcaaggtgctcgatgccggaggattgctaggcgagctcgaaggcgctcttccggatgacccccgcctgcttgtcgctcccgaagaggagccgcagacctcatttgcggtcttcgaggagagcagggatgtgctggcggaagagacccgcatgcagacctcgcgcgagggcatcttctcctactcgtctgtccatgagaagatggctgagatggtcgacatgccggacttcgagggagaggcgcggccgaagcggggagggcatgtgctcccgacccgcgccgagcgcgatgcgatgcaggaaggggcgcctgtcgtcgccgatgcggacaaggcgacaaacctcggctctgccttccatctccttgcccagagcatggcagagacgggctctttcccggatgcagaaaggattgcagcgcaggagcaggtctggcgtctcagtcccagggcggcttcgaggctcgaagaggcgctttcacgctggagcggttcttccgtgaggcatgaggcgctctcccatgtccatgtccaggcggaggtgccgttcttttcgaaggcacatgaagagaagcttgggcgctatgcagaaggcgccttcgaccttctcgcctggaacgacagaagcgaagcgttcctcgtcgactacaagacaggtgatgtggggctcacgtccgaagagatcttccagaggcatttcctccaggcggatctctatgcccgtgtcctcatggatcagggcttcgggaaggtatcctgccgcttcgtctgtgtggagctcgaggatgcagaccaccctggcgagcccttcgtggtcgcgtacgactatgatgcagagcacacaccggccctttggtagtacagacgttccagagcattctgctatgctggaaggagggcttcccgccttccagcaattcctatgaggagagatagatggcattcgtacatcttcataaccactcggacttctcgcttctcgacggcgcgacacgcataccggccatggtgaagagggccgtagatctcgatatgccggctgtggcgctcacggaccatggctacatgttcggcatcccgaacctcgacctcgagtgccgctcctacaacgacgcccaggagaacatgaagcagtggcgccatgatatggaatgcttcaagaagggctgggagcttgacgagccccagaactcctctcccgatgtcggctacttcgacgatgtccacgcccagtgggcctccgatgtcgctgtctgggaaagctcggaccatgacctgaaggcggtcgaggcgaaccgtccgcgcctcaagatcaagccgatcttcggctgcgaggcctatttcatcaccgatgactgcatcccgcgcggcacgaagcagcgccgctaccacctgatcctgctcgcaaagaacgagacgggctatgtcaacctcatcaagtgcatgtcgaaggcggcaggccacgagatgatgtactacaagccgaggacgacgctcgggatgctcgaggagtaccacgagggcctcatctgccagagcgcctgcgtgcagggcatcatccagcagaggatcctggacggcgagttcgaggatgcaatgcattgggccaaggaattcaagcgcgtcttcggcgacgacttctatatggagattcaagatcacggcctgaagttcaggaatggctgggatgaccgcaagctcgacgagcgtctcgtgaagattgcccacgagctcggcatcaaggtcgtctgcacaaacgacttccactacctgacccgcgaggatgcaaagacccaggacctcctgtcctgcatcggcaagaacacgaccgtgaacgacacgacgcgcatgcgcatggagggcacggagttctatatgaagaccgaggaggagatgcgcgagctcttctcctggtgtcctgaagcatgcgacacgacgctcgagattgccgacaagtgcaacttcgagctcgactggagctcgatgtacctgccggagttcccaggcctcaagccgggagagacggcagaggagcgcttccgcgccgagtgcgagaagggccttgcccgccgctatggaccggactggaagaacgtgacgatcaacggcatcaacgtcgaggaccgctacgagcatgaggccggcatcatcatcggcaagggcttcgcaaactacttcctgatcgtccaggactatgtccagtgggcaaaggacaacggcatcggcgtaggaccgggccgtggctctgctgctggcgctatcgtcgcctacgcaatgaacatcacgaacttcgatccgctcgagaacggcctcatgttcgagaggttcctgtccccgcagcgtaccgagatgcccgatatcgatatggacttcgacgatgagcacctccaggacgtcctgcagcatgtgcgtgacgtctacggcgaggaccgcgtctgcaaggtcatcacctattcgcagatcaaggcgaagcaggccatcaacgatgcgaaccgcgttctgggcttcccggtctacatgggccagaagctctcgaagatgctttcgaacgacccgaagctcacgctcaagaatgccctccacaagaacgatgcgaagcctgaccagtactctcccgacttcgaggaggtctacaacaaggacccggatgcaaaggccatcatcgatgctgccatgtccatcgagggctacatgcgcggcgagggcgtccatgcctgcgccacgctgatcgcaccgacccccgtcacggaccacgtcccgacgaagctcgatacgaagggcaacgtcacgatcacgcagtacgagggccactcggtcgcagacatgggccttctcaagatggacttcctgggacttcgtaccctcacggtcatcaacaaggcgctcgcgaacatccgcgcgagctatcccacaaaggaagatatcgagaagatgcccgagaccgtcaggaagacgatcaagccgggggcagagtgcgtcgatatcgatgtggacaagatcgacttctccgatcctgccatctacaagctcatgggcgacggccgcacagctggcgtcttccaggtcgagtctgccggcatgacggcaacgatcaagaacatgcagccgcgcgagtacaagcagatcgtcgctctcatcgccctctaccgcccaggcccgctcggcgccggcatggtcacaagctacatcaaccgcatgaacggcaaggagccggtcgtcttctacgatgaccgcctctccgacatcctggacgagacctacggcacgatggtctaccaggagcaggtcatgcagatctcgatgaagatgtgcggcttcacgccaggcgagtccgactcccgtatccgcaagcctgtggccaagaagaagatcaagatgctcacgagccagatcttccactgggaaggcaatggcgcggatgagacgatctacgaccactggatgaacggcgctgtcgcgaatggctacaagaaggagacggcccagcgcatctgggacgatgtcctcgagttcgcttcctacgccttcaacaagagccactctgccggctatgccatcctcgtcatgcagacggcctggctcaaggcccatttcccgcgcgagtacatggcatcggtcctcacgtcctacatgggcaagacggacaagatcgtccactacgtgaactcctgcaggcatgagggcatcaagatcctgccgcctgacatcaacgagtccggccgcgacttcacggccacgcatgagggcatccgcttcggctttgccggcatccgcggcgtcggcgagtcggtcggcgaggccatcatggcagagcgcgagaagggcggccccttcaagacgctccatgacttcgtggaccgtgtcgactcctcgcaggcaaaccgccgcgtcgtcgaggcgctgatcaagagcggtgccttcgactcgacgggctacacgaggcgccagctcatgcacttcgtggacaagaacaatcccttgaacatcatcgactctgccgcaaagcgccagagggaccgcgccgctggccagtcctcgttcttcgacatgttctcggaggttgagggctctggcttcgaggatgaggtgccggcgcctgatggcatcgagtgggaccgccgcacgaagcttgcccaggaatacgaagtcctcggcatctatgtctccgaccatccgctgcgcccgtacgagtacgcgctctcgaaggcacgcgactacaagatttccgacctcgaagtctccgaagaggtcacgaacagctataccggcgccacctcgacgcgctacctcgtcgaggaaggcaagtcaatccgccttgccggcatggtgacagccgcgcagaagaagacgacgaagaccggcaagtccatggcgatcgtgacgcttgccgacatggaggcagagaccaccatcgtcatcttcccgaagctcttcgaggagtgcgcagaggccctgcgaggagaggtcgacgaggagacaggcgagaccgtcggcgatgtcttcatccaggtgcgcggcaagctcgagcgctccgatagaggcgaccaggtcattgcccagagcgtagagccgctcatcctgaacgatgcgacgaaccgtccgaaggtgctcgaggtgaacctgccgaactcgatgctctcgcgcggccacatggagacgctcgactcgatgcttgtccgctatcccggcctcgaccatgtggagctcagggtggaggcagcgacaggcgacatgctctgcttcgagcttccctgcaaggtcgatgcacacaacatggtgcttctcgcggaagtctcagattttcttggacatgacggaaaagtgatagtagcttagtagaaaataggatatactcctgtttagaagcccggaaaggcgggaacaaagagactaagtcacgtcccacaagagaggggatacatcatgagtgaagtcacgttctatcgctgcaacaagtgcggcaacctggtcgctgtcgtcaatgagggtgcctgcacaccccagtgctgcggccagccgatggagaagctcgttgctggctccaccgatgctgccaccgagaagcatgttccggtcgcagtacgtgagggcgcagatgtgaaggtcaccgtcggctctgtcgagcacccgatgctcgaggagcactcgatccagtggatcgctcttgcccagggcgaccgtgtcgagatccatcacctgcatccgggcgagaagccggagacggtcttcgcttccgtggcagagggcccggcgacggtctacgagtactgcaacctccacggcctttggaagtgcgagctctaagcgctactattctggcaagacctttgtttcgagcagtatgggcccgggcgcaaggcgcccgggccttttttctttggatggtgcacatgaagattgccatagcccagatgtcttcggtggcgggcgatttcgaggtgacggccaagcgcatggccgaaagcgcgaagaaggcagccgatgcaggtgcccgcctcgtcgtctttccgtatgccgtgctgacaggcccctctcctgtcgaggagagcgatatcgaggcctatgtgggggatgcggcagagacgctgcgccgtctggccgacgatattccctgtgctgcgatcgtgccggtcgtggcaggaaccggcaccggtcttgccgccgaagccttcctgatagacggtggggagcttgtgcctctgcgcatgggtgccatgacggcatcgatgggcgcgcttgccagctcggggcagcttccccaggcaggcagcatgccggcaccggatcttcccgagttcgagctcgacggcacgcatatcggcgtcgccttcacctacgacgatctcgacgactaccgcgactacgacttctcgctcgatgtcctgctctaccttccgcaggatggctatgttgccagagatcccgactcggcgctttcgctctctcttgcggagaaccgctttgcaaaggatgcagaagagatcggctgctggcttgcctgcgccgactctgtcggcggctatgggcctcagctctttgccggcggaagcttcgtgctcgatgcagaagggcgtctccaggcgaaggcaccgcttctcgaggagagccttcttgtcttcgatacggaagacaaggctgaagggatgcctgcggcagagcttccgcatccgggcatccgggagaagagccatgtgctctgggggcttctcgtgcgtggacttgccgatcttgtccatgcagaaggggaggacaaggtcgcgctggcgctcgacggaagccttgcctcagggcttctcgctgcgcttgcctgcgatgctttgggcccccgcaaggtcgaggccctcgtcgtggacggaagctcagctgccgcagagcttgcagaccggctccacatcgagacaaggatgcctgatttccgcctgcccgtgccgcagccgggtgcctgggccacggagtcgcctctgctcctcaagggtgtcgaggcagccttcctggcggagcttgcccgccaggagcatgcgcttgtgctcgtgccagacgacaagacaggcctggcgctcggagaggagcgtatgggcgtctccggcaaggccgcccttcggcgacatctggaggtcccagctcctcgatctggccgaggacaggatgcgtgtctccggtgcttccggacgggtgctcagcgcctacgctgtgcctgacatcttcggcatctcccagagcgcgcgaccgacaagggcaggctcgaggcgcttgacgcatgcttgcgcacgcatcgggatatgcatgatatggcagcgcttctcgatgagggctatcctgctgtttcgtgaaggcagcgctccatcgcctccatgatgtgcactcacgcgccagatgcttccgccctgcttcgaggtctcgaacgcacgctttccgagcttgagactcccgtcggcgttgcctgggtggaccatgagcgcgaagggggaggagccgagaacctcgaggatatcgtgcatgagctcgaggcgcatgctccagggccagaaggcaggggctctcccgcctcaggactcagatgccctcgccgatgccttcgagctcatccgcgagctctcgaacacgccgggtccgaaagaggtgccgggcatgccggaaggcacggagcaggatggcttcacgatccgccctggcttcccgtcgtggggggcagccgttctcggagaactgatatcttctgtgcgctcctgtgccgtgtgctgcaacatgccggtctgtgctaccatggtatgagtcagaacggttgttcgggggttaccatggtcatcatcggcatcgatcccggctgcgcatacgggctggggcatcattgagacaaggggcacggtctgccgtgcccgtgcctatggtgcatcaagacgggggcagacgagcgctccgagaggctgggccgcatctaccaggacgtgaacgacgcgatcatccagttcgagcccaccgagcttgctatcgagaagacttcttcgcagagaacagccgctcggccatagcgacagcgcatgcaagaggggcggcacttgtcgctgcggcagagaaggggctcaaggtcggcgagtacacgccgatgcagatcaagcaggctgtcgtcggcaccggtgccgccgacaagcatcaggtgatattcatggtgaggcggtgcttgcgctcgatcatgacccgcaccccgaccactgcgccgatgcgcttgcgctgccatctgcctggaatctgaggcgcacgcaggacatttcccgctatgcgaacggcaaccagaggacggcagcgctcgtgcgcgaggggagagcgccagaaggagcagaggcgccgggagaagcatgaggagacggcggcagcaacggctgcccgcctcgagaagatggcacgggaaagggcttcaagatgatcgtgcagctgacaggaacgcttgtggagtgctgcggagagtggtggcttcgcggtgtcggctatgagctcggcatatcggcaaacacggcagcgtcgccttcccaggcagggaggcggggcgtgaagcttctgacccgcatgatcgtctcccaggatgcagttcggctctatggattcgcgacgaaggaggagcgcgcgctcttcgaacggctggtccaggtcgcaggcgtggggcctcgccttgcgctctccgttctctcgacattcacgccgcaggctctatgccgtggtcgcagcagacgatgcagcgggatggcgcgcgtgccggtgtcggcaagaagacggcgcaccgcctcatcctggagctccagggcgtctttgcgaaggatccgtcctcatgggcttgccggcaaggctgccaccgaggttcccgctggcaatgcgcctctgccgcttgtggagtctccttccgaggggttgcgcaggcgcttctctccatgggatttaccccgaaggaggcagagcttgcgctcaagggcgcagacgaggcgggagctgtgaccgtcgaggcagcgctcagctatgcgctgaaggtctgggagggtggcatctaggatttggcaggccaagcaggacgaatcttcgaggacatggcgcggccaggacatgcccgccaggtctcgggagagctcacggaagacgatatcgaggtcgaccgcacgctcaggccccgcacgctcgatgactatattggccaggagctgtgcgcgacaacctccgtgtcctcatcgaggcagcgaagaagcgcggcgaaccgctcgaccatgtgatcttctcgggccctcgggacttggcaagacgacgctcgcgaacgtgctggcaaagagatgggtgccaagatgcatacgacgagcggccctgccatcgaacgcaacggcgatctcgcggcaaaacttacaaatctcgagccaggcgatgtgctttcgtcgacgagatacaccgcctgaaccatcaggtggaggaggtcctcatcctgccatggaggatttcttcctcgatatcgtgatcggcaagggccctgcagcccgctcgatccgtctcgatattccgaagttcacgcttgtcggcgccacgacgaggacgggccttctgacagggcctctccgcgaccgcttcggcatctcctaccgtctcgactactacacagattcccgagctcacgcgcatcgtcgtacgctctgccggcacctgggtgtcgggatcgacgaggagggtggcaggagatcgcgtcgaggagccgcggcacgccgcgccttgcgaacaggctctgaagcgcgtgcgcgactatgctcaggtgaagagcgatggcacgattacggaaaaggttgcccgcgaggcgctctcgttcttcgagatcgacgagctcggcctcgactggatggacgtgaagatcctgacagcgcttgcagcacgttccgcggacgtccggtggctcacgacgatcgcgagtgccgtcagcgaagatccctcgaccatcgaggacgtctacgagccgtatttgctacagtgtggttgtgatccgaacccccagggaaggaaagcgacccgtgcggcccgagcacctcggactcattccgcctaccgacgcataggagcgattcatgctgcaacgcgactatatcatgatgctcatcacccagttcgtcgacgccgtcacggacccgctgctccacgcagcagcgcatcaggacctgaaatcgatccacgaggcagaacatgccgttggcgacctcctgcagctcgatcccgagacggcgctcatgctgacgcctgaatcgctcgtcacgatgatggatctctccggcatcggcgatacggttgcaggatatgctgcctacgtgctgaacaagctcgcctcgctctatgagaggcgcggagatgacaagacgtccgagttgaggcttgcccaggcgcgtgccgttgctgtggcattcggctgggacctctcgaacataccggacgagcttgccgacctcgacaagcagcttgcatagatgtggatattccctgccgttcatgggctgcattcaggcgctagccgcacctgttcagccattggcagactttgttcctggaattgctgccacttctctcacagaagccctagagtgatggcgcgggcgcgcggtggaaggagcggacatggcatgctatgcactctctgacatacatggcagactgaagacgctcgaccgcctcctcgagaaggtctcgcctgccgaagacgacgagatctacatcctgggcgacatggtcgacagaggacctgactctgtcgaggtcatgaagctctgccggaacctgccgaatgcgacggtccttcttggcaaccatgagcagctcatgctcgacttcttccacaatccgcaggatcaggaggcgcttctgaactgggccatcaatggcggcgtcccgactgcccgggggctcatgaagatgaaggcggacgcacgccacgatttgctcgactgggcggcaggcctggcgcgctggatcgtgaagaccgttgccggaaggacgtacgtgctcgtgcatgccggcctgcggacagagaagctcgctgccgatgcagcggaccatatctccgcagcgcttgcggcgcaggatgcggatgaccttgtctggatccgcgaagggtatctcgaccggccgaccggccttctcgatgcaaagggcgaaggccccgtcatcgtcggcggacatacgccgacagcgcttgcagaaacgcttgccgatgtggcagacagaagtgccctgaacgacgatggcagatgccagatgctctcgcttggcgcgacggaggcgacaggcggcgttgccgaccgtcttgttatcgactgcggggcggggtcggtgcctgaccatggcaggctctgcatgctgaggctcgacgaccggaaagagttctacgaggacgtgcttgatggagactgagacgatcgtccatcctctgaaaccgattctgccggcagacgcccgcgtcctcatcctggggagccttccgagccccaagtcccgtgaagccggcatgtactatgcaaatccgcagaaccgcttctggcctgtcatggcagggctctgggaagaggacgagccgctcacgaacgaagagcgcattgccttctgtgctgcgcaccatatcgccctctgggacgtgatccatcgctgccgcatacagggtgcctctgatgcaagcatcaccgacgtcgtgccgaacgatatagcgaagcttctttcaggaacctcgatcggatgtgtcttcacgacgggcacgagagcgcatgcgctctaccggcgctatgtggagaaggcagcagggatctctgcccatgtcctgccttcgacgagccctgcaaatgcccggatgcgcctccccgatctgcttttggcttaccgtcctgtccgcgaagctgcagatggcggaaaagcccgctaagatggagcaatagtaggatttgcgccatatcgcggcacgaggggtcagctccatgggtctcaaagacatgctcacatcagaggatacgcgccggctcctcatcgaggcgccggcagcacgcttcctccatggagcgctccgcacggaagaggaggcagcgggcctcacccgtccctggcgcatgagcgaggcgggcatgcgcgcgctcggcagctgcgtggcatggcatccggggctctacaagcagatgggaaagacctctgcaggcatggtgctgcgtctccgcacgaactcgctcgagattgcgctcgagcttgtgtgggatgaggagccttccggcacccgggcggtgctcaaggatgtggacggaaaagaccctgctgcctggaaggcacatgacggggtgtcctgcacctgcgatggacgcgagcttgcattccatgaggcaggaaagggcagagaggtcgtcagctggtatctcgatgaggatacgctccatccttcctggcacctgcagcgccttccgggtttcgggccagagcatgaggtggagatatggctgccctgccttcgcggcgtgcgcctgggcaggatctggggcgacggcacgacgctcgagcccattgaggcacgccccttgtgccttgtgattggcgactccatagcccagggcttcgtcgcggaagatccgcggcatgcctgggtggcccagtgggcagagtctcagaacctcgaccttctgaacctgtccgtcggcggccaggtcttcgagccgcagttcttcgagacgctgcccgagggcctcgacgtcgctcaggtcattgtcgggctcggtgcaaactaccgctatgaggcgtacccggaaagcaggctccgcttcgatgtgcgcacgagcctttcggcgctcgcagcgcgctatccggatgccgagacgtatgtcctgacgccgttcccctatagggaggagcgctaccagacgcatccgagaagctgcatggcaaaggttgcccccgtgctcgaagaggagtgtgcccgccactcatacatgaagcttgtggacggctcgcatctctccgatagggctcctcgggccttcgccgacggatgcgaccatccaggagagaagagccaatctacgatctgtcggcgcttcgcgtatctgacgcatcctggcacgcgttctgaggaagagcttgccacggcagcagagaagatccttgcccatgcgccgcgccgtgcctttcccctcatggagcaggcaaagaggggctgccttgcctttctccatgtctcggaaggttcgatccttgcgcggaatgcccaggggaccgagatcctctttgcgcctgatgcagaagaggggaaagatgcgcttgcactccagagccatgcagaccgcctcctgctcctcgagccagaacttgcatcctttgcagcagaagagctcggactcacgaagaagatgccgctccacctcgcggtctacaagggaaggcgccgctgcaaggtggccaagcgctaccatatcgagacgctcagcaaggatgctgcagatgaggtatcagccttcctccatgggaagagcgaacgtgccgatgcggagatcctcgaaagcctttcaggcggcacgcttctcggcggcttcgatggagacgagctggtcggcgtcgtggggcttcgtgcggatggctcgatcggccccctcgaagtgaagccggaatggcgcagacgcggctgggcgtctgccctcgaaggcaggctcgtgaaccgtcttcttgcggaaggcagggtgccctgggcgctcatagcgcccgaaagcaagccgtcgctccgtctccattcagagctcggcttcgaggtgagccctgcagatgagcagtgccttcttctgagagggaacgtctgatctgctggctgatctatactgattcctgacaagagacgagacagcagaaggaggaccgtatggccaggctcctgaatcctttggctccgcaccttgcaggaacgctttcgcccgatgtggaagcaggcgtgaaggctctgcttgcatcgggtgcgcttgcagacggtgcaactcccgacgaggcagcgctcaggcgcgacgcgcgtgctgccgacgaagagtccgtcatgcgcccggcattcctgcgcgatacggaaaagatcatccatatgcctgcctacaacaggctgtccggcaagacccaggtgttctcgttcgcagcaaacgacgatctcacgaggcgcgggctccacgtgcagcttgtggcccgggtcgcccgtgatatcggccgtgccctggggctcaatctcgacctgatcgaggccatggccttgggccacgatcttgggcatacgcccttcgggcatgcaggcgagcacttcctgaacgatgttttccacgagaggagcggcctctggttcatgcacaacgtccagagcgtgcgcgtcctcgatgtgctctacggcaggaacatcgcgctccagacgctcgacggcgccctctgccacaacggcgagttcgtgaaccagcatctgaagacaagcggtcttgcggatttcggagaattcgacaggaggatcgagcgctgctgggcagaagggccggcattcgtgaagacgctgcggccaatgacaaaggaagggtgcgtcgtgcgcctctctgacatcattgcctatgtcggcaaggaccgccaggatgcggtgcgtgccggccttgtcggcgaggatgccttcagggatggccttggcggtggctacaatgcctgggcgctctcggccttcgtcgccgatatcgtgaacgagagcttcggaaagcctgagatttcgatgagcgaggaaggcttccgggagctcgcgcgtgcgaaggaggagaactacgagaagatctaccgcacgcacgaggtggcaggcgacttctcggaggacatccaggagctcttctcagcgctctatgaccatgagctcgaaagcctcgcttcgggagacgagagccgcgcgatcttccatcatcacatcatcccgctcgaggcgcatctggcgcactatggcaggacctatgactggaagagctcgcctgaccagaccgtggcagacttcatcagcgcgatgaccgacgactacttcatagcaacctgcgagcggctcttccctgaggcgagaaggctcttcccgaagcgcagctacttcgactacaagcttcctgtcagggaatgggagggatagcggcgtggacaatctgttcagtgcctatgaacgcgaggcgcgcatgaagcatgcaccgcttgcagtgcgcatgcggcctgagacgctcgaggactatgtcggccagacggaggcggtaggccctggctcgtggctccgtgcggcaatcgagcacgatatgctgacctctgtcatcctctatgggccagcagggaccggaaagaccacccttgcccgcatcatcgcgcatacgacgcacgcggagttcgtcgaggtctcggctgtcacgggaaccgtgaaggacctgaggcgcgagatttcagatgccgagcaccgctggcttgcgcaggggaagcgcacgatcctcttcatcgatgagatccaccgcttcagcaggagccagcaggatgcgctgctccatgctgtcgaggaccgcacggtcgtgcttgtcggcgcaacgacagaaaatccctacttcgaggtgaactcggccctgctctcgcgctcgcgtgtcgtcgagctctctcttctgtccgacgacgatatcaagcagatcgtcgagcgtgcggttgcggcgcctcagggtctcgatgggaagtatgtgctcgatgaggatgcagaagcggagattgtgacgcttgccggcggagatgcgcggtctgcccttacgtcgctcgagcttgcagcgcagcttgcagcgcctgttcctggcaaagaaagcgaaggcaaggcagacgaaggcccttggaagatcacgcgggcactcgtcgaggaggccaatcctcgccatgggcagagctacgacaagtcgggagacgagcattacgacatcatctccgccttcatcaagtcgatgaggggatccgaccctgatgccacggtcttttggctagcccgcatgatcgatgcaggggaggatccgaagttcatcgcgcgccgcatcctgatctgcgcctcggaagatatcggcaatgcagatccgatggcaatatgcgtggcggaggcagcattccgctcggctgaggtcatcggctatccggaatgccggatcaacctctgccaggccgcgctctacaatgcgctcgcccctaagtccaacgcagcagaggcggcaatcgatgctgcgctcaaggaagtgcgggaaggccctgcacgtgccgtgccgtcctatctgcgcgaccgtcaccgtccggggtccgagtcctatggggcctatctctatccgcatgactatccttctggctgggtcgagcagcagtatctgccggatggcctcgagcgtggctgcttcttccagccgagcggcaggggatgggaatcatggcgcatcgagcagacaggacgcgatcgccaggatgcagcttcgcataaggccggcaaaaacggatagaatccagaagagcatgcctccaggggggaggccgaatctttgagtatgtgcgctgagaggaagggagccagcatgagtcttaccgacgtgcttctggccgtgcttgtggcagcaggcatctgggcagtggcggagcttgccatcaccatcaggaaggcccgtaagtccatcgacgaggtgacggcttcggcgaaccacgcaatcgacgagatcgagcccatcatcgcgaaggccgatggcatggtggacgacctgcagccatctgcaaagcaggtcgagccaatcctcgagagcgcacgcgatgcggtcaactccgcaaacgagagcctggccaagatcaatggcatcctggacgatgtctccgaggtgtccggcacggcagcagatgcgacgaatgtggtttcgacgggtgttgcaagggtcgcagcaggagctgcaactgctggtgcccgcattgcatccgccctgggcgcaaagccgagaggcgagcatgctctcgaagagggcgctcctgcagcagagcctgaagatgcgaaggaggcttcctccgacaagggctatgtcacgtatccttctgtgcaggagagccaggatgctgacaaggaaacaggaaggtaggtacctactcccatgcagaaaaggcatgtaaccctgaatatcccgcctgaggcgggctttgcaaggtcggtgcgcatgctcgccgccaacctcggcgtcgtctgctcgttctccgtggacgatgtggaagatctgcgcatggctgccgaggaaggcttcgtgtatgcctgcgcgacgaagccggagagctgtgctgtcacgttcgacctttccgatggcacggtcgagatcacctacagcctgggcgatgcagatgcatcggaagatgagaccattgcctatgcagacctcctgctcgctgcgctctgcgacgattacgagatcgacgccgacaagcacgagctctatctcatgaagcacgttgggacggtagagaatgccgacagataatccagcccccaaggtacgccgccgcgtatcttcgaggacaccacgcggaaagcttgcctgggacaaggaccggacccgggagctcttccgccgctacaaggaagaaggggacaccgaggcgcgcgagcagctgattgtgagccatctgaaccttgtccgcttcctcgcttcgaagttcaagaacaggggagaaccgctcgacgacctcatccaggtcggcacgatcggcctcatcaaggccatcgatcgcttcgagcccgaccgaggcctcgaatttacgacgtatgcgacgccgacgatcatgggcgagatcaagcgccacttccgcgacaagggctggtcggtccgcgtgccgaggcgcctgcaggagctttctgccaaggtgaaccaggccaccgacgagctcacgaaggagcttcagcgctcgccttccgtcgaagagattgcagagcgcctgggcacctccgtcgacgaggtcctcgaagccatggagtcctcgagcgcctacagcgccgtgcctctcgaggccggcggctcgaacggcgatgaggatgcgccatcggtgctcgaccactatgcctccgaagacgagaacctcgcgttctctgacgaccgcatggtgatcgaggatgcgattcgtggcttctctccgcgcgagcaggaagtcatccgcatgcgcttcatcgatggcctcacacaggtcgagattgcagacaagctcggcatctcccaggtacaggtctcgaggctccttcgccgcacactcaagaaaatccaggagaagatcgatccggacggcgtcatgcgctagagcgcccctaacctgctatcatcaatgagctggcgaatcgaccaggggagggccgtggctccgaaggacaactcatatgcgaccgcacgcaaggtcgctgtcgtaagcgctgccatcatcgggtgctgcgtggcgcttgttcttgtcgtgcggctgcttggcctcatcggccctgccctcgagcttctgcttgtgggcgtcgtcctcggcttcatctgcagccccatcacgaactggctcgaagaccacgggataggacgtgcccttgctgccttcatcgccctcgttgtcgtgatagcggcacttgtgggcctggccgtcatcgtggtgccgcccttcatccagcagctcatgcacctgctgcagacgattccgacctatatccaggagctccaggcccagatcaccgatttcatgagccgctatacgacgaccgacaacgccggtgcccagtacatgctctcgcagggcgtctctgcgctctcgtcgcttggctccacggtctcgcaggatctcatgaacaagatctcgaacggcgtcatcacgaacgccgtgacgaccgtgaataatgtcgtgacattcttcctggggctcgtgcttgcctactggttcgcgaaggactatccggtcatggtgagggagctcgcaacgattgccggcgagcgccacgagcattccgtcacgctcatgctcgcggtcatgtcgcgctccatgggcggctatatgcgctccatggtcatcacttcgctggcaaatggcgtcctcgcgaccgccggcctcgctcttttcggctatccctatgcgggccttgtcggcgtcatcacgggcgtcgcgcatttcatcccggtcgtgggacccttcgtctctgcggcatttgccgtcgtgctcggactcttccagagcccgcttcttgcccttgagaccttgatcgtcatggtcatcgcccagaacgtgacggacaacctcctgtcgcctctggtcatgcagtctgccgtgcaggtgcatccggtgctctcgctcatctgcatcatcatgggttcggccttgggcggcgttctcggcatgattctggccgtgccgctcacggctgccatcaagggtgtctttgtgtactacttcgagtcgcgcaccggacgccagcttgtcacctatgatggggctatcttcaagggcaggccgtacgtggacgatgcgggaaatatcgttccatccttcgacgccctggacgatgacaggttcttcgagagctccaggcttgtccgggagcttccgcacgaagggaagaacacgtcaaacgctgcaggctccaatgcgggcggcagcgcatctgcacacaaccccggagattccgccgggaacgacaacaggtaaaggtttggagacacatgagcactgctgagtacaagacgatgacaacagcggagatccgcgaggatttcctgcgcttcttcgagagcaagggctgcaggctctatccctcctcctcgctcatcccggacgatccctcgctgctccttgcaaacgccggcatgaaccagttcaaggagtactaccagggcacgaagaccatgaaggagatcggtgcctgctcctgccagaagtgcctgcgcacgaacgatatcgacaacatcggcgacgcacgccacctgtcgttcttcgagatgctcggcaacttcagcttcggcggctacatgaaggcagatgccatcgagtgggcctatgaattcatcacggacgaagaccacctcggccttcctgccgaccgtctctacatgacggtcttcgaggacgacgacgaggccatcgagctctggcatgcccagggtgtgccctatgaccacatctcccgcctcggtgccgaggacaacttctgggcggcaggtccgaccggcccctgcggcccctgctccgagatctacttcgaccagggccctgccttcgagggcgagcgcccgggcgacgacggcgaccgctatctcgagttctggaaccttgtcttcacgcagtatgaccgccaggaggacggctcgatgccggaccttccgcatcgcaacatcgataccggcatgggcctcgagcgcatcgctgccatcatgcagcacaagggctcgaactatgagggcgatgtcatgcgctccctcatcgcgctcggcgagaagcttgccggcgtcgagtacaaaggcagctcgcaccttgcctccgacaagagcctgcgcatcctggcagaccactcccgtgctgtcacgttcatgatcggcgacggcatcctgccttcgaacgagggccgtggctatgtcctgaggaggctcctgcgccgtgctgtctatcacggacgcctgctcggcatcgagggcccgttccttacgacgtatgcgcatgaagtgacgaagatcctgggcgatgtctatccggagcttgtcgagaaccaggccctcatcgacggcatcatcgctgccgaggaggagcgcttccgtggcacgctcgatgcaggcgagacgatgcttgcctccgagatggaaaagctcggcgggggcgagcagctttccggagacgtggccttcaggctccacgacacgtatggcttcccgatcgacctcacccgcgagatctccgagaccgcaggccatgctgtcgatatggacgccttccaggctgccatggatgcccagaaggagcgcgcacgcaagagcgcgaaccgcgatgcctggggccaggccaacaacgtctggacggcgctttccggccgtctcccgaagacggagttcacgggctatgattccgacgagctcgagggcgcgaaggtccttgctatcgtctctgacggcgaagaggtaaagagcgccgaggcaggagacgaggtcgaggtcgtgctcgacaggacgccgttctacgccgagatgggcggccaggtcggcgataccggcacgctttccggcgtctctgcacgccttgcagtcacggacacgaagggcaagagcggcatgagcgcccatgtggcaaccgtcgaggaaggcgagctccatgtcggggatacgctcgactgcacggtcgaccatggcaggcgtgagctcatccgccgcaaccatacggcgacgcacctgctcgatgcagccttgaagcaggtcctcggcgaccatgtgaaccaggcaggctcgctcgtcgaacccgaccgcctgcgcttcgacttcacgcacttcgaggcactcacggaagacgagctcgagcgcgtcgagggtctcgtgaatgccgagatcttcgctgccgagccgatcgtcacgaaggtcatgggcctcgaggaagccaaggcatccggtgccgtggccctcttcggcgagaagtacggcgacaccgtcagggtcgtctcgacaggcgagagcgaccatccgttctcccgcgagctctgcggcggcacgcatgcgaggaacacggcagagcttggcttcttcaagatcgtgtccgagagctccgtcggctccaacgcacgccgtatcgaggctgtgacgtctgcaggcgctgtggagtacgtcgacgagaggctctccatcctgaatgacgtggcatccgagctcaagtgccagccgaaggacgtgctctcccgcatcgaggcgctccagcaggagctgcgtgcagccgagcgcaaggcagaggacctcatgtacggcagctcctccgaccaggttgcgcaggctgtgaaggcagcagagcagcttgatggctacaagtgcgtcttcgcgaagctcgcaggcctctccggcaaggagctccgcaatgtctgggatgccgtgagagacggcatgggcggcgagccctgcgctgccgtcatcgcctcttcgacggcagatggcaaggtcgccctgcttgctgcggcaaccgagaccgctgttgccaagggcttcaatgccggcaaggtcatcaaggagatctccggcctcgtcggcggccgtggcggcggcaggccgcagatggcccaggcaggcggctccgatgcttccggcatcgatgctgcgctcgaggcagcaaagggtctcgtcaagtgagggcgcttgcgctcgatatcggggatgcgcgcatggggattgccgcaagcgatgcttctggcgtgcttgcggtccctgtctgcgtccttccggctcaggaggtcctttcgctctcccggaacttccgccgtgtcatcgaggaccacgagccggagatcctggtctgcggccgtccgaagacgatggcaggggaggatgggccccaggcagagaagatcatgtctgagggcaaggccattgctgagaggcttggccttcctgtcgagttcgaggacgagcgcctctcctcgagcgaggcaaagcggattctccgtgcacagggactctcggagaagcagatgcgcggcaaggtcgactctgtcgcagcctcgctctttcttcaacctggctcgacgcgaagcgcgcgcaggatcgagacgcctgattgcctccaggcacaagagtttcgaagcccttttcatgctggaatttcagcaactggtatcagacgagtccgaccgcaaagcttgagctgtcaaggaaaatcggagattccaacagaatggatcctggtggccaatagtgctgccctagtgaagcattgagagattcgaaaattactagaaattgcaaaaatgcaagaactattacgcagacggtataccaaattttgactgttttgatatgaatacgaaaaatagttacaaattaagaccagataaaaacgttaccggaaccgctatatacgaaaaatatttaattcggtgagcagttcctggtgcacaagaattgttgtcgaaatataatgacgcagtgtggaaaacatggtggacacataagcacatatgttcacgaacgagagtccacatgttctgtaggcagcgtgagagaagtaaggaggaagttggatggtaggaatcgtcctggcaagccatggcaagttcgccgaaggcatcaaggaatccggaagcatgatctttggtcctcaggaggacgtcgccgctgttgtcctgacccccgacatgggtcctgacgacatgcacaagaagctgcttgacgccatcgccactttcagcgatcaggagcatgtcctgttcttggtcgacctctggggtggcacaccgttcaaccaggtttcacgcatcatcgacgaggagaagcacgaggactgggtcgcaatcaccggcctcaaccttccgatgctcgtcagcgcgtacggctcccgtatgggtgccgacactgctgtcgacgtcatgaaggagatcttctccgagtccaaggatggcatcaaggtgaagcctgaggagctcgagccgaagtctcagaccgcggcacccgctcctgctgcagctgcggccccgcagggcgccattcccgagggaacggtgcttggcacgggtcacatcaactacgcgtacgtccgcatcgacacccgtctgctccacggccaggtcgcaacgtcttggacgaagcaggtcaacccggatcgcatcctggttgtctccgacggtgtcgcccacgacgagctgcgcaagaccatgatcgtgcaggctgcgcctccaggagtccatgtccatgtcatcccgatcagcaagctgattcaggtcgataaggatccgcgcttcggtgcgacgaaggccatggtgctcttcgagactccgcaggatctgctcgaggccgagaagggtggcgtcaagttcccgaaggtgtgcatcggctctatggcacattccgccggcaaaactgtcatcaaccaggcaatcgcctgcgatgaggacgatgtcaagacgctcaaggaatgccgtgacaatggcacggagttctacgtgcagaaggtcccgtcggaccgcgtcgaagacatctggaagcttcttgccgaaaagaacatggcctagagaaggagggaatgtatgtcacctattacggtacttctggtcattatcgtggccttcttggcaggcatggaaggcatcctcgatgagtgggaattccatcagccgctcgttgcctgcacgctcatcggccttgtcacgggccatctcgatgcaggcatcatcctcggcggccagctgcagatgattgccctcggctgggcaaacatcggcgctgctgtcgctcctgatgcagctctcgcttccgtcgcttccgccatcatcatggtgctggcgctcaatggcggcggcaaccagcaggacgccatcacgacgtccatggcagtggcaatcccgctgtccgtcgcaggcctcttcctgacgatgatctgccgtacgatcgctacggccatcgtccacgcaatggatgcctgcgccgataaggacgatatggctggcatcgaccgctggcagttcatcgccatcgctatgcagggccttcgtatcgccattccggcagcctgcctctgcttcattccgtccgaggctgtcacggcagctcttaacgctatgcccgcatggctcaccggcggcatggcagtcggcggcggcatggtcgctgcagtcggctactgcatggtcatcaacatgatggcttccaaggaggtctggccgttcttcgcgctcggcttcgtcctcgcagccatcaaggagctcacgctcatcgccctcggcgtcatcggcctctcccttgccatcatctaccttggcctcaaggacatggcaaagagcggctctggtgcagctgccggctccggcgacccgctgggcgacattctggacgactacgaatagcagaaggagtgtgaaaccatggcagaagcaactattgagaagaacgcagacggcaagatcgtcctctcgaaggcagtccgcaagcaggtcatgtggcgccaccagtaccttcagggctcctggaactacgaacgcatgcagaatggcggctggtgcttctcgatgatcccggccatcaaggccctctacaaggatcctgaagaccagaaggcggcactcaagcgccacctcgagttctacaacacgcacccgtacgtctccgctccggtcatcggcgtcgtcctcgcaatggaggaggagcgcgccaacggcgccccgatcgacgacgttgcaatccagggcgtcaaggtcggcatgatgggcccgctcgccggtgtcggcgacccggtcttctggtacacggtacgcccgattctcggcgctctcggtgcctcgctggccctgtccggcagcatcgtcggtccgctcctgttcttcattgcctggaacatcatccgtatcgccttcctgtggtacacgcaggaggccggctacaatctgggcacctccatcacgaaggacctctccggcggcctgctcggcaggctgaccgaaggcgcttccatcctcggcatgttcatcatcggtgccctggtcgagcgctgggtctccatcaacttcactccggtcgtcgcccggatcccgcagcaggctggtgcctacatcgactgggagagccttccggctggcgctgatggcatcaagcaggcgctcacgatgtacagctccatcggtgccacggctctcgatcctgtcaagaccgtcaccctgcagtccaacctcgaccagctcatccctggccttgctgcagtgggcctgacgctgttctgctgctggctcctcaagaagaaggtctcgccgatcgtcatcatcctgtgcctcttcgcacttggtatcgtcggccgtctcctcggcttcctgtaggattgccaaggcgctatcatgggccgtgcttccgcaagggagcacggccttttcgattaaggagtcacatcaatggcaatggtccagtcgcagaacagctcggtggaatacacctgcaaggtgagctctctccagggcctcacctcaaccggtgaccttatggtcggcaacaatgccctcgagtactacaacgagcgcaatacccaggactacatccagattccctgggatgagatcgactacatctcggcttcggtctacggcaagcgccacattgcccgctgggccgtcttcacgaaggagaatggtcacttcacgttctctgcaaagaacaacagggaagcgctcagggcaatccgcgagcatgtcgacccgagcaggatgctgcgctctcccgacttcttcgatgtcctgcgtgccggcgtcaaggctgctggcagaaatatcgcaggcgtcttccatcccaagaaggacacggctgacgaagagtaagcttctgcctcgatttatgcagactgcgagtgttttcgcagcttggaggcatcaagtctgcgcatttcctctgtagatgggtatctgctgcgaacacagtcacactttcggcgtatgctcaggcacactcaagaaatctgtcagtctgccctgtagcctgtagggtagctgcaaagaagctaaggactgcccatgagctcgactccccgccacgaatcgcaccaaccacgccgccgtacggcaggccatgctgtggggacggtgccggcgacccatctttcgtcgcgcacggcccaggtgacgcagaggacgcgcgagaagagccgggcggggcatgtacgcgaggtcaagcgcaagtcgtcccacggaccggcaccctacatcctgggcacgatcatcgcagtcgcagtcgtcgccttccttgcaatccgcgtcctcccgggcgtgctgagcaggatcgacggtgcgggctccaagacgacggtcgaggagggcacccaggtcacggtcacggtgccgaagggcgcttccggccagaccatcttcaagacacttgtcgaagcaggccttctcgacaacagccagtcgagcgatttcctcactgcctacaagagccatggggacgacgcacagatgcaggcgggcacctacactttcacggcaggagcgtccgtcgaagacatcgtgaacggcctcattgcagggcccagctcgagctatgcctacaagctgacagtgcctgaaggctatacggtcgcaaagaccgctgcggctgtcgcagaagccatcccttccatcacggccgacgatttcacggcgcaggcaaaggcatcgaactatgtggcagactatccgttcctggcctctgcccagaacgattccctcgagggattcctgttcccgaagacctacacgttcaatgcggatgtggatgccgacacggtgattcgtgccatgctcgaccagtacaagacggagatggcatccattgactttgccacgggcgaagcgcagatcaaggcaaagtacggcatcacgatgtctgactatgatgtgctgaccatggcgtcgattatcgagcgcgaggctgtgacggacgatcagcgcgcaaacatctcctctgtcttctacaaccgtctccaggctgccatgccgctccagagcgatgcgacgatgggctatgtgacaggcggcgaagtaacggcagacgacctcgagcaggaatcgccctacaatacgtatctcaacgaaggcctgccgccaacacctatctgcgcaccgagccttgcctccatccaggctgcgcttgctcctgccgacacgaactatctctatttctatatcgtgcaggagaatggccagacgacctcgagcttctccgagacgtatgacgaacatctcgcaagcattgttgcaagcagcaatgcagagcccggggagtaggagagcgtgtctctcttcgaagctagccgctatgtcgcacgcatcgagctcatcgatctcgatgagctctggcaggagggcgtgcgcttccttctcatagaccgcgacaacacctgcatggctcgctcaacgatgcgcgtcgaacctccggttgctgcctggttcgcaaaggcgcatgagatcggctttgcgacctgcctcgtctcgaacaacttccatggggcagatgtcgagaggacagcagaagagcttggctctgccgtcgtccaccatgcgatgaagccagcaccgtttgcgcttgcgcatgcgctggcccgcgaagggttctctgcggcagagaccgtgcttgtgggagaccagatcttcacggatgtcctggcaggaaacctggcgcatatcccgaccatccttgtgcatccgctctcgacgacagacctctggtatacgcagatcctgcgcctcatcgagcgtccgcttctttccggccacaatttcgaaggcgaccgatgattgtctgtgccgccctggcgctcgccttggcggtagccgtggaggatgcacgcagctgccgtatccggaacagcttctgccttgctatggcagccctgggccttgccttccaggcggtgcgcatctgggcgcccgagctctcaggcgtgcttgccttccatcttgcagatgggccgtatgccccccaggccgttctggcagcagcgctccttgtgctcctttgcggtgcagcgcttgagcttgcatggcgcaggatccatggagcctctggcatggggctcggcgatataaaatacattgctgcctgggcaatgcttctgggacctggcatcttcgtgccgcttgctgtggcagcgcttgtgggcgccctggtcacgcttgttcagaagaagaagcgctttgccttcgggccctatctttcggccgcattctcctgcatgcttgtgctcctgtcctcaggcatcctctgatgccctgttttgatgcaggatgtacgtgtgctctcctctgacaggacagcttcggtctcgatgatagaatcaaggagatcggactgtgtttttcggaggttttggtggacagaccatgcaatggatatgtcgtgcatgaagggtgcgatcatatcttcttcgtcggctttctcggagccggcaagtccacggtggcaagaaatatcggatgcctcttctgccggccctatgtggataccgaccgcatggtagaaaggatccgcggcaagagcgtctgcgatatcttccgcgaggatggggaagagtcgttccgcgatacggagaccgaggtgctcagaagcctcagcgagaagaagtcgctgctcgtgagctgcggcggcggcatcgtggagcgctccgagaatgtcgacctcatgcacagcatgggcaagatcgtattcctggatggagatctctccgattcgctgaggcagatccagcacaaggagacacggcccgatctgggtggctgtctcaaggagacgagcgcctgctataatcgccggcgtcccctctatgaggcggcggcagactatacgatcgatatcaggaacaagagcttcgaagaagtcgcttgcgatgcgtcgaagcttctatgggaggaagggctgctatgagcgaagaagagcttgggacgagcgtccctcaggacaacggggatgctgcacaggctcctgccgatgtggctgagactgccgaagtccctcaggaagaggaagcgccgaagtctcctctggctgagacgacccgccagtgggtgtcgcttccgggcagctcctgcaatgtccgcataggctcgggcaacctcgagaacttcggccacgacctcaagagctctgtcggaaagcctgcgaaggctgcgctcctcgtgtccgacaaggcggatccggactttgtccaggagctcctctggcagctgaacgatgccggcttccaggcgctcaggggctctgtgccgggagagctcacgctttctgcggcagatgaactcttcggcgagctcgacaggctgcacatcacgtcggatgacctgattgtctgtgtcggtgctgcccctgagctctcgcttgtcttatatgctgccggcgcctggtgcggccgtacgccggtctgcgccctgccgctcgatctcgaggcgcttgtctgcgcaaccgtcacgcctgaaggaatctcggtcggcacgcaccgggatatggtgtctggccataacagcctgaagaacgtctttgccgactttgcccgcatcgacctcggaccttccgagaagcgtctccacgcctatgcgacgatggtcgcgactgcggtctccgatacggaaaaggcattcgaagcgctctataacaggcgcgatgccctcgccgaagctgacgaggtggcactgcgcgagcaggtgaacgagacgctcaggagccgcggccgcattgcctcctcgacctctgttgccgtgcgccagtcgctttcctacggcgtcacgtttgcagaggcgctgagccatcttgtggaaggcgttcctgcctcgacgcttctggccgaaggcctgcgcttcacggcacgagtggctgtgaccgaggaggacttcaaggtcgacgatatgcttgcccaggacgagctgctctcagtgctgggactgggcacggtcagcgtcacggtagatcccgatgcgctcctgcacgagatgcgcgcctgtgcacatctgcgctcgaaccgcttcatgctcgccgtgccgcgcgctttcggacgcgtccgtctcgcgacgatcgaggatgcccgcctcaaggcgcatctcgaggcctggtgcgcacagcaccaggcggactagttgcttggcacattcaatcggaaaggatcttttgctatggcagatcaggaaatgggaaaggcgcgtgttgcacgccttcgtgccctcatgcaggagtatggatatgacgcagtcgtgctgcgccacaatccggatctgcgctggctcacaggagccgagcgcacgttcgacgacgaggtcgcacatacggccttcgtgacccgcgagggccagtggctccatacggattcgcgctacttcggcacattccaggaacgccttggcaaggatacggactggcagctcgatatggatgccgtgagccatccggcctggacagcctccctgatcaggaagacccatgcccgtgtcgtcgcaatcgaggacacggcagaccttgccttcttcgatgcgctcgaggcagagcttggccgccagtcggcggcatgcctgctgccgcgcatgcatggcacggtctcggcgctgcgtgtcgtgaaggacgccgaagaggtctccctcatgcgccatgcccagaccatcacggatgctgccttcgagcacatctgcggctacatcaagccgggactcaccgagctccagatcagggcagagcttgagagcgcgatgttcgaccgcggtgccgatgcgctctcgttcgacacgatcatcgcaagcggcccgaacggtgccaacccgcatgcccagccaggggagcgccgcgtcgaggagggcgacctcatcgtcatggactatggtgccggctaccatgactaccattcggacatgacaaggaccgtgtgcgtcggcaaggcgacagatgagcagaagcaggtctacgccgtcgtccgcagggcgaacgagacctgcgaggcagcgatccatgccggtgtcatcggcgtcgatatccataacctcgccgtcaaggtcatctcagatgccggctacggagactacttcaagcatggtctcggccacggtgtcggcctccagattcacgaagcaccgtacttcagccgctccggcgctcctgccgagcacggcgtcatccctgcaggatctgtgatcacggtcgagccgggcatctacctcccgggacgcttcggcatccgcctcgaggacttcggacaggtgaccgaggacggctacgacgtcttcacggcatccgcccacgacctcgtcgagatcccctgctaggacccacatcttcacactttgtgtagtcgctccggcttgccagcatgagctggagcgacgtcgtatactgataccgtttcggagttttacggataggaaagagatcaaccgtggcaacgcagaccatcagcaccgctgatttcaagaacggcatgggcctcaagatcggcaacaagtactacacgattgtcgagttccagcatgtcaagccgggcaagggcggcgcattcgtgcgctacaagatcaaggacctgcgcgatggccgcacgatcgaccagacctgcaatgcaggcacgaagttcgacagcgtgcagctcatcaccaaggagatgcagtatctctacaacgacggcgtcgactattacttcatggacaacgatacgtatgagcaggtcgctgttcctgccgacttcattggcgacaacgcccagtggctcgtcgagaacgacaacgcctctctgctctacgctgacgatgagctcctcggcgtgacgcctgccatgttcatcgaggtcgagatcacgcagaccgacccgggcttcaagggcgacacggtccagggcggcacgaagccggccacaatctccacgggcgctacgatccaggtgccgatgtacctgaaccagggcgagaagatcaaggtcgacacgcgcgacggcaagttcgtccagcgcgtctagcctctcgcacaatgagggatgccgcgtcccatctggcggtggggcgcggcatttttctatgcaggcaggccctgcaatgtggaaaccttgggagcagctgccagcgcgcttccaagatgcggccctgcctctgggctatttgcgtatactgggtatgaccataagcaagccggaaagctggctttctggcggatgcggaaggacgttctatggacgagctctccatctctggcattggcatctcccgccgcgtcatcgcgaccgtcgttgcgctggcagcagaaaaggtcgaaggagtcgcctctgtcggcggcaatgatacgcttgcctcgagcctcatcagggtcttcacggccaagagcctcgatgtcgcacaggcagtcgagtccgaagaagaggacggccgcctgcatatcacggtccatctgtcggtcttctatggctacccgttctgcgagcttgcgcagaacgtgcgccaggcagtcgcagatgccgtgtccgaacagatcggcgttgaagtatcggcagtcgatgtctgcatcgacagcctcgtattccccaaggagtagaagccttgtcaaagcaatcgtcaaagcagttcaagggacgcacccttgcacgcagccaagccctgcagattatcttccaggcagaggcaacgggccgtgccgtggatgaggtgctcgatggggactatgccctctccgagggcccgctcgatcccttcggcgagcgtctggcacgtggcacctggtcgctgcgtcccggccttgaccgcatcatcgactccgtcgctacgaactggtcgctcttccgcatgccggcagtcgaccgcaatctcctgaggcttgccctctatgagatcctcgaggtcgacgaggtcgagctgcctgtcacgatcgacgaatgcgtcgagcttgccaaggcctatggcacggacgagtcgagccgcttcgtgaacggcgtgctcggaaagatcgcacgcgagctcgaggcaggacgcgacctcaagcgcgaagctgaagaggggaccgaggaggcagaggcgcttgccgctacagcccccgaagcagaagcccccgaagaagagcgcgagtggcctgcctatggtgccgagatccgtgccgaggaagaggctgaaggtgccgaagagggcacctggcagccgggcgaggatgcagaagacgccgatgaggccgcagagccgggcgaggacgcgtaatggccaagatcgatacgtctgcctacaagaccttcgatgagattgcaggcaggctcgacgagattgccgggcaggtgcgccagaaggatacgtcgctcgagcgttcgctcgacctcttcgacgaagccatcgctcttggctccaaggcagtcgatatggtcgacgcccaggatgcagagcacgcgggcacccagaccaaggagggctagagcctgtggcacggcgcagaaggctcgatgaggaacttgtagcgcagggcttcttcccaacaagggacgaggccctgcgttctgtcatggcaggagatgtctcgacgacagaccgccgcatggaatctgccggcgagcaggtaaagcccggcatcgagctccatgtaagagggcacatcccgttcgtgagcaggggaggactcaagctcgagcggggtctcaaggccttcgatgtgaagccagaaggccttgcctgcctcgatgtgggctgctcgtcgggaggctttacggactgccttctctcccacggggcaagaagcgtcctttcggtcgatgtgggctatgcacagttcgactggtcgcttcggaacaatcccagagtcgagctcctcgagcgcacgaatatcgtcgatgtgccgacgcctgagcgcatgggcacgatcgatcttgctgtctgcgatgtgtcgttcacctcggtcgtctccatcctgccttctgtcatggagctcctgaaagatgacggggcgttcctgacgctcgtgaagccgcagttcgaggcagcgcgcgatgaggtggatgaaggcggcattgtgcacgatcctgaagtgaggcttgaagctctcatgaaggtggccggtgcctttgtggatgcaggccttgccatcaagggtgcctgcgaaagcccgatcacgggtgccaagggcaaccacgaatacctgctgtatggcagaaggggagaggctggactggtgccggacctctctcaggttgtcagggaaggcgagaccttcatcgcttcatagaacatctgtacgtctgtgctgcaagatggcgcttgatgctacactgggcgtacggaatcgatggaacgaaggtgaactgacggtgaaggtgcttctcgtaccgaactatggacgcagcgatgcgcttcagggcgcgcacaatctttccggctggctcgaagccgaggggcatgaagccgtgcttgcccccgacaagaagcgccacgaggaagagcgtcccggccttgctgatggcatggacctcgtgatctcgcttggcggcgacggcacgctcctgcgtgctgcccgtatcgtcggctaccgggagattccgctcatgggattctcctatggacatctcggcttccttacctgcggcggtccgaaggacatgcgcacgaccgtcgcggcggcgcttgcaggcgagctccattcctcgcatagggcgacccttgccatcgaggcagaatatgtgctgccggacggaagcgcctataccgagaagagctttgccctgaacgatatggctgtgacccggggcggtctcggcgatgtcatctccttcgatgtcggggtctcggggaaccacatcgacaggatccgcggcgacggcttcatcgtctctacggcgacgggctcgaccggctatgcgctggcagcaggaggccctatcgtgacgccggagttcacgggcatggtctgcgtgccgatcgctccccataccatcctggcccgcgccttcctgacagcgccttcagatgtcgtggagatcgacatgtcggaggagcgcccggcagagcgcagcgtcctcgccgatggccgcctcatgggccatggaggacgggccatgcatatgcgtgtcaggcgcggggagggcgacatcatcctcctcgactacaatgcgcagagcttctattcgtccgtttcgcgcgtcttctacgggaaagtggccaaatagatgattgacgagattcaggtcagaaatgttgccctcatcaaggaagcggagatagagccagcagaaggcctcaccgtgcttaccggcgagactggctcgggcaagtctgccctgctctcgtccctgaagcttcttgtcggcgacagggcagatgcctcttcggtcagggaaggcgcagatggcctcgaagtgcagggccgcttcttcacggatgacggggaagaggatggccatatcgtgcggaggcgcctcaccgctgatggacgcggcaaggtcgatatcgacgggcatatggcatcagtgaaggagctcgcacagacgctcggccgcacggtcgatctctgtggccagcatgagcaccagaagcttctcgatgtcacgacgcatgtgcagcttctcgatgcctttgccggagagcctgcagctgaggcacgtgaagcctaccaggaagcgctcaggaaatctgacgcagcccatcgggagctcagacttgtcgaggaggcgagccgtgcctccgaggagaagctcgacgaggcggcattcgtgctctcgcgcatcgacgaggtcgggccttccgaggaagactatgcagagctcgaagaggcgctgccgaaggcagagcatgccgaggcgctcatgcgtgctgccgaaggggcacatgaggcggtagcaggagacgatggcgtctccgatgtgctttctgcggcagtcgccgagctgagggaggcggcgcgcttcgacgagaagctcggaaagctggctgatgccctcgagagcgccctcatcgaggctgaggatgctgcatcggagctcagggactatgccgactcggtcgagctcgatcccgaagagctcgagcatctgcaggagcgcgaggctgcctaccagaggctcatccgtgcctatggtccggaccttgcccatgtgctggcacggagggcggaggcagaagagaccgtctctgcggcgcaggatgggggagagcgcgtacgcaaggcgaagaaggcgctctccgctgccgaggccgagcttgcagaagctgcaaggcagctctcttccgtacgtgcgaaggcagcgcctgagcttgcagctgcaataaccaaggagatggggcagctcgagatgggcacagcctcgctcgaggtctcgctcgagccgcttccacgctcgcaatggacgctcgagggccctgaccatgcagagctcatgtatcgtcccggtgccgggctctcatcgcgcccccttcgccgcatcgcctcgggcggcgaggtcagccgtgtcatgctggcggcaaaggtcgtgctcggggatgccgacgagacggatacgctcgtcttcgacgaggtcgatgccggtgtcggcggcgccacggcgaatgctttggccgaggtgctcaagaagctctcgcgcacgcatcaggtcatcgtcgtcacgcatctggcgcaggttgccgtcatggcagacaagcactacgtcgtcacgaagacggaaggaagcgtgcccgagacgaagctctccgaggtcgagggagatgcgcgcgtgcatgagattgcacgcatgctttcgggcgacgagtcggaagcttcgctcagccacgcccgagagatgctcgagcgcgtgcatgcctcgtggaattgatgcaggaaccgtttctcggacaggttcttgcctcacgtgcggaatgaaccgcggtattatataggtccgtacgaagagcaaagcaacgcgtatggaagggtcctcatgaccaagcacatctttgttacgggcggcgtcgtttcttcccttggaaagggcatcacggcagcttcccttggccggcttctcaaatcccgtggttacaaggtgatgatgcagaaggccgatccctacctcaacgttgatcctggcacgatgtcgccgttccagcacggcgaggtcttcgtgaccgaggacgggtatgagtccgatctggacctcggtcactacgagcgcttcatcgatgagaacctgacccgcaattcgaacttcacgaccggcgcaatctactcctcgctcatcaagcgcgagcgcaggggcgatttcctcggcggcaccgtgcaggtcatcccgcacgtcacgaatgccatcaaggagcgcttccgccgcatcgaggagcagtcgggagccgatgtcgttatcaccgagctcggcggcacgatcggcgatatcgagagctcgtcgttcgtcgaggcaatccgccagttccgcaaggaagacggcccaggcaacaccctcgtgatccacgtgagcctcgtgccctatattgccgctgcccatgaggtgaagacgaagccgacgcagcactccgtgaaggagctgcgctccatgggcatccagcctgacttcatcgtctgccgttccgaccatgaggtcgaggcaccgattcgcgcaaagatcgcccacttctgcgacgtcgatgaggattgcgtgttcgagaactccgactgcccgtcgatctacgacgtgccagcgcacctcgccgagcagggcttcgatctcaaggtctgcgagaagctcggcctcgactcgcgcgagagcgatatgagctcctggtacagcttcacgtctgccatgcatgcagcgaagcagaagccggacaagacgaagatccgcatcgtcggcaagtatacgcagctgccggatgcctacctttccgtcatcgaggcctgcggacatgcaggcgtctacttcggccgcaacctcgacgtcgagctcgtcgacggcgaggagctcaccgaggacaacgtcgaggacgtgctcggcgatgctgacggcatcctcgtgccgggcggcttcggccagcgcggcgtcgagggcaagatcctctctgcccaccttgcccgcacggagaagaagccgtatctcggcatctgcctcggactccaggtcgctgtctccgagttcgcccgcaatgtcgctggcatgccgggcgccaactccaccgagttctcgccggactgcgagtatccggtcatcgatatcatgcctgaccaggaggatgtcaccgagaagggcggcacgatgcgcctcggtgcctacccctgcaaggtcaagccgaacacgcttgccatggaggcctacggcgagccgctcgtctatgagcgccaccgccaccgctatgaggtgaacaacgcattccgcgacaagctgatgcaggccggccttgtaatctgcggcctctctcctgacgagcgcctcgtcgagatggtcgagcttcccgaggatgtgcatccctggttcgttgccagccaggcacaccctgagttcaagagccgcccgacgaagccggcaccgctcttccgcgagtttgtccgcgcttccattgcccaccacgagggctgcgcacgccagagcgtccagccggagtagggcgcacttggatcttgcatctgcacggaaggaattcatgggctacctcgctttcgaacgaggtagctcttctcataccgtggaagcctatggaagggacctcgagcgctatgtgaaggcgctcgaagagaagggcgtgaccgagcccgacgacgtgacccgccctctcatagaggagcatctcgagcaccttgccgaggagggctatgccccgtcttcagtcgagcgggcgctctctgccatcaagagcttccaccgcttcatgctccaggaagagatgtcttctgtctctcctgcagcggcactgccgcttccgaagaaggcagagcgcttgcccgatgtcctgagcgtcaggcaggcgctcgcgcttctcgaccagcccttcccggagacggcggcaggacagcgcgaccgtgccatcatagaggtgctctatgggtgcggccttcgcgtctcggagctcacgggcctcgatgtcggggcggtatcgctcgaggatgaggtcgtgcgtgtcatcggcaagggaagcaaggagcggctcgtcccgctcatgggaagcgcccacaaggcgcttgcggaatacctctccgactggaggggagagctcgtctcttcgagaagcggcgctgcggtcttcctgaatgtccgcggcggcaggatctcgcggcagtccgtctttgcaatcgtcgagcgggcaggacgcgtcgtcggcatagacggcctccatccgcataccctccgccacagcttcgcgacgcacatgctccagggaggagcagacatccgcatcgtgcaggagcttctgggccactcgtcgatccagacgacgcagctctatacccatctcgacaggagccatcttcggatggcatacctctcggcgcacccccgggcgcgcagggagcgggagcagccacacaattccgacaaatgaccgccgagccgggcggtgctataccacgccttcgagcttcgggtttgtgggggcaaaagaaagagaccgctagatgttgtgggggtgcaggcgcgtgtgcctgcacccctttttatctgcggaaatgcagtttggtgggagaaagtgggacaaagggttggaaaaggggacatcgagacgttatagttggatacacgctttgagaggggacaggccgagtcgtcgggaggtggcagatgtacctgacgggcgagaaacagctcaagctcgatgccaagctgcgccttaccctgccggccgacttccgccgccagttcggcgaccgcgtctgcctcgttcctctcaaggacgcaatctggggcttcactccagaaggccacgaggcctggaccgcctcctatttcccggatggcttcaatccgagggacagggagcaggacaagcttcagcgaacgctcatgaggaggaccgtgacggtggacatcgatgccgccggccgtgtcgcgctcagcaaggttcccgaagagaagcttgcgaagctcggcatctcccgtgacgtcatggtcatcggcaaccgcgaccacttcgaggtctgggattaccagcacttcgaggagctcaacgccgaggacgatgacgacctggacgacctcatgttcgactagccggaaaggagcagctcccgttgaaagtcgaatatcggcataatcccgtcatgctctccgaggtgctggaggccctggacccccagcctggagaggttgtctgcgactgcacgctcggaggagcggggcactcggtcgctctggccgagcgcattgctcctgctggcctctcgatcggaatcgaccaggacgatatggctcttgccgccgcagcggaacgcttcggccgcgaggtgcccagcgcccgccatcggttcctcaaaggcaacttcggcgacctcgaccagcttctggtcgaagccgaggtgcccggcgtagactgcttcctcttcgacctcggggtctcgtcgcctcagctcgacatacccgacaggggcttctcgtaccacgaggacgctcctctggatatgcggatggatccgaggaacaacactctaaccgcacaagaggtcgtgaacacctacaacgaagcagacctcacccggattctccgcagctatggagacgagaagcatgcagcatccatcgcgcgccacatcgtgcgcgcccgcgagaaggcgcccatcgagacgacgctcgagctcgtggagatcgtgaaggcagccattcctgcccgcgaccgccgccatgggggacacccggcacgcaagaccttccaggccctgcgcatcgaggtgaaccacgagctggatgtgctggagaggggactgcgcgctgccatccgctgggccaatacgggcggcaggatctgcgtggtctcgtaccactcgctcgaggaccggtttacgaagcatgtgttctccgagctctcccaggggtgcatctgcccgccggaccttccggtctgcgtgtgcggacatgtgccgataatcgaggtcaagaccagaaagcccctggccgcgaccgaagaggaagtgcgctcgaacccacgggcacgcagcgctctgatgcgcgtggcagtcaagctcgatgtcacacaggctcaggcgcagacctgatgctcacggcccctccggaccgtctgcatagcacccaacgcaccaaggatgcagcaccaccgcaccataaacgaaccacaacgcactaccaatgcagacaacagatgaggggtatttcggtatgaggtatgagtcctctgaggcagtccgcctcgacggatatgatatgcgctcgaacatgcgcgaggcctcggccagcccctctttcgatgtatacgaaggcggcgggctcgatgcccgcgtccgccagggcgtcacgcaccagttcctcgtgaagctggtccgcgtcgcgcttgtcgcggcagccatctgcgcgctcggctttgcccgtgttgcgatctcgacggcgaccgtctcagccctccaggcaaacgagtccctcgagagccagattggcgatgccacggctctctacaacgacctcaaggcgtcgaagtcggcgctgtcgagcgtgtcgcgcatcgagcgcatgcgacggaagaactacggtatgagtatcgagcgaccccgaggtcatctatcgacggcatcctcctctggatagcgccgctgcctcttcgaacgatggcaagcatccatcttctcaggactgacgacagagactcgcggattcttcgaatgtggagtagggggcgcgctcttctggcgtaagccatccacatgggacagacagacacgaacagcagaagcgaacggaccctagaggggcgctgtcgtacgacgaagtggtccagaaccgcgaggcgcgtgcccgcggcgcgaggagcgcgcacagcgcgggacagcagtcctggcgcagggaccaccagacgggcggcatcctccccatggtgaagggcaggtggccgccttgtcgcggtcttctgcatccttgctgcgctggccactcgttgtgtgcggacgctttctatctccagatcctccagggccctgagctaagcagcatggcagagacagcagccacgaacggagtcacgattaccggcaaagcgggcacgatcatacgacggaacggcatgtcctcgccatgaggtcgatgtgaagaccatctactgcaatccttcgctcatcaaggacacggaccaggccagcgagatcatggcagagacgcccttggcggtcgaaggacgattctcgagatcgtcgataggatacgacgtttgacctatatcacagaagaaggtcgaccacgacgacccgctcgacgctcgagaacaagctcgacgaagccatatccaggagtctatctcctcgtatgacacgaagcgcatctacccttatggacctctgtcgcgggacgggtcctcggcatggtcggctcgatgggcagggcctcacagggcatcgagactcataatacaaacgaggtgcttctccggcccggaggctcatgatcatggagacaggcgtgacggcacgccatggcaggggcgtcgctgaagtcacgaaggcgaccgagtctccgatatcgtgatccgattcgatcgtgaacatccaggcaaagctcgaagaggtccgacgaaggcacggagaagttacaaggcagactcgtgtccgccatggtgacagacccgaatacgggagagatcctgccagccgcatcgacccctctggccgatctcttcggatacctccggaggcctcacgaaagaggcgcgaaacctgcgcctgggtggttatcggacctctatgagccgggctccagcttcaagataatgaaggatggcataaggcggcagtgaagacaggcgttcagccagcatacgatcttcagatgtgaaggtcagtatccatggtcggcgaacgactagtcacggatgccatcaagcgactactcgaccgaagacatgacggttttcgcacatcctcgaggaatcctcgaatgtcggtgccatactatggcccagtgccggtcggcgcagaaggcttctcctccactggtgtcgagtctggcatggccacaggaccggctcgactatatcgcgaggcgacgaggcatggtcacgggactacgacaaatccatcgacgacgatgatcgcgacatggcattcggacagggcatggccagtcctcaggtgcagctgccagtccaggctgtcggtgcaatccgacgccctgcggattgctcatgacgccacactgcctgacagagaaggccggcgagaccatgcagtggggactcgaagggaacggtctgcacggcaggatggaccgaccagatatcgaacgtcctcgagtctgtcatcgagcggcacggcaaagcattgcagccgtggaaggacacagtcgacgcaaagaccggcacggccccaccagatgacggaagacgaggaaggcaagccgaggcaagtacataacttcccttatcggctatgcgaatgccgacgaccctcaggtgcttgtctatgtcgtgtttgaacggaaagccttatcttgcagaaagcagtcatcagcctacatgttcgtattatgagtgggcgctaaaagatatggcgaatcaagcccgtgtcctagaggagatactggaaacagcatgctgaaaatgacgatgacgagctgatccacgcaacgggagcagagctcgtggcggcagccccaagccaccgttcgaggggctgcacgatcgcttcgcgcaaggcacagaaggctcgctcttcgtggccttcaagggcgagaggtggacggacaaacctctatgtggccaaggctccgaggtgcaggagctgcctgtgccgtggtcaggaggagccgaaggaggaccgcgctcgcatatgcccgcaagggaggcctgcgctatcgtcgtgcggcacatgacgaccggaggagttcatgctccgcctcaccgcctggcgccaaagaatcatgacctgaagtatgcgggtttgtacaagggctcttggtcggaaagacacgacgaaggccatgtgcgcaggcggcgccgctctgcacgctggcgtgtacacaagacagaagcaactcaacaaactgatcggcgtgcccctcatgactttgccgccaccttcctgacgctgcccaggcgctagtcgttagagatggcgcagaaactgcctggcgagatcgcgactgtgcagcagatgaggcctaccgtcgtgtcatcacgaatgtcgctacgagccaatcggcaccttggctcgcgagaggaaacatagcccgtgcgaaggcagagatcgattccggcatgatgaccataggctgggacctttgcccgcatattcgccctgcctgtcctcaatgcgaccgatgacttcacgacgtttatcgagaagggctttgcccgtctgcggccttgagccgtgaaggttgccggcgggaggagcgcctgcacgcgagctccgatgtcaaagctcgacgaagaggggcgcgcctgttcacgctcctatggagggcggctatacgcgcccggtgaagctccgcatcccgggcaggcatgtgtgacggacttcttgctatgccatgggcaccatcgcaaagaccgactgatgtggacagccgagcaggcggcagctgcatcgatgggcccgaagcctatgcatgcgcctcgacgtgaaggtcgctgcaaacggagcgcggcatcgacgacactacaacgcaagcccctgcatccatggcagaggccactcgacgccggcactccatgagggcgagggcgggccaggtgatctcgtcctcggcgagatgggggagctaggtgccgaagctgagcgcctgccatggctatgtcggagcctagtggcggctttgcgtgcgccagacctcttcgtgaccataggccacgaccttgcggccgccatggcatagcagaagtcgttcacagcatgcatgcctgcccgggatgcggagattcaccgggcgcgtatagccgcctccatatggagcgtgaacgaggcgcgcccctcttcgtcgagcctcgacatcggtcgcggtgcaggagctctccctgccggcaaccttcacggcttcaaggcggcgagacgggcaaagccctccgatgaacggcgtgaagtcatcggtcgcatgagacaagcagggcgatatgccggccaaaggctctagccgatggtctcatgtgcggagacgatctctgccttcgcaagggcgatgttctcgcgcgagcaaggtgtgccgattggtctagtgccgacaattcgtgatgacagcgacggtaggcctcactgctgcagccaggcggcggactctcgccagcatggttcatccacccatccgacgacgagcgctgggcatgtcaggagcggcaagagcagaggggcacgccgatcaggttgttgaagttgccttcggtcttgtggacaagccagcgggcagagagagccgccggcgcacatggccttcgtcgtggtctctttccgaacgagcctgtgaccccgcagacgatccagtcaggatgcttctggcgccaggcggtggcaaggcggagcatgaactctccgggtcgtatgtgccgccacggccgattagcgcagcctcccttggcggcatagcgaggcgtcctccttcggtcctccgtgaccacggcacaggcagctcctgcctcgagagccttggccacatagaggttgccgtccacctttcgcccttgagtgccacgaagagcgagccttcctgcttgcgcgaatcgatcgtgcagccctcgaacgtgttggggctgccggcacacagcttgctcccgttgcggggatcgctcgtcaatcgtcatttcagcatgctgtttcagtatctcctctaggacaggcttgattcccatatctttaagcgcctcactcataatactcgatgaacatgtaggctgatgagctttctgcaagataaggcgtgccgttcaaccgacatagacaagcacctgagggtcgtcggcattcgcatagccgataagggagctatgtacttccttcggcgtagccttcctcgtcttccgtcatctgtgcgtgccggtcctttgcggcgaccttgtagccttccacggtgcatgcttttgccgtgccgttctcgatgacagactcgagattcgttcgatatctggtcggtcacatctgcgtgcaagaccgttcccttcgagtcccctgcatggtctcgccggctctctgtcaggaagtgtggcgtcatgagcaatccgcccgttcgcgatggccaccgacagcctggaccattcacctgcaggaatggcaaggcctggcgaagcatggtccgacatcgatgtcgatgtgtcagttgtcgtgtccgtgaccatgcccgtcgcctcgcgggatatcgatgccggtctgggccaatgcccagactcgacatggaggagaaggccttctgcgccgacggacgggccataaggatggcacgacatcgaggatcctgaggatgtgcgaaaaccgtcatgtcttcgcgttcgagtagcgcgtgatggcatccgtgacatagtcggtcgccgactgatctgaaccggcacgctgaagatcgtatcggtgctgaacgtcccgtgcaccagcccggatgcatcgtcagatcttgaagatggagcccggctcatagaggttccataccatgcgccatgttcagcgccgttcgtgagctcggggatccgagagatcgccagaggggtcgatgggtgccaggatctctccgtatgggtctgtcaccatggcggcgacgagtctgccttgtacttctccgtgccttggtcaggactcttcgagcttgcctggatgttcacatcagtcgagatcacgatatcgagcctgcggtcgccttcgtgacttcagcgacgccgcctgcaaaggcgtgccgtcgcgctgtctccatgatcatggagccatcctggccgggagagacatcgttgtagtagagctcgaggcctgtggcccttgcccatcgagccgacatgccgaggacctgtcccgcgacagagccataagggtagatgcgcttcgtgtcatcgaggagattagacgcctgcgatattgcttctcgagcttgtcgtcgagcgtcgaggcggtcgtcgtgttcgaccttcttcttgatataggcaaacgttcgtatcctcatcgacgatctcgagatagtcgtccttcgagccgccaagcgtctctgccatgatctcagtgcctggtccttgtccttgatgagcgaaggtaaggattgcagagtagatggtgtttcacatcgacgctcatggcgaggacattgccgttccgtcgtagatcgtgccaacgctttgccgtaagcgtgatctcgttgtgcggctgtctgctgcatctgcgtgagctcaggcctggaggatcatggagatagaagaggcgtcgcacacaacgagtgccagcgcagcaaggatgcagaagaccgcgacaaggcggccatccatgcccttcacatggggaggatgccgccgtctgtgtgtccatgccgccaggaatgcctgtccccgcgctgtgcgcgctcctcgcgctgcgggcacgcgcctcgcggttctggaccacttcgtcgtacgacgagcggccctctcggggccgttcgctctgctgtgtctgtcttgtctgtccatgtggatgagcttacgccagaaggagcgcgcccctactccacattcgaagaatccgcagtctctccgtcagtgagaaagggatgccgtgccatcggtcgaagaggcagcggcgctatcagaggaggatgccgtcgaagagatgacctcgggggtcctcgaggaccataccgtagttctgcgtcgcaatgcgctcgagcgcgagacacgctcgaagcgccgacttcgacgccttgaggtcgttgtagagagccgtggcatcgccaatctggctctcgagggactcgtttgcctggagggctgagcggtcgccgtcgagatcgcaacacgggcaaagccgagcgcgccagatggctgccgcgacaagcgcgacgcggaccagcttcacaggaactggtgcgtgacgccctggcggacgcgggcatcgagcccgccgccttcgtatacatcgaaagaggggctggcgaggcctcgcgctagtttcggagcgcatatcatatccgtcgaggcggactgcctcagaggactatacctcataccgaaataccctcactgttgtctgcattggtagtgcgttgttgttcgtttatggtgcgggtggtgctgcatccttggtgcgttgggtgctatgcagacggtccggaggggccgtgagcatcaggtctgcgcctgagcctgtgtgacatcgagcttgactgccacgcgcatcagagcgtgcgtgcccgtgggttcgagcgcacttcctcttcggtcgcggccatgggcttttggtctgacctcgattatcggcacatgtccgcacacgcagaccggaaggtcggcgggcagatgcacccctgggagagctcggagaacaacatgcttcgtaaaccggtcctcgagcgagtggtacgagaccacgcagatcctgccgcccgtattggcccagcggatggcagcgcgcagtccctctccagcacatccagctcgtggttcacctcgatgcgcagggcctggaaggtcttgcgtgccggtgtccccatggcggccggggtcgcgggcaggaatggctgccttcacgatctccacgagctcgagcgtcgtctcgatgggcgccttctcgcgggcgcgcacgatgtggcgcgcgatggatgctgcatgcttctcgtctccatagctgcggagaatccgggtgaggtctgcttcgttgtaggtgttcacgacctcttgtgcgttagagtgttgttcctcggatccatccgcatatccagaggagcgtcctcgtggtacgagagcccctgtcgggtatgtcgagctgaggcgacgagaccccgaggtcgagagaggaagcagtctacgcgggcacctcggcttcgaccagaagctggtcgaggtcgccgaagttgcctttgaggaaccgatggcgggcgctgggcacctcgcggccgagcgttccgctgcggcggcaagagccatatcgtctggtcgattccgatcgagaggccagcaggagcaatgcgctcggccagagcgaccgagtgccccgctcctccgagcgggcagtcgcagacacctctccaggctgggggtccatggcctccagcacctcggagagcatgacgggattatgccgatattcgactttcaacgggagctgctcctttccggctagtcgaacatgaggtcgtccaggtcgtcatcgtcctcggcgttgagctcctcgaagtgctggtaacccagacctcgaagtggtcgcggttgcgcgatgaccatgacgtcacgggagatgcacgcttcgcaagcttctcttcgggaaccttgctgagcgcgacacggccggcggcatcgatgtccaccgtcacggtcctcctcatgagcgttcgctgagagcttgtcctgccctgtccctcggattgagccatccgggaataggaggcggtccaggctgtggccttctggagtgaagccccagattgcgtccttgagaggaacgaggcagacgcggtcgccgactggcggcggaagtcggccggcagggtaaggcgcagcttggcatcgagcttgagctgtttctcgcccgtcaggtacatctgccacctcccgacgactcgcctgtcccctctcaagcgtgtatcaactataacgtctcgatgtccccttttccaaccctttgtcccactttctccaccaaactgcatttccgcagataaaaaggggtgcagcacacgcgcctgccaccccacaacatctagcggtctctttcttttgcccccacaaacccgaagctcgaaggcgtggtatagcaccgcccggctcggcggtcatttgtcggaattgtgtggctgctcccgctccctgcgcgccgggggtgcgccgagaggtatgccatccgaagatggctcctgtcgagatgggtatagagctgcgtcgtctggatcgacgagtggcccaaaagctcctgcacgatgcggatgtctgctcctccctggagcatgtgcgtcgcgaagctgtggcggagggatgcggatggaggccgtctatgccgacgacgcgtcctgcccgtcgacgattgcaaagacggactgccgcgagatcctgccgcgcggacatcagaagaccgcagcgccgcttctcgagagacgagctctcccctccagtcggagaggtattccgcaagcgccttgtgggcgcttcccatgagcgggacgacgaccgctccttgcttccttgccgatgacacgcacgacctcatcctcgagcgataccgccccgacatcgaggcccgtgagctccgagacgcgaagccgcacccatagagcacctctatgatggcacggtcgcgctgtctgccgccgtctccgggaagggctggtcgagaagcgcgagcgcctgcctgacgctcaggacatcgggcaagcgctctgcctttcttcggaagcggcagtgccgctgcaggagagacagaagacatctcttcctggagcatgaagcggtggaagctttatggcagagagcgcccgctcgactgaagaggggcatagccctcctcggggtgctggatgctcaccttcttgagagggcgggtcagtcgtcgggctccgtcacgcccttctcttcgagcccttcacatagcgctcgattctttggttgtattccccccactccacgcccatctcacatgagccccctgctccccccccttgcatcgactcacacgcacggagatgcacagctacgttcgaaagcgaggtagccatgaatccttgtggtgcagaggcacgagccaagtgcgccctactccggctggacgctctggcgtgccgcagctcctcgtgggtgggcactggaagcgcggacactcgacggcaacgcacgacgtgcggcttcgtcgggcggcttgaactcaggtgtgcctggctggcacgaaccaggggtgccatctcgggaagccgaccattcgtcgaggcgctctcagcgagagcgccgattacaagcggccgcgtcgcggatgcttgtcacctcatacgtggcggtggcgactctagagagcggctcgccgtaggcctccatggcagcgtgttcggcttgacctgcaggggtaggcacgaggcgcatcgtgccgcccttctcggtgacatcctcctgtcaggcatgatatcgatgaccggatacgcgcagccggcgagaactcggtggagttgggcccggcatgccagcgacattgcgggcgaactcgcgagacagcgactcctgagtccgaggcagatgccgagatacggcttcttctccgtgcgggcaagggggcagagaggatcttgccctcgacgccgcgctggccgaagccgcccggcacgaggatgccgtcagcatcgccgagcacgtcctcgacgttgtcctcggtgagctcctcgccgtcgacgagctcgacgtcgaggttgcggcgaagtagacgcctgcatgtccgcaggcctcgatgacggaaaggtaggcatccggcagctgcgtatacttgccgacgatgcggatttcgtcttgtccggcttctgctcgctgcatgcatggcagacgtgaagctgtaccaggagctcaatcgctctcgcgcgagtcaggccgagcttctcgcagaccttgagatcgaagccctgctcggcgaggtgcgctggcacgtcgtagatcgacgggcagtcggatgttctgaacacgcaatcctcatcgacgtgcagaagtgggcgatctttgcgcgaatcggtgcctcgacctcatggtctggaacggcagcgatgaagtcaggctgagatgccatggagcgcagctcctcacggagtgctgcgtcggcttcgtcttcacctcatgggcagcgctggcaatatagggcacgaggctcacgtggatcaagagggtgttgcctgggccgtcttccttgcggaacggcggattgcctcgcacgaacgacgagctctcgatatcgccgatcgtgccgccgagctcggtgataacgacatcggctccgacttgctcctacgatgcggcggaagcgctccttgatggcattcgtgacgtgcggggatgaccgcacgtgtggcgcgaccgaggaaaatcgcccctgcgcatccgcgctgatgagcgaaggagtagagtagttgcgccggtcgtgaagttcgaattggggtcggttctcatcgatgaagcgctcagtagtgacgaggtccagactgactctacccgtcctcggtcacgaagacctcgccgctgctggaacggcgactcgtgccaggatcaacgttgaggtaagggatcggccttctgcatcatcacttaaccacgggatttgagaagcggccaagggaagctgccgtgatgcccttccaaggaaaaggaagaagaacgatccgcccgcccgtaacaaagatgtgcttggtcatgaggacccttcatacgcgttgcttgctttcgtacggacctataataataccgcggttcatccgcacgatgaggcaagaacctgtccgagaaacggtgtcctgcatcaattccacaggcatgacgagcgctcgagcatctctacggggtggtgagcgaagcttccgactcgtcgcccgaaagcatgcgtgcatctcatgcacgagtccattccctcgactcggagagctcgttctcgggcacgcttccttccgtcttcgtgacgacgtagtgctgtctgccatgacaggcaacgcgcagatgcgtgacgacgatgaccgatgcagtgcgcgagagagctttctgagcacctcggcaacagcattcgccgtggcgccgccgacacacgcatcgacctcgtgaagacgagcgtatccgtctcggcatccccgagacgaccttgccgccgcatgacacggctgacctcgccgcccgaggcgacgatgcggcgaaggggccgcgatgagagcccgcacacggacgatacatgagatctgcagtggctagggcctcgagcgtccattgcgagcgtaccactggaagcggctcgacgagacctcgacgagaggctgtgaccatcctcgagctgccccatctccttggttattgcagctgcaagctcaggcgctgccttcgcacgtacggaagagatgcaccttgaagcttctgcaagctcggcctcggcagcggagagcgacttcttcgcttgctacgcgctctcccccatacctgcgccgcagagacggtctcttctgcctccgccctccgtgaccacgcacaggccaaggtccggaccataggcacggattggccactggtaggcacctcgcgctcctgcagatgctcgtagctcttcgaagggatcgagctcgaccgagtcggatagtccctggctccgatgcagcatcctcagcctcgatgagggcgctctcgagggcatcagccagcgttccgagcttctcgtcgaagcgcggccgcctcctcagactcggcgactgccgcagaaagcacatcggagacgccatcgtctcctgctaccgcctcatgtgccccttcggcgcagcacgcatgagcgcctcggcatgctctgccttcgggcagcgcctcttcgagctctgcatagtcttcccggaaggcccgcctcgtcgaatgcgcgagagtcacgaatgccgcctcgcgagcttctcctcggtaggcacggcatcgcctcctcgacaagtctgagctccgatgggctgcgtcagattcactgagcgcttcctggtaggcttcacgttgcctcagctgcagcgctctcggcaaaggcaatcgagaagctgaccagcgtcgtgacatcgagaagctctggtgctcatgctggccacagagatcctagacggcggccgagcgtctgtgcgagctccttcactgatgccatatgcccgtcgatatcgaccttgccgccgctccatcagcggtgaggcgcctccgcacgatatggccatcctcttccccgtcatccgtgagaagaagcggccctgcacttcgggccatctggcgccttccctgaccgaagaggcatactgccctgtcgccgacaagaagcttcagggacgagagcaggcagacttgcccgagccagtctcgccggtagcacggtgaggccttctgctggctctacctctccgcttccttgaggcgggcacattctgactgaatctcgtcaatcatctatttggccactttcccgtagaagacgcgcgcgaaacggacgaatagaagctctgcgcattgtagtcgaggaggatgatgtcgccctccccgcgcctgaagcatatgcatggcccgtcctccaggcccatgaggcggcactcggcgggaggtacgctgcgctctgccgggcgctcctccgacatgtcgcgcttccacgaaggactgaaggcgctgtcaggaaggcgcgggccaggagagtattggggcgatcggcacgccagacatgcccgtgactccggcgatcacgatagggcctcctgcgccatcgcatagccggtcgagcccgtcgacccgtgagacgagaagccgtacgccgcggatcctgtcgatgtgcgttccccgaggacccgacatgaaggaggatgacatcgccgagaccgtcccgggtcacagccatatcgtcggtcgcaaagctcttctcggtataggcgcttccgtccggcagcacatattctgcctcgatggcaagggtctcgccctatgcggggaatggatcgcctgcaaacgcaagcccgccggacaggtcgtgcgcatgtccttcggaccgccgcaggtaaggaagccgagacttgtccataggagaatcccatgagcggaatctccggtagccgacgatacggcagcacgcaggagcgtgccgtcgccgccaagcgagatcacgaggtccatgccatcagcacaggccgggacgctcttcctcgggcttctgtagggggcaagcacggcttcatgcccctcggcttcgagccagccggaaagattgtgcgcgcctgaagcgcatcgctgcgctccatagtttcggtacgagaagcacttcacgcgtagttcaccttcgttcacatcgattccgtaccccgcagtgtagcatcaagcgccatctgcagcacagacgtacagatgttcctatgaaagattaaaggtctcagccttccctgacaacactgagagaggtccagcaccagtccagcctctccccttgccagacagccaggtattcgtggttgcccgtgcaccgtgatcgggctttcgcaggcacccttgatggcaggcctgatcacaaaggcaccgcgccaccttcatgagagttcagcctcacttcaggatcgtgcacaatgccgcttcatccacctatcgcgcgctggctcgaactgcggcttcacgagcgtcaggaacgcccgtatctttcaggagctcctgacagaaggcaggatggagacgaccgaggtgaacgaacatcgcagacagcaagatcgatcgtgcccatgcgctcaggcgtcggcacatcgacgtattcgtgcgctcgaagagctcgactctgggatggttccgaagcgaccagtcgaaactgtgcatagcaccacatcgaccgataaggacgcttttgccccgtgggagagaaggcagtccgaaagcctcccgacgagcagcccaccatcgaggcaggcaaggccttctggcttcgcatcgaaggctgagagaccccgctcgagctgagtcctaccctgctcacgaacgggatatgccctctcacatggagctcgatgccggctttacctgcatcgccggcagatttaccatgcgcggtcgtcgtcgagacattcctgccatgacagaaacgcagggcctcgtccgttgggaagaagccctgcgctacaagttcctcatcgagccttctgcgccgtgccacaggctctgccctaccttggtctgggtgccccgcgtgctctgcatcctgggcgtcgaccatatcgatgaccttggagccaagagcgatgggctcgtcgaagaggtcgagcgaacacgctcgtacgcgacgttcctcggcgtcacctgcccggcaattcctcgtcgacctgctgacatctcatcgaagtcttgtaggcagatcgtatcgatcttggccatttacgcgctctcctctgccgactctgcggcctgtcatcggcgtcctttgatcccttcgcccgctgcaggtgccctttcggcaccttcacgcctcttcctcgtgcaacgatctcggcacataggcagggccaactcgcgtgcttctttcttcggggcttctctcgcttcggggctgtagcggcaagcgcctctggccatctcggtcaccctcttcagcttcgcgggcttgaggtgcgtctgcctcgagctcgcgtgcgatctttccgagcacgccgttcacgaagcgggcgtcgactcgtccgtgccataggccgtggcaaaagctcgacgcatcgtcgatcgtgtacaggggtgggacagctctacccgtcgacgtcgagcggatctcataggggcaagcctcaggagatgcgagttcgactggccgtcatgtaatagagtcgaccagttcgtagcgacggagtcgatgatgcggttcaaggagggacgcagcgaccagtgccacgtggcaacgctcgccgaagggatctagcgggcctcgatatggcattagtcccaatcgagcacctccatcccgacgcccgttcctctgtcctggaagataatctgccagtctgtgcctgcgtgcagggtgcgtccctttaacgctttgacgatgcttgacaaggctttacacccttggggaataacgaggctgtccatgcagacaatcgactgccgatacttcaacgccgatctgtttcgggaaccggcactgcgactggccctggcgcacgttctgccgcaagctcgcagcaagaacgggtagccatagaaagaccgacagatggacgaccgtgactcatgccaggcggccgtcctcttcttcggactcgactgcctgtgcgaaattcgagagtcttggccagtgaagacactga

SEQ ID NO: 70 - DNA, 50163 bp, Unknown
  Metagenome-assembled genome
atacctcaggcatcgtctactgcaggacgaggaagcgcaccgaatagtcgcagcagcgtttctcgagacggcttccgtgctgccacctaccacccggtatgaggcggacgagcgcacccgcgaacaggaggcctttgtccaggacaatgtctctgtcatcgtcgcgacgaatgccttcggcatgggcatcgacaagtccgacgtccgctttgtcatcaatgacggcctgccgctcacgctcgaggaatactaccaggaggcaggacgtgccggcaggaggagagcccgccgagtgcatcctgctttggagcgacggcgatatccgccttgcgcacttcctgatcgacgcaccgaggtgccggaagggtcggacctgatcctgaagagcgcatccgctgccgcgagcagcttttgggctccatgatcggcacgccgagagcacggtctgcctccgtgcccgatgcttcgctatttcggcgagaaggcagacatggccggaaactgcggcggctgctctgtctgcgtgcccacgctcggcgagcttccgcgccagtcccatgtcttcggcggtgcggctgaagctgcttcagtctcttccttcacgaggcgggagacgatgcagaagagatgttccagaggctgcgtgccttgaggagcgccttgcagacgacgccatatcgcgccctacatggtcttctccgatgcgacgcttcgtgccatggtccgccgccgtccccagacgaggacgggatgctcgagatatcgggtgtcggccaggccaagctttcccgctatggcgcgtatttcctcaaggaactccaaagctagcggcaacaatctgcagcaaaccgggtaggaaatgtgttattagaggtgacagacaggagcagacgtggcgacaaagccgaagatgaaggtgaaggcacaggtctcgagcacgaagggaagtgctgaagagcaggagcgcatgggctccgtgcgcaagagcgtcgtctttctggctatcgtcgctgtcatctatatggcctaccttgtccccgggcagttcgggagttcatggcggccttgggctccatagataagggctgggtcgcggcagcctgtttcgcctatgtcatctactacttcttcggtgtccttgcctatgtccttgctgtcatcaaggacccgaagtgccccttgggcatccgacactcatgagcgcgtagcgtcgggcatcttcttctcgaacttgacccgaacggcgcgcggcgcgcctgcccaggtctaccgtctcatgcgggcagggctttctgtcggagcggcagggctgtccagtacacccgcttcatcatctacgaggcaggaggaggcatcttcgctgccctcatgctcatcttccgggccctgggttcatggacacctatgccgatgcagcatggctcggcgtgcccttctcctcttcggcttcaaggtcatcgaggtcggcgtccttctggccatctgcttcttcccgaaggtcgtgacgaggtcggcctctggatcatcaagatcgccacgaaccatggatggatgaaatccggacaagtggcggagatggcaacggtccggtggacgagttctcgcgcggcttccgctccgctgccaagaatctgcctgagctcgggctcaccttctcgtgacgctcctgcagctcagctgtctctatgcgctgccgtggttcgtgctccatgcctttggccaggatccggatcttctgacctgccttacggcaggctccatgctcgagcttctgacctctgcgattcctcttccgggcggtaccggcggcgccgaagcggctttgccgtgctctttggcggcatgttcggcgacgcgaatgtcgcagcaggctatgtggtgtggcgctcggtcgagtatttcctcctgtgctcgcggcgatccctcttctctcgcttcgttccgacaggggcagcatcgcagcgcgctgggcacgcttcaagcgccgtaccggctcagcgaccttgaagctcgcttcgggcggccgctcgaagggcggcatcagcgtgaatccgaagaagatgcagaacaaggacaggaagtagcctcctgcatgccgtctgccgacgcttcggtgcagggcgtccgtttggagcagcgcaacccctatttcctacgcatactgggtatgttgcaagtctattgctgcacgaggcacacccagggaatgcgaggatcatccatgaacatcatcgagcgctttgcgtcgaaccccgaatactcttcgaagcaccggagaggctgacctttgtggcccagccccgtaccatctatgcgccgcttgcaggcagatcgtcgaggacgaggtcgagaccagggcctcttcggcaagggcgtagcccttcatccggcagcagagatcgtctatgcgccgatttccggacgcatccgtgcgacgactgcacgaaccagctatcggcatcaccaccgctgacggcatcgatgtcctcatgcacatcggcattggcaccgtatccatgaacggacgcggctttgtccgcttcgtgcaggcgggagacgaggtcaggtcagaggcaggagatccgctcatcgccttcgacgaccagcgcatcctcgatgccggctacaaggacaccgtcgtcgttatggtcacgaacgcagacgagctcgggcctgtcacctacgaggtcgacgagtccgtgaagctcggctcgcaccccgtcgtgaagccgggcgagctcctgatgagggtcgccgagaagtaggccagcggcgcttctttggaatgagcaggaagacggccaggaaggcgcagaccgcggcgccttccggcttgccggctacggtgaagcctatggctccgagtgcaaggattacgaacttggcaggtgtcggcttgagccaggagcgctctgcctccctgagctcgcggtcggtctccgactcctctctgtcttcctctgccctcttttccttggacgtgtgggacgcggcatctttgcctgccagtcgcccctcttcatcgccgtagtccccagaatgtcttgcctgttgccacctctatgctcttgagcggctttgtgcgcggctttccgtaccagggattgcgcagcagttcgtggaaggtgaaagccgcagcctctgcctctgaagcagctgtcgtctctggtgccttgccgctgaaataggtgacgcactcttcaagcgtgcaggccttccaggagtcggttgccgggtccataggcgccatgcgcctctgagaactcatgggcaaggtcgagcgtctttgcctgaggcagcgtgatgcctgatttcttcaggaaggcaggaacatcctttccgtagaagacgatgagctgggcagaggagagaatctcctctatctcgggagcctgctcgcgcggggtcttcctgccctcgaccatggcggggagatgcgggtcctcgtctctgccctgcttccagctcttgcgcctctcggggcgcacaagctcgtcgaagaggatctctccggtgccgtctgcaacggcgagggcaagcgcttcatctccggcctttgcgttgggtccggtcgtcaggcaccctatggctgcgatggctgccggtgcatacgatttgagcccttcttttctccccatagctctctgccttcctgagatggttgcagattgattctggcacaagccgcccttcgtgcgtattcgtcctgccagatgccgccagcctgttaacaataggggaaagacctgaaactatctcatagccttggatacaattcttcatactgtccatcgaaggagggctcatgggatacagcgacgaagatgctcagaaccgcgccatcatcacggtgctcggcagcgaccgatccggcattgttgcagccgtgacgggagtgctctcggaacacgatgccaatatcctcgatatctcgcagaccatcctgcaggggatcttcacgatgaccatgctggtggacctgaaggacaccgacgtgtcgttcaaggcgctccaggcagagctgcaggacctttcgcagaagctcgatgtccagatcacactgcagcgtgaagaggtattccgcttcatgtatcgtctctaatctaaggaggcagcgtgtcacaggaagacaagcagcccgacactcagacgggtgccggaagcacggcatctgctcccgaggtacccgtttccaagccacagattgttcccggcaaggagcataggcatggcgcgattcttgattcgaccgagacctcggctctgagcctcatgggcgagaaatatccgatgccaagcgtgagcctggggcgccccccggtctccgaccagctctatgtgggcttccgtgctatcgacgaggtgccgaacgagctattcgagaaatacgacgtgaagaggggcctgcgcaatgccgatggctccggcgtgctcgtaggactcacgacgatctccaatgtccatggctacaacatggtggacggcaagctcgtgccggatgagggcgacctcatataccgcggctaccatatccgcgatctcgtcgacaacccgcagaaggaggaccgcttcggctacgaggagattgcctatctcctgatttccggcgctcttccgacccgcgaccagctggccgacttcaaggcccgcatcgattcgaggcgcgagttcccgacagacttcctcggcgtcttcccgcgccgtacgagctcccattccatcatgaatgtgatggcccgctcgatccttctgctctatgccttcgacccgacgccggacgatacgtcgccgacgcatgaggtggatgtggcactctcgatgctcggccgtcttccgcgcatcgcagccatcgcccaggcagcagaccgtgccgccaagaacaacgagtgtctcgtcgtgccagcagctgagcctggattctcgatggcagagacggtcctcgatatcctgcgcggcgatgagggcttcacgcacgaggaagccatgatgctcgatgtcatgctcatgctccatgctgagcacggcggcggcaataactcgacgttctcttgccgtgtcctctccagttccggcaccgatgcctactctgcctatgcggcagccatgggctcgctcaaggggccgaagcacggtggcgcgaacttcaaggtcggccagatgatcgacgatatcgccgcccacgtggagaagtgggacgacgatgatgagcttgcggcctaccttgcccgcatcgtcgagggccaggccttcgacaagtccggtcttatctacggcctgggacatgccgtctatacgctttccgacccgcgtgcacagctcgtgaagcgctacgcaaggaagcttgcgaagaacaagggccaggaagagcggctcgacctgatcgagcgtatcgagaagctcggacctcaggtcatgcgcgacgtgaaaggcacgaagaagccgatctgcgcaaacatcgacctctatacgggcttcgtctactcgatgctcggcatcccccaggagatgtatacgccgatcttcgctattgcccgcatggcaggctgggcctcgcatcgcatggaggagctctatggctcgagcaggatcatccgtcctgcctacaactcctacatgccggaaaacgagtatgtgccgatcgacgagcgtgcgaaggtgtcacgcatttgggcataaggattgtcttctcggacctcgacggaacgcttctgacctacgacaagaagctctcctgtgctacaagacagatgctcgagaatttgacctcgcgaggaatagaattcgtgccctgctccggcagggcactttcaggtcttcccaaagagctcttggagctcccgtgctgccactatgcggtgtgctcgaatggtgctgccatctccgagtccaagacagatcgcaagctcttccagagctatatgggacgagaccgtgcactggcgctctggaagcgtgtcaaggggctcgatgtctctttcgatatctttgcgggcggcaagatatggtccgagcgcagagcgtacgagaggctcgacagctacggcatcgatgaacagaccctgaagtctgtgaaaggctgccgtacgccgacggagaggacccctgaagagacgctcgcctggctttctgggcgaggcgaggacgtggagcgtgtgaccctcttctggaagacggaagagggaagagacgcggtcattgccgctgtcgcagcagacccgacgcttgcttggacgaactccgtacctcatgacatagaggtcatggatgcttcggtgaacaagggagctgccctcatatggctctgcagccatctcggcatccctgtctcgtcctccgtcgccttcggagacggactcaacgatgcaccgcttctggccgctgcaggtgtgggtgtggctatggcaaacgccgtgccggagacgaaggcagaagcggacgccgtgacgtcctcgaacgacgaggacggcgttgcacgtgcgatggagaagcttctcggatagagcagcggcaacaggcaggcatcctatagcggagccaggaaaaagcaggggctggcatgtgccagcccctgcttcgtcgttctctgagagcagctatttcttgtctgcagtctctgcgttctcggtctcttcttcctcttcgatatcctcgtcggagagcggacggaagacggccgtgtcgccgccgatgacagcctcttcggtgattgctgccatgttcgacgtctcgtctgcgacggagtcggagaagatgtcctcgtcgtcctcgtcgatctttgccatcttcggggcagtgcccgtcgtatcaggaggtgcgatgcgcttcagggtcggagcagccttcgcacgcgtgaacagcggcacgtactcgtagatgatggacgaggtctcgaggccataccagcgggcaggcgagccgcagacgtgcctgattgcgtacttcatcatcatgacgtgatagtcgctgccggagagggcggtctcaggggcaagcgccttgtgcaggatgcagaagcggaagtcgcccacagcacccgggttcttgtagatcgagtagtggtggtcctgctttgcgagctcatggttctggacaaggtcgccgacgatctggcgcaggaacgcattgacacgctggttcacgcggaagccgaggcgcagctggaccttgaagatgaagtcagtgccgaagctgttgacagagtactcgagcgtgttcggctcgtctgtgaccgtgacgttcaggaaccagtaggcacgggcacgcttcgggcgcttgtcgaggatcgagtagaggatgtcgcggtcgagcttgtcaggcgaggagtcgttcgtcaggaacacgaggttgtctgccgtgtagttgtaggcggggtcgtccctgagctctgcaagctggccgatgtagtccttgacgggaaggtagacggactgcgtgcgctcgatggcggtgccacggcgccagatgaacatgacaaggaagatgagcgttgccatgagcacggtgaagtagccgccatgcatgaacttcgtcaggctcgagaagaagaatgtggactcgaggacaccgaagaacacgaggaagacgaccgcgccgacacgcttgtggcacatctgcgacaggtacgtgtacagaaggatcgttgtcatgagcatcgtcaaggtaattgccaggccgtaggctgcttccatgtgcgaagaggtctggaagagcagtacgacgaagatgcaggcgacccacatgatgttgttgaccagaggaatgtagagctggcccttcgtctcggaaggataggtgatcttcatgtgcggcaggaggttcagcctgattgcctcggagacgatggagtaggagccggtgatgagcgcctgggaggcgatgatggcggcaaaggtcgaaaggatgacggcgaaggggcgccagacctcaggaagcatctcgaagaacgggttcatgtccgtcatagcaagaagcgtcgggtcggtcctgtttgcaaggacccaggcaccctggccaaggtagttcaagatcaggcagcacttcacgaatggccaggaagcatagatgttcgccttgccgacgtgtcccatatcggagtagagggcctcggcgccggtcgtgcagaggaagacgttgcccaggaccatcatgcctgcagcgttcttgttcgagaacaggaatgtgaccgcgcggagcgggttcagggcgcgcaggacgttcaggtctgcacccatgttgagaaggcccgtgaagccgaggaacaagaaccatatcgtcatgaccgggccgaacagcttgccgatgctcgaggtgccggcacgctggatcacgaacaggatgcagaggatgatgattgtgatgccgaccacgatatgctggttgtcgcctatgagctgacgtccaagctcgatggtcctgagtccctcgatagcggtcgtgaccgtgacggcaggtgtcaggatgccatctgccagaagggcagcgccgccgatcatggcggggatgatgagccacttcgcgcagcggcgcacgaggctgtagagcgcgaagatgccgccctcgcccttgttgtccgccttcattgcgatgaggacatacttgacagttgtgatcagggtgatcgtccagatgatgagggacagagcgccgatgatcacatcgtcgtcgatcgtagccaggccgccgttgccggagatgatggccttgatcgtgtacatcggcgatgtgccgatgtcgccgtagacgacgccgagcgtgaccaggatcatgcccatggacagaggaatcgtgctcgacgatctcttctgcggcgtgcgcgcggctgcaccagatttcgtactcatgcagatactccaaactgtcggatgcttgagactcagacagaaatgacgaatcctacaaatgtgatattgtacacgtgatatacgatagcggccctgacatgcctagatgcggctgataacagtctgctagcggcaaaagcgtataaatacttgcatttacggtatagattggactgctctatccaaagaaaggaacgctatggcagaagaggaaaaggcgccggagacggcgcacaagggttcgaatctgtatatcggctttgccgcacctgagaggctcggcgtgcccgagcccgcatcgaaggttctgcactatgaggcaggaggggagtcctttgactacgaagccacggcagcgcaccttccggtctatacaaatgacggccgcgtgcttgcaaagatgttctcgctcacgttcgtgaagctcgaggatggcaagcaggatgagaagcgcccggtcacgttctgctacaacggcggcccaggatgtgcttccgtgccggtcgacttcggcggcatgggacccttccgtgtcgcgacagacggcgtcgagcatctgtcctatccgattgaggcagagcagaacccgtggagcctgctcaggctttccgacctcgtcttcctcgacgcgccgggcaccggcttctctgcggtcgccgaggatgccgacccgaagaagctcttcggtatcgacggcgatgccgatgcgttctgccgtgccatcatggagtggctcgactcccatgcccgctggggaagcccggtctatctcttcggcgagtcatatggcactgtgcgcaactcggtcctcatgcgcgtgctcggcgagcacgatgtgaaggtcgccggcgtcacgatgctctcctcgatcttcgactgggtgcagacgcagccgggcgaggatctctactatcttggcatgatgccgacctatgcggcgacggcccagtacttcggcaaggccggacaggatacggatgtcgacacctggttcgatcaggccatggcatggaacgaggatgtgctcgcaccggcactcctcaagggcgacaggctcggatctgagaaggaggcagaggtcgcttcccagatgagcggcttcatcggccttccggccgagcagatccagcgtgcgcacctgagaatcggcctcgacgagttcaggcgttccatcatcgccgacgagggcaaggtctgcggcaggctcgatatgcgcttcagctcgcctgcccctcttgcctcgcaggacagcgccgagtggtttgccggcgaggatgccgcagatgatgcggtggagtcgagctgggtcacggcattcaggcgcttcctctcccagacgcttggctaccgcaatcctgccgtctatctcaacagcaactatgagggtgtcggcacgagctggaactgggaccatgctgagccgggcacgatggagaccgtccatgcaccgaatgtctcctacgacattgccgttgccctgaagcgcaacccgcacatgaaggtcgccttcctcggtggccgctacgatgcggcaacgacgtactggaacacggtccacgacgtctcctgcctctatctgccggaagacctgaaggagcgtgtcgagttccaccgctatggctgcggacacatggcctatgtcgatgtgccgacgctcgaggcgctcttcgaggacatgcgtgccttctacgcaaagaagtaggctctggaccagagcagcaagagagaggcagtgccgctgcagtcgcagccggcactgcctctttgctgtctatgccgtctcgctaatagcgggcagagtaggggctcctgtgggcaggaccggtacctgcaggaccatgtcccctgttcggacgtccattgccggggcgtccctgtccggaaccgggcttcctcggtccatgcccgccggtgcgggcgtttcctgggcggctgcccgtggagcgggtgccagaaggacgcgggcccttgcgggcgggggcatgtgccgaggagacgccacggggacgaggagcacttctgtgctcgggcgcgctggcttcgccttcaggacgcggcgtcctcttcacgaggtagcagtggtggatcttcggattccgtgcaaagtcctcggggatggtctgggccgtgatgtcctcgatctcgacgcctgctttgctgagcttttccgtatcgggcttgaagctcctgaggttgcaggagaagacgcagacgccgtcatgggtgaggagcctcgagacaccgatcaggagctctgcatggtccctctgtacgtcccaggaggcatgcatgcgcgacgagttcgagaaggtcggcacatcgcagaagatgaggtcccagcggtctcttgtgtggcgctcctgctgcacccaggagaggacatctgtctggacatactcatggtcggggccggagaagccattgcgctccatgttgcgcctggcccattcgagcgatggcttcgacatgtccacggtcgtcgtatggtacatgccgccatctgcggcatagcaggtcgccgtgcccgtataggcaaagagattgaggaagcgcttcgagcccttcgtcttctttgcaagctcgcggatgagggcacgggtgtcgcggtggtcgaggaagatgccgcagtcgaggcgtccctcgaagctgacctcgaagacaaggccgccctcttcgataaggtgggcaccctgaggcaggagcggacgtccgtccttgcgccttcctgttttcggctcgggggctgtgccttcgtctgcgtactgagatccgcccttcgcacgggtgcggaccttgagatagacatggtcgggtgcgaccttcatgacccggggtgcgatcgtgagcacatcgagcagccgctcatgggcgagctcgggatcgatatccttgggtgccgaatattcggcgatctggagccagcgctcaggcgtgcctgcaccctcgaagagctcgattgcgacagcgtagtccggcaggtcctggtcatagaccctgtagctcgagatgccctcgcgcttggcccacttggcacggagctttgcgaccttctggagcctctttgcgaactggtcggaggcagaaaggagcacagagatcttctggccggctgcctctgccagagggcgctctggcacttcttcgatgttccagctcgagagctgctctgtctggctgccctgaaggaccgtggcgctctcctcaggggctgtgccgagcacgcttgcaagcgaggggccgggtgccaaggatgctgccttcgtgccagaggggagtgccgctgccgtctctgcaatgagcgagagggcctctgcctcttcaggaagcgccccttcgcggagccatgaaaggtcgatgagggctgtgggatgggaaagcgtcctcacagctgcggagaggtcttctgccgagcggcgcatatcgaagaagcggggctccacctcgcccatgccagcctggcggagcatctggcgaagcgacgattcggcacctgtcctcgtatcggcgcagatgagggagagcctgctatcggcgcctgctgcagcacgctcctgtgcctcatccgaaagctttgtccatgtgccttcagcgtgcccgagccagccggtgaagccccaggagggacgcagaaggccaggagcccggtcaagcgcctgggacgctgcctctgtggctatggttcctgctccgctatagaccacgagcgcttcaggctcgtcgtggcggacatctgcataccagcgggcctgctcgaggagtgctgctgcatagtcgggcctgagcggcggaaggggagagcgggacgatttccttgcggcatagccgcggcggaagagcggctctcctgaaagatcgatgccgatcgaggcgcgggacttgccgaggcggatggcaatgcggatatcgggattcgcggtatcggtggcaggacggatgccgcgcttctggagcaggcggtcggagattgcgtccttcgtgcgcagggccacgaactgggtgttcctgagggcatcgttcgtgccgtgtgcctcgatctcgagcgtcgaggtggcagagatatggtcttcccagggaagtgctgccgccccttcatagagctcgtcggaggtcttggcatcgaagcggccaagcacaaggacgatgcgggaggcaagcgaggaccagaggcaggccctatagccatcctccaaggtcccctcgaatgcggtctggcccttcaaggggcgtacggatgagatgccgagagaggagagctcatgggccagaagcttctcgaagccggcaggacaggttgcatagaattccatcgggtcacctttcgcccgtaaagtaaggggcgcttatgcgccttctgccattgtagctggcaggacgcagattccctgcttctgcatgcctttcccacgaggcgggctgctgactccatctggatggcatatctgctcagatggggaattgattatcaactttacggcaactagcggtataaaagtagcgtggttcagaatgcagtaagttccgaccgtctctgctctttttggtatcgaggaggatgtacatggaagctgaagtacaggctaaagtcgatctgtggcgcaagaatgtgaccgagccggatctcaaggaggagcttgagtccctcatcgcttctggcaacgaagaccagctgaacgatgccttctaccgcaatctcgagtttggcactgcaggccttcgtggcacgctcggtgtcggcacgaaccgcatgaacgtctacgtcgtcgcacaggcaacgcagggtgtcgcggactacctcaacgctcactacgatcacccgacgctcgcgctcgcccgtgactcccgtctcaagggcgaggatttccagaaggtagctgctggtgtccttgctgccaacggcatccatgtctatgtgtatccgcgcatcgagccggtgccgacgctgtcgttcgctgtccgctatctccacacctctgccggcatcgtcctgaccgcttcgcacaaccctgcccagtacaatggctacaaggtctacaacgacaatggcggccagattgcaaacgaggcagcagacgagatctctgcttccattgcgaagaccccgatgtttggtgctgtcaagatgatggacttcgaggaaggcctcaagcagggcctcatcgagtggacgcctgaggaggtcctcgacaactacatcgcagctgtcaagaaggtctccattccgggcttcaaggcagatccttcctattctgtcgtctacacgccgctcaatggcaccggcatggagtgcgtgacccgcatcctcaaggagatcggcgtcgagaacgtgacggtcgtgcctgagcaggcacagcctgatggcaacttcccgacctgcaagtatccgaacccggagttccgcgaggcactgcagctggctctcgacctcgcggagaaggtcaagccgaaccttgttgtcgcaaccgatccggatgcagaccgcatgggcactgccattccgcacaacggcgagtacaagctcctgaccggcaatgagatgggcgtccttctgatggactggctcatcaagatggccgaggagcgtggcgaggatccgaagcgaaaggtcgctgtctccacgatcgtctcctctgtcatgcctgatgcccttgcccgcgattacggcttcgagatgcgccgtgtcctcactggcttcaagtacatcggcgaccagattgaccagctcaaggacgagggcgaagaggaccgcttcctcatgggcttcgaggagtcctatggctacctcgtcggcacccatgcccgcgacaaggatgctatcgtcgccgtcgagatgtgcgtcgagatggcagcctactatgcagcgcgcaacatggacctctatgaggcaatggaagagctgtacaagaagtatggctactacctgaacggcactgtcaatgcctccttcccgggcgaggcaggcgctgcacgcatggcagagatcatgagcggcctgcgcgagaagccgctcaccgaggtcgctggctacaaggtcaccggcatgacggactacgagaagtgcgcagagatgccgcgtgtctccggtctccagaaggagccggcgcagaagcttcctgctgccaacgttatcgagttccgcctcgaggacgacaacaagatcatcttccgtccgtccggcacagagccgaaggtcaaggcctacctgttcgcaaagggcgctacgcgcgaagaggcagaggccgttcgtgcaaagctccaggaggctgcagagagcattctgaagtaagtctcgcacgacaagcttcatggctggagccggtcctgtacatcagggccggctcctttcttatgcctcagatgcaattcgcgacataacaaaggagggagccggatggctccctccgtgtacgcggatatctctgttgcctcctactgattcgacgtagtcgtggtcgtcgcagtcgtcgaagacgtggagctgtctgctgagtcggctgcttcgagtacatagagcgtcgtcgaggagtccgcaattgtgccggcatcccagctgtgggcggaggcagaggtcgaggtcgggtcatagagcgtgaccgaggtatcgcggttgtaggagacgaggagcgcccagtgggactcgtcgccgacggtacccgcctggagctccacgaggataggcgtgctggccgtaaggttctcggcgatatcgttctcggtcgcatcgatcttcgtgaccttgaggccaagcgaggaggcagcggacatgaagaagtctgcggaggtgccggaagcgcctgtcacatagccgccattgattgcaagctgtgccatatcggcaggggacttgtcgttcttgcctgtgagccccatgtatgccattgccaggctcgtagggccagagccggtaaggccaagaggaagcgaaccatagtccatgaaggcccagttcgtatcccagtcatagagctcaggataggtgcccttcacgaccgtgccggtataggcgctcgtctccttcgaggcggtcggcagctgctggacgaagtcgatggccgtgggttcgcgcagcgcaagctcgatgatgcggtcatcggagtaggcggtcgcgtttgccgcgatatccttcagcttgtctgcattgtcgagggcgctcgaaagctcctgcgaaatcttgtcgtctgccccgtaggcgacgcgggagtcgaccggattcgtctcggccgtctcctgctcctccttctgggcattgcgtgtcgcgacgcagctcgagacgcaggagctgatgccgaagattgcaaggagcgcgacgcaggcaacgacaatcaggagcgcaagcgagcgagggctcctctttccccgcatgcgcagacgcctgacctgctggccagaccgcccgctatagttcgggtgatgcagcgtatagccggtatcatggctgccgactccgttgaggcttctgctctgtacgcgctgggagccgctgcggcctgagggacggccttggcgcctcgatccctgcgtgcgacgatctctgtctcgtgtagaggacatgcttcgatcctttatgccaatatccgtatccggcccgggtctccatgagccggcacctgttcgtacaatttcttatgataggctaccttgcatgcatatgcagcagcgcttttgtgagcgtctattcgtagagccgtatctaccgttcagaacattgaggatattgcggtacttgcggcgcattagactagtatgatgattacgaaagttgttatcgacgctgcataactcgtaagcaaaatgcagaatacatgccagcgtgggaggcatcatggtgaaaagacgcagcaacagacaggatgctgtgcgcgagatagttcgcagcaagtccatcggcacgcagcgtgctctcgtgcaggagctccagaatgccggcttcacctgcacccaggccaccgtttcgagagatatcgcagatatggggctcaggaagcttcctgaaggcatctatgttctcgcagaggacctgcacctgcagcgcatggtctcagagttcgtgaccgagatcgagcgtgcccacaaccttgtcgtcgtgaagtcgcagccggggacggctccaggtgtggctgccgctatcgacgcggcgcagctgcctgaggccattggctcggtcgccggcaacgatacggtgctcgtgatatctgcgacagatgaagatgcacagagcttcgtagatatcctgaacaagcttcgctcgccccacaaatagggaagagcatagagatatatgggaagagcgggatggcttctgccatcccgctcttcttctcaaaagaggcagagataggagaaaggctcgcttgtgcgggcctttctggtctagccattcgttgatgtggatccgttcgtgctctcgcctgtggtgccggagttcgacgtgccggactccgtgtccgttccgccattgccgccattgccacccgtgccagagccgccggtaccggagcttgcggagctgttcgtctcggtggacgaggtctccgtcgaggaagtctcggtcttcgtcgtagccgtcgtgttcgtcgatgtggagctcgaagagttgctcgaggacgtgctggagctgctcgaagcagaggagctcgagccgctgttgtagcccgaagaggtgccgacgaaggcccagctcgaattcgccttgtaggtaggtgctgcagcctccgagaattcttcgcgcgacacgcctgcaagcgcagtgttcaggaagttcacgaagatcgggcaggaggtcgtgcctgggataccggcagagccgtggaccgtgacgccctggccgttatcgttgcggtagccggtccagacagcgacggagagctgcggcgtgaagccgaccatccagaggtcgcggttgttctcggaggtaccggtcttgccagcaaccggctggttgatcgtgatcttggagagcgagcttgcggcggtgccgctcttcacgacgccctcgaggacctgcgttgcggcgtaggtcacgctcgtgtcgacgacctgctcgccagagtcctcatgctcgtagacggtattgccgttcctgtcctcgatcttcgtgattgcgacaggatcgcggtggatgccgccggaagcgatcgtggcgtaggcctctgccatctgcagaggaggcacgcccgaagatccgagggtgatcgaaggaacagcggacaggtcggcatcgatgcccatcttcttggccgtcgagacgatgttgtcagcgccgacgacgagggcgacctgcgcatagccggtgttggaggaaagctccgtagcgcgggcaagtgtgatggtgccgtaattgttgttgttgtagttctcgacacgccaggtcgacgtggcctgaagcgggctcgagcagttgaggatgacggtcgggctcatgccctgctcgagggctgtgatgagcgtgaacgtcttgaacgaggagcctggctgcctgaggccgtaggcggcgacattgtactggtcctcgtcgtagtcgctgccgccgaccatggccttgatgtagccggtcgaaggatcgattgcgaccatggcggaatcgaggctggagtcgccgatggagttgagctggttcgtgacagccgtctgggccgcttcctgcatcgcggagtcgagcgtcgtatagaccttgaggccgcccttgaagatcgtgtcggtatcaaagtcctcggacaggatggacttgatgcagtccgtccagtacggataggtgccgccctcatcaagcacgcttgtgccctcgttgagcgtcagcggctctgccaccgcctcgtcatgctcttcctgcgtgatgtcgcctgcagagagcatgcggtcgaggacggtgttcctgcgctctgtcgctgcttcggggttcgtgaacggatcgtaggcggaaggcgactgcgggaggccggagagcgtcgctgcctcggcaagcgtcaggtcggaagcattcttgttgaaatacgtgatcgaggcagcctggatgccgtatgcgccatggccgtagtagatggtgttgaggtacatcatgaggatctggtccttcgtgtacatcttctccatctggatggcgatataggcctcgcggaccttgcgcttgatcgtgtagtcgaactgctcgtcggagagcaccgtgttgcgcacgagctgctgcgtgatcgtggaagcgccctcggagccgccgccgagctgcacgacgatggcacggacaatgccctgcgggtcgacgccgttatgctggtagaagcggacgtcctccgtgtcgaccgtgcccttgaggacatacggggacacctggtcgatcgtgatggagcggcggttctgcatatagaactctgctatcacgttgccatccgagtcatagacctccgtcggctctgctgccaggtaggcgtctgccgacgtatagtccggcaggtcctggagccacgagtccacaagagagttcaccgacatggtgagcgcgatcgcaagcatcgctatgaagccgaagatgccgacgatcgtgaacgcgacggcatgggtcttggcatgcttgtgagcgcgtctggtgcgaatgcccatgaatttcccctttcatagatacggaacattatagagtcaggggagccactcccgccagaacgaaaagacttggcaagccgctccatgcaatcaatgcttttctggaagatgagggattcatggcgcaagcagctgaaaggctgcccgaagatgttctgttcgctcgtgtggaagcggggggttgcggtgccgctcgctatctatctgcgttacactaactatttgactgaaatgcggcgatgcggcctttcggctcgcgcctcgagaaggagaacatatgctgcctgtagacgaacagctcaaggtcatcacgtccggcacgatgcagatcgtgccgatggacgagctcaagaagaagctcgagcgtggtgtgcccctgaacatcaagctcggcgtcgacccgacgagcccggacctgcacctcggacatgcggtgccgctgcgcaagatgcgccagttccaggacctcggacaccacgtgaccctcatcatcggcaatggcacggccctcatcggcgacccctccggccgcgactccacccgtcctcctctcacggaggagcaggtcgaggccaatgcccagacctacgtcgagcaggccatgaagattctggaccccgacaagacggagatcgtgcacaacggcgactggatcaagccgatgaacctcggcacgatgcttggcctcatgagcaagttcaatgtcgcccgcatccttgagcgcgaggacttccacaaccgctacacgaatggccagtccatcgccctgcatgagttcatctacccggtccttcaggcctacgattccgtgatggtgaaggcggacctcgagatgggcggaaacgaccagatcttcaacctgctcgccggccgtgacctcatgcgcgacatgggcatggagccgcaggtcgccctcacgatgccgcttctcgtgggtcttgacggcacgaagaagatgtcgaagtcctatggcaactacgtgggcctcacggacgaggcagacgatatgtacggcaagctcatgtccatcaaggacgagcttgtgccgatgtacttccgtctctgctccacgctgccggtctccgaggtcgacaagatcgacgaggccttcaaggacggcacggcagacccgtaccagatgaagcgtgcactcgccagaaacatctgcgacctctatcacggcgagggcgcaggcaaggcggcagaggccgccttcgatgcccagttcaagagaaatgaggtgcctgaagacatcccggagttcccgctttccctggcttccgtgaacgacgagggcaaggtctatcttgcaaagctcctcgtcgatgtgaacatcgcgaagtccacgggcgaggcacgtcgcctcatcgacggcggctccgtcaagatcgatggcaagcccgtcgctcccaagagctacaacgtcgatcctgcactcttctctcagccctgcgtcctgcagtctggcaagaagcgctgggcgaggcttgcgtaggcacatgcagaacaggaacaacaagcgctccctcgagcttctggctcccgcaggcggccccgagccgtttgcggcagccctggctgcgggtgccgatgccatctactgcggcttcggaaatgacttcaatgcccgccgcaatgcgacgaacttcgacgacgagagctttgccgctgcctgcaaggcagcgcatcttgccggcgtccgcgtctatgtgaccgtgaacatcgtgatccgcacagctgagatgccgaaggtgctctccgtgatcaggcgtgcctggtgccttggcgccgatgccttcatcatccaggactggggcctcatggcagaggtcaggcgcatctggcctgagatcgaggtccatgtctcgacgcaggcaaacatccatgatgcgcgtgcggtcgcctggatccgcgaactgggcattgcccgcgtcacgatctcgcgcgagctctccttgcctgagctttcccgcatcgcagacgagggcgttgagatcgaggccttcggccatggcgcgctctgcttctgctactcgggcgtctgcatgctctcgagcctctcaggcggcaggtctgccaaccgcggcatgtgcgcacagccgtgccgtctgccctatgacctcgtcgacgaggatggcacggtctcgcagatgaagggtgccgaccgcgcgctctgcccgaaggactactgcacgatctccgacctgtcctccctcatggaggcaggagtcgggtcgctcaaggtcgagggccgcatgaaggctcccgactatgtctattccgtcatctcttcctatagggccgagctcgacgatgcgtatgccggcgtgaagccttcgacagagaccgagcatgcccgcatgaggaggctcctgcgctccttcaacaggggctttaccgatgcctatcttcgtggcgagtccggcaacgagatgatgagctacgagcggtcgaacaaccgtggcgagcttgtcggcgaggttgtctcgtcgaggcgcctcgaggatacgctcgtgcgccgtgggggcgggaatggcggcaggcgccgcaaccgccacgtcacccaggcggagaccgagatcgccctggccgaaccggtcttcgagggagacctcctcgagatccgtccgctcacggatccctcgcagttcctgacagcgacggccgagcatgacgcggacgcgcaggaacgcatcacggtcaggacgacccgccccatggagaagggctctgccgtgcgtgtcatccgctcgaagcaggccatggaagaggcccagcgggcagcgcacctcgaatgcgcacgcaagcatccggtgagcgtctctgctaaggccaggatcggcgagcccttcacggtcacgatcgagaccgaagatggcatctctgcgaccgctgaaggcttcacggtcgagccggcacgcacgaaggcagtcacggaagaggacctgaagtcgcatgtcctgcgcatggggcagacgcctttcgagcccacctcctggacctgcgagatcgatgacgactgcggcatgggcttctccgccgtgcatgcggtgcggcaggatgcctgccatctcctcgaagagaagatccttgctccctacatcgagcgtgaagagaagacagctcctgttcctcctgcgtggaggatcaaggacacgctccgcgaggtcaggaaggccgccggaatccaggacccgctttcctggaaggcgccagagcctgaaatatcggcgctcgtgacgacgcctgaggcagcggaggctgcactttctgccggcgccgacatcgtctatgcaacgcctgatgcgctctcccagggcacctggcctgagagcacggtgccgttcctcgatgaggtgtgccgcgagatcgaccatgagaggctcgatccctttgtcgtgccgggcaggcgtgtcgcctgcggcaacatgagcgagctcgtgctggcacatgagcgcggggctcttcctgagatccgccagctcataccggtccacaacgagtcggcgcttgtcgcgctcgaagaggcaggtgcagaaggcatctggctctcgcctgagctcacgctcgaagagatcgtggcgcttgcggagacgacctcggttcctctgggtctttccgtctatggcaggacgagggcgatgacaagcgagcactgcatcctccaggcagcagggaagtgcatccataactgcgcgaagtgccagctccgccagcgccgcttctcgctgcgcgatatcgacggagcgcttctgccggtgcgcacggacatcgagggcagaagccatctctatgcgtcgcatccgctcgatgcaacgccgcagatccccgatctcatggcagcaggcgtcacccgcttcatggcagacgggacgcttctgaccccgcaggaagtgtcgtttgcggtcgagcgcgtgaagcgtgccgtggcagcaggacgcgagggcaggaaggcagctccgcgcctccaaggtgcgacgtctggccatctcttcgtcggaatcggctgatataccctcggaagggtagcattttgtgacactcttccgaagatgtgcaattgctagttcaataggggtattatcagtccagcgaaaaaccgacaggggagagggtccccagcggcgacgagccgcggtgaaaggaagcttaggattatggctgtagacaaggaacttctggctgcgacgatcgacgtgatccgtcagagccttcaggcagatggcggcgacgtggagcttgtcgatgtggacgacgacggcgttgtctccctcgagatgcagggcgcatgcgcaggctgcccgctctcgagctacgacatgtcgatgggcatcgagcgcatcctgaaggagcacgtcccgggcgtgacccgcgtgcagtcgatgatgtaggatttcgatagaagaagtgagagcagcagccggagcgtcccttcggctgctgcttcttgtaaggcagaaagcaccgaggagcgcccatgtggctcaatgagatctatcagcatctgaatccgatagccatccagatcggccctattgccatcaggtggtacggcatcgcgtatctcgcagggttcatctgcgcctatctcgtgatcaggagcctgaataggcgctgggagctcgatatcgtggaagacgacctgctctcgatcgtgattggcgtcgccttcggtgtcatcatcggtgcccgcctcttctatatcctgttctatggggctggctactatcttgcgcatcctgcctcgatcctggccttcaatgagggcggcatgagcttccatggcgggctctgcggcgccattgtcggtggctggctcgtctgccgccatctccatatctcgacgctctcggttgcagacatggctgtctgcggcgcgcctctgggcctcttcttcggccgctgcgcgaacttcgtgaacggcgagctctggggcaagccgaccgatcttccctggggcgtcatgttcgagacgggcggcaacgtctacaggcacccgtcgcagctctatgaagccatcctcgaaggacttgtgatcttcgtcgtcctctttgcgctctcgaggaagaagccgccccgcccccagggcacgttcatcggcacgttcctcacgctttacggcgtcttccgcttcctgatcgagttcgtgcgtcttccggatgcacagctcggctatctcctcggcacgaactggctcacgatggggcagtgcctctcgatcccgatcttcatcatcggcctcgttatccttgcctttgcccacaagtaccagctgccgcaggtcggctacctcaagaaggcaccggcgcacacgaaatagcgccagaaagaaggaaggccaggcttggcgcctggccttcctcatatatatcgctcttcttctctattcgaagacgatgaacggctcctcgtcgtatccctcgagctcgatatcgtcgcccgtgaagccgaagatctcgcgtgcatcctcgagcgctgtgtcctctgcatcctcgtcgtcctcatcggcgtcgtcttcgtcggcaggttcgcttctcatatcgtaggagatggcttcgtctccttctgcgagaggcgttgcgctcacgagcgagcagaggccttcgcgcgtcggcacgatcttctgccactgcgtcacgagcggctcttccggctcctcggcgagctcgacgagggaatcgagatagatttccttcgctccttcgagcaggtccgaattctggcggatgtcctcgaaatggttcgcgaacttctcgagcgcttcatcggcgtcggctgccttcacgatgcagggcatgaggcagtagttgtgtgcagcgtcgagctcgtcgttgtagctgaagtttccgacatagagcatgaggtgcctccttggacggcgtgaccttcaagagagagcctagcagcttggcttgtgtacggagctccccttgtgtgtggacggtgccaggaaacaggggagaggagaagaaggacgaaaagctccgagcgcttccatgcgttttgcgctgccattcagccagatgcttgctagactgaagtcagaaggcagcaagatgctgccgaacaacatagagacactgtcggatggagaggttcgctcccctggagcgatcaaaagggaacccggtcggaatccgggacagccgccactactgtatcggggaacacctggacgcacgcccattgggccttgagcctgagaaggggtccaggaaggcttctgccatcccccaagccaggagacctgccctccatcctaaggtccgaagcgtcctgggcaaagggggaggctggccggaacagatggggcagcaggcgtggcctgccgccctctcggcgtctggcagcccgcttttccgggaggaaaggaagggctcgatgaagaatcagccagaaaagctagcgaccgcaaagcgcatgctggcattcgtgctcagcctctcgcttgcctggtgccaggtgccgcaggtggcgctggcagaaggcacgctcgagacggcgtccacgcaggaggcggctgccgccgagagcggttccgccaagaacgctgctgcatctgcggactcccagaagaagacagaagccgctgagggcagcacggaagagagcgcccagaagagcgccgatgctgcatccgagagcagcagctctgcagcttcttcgagcgaaagcgcaaagaactctgatacttctgcagcaggccagaagggcaagtccgcctctgcaagcaccgaagccacagcatcagctgcagctggcacgacagccgctgcagcgacagatgccacggagatctccgtcaagatccgtgtcataggtccggatgccgagggcaatgactgcgactggctcgcccagaagacggtgaaggtggagtccggcaagaccgcagcagacctcaccgaggatgccttcaagggcacgctcgcggccgatatcctggcatcgtctcggggtgcctacctcaacacgatcacctcgcccctcgatgggaaggcctatggctacgacagcacgaccggcaagtactggcagctcttcgtgaatggtgccgcctccgagtccggcatgtccgaggtcacgctcacggaaggcatggaggtcgtctggtactactctggctccggtactgcgctcgacagcgcgaagaccgtctcggatccgagcctcgagaagccggatgcaggagccacgcgcacggaaggcacagccgagtgggctggcttcaaccagggcatggaaggcggtaccgtcacggccgatacgccgatctctgcctcgaatacggcccttgcctggaatccggtcaagatcggcatgggcgcttccgaccctgtgctcgtggacggcaagatctatatggtctcgggcggcacgctccaggtcatcgactcctctgatggtgcggtcctggctacgaagaagatctcgacgaagtccggctatttctgccgtcctgtctacgcagaagggctcctgatcgtcccgctcgatgatggccgcctcatggcctatacgctctatagcggcgattctgccgattcgctgaagcttgtctgggagacgccgcgcatcgcagcgtctggtgcgacgcagacgctctcgtccctcacggttgcaggaggacgcatctttgcggcattctctgtcgtcgactggatgaacccgctcaatgggacaggctatctcgtttctgcttccttgaacgatggttcgagctggcaggtcacgacggagaacgacgaatactactgggcaggtgccgcctcccatggttctgacatcgtgattgcagacgagaagggctctgcctatctcgtgaacggcacggatggctccgtcatctcctccgtgagccttggcagcgcaagccatgcaagcatcacgaaggtgtcggatgaagagtatctggccgtgacgacagacggcgtgctccatgtgctgaatgtctccggaacgacaatctctgagactggctctgccaagtttgctgaccgttcgacctcgacagccgtggtttccaacggcgtcgccttcatcggcggctcgacgggcacgagctggccctatgaagggaccctttccgctatcgatctttcctgcatcggcgaggcaggctatgtgccccagacaatcgaagtcggcaatggtgccgtgcagtcgacgccgctcgtggtttctggcggcactgctatatccatctatgtgacgacgaacagcaatcctggcggcctctcgctcgtaagctacaaggatggtgcgctctccacggcccaagcaatcttcacgccgggagatgctacctaccagaactactgcaccgcatccccgatcgcctcgaaggcgggcctcatcttctatacgaacgattccggctatctctttgctctcaagaatgtcctggcgaagacggagacctggacgctttcctttgtaagcaacggcggcagcagcgtcgagtcgaagaccatagtttccggcatggcagcggggagtgtcgaggagccgacgcgcgatgcctatacatttgccggctggtatctcgatccggagttcgagacggcattcgatgcttcggcgacctatgtgaggccgagtggcagcacgatgttgctctatgcgaagtggaccgaaaacgagccagagcctgaaccgacaccgaaccctgacaacagcaacgggaacagcggcaacgagaatagcacaggccaggagaatggcggagccgctcctgcaggcaatggcggcaccgaaggcacggatgcatccgacagcaacggctcccagggcagcgctcctgtgacgcgctctgcacgtacgtccacatctgctggaaccgctgcgacggacacggtccagacgaccggcgtgagcggcagcacagacgcttccgcaccggctgaggccgcaagcactgcgaccgatacctcaaagccttcgagctcgtcctcttcgagctcatccaccggaagctcgaaagatctgggtgctgctgcccaggatacggctgggacgaatgcagcaggcgatgcgtggaagattgccgtgccgatcgttctgctcgtcctgggcctcttcctgatccttctcgcgctcaagcgcagaaagcaggagaagtagcgtggcagaatatatcgtccacgacacagacaatcagaagcctgagggcggcgggagcaccaggcgccgcccaggctggaagctgccgctcatctgcggcatcgtccttgtggcattcagcgtggcactctttgctctcgccttcgatatgcctcaggggcttagctcttcggtagagggcgcagagagcgcggtcgaagatgcgccagcgcttactgaggcacgcatccaggcagcgctccaggacctttcctggcagggcgaagatatcggcctcgatccttctgctgccacggtcacgctcgaggacggcaaggtcagcgtcgtcgttacggacgatggggcagcagcagatgccgtgccgcttgccgcaaagcgcctgcttgccctggcacagtggctcgaggatgagacggggtcagacgactttgcggtctcctggtcagtcaatacctcggccggtgcccaggtctttgacggcacgctcgatgcaggtgctgcgcctgcaacagatgcccagagcacagaagagctcctctcatcgctttcctcctgcacgcttcccgatgcagcctcgcaggatttgggtcttgccgatgtacccgagcagggcggcagcgacagctcaaatgctgaaggcagtgcatctgggcagtccggcaatggggcgcagggaaacggcggcgaagaaggcaagggaagctctggcagcaccggtacctcttctcagacaggctctggcacgtcaggcaatggtgcatcgacttctccgagcgcagctgccgagccttcccagatcaccgtctcggtctccgtcgatgcaagcctcggtggcggcagttcgacctctgtcacggtcacggttccccaggggtcgtccgtcctcgatgcactcgaggcggcaggctacggcgtcagcacccagaatacgcagtatggcatctacatcaccggcattggcggcgtcgaggcgagctcgcgcgacaggcgcggctgggtgtatgccgtgaacggtgtcgagccgagccattctgcagcgaaccatgtcctctcgtcaggcgactcgattgcgtgggcctatgtctcctactgatgatttcggggagggagggacggacgtctcggagacactccgtcccttcgcctccttccatccagccgttgcgcttgccgcaggaaccgcccttctgctctttgccatgtttgccctgcagccggtctatgtgtgcctgagtctcgtctcagcattcgtgctctcaggaattctccgtggctggacgcgtacgcttgcaaagcttcgctggcagctgggccttgtccttctcatggcctgcgtgaatgctctctttgccgggtatggggcaacgacgctttgcgtgctcggccccttcacgattaagctcgagagcctcgtctacggggcgatgatgggcgcagtctttgtttccgtcatgctctggtgcgagaacctcagctccatggtgaacgaggatgagatcatgcagatgatgggcacgaaggcgcctgctgcggcgacgactttggctatcgctgcccagctcgtgccccagagcatgaggagataccgtgccgtgaaggatgtccaccttgcgacgactgccgcaaggcagccctcgtctgccaaggagcggaccgatatcctggcgggagggatcctgctctcctggatgctcgaggactcgatcggacgtgccgatgcgatgcgcgcccgcgggtgggcacgggggcagaagcggtcagccttccagacgcacgaattccatgcacgggatgccgtggcgcttatcggccttgccgcgctcgggcttgcctcggctgtgcctgcgggcatggcggtcggacaatggcacttctatcccacaatgcctacgcttgtcttctggtggggctatgtgccctatatgatgcttgcagccctgcccataggatctctcgtgcatgagcggatgctctggcggaaggaggagagatgacagaaagcgctctggagttcagccacgtgagctttgcctatgcagtgccggaaggggagcagcaggggccagatgtccttgccgacatcacattctccgtgccggaaggctccttcacgatcctctccggtcagaatggctcgggcaagacgacgcttctgcgtctcgcgaagccagaactggcacctcacggcaggttttctggcactatctccttcttcggacatccgattgatgcactctctcctgccgagtctgcctctggcatcggatacgtgttccaggaccccgagagccagatcgtctgcgatacggtctggcacgagcttgccttcggcctcgagaatctgggctcgacgcaggaagagatgcgccagcgcatagccgagacctgctatttcttcggtatcgactcctggttccggaagcgcacctccgagctttcaggcggacagaagcagattcttgccctggcctcgctcatggtcatgaggccacgtcttctcctcctggacgagccgacctccatgctcgatccgcttgccgcaaagaccttcctggggctgctctggcgcatgaaccaggagctcggcatcactgtcatcgtcgcgacgcacgaccccggaatgctcgtcccctatgcagacagggccttgacgctttctgcaggaggcatgcttgcagaggcagaggccagagcccttgcagaggcaccctcagcgctttctggcatggcggccgtgcatcctgctgcagctggtgtggcagcagagcttgagcgcgtctaccagcgctatgtcgcgcgtgccccctgggtgcttcgcgatctctcgtttgcggtgcctgagggaagcttcagcgtgcttcttggcggcaatggatcgggcaagtcgacggcgcttgctgtccttgcaggcatcgcttcggtgcagcatggaaaggcgagaaacgcccatgcgaagatgcaggcgttcctgccgcagaacccgcgtgcgctcttcgagaagccgtccatctcagaggagcttctggaatggggaccttctgtcggctatggcaggaaagaggctctggaggtgctcgaggccctgggccttcctcaggacgaggcattcctcgcgcggcacccctacgacgtctcgggcgggcaggaagagctcctggcgattgcgaagctgctgcttgcgaagccggagatcctgcttctggatgagccgacgacgggacttgaccggagctcgaagagaaggctggctgcggcgctccagaaggtgcaggaggcaggcacgaccatcgtctgcgcgacgcacgataccgagcttgtgcgagcgctagccaatacggtcacgctcatcttcgatgggggagcagcggtgagcacggatgcagagagcttcctttcgagaagctggctctgggggcacagatgatgtggcagcgcatcctcaaggcttcggagcccctggtcctggccctcgtccctctcctcatgctctggtctgcctgggcgggctctgccatatcgggcgggcttgcgctccttgcagcagccgttgccatcctcttcatgttcgcccgcatcgaggcaggaaagccggcgctccggcagatgatgcctgtagcctgcctttctgctctggcggcagcgggcaggatcctctttgcggctgtgcccgatgtgaagccggtctctgccatcgcaatactttcaggggcgcttctggggccggagagcggctttgccgtcggcgccttcgcagcgctcctctcgaacttctttttcgggcagggcgcctggacaccgctccagatgtatgcctgggggcttgtaggctatctcggaggcgttctggcacgtcatgggctcttgcatggcaagtggcagctcgccgtcccaggcgtgctctcaggacttctctatggggcgattctcaatggctggtatgtcctgggctacgtgcgtccgctcgtgcccgagactgtcatcgccgcctttctcgcaggactgccgctcgacctcgtgcatgggctttctaccgctggattcctgctgcttgtctggattccctggggcagatcgctcagacgtgctctggcgcgctatgattgatgaccgcacaaacgcagattgtacgtaccaccatggctttcggggaccttcgcaggggtgccacacttcggcatcttctatttgcaaagtcatccctgcttttgtattatctgtatgttttgccaatctagaaggagatgtgcatgtccggacactctaagtgggctaccacgaagcacaagaaggccgcaatcgacgcaaagcgttctgcgctcttctccaagcattcccgcaacatcaccgtcgcagcccgtaccggcggagacccgaaccccgcaaacaacgcttcccttgctgcagcaatcgcccgtgcccgcatggtttccatgccgaacgcgaagattcaggctgccatcgacaaggccttcggctctggcgccgaggctgtcgtgtacaaggaggtcacgtacgaaggctatggccctgcaggcgttgccgtctacgtcgagtgcctgaccgacaacctgaaccgcaccgctgctgatgtccgctccgtcttcacgcatgcaggcggcaacctcggcacgaccggttccgtcgccttccagttcacccgcaagggttccatcgccgtggagaaggtcatcgtctccgacgagaagaaggttcctgacaaggagaacgctgtcgacgaggacgagttcatgatggccgtggccgaggccggcggcgaggattacgaggacgcaggcgacgagtggatcgtctacaccgcgtatgacaagatgcaggacgtcgagaagggtctcgaggatcagggcatcgaggtcaagggttccgagctcacgatggtcccgaacacgccggtcgagcttggtctcgctgacgcccgcaaggtccagcgtctgatcgaccgcctcgaggagctcgacgacgtccagaacgtctactcgacgatgtctgtctccgacgaggtcgcagagcagctcgaagaggacgagtagcctccattccagagcgcacagaagggtgtccggttcatccgggcacccttcttctatacggaggcaggccatgaagaagggcggcaggggaagcgtccctgccgcccttcgcggtgtctctaggtggtgcctattgccccaggacctcggctgcgatctttgcggtctcggcggcgtccttcgcgtagtagtcggcgccgaccatcttcgcgtactcgggattcaggacggcacctccaacgacgaccttgcaccagggtgcctgcttgcgcaggagctcgatcgtctctcccatggccggcaccgttgttgtcatgagtgcgctgagccctgcgagcttcacatggtgctcgaccacgacatcgcagaatgcctgcggatccacatcgcggccgacgtccaagacctcgtagccatagttctcgaggagcatcttcacgatgttcttcccgatatcgtggatgtcgcccttgacggtgcagagcgcgatcttgcccttcgtcggcacggcatccttcggctgcgatgccttgattgcatcgaatcctgcctttgctgcctcagctgttgccatgagctgaggcaggaagaacgtgcccttctcgaagcgcacgccgacctcgtcaagggcagggatcagcacctggttgatcgcatacatcgcatcatggccttcgaggagcttctctgtcgccgccttgacggctgccttcctgccatcgagcacaccctgaagggcagcctcttcaggcgttgcggcagcagacgatgcgctcgaggcggcaggggtgccgacagcagcggccgggccctttgcctcggtacggccggcattctcctcgacataggcacgggctgcctcgtcttcgcctgaaagcacgcgccaggcgctcacgacatcgtgcatgcgctgctggcccgggttgatgatagcgaggtcgaggccggcagcaaaggcagcagcgaggaaggtcgcattgatcaaggggcggaagggaaggccgaagctgatgttcgagacgccgaggatcgtgcggacacccggcatcgcctccttcacgaggcggatgctcttcaagatctcgccaggtgccttctgatccgtgcttgctgccatagcaaggcagtcgaagacaaggtcctgtgccggcatgccttccttgcgggcacggtcatagatcttgcgcgcgacggcgaggcgtccttctgccgtggccgggatgcctgcctcgtcgagcgtcaggcagacgagcgcgcacccatagtggtgggcaagcggaatcatctcctccatcatgtcttcgcgcccattcgtggagttgatgagcggctttcccggatagctcctgacagctgcctcgaccgcggaagccgttgcagagtcgacctggagcggcagcgatgtgacgcctaagatgtccgtgaccgcacgcttgaggagcttcgtctcgtcgatctcgggcaggcccacattcacgtcgagcacctgggcgccggcgcgttcctgctcgatagcgagcgtcaggatgtagtcgaagtccccggagcgcaatgcctccttcatgcgtttcttgcccgtcgggttgatgcgctcgccgatgacggcaatatgtcccgaagcaagcgagaggagctcctgggagcttgcgaccgtgaagtcgggggagagcgcatggggacggggcgtgccgatcccgtcgatgagggcacgctcgcgcgcgatatagtcgggtgccgtgccgcagcagccgccgacaatggagacgcctgcctcgaccatgggcttcatggctgagacgaattcctcggcgtcgattccataggtcgtcacaccgtcatgcacctcagggagtcccgcattggcctgcaccatgcaggggcaggaaaggtaggggagcatgcggagcacaagcggctccacgtcttcagggccaagcgagcagttgatgccgacagcatcggcaccgagcgaggagagcgtcacggcagcgacttcaggcgtcgtgccgaggaaggtacgaccgtcctctccgaatgtcatggtcacgaatgccggcagctgcgtatgttccttgaccgcaaggagggcagccttcgcctcggcgaggtctgccatcgtctcgatcacgaagaggtcggctcctgccccttctgccgcgattgcctcttcggcaaagagcccataggcctcttcgaacttcatggtccccatgggctcgaggagggctcctgtggggccgatatccgccgcaacatagcgcgctcctgctgcacgcacgcaggagacggctgcctcgaagatatggcgcacggtcgccttgccggcaagcttcagggcattcgcgccgaacgtgttcgtcgtcacggcctctgcaccagcctcgacgtaagcggcatggatggctgtgacattgtccggatcttcaaggcagaggagctctggcagctctcctgccttcatgccacgttcctggagctgcgttcccatggcgccatcgaagaggaggaactcctgcccttcgagcacgtgggcgaggtgctcgtccttgattctgagcgtgcgcttggtaccaggcccgaagggggcagatgccggcaccttcgggtcgcggatagcaacagaggacagggtcctatttccttctgtcatggcaggtccttccctggacacggaatgtgcagaaatcgtggcagacgcacttggcgcagctcatgtgcgtgcttctcttcggttccgtgaaacagccgacaatggccgtgacgctcttcgtcggtgtcatgaggaggctcggcgagagcgtgatgcccaagagcctctgggcattgagggcagaaaggagcgtcggctgcacggcaagcggcaggtctccgtagccaggagagtagcgccaggtgcagaagagtccctggcctgctgcccacttcacggcttctgcctctgcagcatcggcggcacgctcgacgagtgcgactgaggcagcatcgaagaggatctgctcgagatggtcggtaagcgagaggcgtctgagctcccgctcagtcgacatgcccaaggtcaccgcgaagacggctgcggcctgggccccggcaagatgctctgcgatatcgtggccgggaagcttgagtgccgtacccttgagatggacgcagggattctcgccttcgtctatgcgctcgacctcgaaggggcgcatgacccccttcggttcggagatagcgagggcatgcccgatggccgcatcgatcctgccatccaaggatgggtcatactcctgcccggcatagccgaggtagcggagcacctcctccttgtcgacagaggatatctcgtagcgggagacggatgcgctagctggcaaggtagccgcaccccacaagcgcctcgtggatctcgtgcgccatggcaggcttgttcatcgtatagatgtggaggccgtcgacgccgttctgtgcgaggtcctggagctgctcgattgcgtaggcaacgcctgcctttgcctgctcggctgggtcgtctcctgcggcgatgatgcgcttgatcacggcagagggaatggatgccccgcacgtgaatgccatgcgcgtgatctgcttctggctcgtgaacggcatgatgcccacaacgatgggaatcttgatgcggccacgggcgcagaggtcgcggaagcggtagaacgtctcgttgtcgaagaagagctgcgtcacgaagaagtcggcgccggcatcctgcttgcgcttcaggttctcgagcgatctcctcatggacggcgactccacgtgtccctccggatagcaggcagcgccgaggcagagctcggggtgctgtgccttgaggtaggagatgaggtctgacgcatacgtgaagtcgatggcatcgcgtcctggggcgcggtcgcctctgagcgccaggacattggagacgcctgcccgatcgagctttcccacatagcgctcgacatcctccttcgaggagccgaggcaggtcaggtgcgcaagggaggtgatgccgaggtcgttctggaccgtgttgcagatctctgccgtatgcgaggaggagccggtgccgccagcagagaatgtcgtcgatatccagtcaggatggtcctgagcgagcgcttctgccaccttgcgcgcatcggaaagcggcatcgtgccctttggcgggaagatctcataggaataggtctgctttgtcttcagcagctcgtcgattctcatccggtgcacctttctcgagtatctgtctttccatcatatgggagctctgtttcatctgcatctcagctgcagaatcgtggcagatttcatggcagggacaagagggccggcctcgcagactcatgtcggcgaaacggggtatccttgggatgtatctgacgctggcggaggtggcagcatgggatttctgaagaagctcgcgatgaccctgtggttcctggcgacgattttcgcgtttgccgcgcttgtgctcacgatcttcggaccgtggacgaaggaggcgctcgcgctctttgccgtcgacagctacagctatgccgtgcagggatgcgttgccttctccctcatcggcagcttcgtgatgtgggtccgcgtgcttgcccgccgcaagaaggcacagacgatcgagctcgaggatgaagagggctcgacgattgcaatcacccgcgatgcgattgcctcccaggctacctacatcgtcgaggaggatggctcctgcgaagcgacgaaggtcgcggtcttcgcggagaagcatggcatgatatcggtccatttgacgatccgtccgcacgagacggtctctgccgtcgagaaggggcgcgagctcaaggaggagctcgaagagggcctgacaaagctctgcggcgagaggatctcctcgatcagcctcgagttcctggcacctgaagagccgagctcgctttccgagcctgagtcctatgaccacctcttcgatgtgccggcgggcgatgccgatgctccggcagaggaggcatctgacagcgtgtctgcatctgaggatgattcctcagaggacaccgccgagacgccttccgtagagggcggctctgtcgccgaagaggatgctcctgctgcagcagatgagcccgaggttcatcctgcagcgtcgggcgacggcgtgacgatctccatgaagggcaggaccccgagggaggaggaggcgcatgaataggccgaaagtgacggtcgacgaggacgagcccaagcgtgatgcgaagggagcatcggaagccagcagggacgctgtagcagacacggcttccacgaagcagaaggctggtgcccgtcctctcgaggcagccgaggcgtggctccacaagacgtttccgggccacgagaatgcggtgctctgcggctttttgggcctcatcgtcgcaatccttctctttgcaatcggcttctgggcaacgcttcttgttgcgctctgcgtgaccataggcgtcgcaataggccagatgcttgacggcgacccgaagatcatctcattcttccgtggcctcatgggtccgaaggatgacggaagatagctggaaaatcgagacgagcaaggagtggatgtatggatacagagacgaaggacacagcaaaggccacgtatgctgctcctgatggacaggagagcatgaccgatacggaagacatcgtggcagcagaggaggatgacaactccgaggattcgctgacgttcagcaacggcgtgatcgagaagaggcggtctcggcggcgtccttcgcgtagtagtcggcgccgaccatcttcgcgtacgcgggattcaggacggcacctccaacgacgacttgcacccagggtgcctgcttgcgcaggagctcgatcgtctctcccatggccggcaccgtttgtcatgagtgcgctgagccctgcgagcttcacatggtgctcgaccacgacatcgcagaatgcctgcggatccacatcgcggccgacgtccaagacctcgtagccatagttctcgaggagcatcttcacgatgtcttccctatatcgtggatgtcgccctgacggtgcagagcgcgatcttgcccttcgtcggcacggcatccttcggctgcgatgcttgattgcatcgaatcctgcctttgctgcctcagctgttgccatgagctgaggcaggaagaacgtgcccttctcgaagcgcacgccgaccctcgtcaagggcagggatcacacctggttgatcgcatacatcgcatcatggccttcgaggagcttctctgtcgccgccttgacggctgccttcctgccatcgagcacaccctgaagggcagcctcttcaggcgttgcggcagcagacgatgcgctcgaggggcaggggtgccgacagcagcggccgggcccttgcctcggtacggccggcattctcctcgacataggcacgggctgcctcgtcttcgcctgaaagcacgcgccaggcgctcacgacatcgtgcatgcgctgctggcccgggttgatgatagcgaggtcgagtccggcagcaaggcagcagcgaggaaggtcgcattgatcaaggggcgaagggaaggccgaagctgattcgagacgccgaggatcgtgcggacacccggcatcgcctccttcacaggcggatgctcttcaagatctcgccaggtgccttctgatccgtgcttgctgccatagcaaggcagtcgaagacaaggtcctgtgccggcagccttccttgcgggcacgttcatagatcttgcgcgcgacggcgaggcgtccttctgccgtggccgggatgcgcctcgtcgagcgtcaggcagacgagcgcgcacccatagtggtgggcaagcggaatcatctcctcctcatgtcttcgcgcccattcgtggagttgtgacggctttcccggatgctcctgacagctgcctcgaccgcggaagccgttgcagagtcgacctggagcggcagcgatgtgacgcctaagatgtcctgaccgcacgcttgaggagcttcgtccgtcgatctcgggcaggcccacattcacgtcgagcacctgggcgccggcgcgttcctgctcgatagcgagcgtcaggatgtagtcgaagtccccggacgcaatgcctccttcatgcgtttcttgcccgtcgggttgatgcgctcgccgtgacggcatatgtcccgaagcaagcgagagagctcctgggagcttgcgaccgtgaagtcgggggagagcgcatggggacggggcgtgccgatcccgtcgatgagggcacgctcgcgcgcgatatagtcgtgccgtgccgcagcagccgccgacaatgggagacgcctcctcgaccatgggcttcatggctgagacgaattcctcggcgtcgattccataggtcgtcacacccgtcatgcacctcagggagtcccgcattgcctgcaccatgcaggggcaggaaaggtaggggagcatgcggagcacaagcggctccacgtcttcagggccaagcgacagttgatgccgcgcatcggcaccgagcgaggagagcgtcacggcgcgacttcacttcgtgccgaggaaggtacgaccgtcctctccgaatgtcatggtcagaatgccggcagctcgtatgttccttgacccaaggaggcagccttcgcctcggcgaggtctgccatcgtctcgatcacgaagaggtcggctcctgccccttctgccgcgattgcctcttcgcaaagagcccatagcctcttcgaacttcatgtccccatggctcgaggagggctcctgtggggccgatatccgccgcaacatagcgcgctcctgctgcacgcacgcaggagacgctgcctcgaagatatggcgcacggtcgccttgccggcaagcttcagggcatcgcgccgaacgtgttcgtcgtcacggcctctgcaccagcctcgacgtaagcggcatggatggctgtgacattgtccggatcttcaaggcagaggagctctggcagctctcctgccttcatgccactttcctggagctgcgttcccatggcgccatcaagaggaggaactcctgcccttcgcaacgtgggcgaggtgctcgtccttgattctgagcgtgcgcttggtaccaggcccgaaggggcaatgccggcaccttcgggtcgcggatagcaacagaggacagggtcctatttccttctgtcatgcaggtctccctggacacggaatgtgcagaaatcgtgcagacgcacttgggcgcagctcatgtgcgtgcttctcttcggttccgtaaacagccgacaatggccttgacgctcttcgcggtgtcatgaggaggctcggcgagagcgtgatgcccaaggcctctgggcattgagggcagaaaggagcgtcggctgcacggcaagcggcaggtctccgtagccaggagagtagcgccaggtgcagaagagtccctggcctgctgcccacttcacggcttctgcctctgcagcatcggcggcacgctcgacgagtgcgactgaggcagcatcgaagaggatctgctcgagatggtcggtaagcgagaggcgtctgagctcccgctcagtcacatgcccaaggtcaccgcgaagacggctgcggcgctgggccccgcaagatgctctgcatatctggccgggaagcttgagtgccgtaccccttgagatggacgcagggattctcgccttcgtcatgcgctcgacctcgaaggggcgcatgacccccttcgtcgagatagcgagggcatgcccgatggccgcatcgatcctccatccaaggatgggtcatactcctgccggcatagccgaggtagcgggcacctcccctgtcgacagaggatatctcgtagcgggagacggatgcgctagctggcaaggtagccgcaccacaagcgcctcgtggatctcgtcgccatggcaggcttgttcatcgtatagatgtggaggccggacccgttctgtgcgaggtccgggagctgctcgattgcgtaggcaacgcctgcctttgcctgctcggctggtcgtctcctgcggcgatgatgcgcttgatcaccagagggaatggatgccccgcacgtgatgccatgcgcgtgatctgcttctggctcgtgaacggcatgatgcccacaacgatgaatcttatgcggccacgggcgcaaggtcgcggaagcggtagaacgctcgttgtcgaagaaaagctgcgtcacgaagaagtcggcgccggcatcctgcttgcgcttcaggttctcgagcgatctcctcatggacggcgatccacgtgtccctccggatagcaggcacgccgaggcagagctcggggtctgtgccttgaggtagagatgaggtctgacgcatacgtgaagtcgatggcatcgcgtcctggggcgcggtcgcctctgagcgccaggacattggagacgcctcccgatcgagctttcccacatagcgctcgacatcctccttcgaggagccgaggcaggtcaggtgcgcaagggaggtgatgccgaggtcgttctggaccgtgttgcagatctctgccgtatgcgaggaggagccgtgccgccagcagagaatgtcgtcgatatccagtcagatggtcctgagcgagcgcttctgccaccttgcgcgcatcggaaagcggcatcgtgccctttggcgggaagatctcataggaatagttctgctttgtcttcagcagctcgtcgattctcatccggtgcacctttctcgagtatctgtctttccatcatatgggagctctgtttcactgcatctcagctgcagaatcggggcagatttcatggcagggacaagagggccggcctcgcagaccatgtcggcgaaacggggtatccttgggatgtatctgacgctggcggaggtggcagcatgggatttctgaagaagctcgcgataccctgtggttcctggcgacgattttcgcgtttgccgcgcttgtgtctaacgatcttcggaccgtggacgaaggaggcgctcgcgctctttgccgtcgacagctacagctatgccgtgcagggatgcgttgccttctccctcatcggcagcttcgtgtgatgtgggtccgcgtgcttgcccgccgcaagaaggcacagacgatcgagctgaggatgaagagggctcgacgattgcaatcaccccgatgcgattgcctcccaggctacctacatcgtcgaggaggatggctcctgcgaagcgacgaaggtcgcggtcttcgcggagaagcatggcatgatatcggtccatttgacgatccgtccgcacgagacggtctctgccgtcgagaaggggccgagctcaaggaggagctcgaagagggcctgacaaagctctgcggcgagaggatctcctcgatcagcctgcttcctggcacctgaagagccgagctcgctttccgagcctgagtcctatgaccacctcttcgatgtgccggcgggcgatgccgatgctccggcagaggaggcatctgacagcgtgtctgcatctgaggatgattcctcagaggacaccgccgagacgccttccgtagagggcggctcttcgccgaaaggatgctcctgctgcagcagatgagcccgaggttcatcctgcagcgtcgggcgacggcgtgacgactccatgaagggcaggaccccgagggaggaggaggcgcatgaataggccgaaagtgacggtcgacgaggacgagcccagcgtgatgcgaagggagcatcggaagccagcagggacgctgtagcagacacggcttccacgaagcagaaggctggtgcccgtcctctcgagcagccgaggcgtggctccacaagacgtttccgggccacgagaatgcggtgctctgcggctttttgggcctcatcgtcgcaatccttctctttgcaatcggcttctgggcaacgcttcttgttgcgctctgcgtgaccataggcgtcgcaataggccagatgctgacggcgacccgaagatcatctcattcttccgtggcctcatgggtccgaaggatgacggaagatagctggaaaatcgagacgagcaaggagtggatgtatggatacagagacgaaggacacagcaaaggccacgtatgctgctcctgatggacaggagacatgaccgatacggaagacatcgtggcagcagagaggatgacaactccgaggattcgctgacgttcagcaacggcgtgatcgagaagatcgtcgccctcgccgtacgcgacgttcctggcgttgtcggcatgaagggcggcggggtgaaccgcgtgcaaatgcccttggtgcgaccgaccccaggaagggcgtgacggtcgaggtgacgcctgtgtgctgccgtgcgcgtgaacatctcgtccgtcctgatcgagtacggtgcctatgcaccgcagatcttcgaggacgtgaagaaggccgtcttgaagcagtcatggggatgacggtctcgaggttgcaggcgtgaacctgcgcatcggatgtcctcacgcctgaagaggtctcccgcaacgcgaagcgcgcagccgaggaagagcagatgccgatgccgaaagcgaggccgaggcacaggagtccgagaggatgtggcaccggtcgcttcgacggagcctgccaaggcctggaagctgaaaatcagcatctgaacagccggcaagaaaagataagcctgcatgccttgcatgcaggctttttatatatgatttgtaaccaggcaggccagtcggttgccaaatgtccccgctgcggtatattgtcagaaactggaagcgttgaggaggagctatggcacatgcggcacccctgcatcatcgatgtggatccaggtgtcgataacggctgcgctcttcatagcctgacctgctcacgtctcgatacgtcgctgtgacgaccgtcgggggatcgatcggcgtcaaccaggcaacagccaatgcgctgaagctcgaggccttcctcggcacccgtgcacttgttgccaggggacgcgacctcccgaattccgagaagcgccactacatgcagccgacgctcggaccgtccggtctgggtctctgggtctttgccgatgaagcatgggacctcttctacaacgtgcctgcgaaggatgccatctgccagacggcgaagagcgcagcagcaaaaggcccagcgtgcctgtatgatctgccttgcaccgctcacgaacctcgccgatgcactcgaggcgcaccccgatctgcccgatatcctggtcccgtcttctgcatgggttcgaccatgggaacaggaatacgctgcagcgtgccggcaggaatgtcgcagcagaccctgcaagcgcgaaggcggtccttgcctccgtctcgatgtcttcctcgtgccggtcgaggtagcggcagcggttcgcatgtccgatctcgatatggccgaatcgccctttcgggccgtgtcggcaatgccgtctatacgatgctctccggtgcccagcctcgacggcaagggcaaggagattgcagaccccatagcggcggccttgcgacccatcccgagttcttcacgtcgtgcccgcgagcttgaagtcgaaacgacggctcctgcggcatgaagataggggagaacggccacatccgaactgccttgtcgctacggctatcgatgtgcatgcattccgtgcctggttcaagtgggctctagcgcgcctcccgctagcggatatcttcatcgcacgctcagctgtgcgcccatttgtgctcctttgccgcttgccctccataatgcgtcccatctcgcctagagtagataggtcgaaggggatgtggagcttgggtcagacaaggatgcgcgatatctggatcagtcagctgtgggcgtggctgcgctgcggcattcctcgttgctgcagcctatgccgaggcgcgctgggagccgcaggcaccggtctatcccgagccagacgatgcgtgggatgcgcagtgcatcgaggaggcatagaaggccctgcggtcggcaccgatgcgccaatgccgtgcaggactatttccccgacgagccgaccttcgcatcctttcggacaaccccacgaccgatgagacgcaggacgcaacagaagacggtacgggcgactgccccgacaatcctgaaagaagctactccacgtatcgtgcgctcgacgagtatctcgatgagaacttgcgatgcggctggcacgcctggcataggcgttgtagtcgtcgatgcagcaggagccgagtacgagagaacgatgggcgacatcgagagcgaccacgacacgatgctcataggctcgctacgaagtcgttcacggccctctcgatcatgcagctcgtcgaggatggcaagatcgacctcgatgaaccgtggcaacctactgcgacgccatgggacgccggacaatgtgaccatcaggatgctcccagagacagcggattcggctactacgactcgcttccgaggcgagccgggcctcacgcaggcacgttctcctattcgaatgcgaactacgacttctcggcaagtcagcgaggctgtctcgggcgaggcgtacgaacgagtatgtcgaagagcatatcctggagccgctcgagatggacgactcctcggcgagccttgaggcgcgtgcctctgcccatgcctgaggaactacttcggctggaatgtccaggatggctttgtgcacgagtttcccgcataacggagcaacagacttcggctgaaggttccaggagcgttgcacgaggactctggcatgattcctgcgggcagtagccaggcattggaagcacgccgatagcggcggggcctcatgatcgtcagaacccagaggcacccagtacgctacaggcgtgcgcccattggcttgagctccctgcaggatacgccgtcctcgtgcacaaagccagcctacattccagcagaattgagtagttcctcaccaaaaaaatgcatgggcatagaaggcacgcgccctcaaaggctcgtccgaggagtcgtccatattcgagcttggactccaaggtatgcgcttcgaatctcgtcgtagcctcgccccgagacagcctcgatgtaccttgccgagaagagactccgcgtctgtatttcgcattcgaaagggagaacgtgccctggtgagttcccgcttcgtcgcctctagcaagacgagtcgtagattagccgaatccgcttgtggttgtaggagcaatgcctgatgggtcacatttgttttgcggctcattcccataggcgtcgcagtagtgtttgccaccggttcagcgaggtcgatcgttgcctatccttcgacgagctgcatgagtcgagagggccgtgtgaacaattcgtagagcggggcctatgagcatcgtgttcgcttgccgctctgatgcgtaccccatccatgttccactcgtactcgcatgcccctgcctcatcgaagactacaaaaaacgcctatgccaggggatcgtgtgcagcagatcggaaggttacttcatcgagaacttttgtcgagcggcaccgatacgtggagtagtcttcctttccgagatgttcgggtagggaccagtccctccgtaccgtcttctgttgcgtcctgcgtctcatcggtcgtggtggttgttccgaaaggatgccaaggtgctcgtcgggggaaatatgcggatctgcacggtcattcggcgcatcggtgtccgaccgcggcagccttctatgccctcctgatgcactgcgcatcccacgcaccgtctggctcggatagagacggttgcctgcggctcccagccgcctcacggataggttgcgcagcaacaggaattggccgcaaggcagcccaacgccagcaacagctgacttgagccagatatcagcgtgcatccttgtcgatccagctccacatccccttccgacgctatttctactctaggccgagatgtgggacgcatatgggaggcaagctgcaaggagcacaaggtgcgcgccacgagctgagctttttttgtcgttgcaatatatccgctagctggtgaggcgcgctccagagcccacttgaacatgcggcacgtgctgcacatgatgcctagtatagcagaccacggcagtttcgtgattgccgcttccccctaatctcattgccgcaggagccgcctcttccgttcgacttcaagctcgcccggcacgaccgtaagaatcggatggcgtccaaggccgaccgctatggggtctgcaatctcctgcccttgcccgtcgaggctctgggcagaccggagagcatcgtatagacggcattgccgacacggcccggataagggcgatatcggcccatatgcgagatcggaatgcaaccgctgcgctaccttcgaccggcacgagaagacatcgaaaatacgcggatggtcaagtgaccgccttcgcgcttgagggtctgctgcgacattcctgacggcacgctgcagcgtatctcggttccatggtcgaaccacaggagtacgggaccccaggagttacgcgcagatcggggtgccgaccatcgagtagcattcggcgaggtgcgtggcggtgcagagcagatcatacaggcactgcgtggacctttgactgcatgcgtctcttccgcgtctatcagatggcacctcgcaggcacgtatgttaaagacgtgtacccatgctgtgcatcggccaaagaccaggagccagaacggacggtcccgagcgtcggcgtgcatgtgagtgggcgcttcttcggaattctcgtggagggtcgtcccctggcaacaagtgacggggccgtagaaggccctcgagcttcagcgacatggctgttgcctggttgacgtccgatcgatcccccgacggtcgtcacaagcgacggtatcggagacgtgagtcggtccagcgcttcgagagcgcagccgcatcatcacacgctgatccacatcgatgagcaggggtgcctcatgtgctcatagctcctcccaacgtcttccagattactctgacaaatataccgcagagggggaatttggcaaccgagtggacctgacctggttacactcatataaaaaagcactgcatccataggcagtgcaggcttatctttttcgtgctcggggcgtattcagctgctgacttttcttagctttctcttggcctgccggctctcgtcgacagcgacctggtgccacattccttctcggactcgcttgccctcggccgctcgcttcggcatcggcatctgcacctatctcgggctgcgcgcttcgctgttgcggagctctcttcgggcgtgaggacatacctcgatgcgggttcaatggtgccacgcctgcactccgtcagacccgtcatcgcccatgacctgcttcacgacgggcctttcacgtcctcgaagtattgcaggtggcattttagcaccggtaccgatcggagaacggagatgtttcactgcgcacggaatcagatcagtgcgtcacctcgactcgtcacgcccttcctggggtcgttcgcaccaaggcatcctgcacgcgtttcacccagccgccctttcatggccgaaacgccaggaacttcgcgtacggcgagggcgacga

SEQ ID NO: 71 - DNA, 5833 bp, Unknown
  Metagenome-assembled genome
cttgaatgaggcagcatgtccagttcaatgccacttcagtcaccatctccgcatttttgccattacctcttggcaaggcgtcgagacgggtaccatatgcacgcaaagaagcatgtgagcgaggctggtagcatggcattgaacagatggacatacagacgatcgtggtaggcggaggccctgtggcttcccttctggtcctgaagccccgcattcccgaagaggcccctcatgacgcacagctgccgatcaagatcggtcctgtggaagccatggccatcggggtgggtgtgaacgactcccaccgcacaacagacaggccgatgacgcacgaccttctcaaacatgtcatcgaatccctcggcgcccatctcgattctgtcatcatcagcgcggtctccggcacgaccttcttcgcccagtgaggatcgagaaggaagacggagaggccatcttcatcgattcgagaccgtccgatgccatcgcccttgccgtacgcacgggcgcccccatctacgccaggagcgacgtcctgaccactgcctcctaccccgacttcaagggttggaaaggaaagagaaggcacgagatggaggagttccacaagttcgtgggagaacctctcgcctgatgacttcgcaacgacagcaacggcagcgcaaagtagtgcttggctgcatatcatgacactgctccagacaggtgacaccgattcctgtctggggcatttcttttagcctttgcagcaccattcgaacgatggctggtcgatcggggctattgcttcttctttatcatgtcgcgcaggccacgggccggcgctgtgatacagcgccccacgtggaacgatgtggaatgttcgaacccctctatcgccgtctctttgagctctacttgatgctccagctcggcaatacgccgattgagctcgtcaatctcgctgtgcagcttggcattctccatccgtacgcgcgatgcatgatcttcgcagccatcgtgcctgatcttgaggtctgcatagtgagcgaagacaagctccgtcagaggaagatggaggatgtcctggatgcgctgctgatgccaggggctctcgagcgacgagatatctgcatctaccagatcgagctcctgaagtccacccttcttcatcttgttggctatggttgcgaagccctcaagagatcgggcaacctccaagttggcaatgacgctgatagctgcccagctgatataggaatcgtggtagagctcccaagtcccctgctccttcagtgtatccctcaaggctatgagcgcctcatagaaatcgagaggatacctgtcgcttgtagccattgcgctgttggcattgttgatgcgaaacctatgcagatattcgtcaagcaaagcaatgcggcgcgcttccgtcagggcgcggcaggtaaagagaaggtctgccgtcctatggagaggctggaaagacagattgcgttcatggacataggaagctctgaacagcttgttgtgaacccagttctggaatgagttgaggatgcgtttgggccactcatgcggatcgaagacatcgatctcctcaggcagccattcgcgcatgtaggagcagccaatcggcagcacctcgcctgtcacgtcattcagcgtgagagtacggaaaatcacgaggtcggcatcggtgttttcgcctctggcaatggcatgctcaagaagctgtggctccataaggtcatctgcatcgaggaaatagagccacttgccagttgcggccacaaagcctttctgacgtgcaggaccttcccctgccgtcttctcttcaaggacctgtatgcggctgtcttctgcagctgcctgctccaggatatctcgggtggcatccgtcgagttgttgtcgacacagatgatctcgatatcacgttccgtctgattccgggcactcatgagcgtgtcggggagatacttctcggcgttatagcagggaatgatgattgaggccttgggcatgtttgctcctccgatcgaaacgtcatttccctcataatgcaaactagggtatttgaatgcagcgtgaatttacagatagcaatgggcggacggaaaaggccaggccgcgcaatgtccgtactgttcggacaacgatgccagccagccttcaccagcatccctatttcagctgtcttttccaccatgattgatgctgctgataccaggcaatagtctcagatagcccctcttcgaagctagtatggagtggcttccacccaagctctctttgaatcttcgaagcatcgagtgcatatctcagatcatggccgggacggtccgaaactgactcgaaccaatcctcgtctttccccatcatgtgcaggatatcctgaagcacctcaagattgcttctttctccttcagcccctatcagataggtttctccagctctgccccgcgtcataattgcccatatggctgtcacatgatcttccacatatatccagtcccggacattcctcccgtcgccatacagctgcggcttctcgcccgagagaatcctgcttatctgtcttggtatgaatttctcgatgtgctgatatggcccgtagttgttcgagcaattcgagatggttgtatagagcccatatgttctgtgccaggcacgtacaagcatgtctgcagatgcttttgacgcgctgtagggagaagacgggcgataggggctctcttccgtgaacctgtcctcgctttcgtaaggaaggtctccatacacctcatcggttgatacctggtgaaaccggacgccgttcttcgctgcctcctgcagcaggcaataggtcccctcaatattcgtcttgatgaaaggcccgggttctgaaatggaattgtcgttgtggctctcggctgcaaaattgacaatcgcatcatgtccaggcactacaccatgaagaaggcctctgtcacagatatcgccgactacgagctcgacctgcgtggacggcagtccaacgagattgtccaccgatcccgcataggtaagcttgtccagaacagtcacatgagtctcgggatggttcctggctacccagtgcacgaaattcgtgccaatgaagccacagcccccggtcaccaggatattgtgcgggccttgcgtctccattgaacgtcctctctcctattcagccttccctatacaggtagcatagccatcttgcaatgagtgtcagcatcacacacctcaacctcttgccgccctggcgccaccgtacccgcagccatcatgcataaaaccgcgagccgtcgcaatatcgaggccaagcggattgggcgttgacgattttccaagagccattgctcttggctacgaatgccacttcgagattcgtccttgctttcgtactgctgcacatttgcaccagcataggaggcggctcctgcaacgtcgagtgcacgtcctgtgcctgcattcttgaccgtatagtagccgctggcatcgtcgtagaagacagcaaacctcgcgccatcgtgccgttctcgcgataggaatcgatgttggctcctgatgcctctgaattgcccgcgacatcgatgacgcgctcggatccaatgccggaatagatctcgtaggtgccatcctgaatggtcttggtggcagtgagcgaccagttctgcgccttgcttccgttctttttccagatccagagagagggcgccatttgctgcctgtgcagatggaacatcaagggcataccgaaggccatctgctccttgagccaggagaggatggtccaggagccatctgcattgctgatgagttcccatttctgggatctgttccatttgccttgtactgctgcacgcgagtaccattggctgccctggcgctgtctacatcaagcacaagctgcgacgaggtattgcggatggtgtaggagccgtcgcctcccttgatgaaggagaaacgctgggctggcgtctggttgtccgaatagagctggactgaagttccgggagcagacgatgcgccaggaatatctatgctttggacgaatcgatggctgtctcgattgtatatatgccatccgaaaccgaagcggcagcgcgtccttttcagcagtatctgccgtcgttgatgcaggctcctgtgtctctgcattcgcattgtcggccgagctgctcccgatgtggctgtgtcgtcttcggtgacgtgacagaagtcatgtcgtctttggtgctttcggtatccaccgtctctctggagcgctgtcctgctttctgacgtgctgtcctcagcagtcttggcgtctgtggacgaggcttcagatgtctcctgcctctcctcgtccgctgcagcttctgctgtatcaggagttgcctcgacaggagccttcttgtcggccatttgcccagcgtcagccttagcctctacctgcgttgcagcggcgtcagcagtgcccgtcgctcctccgcgatagctatacagggcatagatgctgagagcgcaccggcgaggcatagggcaatgagcctgcttgtccttcgcattggtcctccaatctcgtgggcggggtacaaaggcgatagcctgcatccgtgccatttcgagcaagcccgttgtcggacgcggatttcctcattgaatggatgaggctgcgcggctatctactgaaacattactttatctaacagtctagataatgagggccggtccaggctgtctgacagcgggtgatacaattccacatgccaaatggagaatgtgccctggagcccacccggctctctgtttggcgacggttctgccgggtggcctccagggcgaagtggaatcgtcaggatcatggtacgggagaatcccttccgcacccgcatcgcagaggccgaggagcaggaggtccgccagctggaggaggccatagccgagcgccgctgccgcgagcagacgggcttcggcaccttcgccgaggcggcatccgagttcaggccccatccgtgctgtccgtcatgcgggtccgcgcgcacgaagcgcgacggcctcgcgccgaacggcgtgcagagatgggagtgcctcgattgcgggcgcaagtacagctcgctcgcggggacgtctccgagcatgcccgctatgggctgccgaaatgggtgtgttcatagggctcatgcgctacaacgtgccgctggactgcatagccgagacgctccagatatcgcaccagaccgcctgggaatggcggcacagggtgttcgctaccgtggacggataccaggaccgcatcgtcctcaggaagcgcgtctggatcgacgagacatacatcgtggactcggacctcgcgcacggatacgggcaggcgaggaagcgcggcctctcctcgcagcagctctgcatagcggtcgggatagacgtcttcaagaacccctacgccgtggtatgcgggcacgggaagccctccacgaagaggatgaaggacgcattcggcggccacatagccgagggcgctgccgcgtgcatgacagggagcgcgcccacaacggaatatcagggatgccggagccgtctccgaatcctacaaggcagatgtgcgggaccccgaatactcgagagcatggagctcgtgaacaacctctgctcctggctgaagagatacctctggcgcttcacggggatgtcgatgtccaacatgcagagctacctcaactggtatgtctacctgttccgggtcaaccaggccagggacaggtggcccgagactgcaagggtggtccgccaatgctcatggccgatgcgagtttccgcagctcggcgtaggtctggcggccctcattatctagactgtcagattactttaaatac

SEQ ID NO: 72 - DNA, 38195 bp, Unknown
  Metagenome-assembled genome
ggggtctcgaagcgtcacccgccaatccggatatcccttgtgcagctgcattccacaatacacgtctttccgtctcgctatccctgctgacgcatatctttcagagttttatgcaggacatatgcgtttctttcttttctggcatcgcagcaagggtcagggcccagccctttctcccacaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaccactctgccagcagagctgcacgttgccggcacatgcagacctgccatctgggcatatccagataccggttgtctatgcacgcgttcattgccgcctcaaatacttacaattgcgtaagctgaagcttcctgcacaaagagaggaacatgctttccgatcgccttcgactagcggcggcgattgccaggccccccccaacgccacgatgcgcggcatcgtgaagcggttctctctctccacaactctaaggagaacgtcgagatctacgggctttgggacggctaatcagggcctcatctagtggcgctactcgccagtgacgttgacggcttctccggcgtgcgtaccccagggcggcacgatcctggcacgagtcgcccccccttcaagatgctcgacttccgagcagacggagtccagaaggtccctgccatgaagaacacgtacaagagcctcaactttgaactgcctcttcatgcttgtcggcaacgcctccacgaagacgcgcaaaccgcctctcccagaaggcctgaacgtttcgcccttccaagaccatcgacaacgatacctggtaaccgacatacgttcggcttcacctctgccatcgatgtggcccacccgcctccttcgacgaatcaagaccacggctcttccttcttcccacatcgcgcttcgtcgttgagatcattgccacaagtcggctggtcccctctatgcaggcattgccgcgctcctgacgttattcttctttccttatatcccctacgatacaaaacgtcgtccgcgcctcgagtccgcagcagtgccggcggccggctatggccctcgtcgcctgcgcaaaggcgccatctccaataagtccggcagcaatgcccaagaaggagtacaagaagctccgggcccagcgccgctactctcctttcgttgctagagattgcgaccgatattgcacagctcacgtcctcgctagtccgtgtcgggcatcctgtccacactcgccttggcggccatcccctgatgcccaggaccgcatctttgcgacccagtgcggcgtcgaggcaggcccgtgccctctgcgatcatgactatgtctgccttattcgccaaggtcaacaacaatatggtgcgtgtcccctcttgctgatgttgcaggcaagctcaagtacgtcgacccgaatcggaacctggtccaggaggccaagcttctgggcatcagcttcggcgactagtaaggccgaaagcgccattgcagcccttccgaaagagcctgggagcgcaagcttcagcttcttttttcatggaggactgggcacggcgcgcgagtaccgggtaccagctcatccagccattcctcttcctccatgatgacaagctgcgcgtggttcctgccccgtgattcgccgtaggcttaaacctggcagaaggcatctcatccccctccgccatcctcctctccgaagaaggtcgcaccttccgaaggaacggcgggacagagccgacaggcaacccgcccaccgcaggccagatcatcgcatgttttcctgtcgcatgcaacctttcgatccagctcagagctcggtgcatcatagtttgcctggccgcactgcttcttgccacattatcctccccacctctcagccgccttcctcttgccccgcgccatctaggatgcgtcctctttcttgaggctctcttcttgtcacatcgctcgagcgattgtcgccatgattgccttctgccaaaatcctgacgcagaaggccgttagccctcgcattcatcttctgcaagtcagcatggcatgtatgacgttatatccatggtttgtcttcacactcgtagacctgcacccaccgctttgctccgcccatttcctcggtaggttcttgttccctacaccgggttcaactcctgtcatggctcaagtcaatggtctgcgtgccaggaagagagtactccccacacgtgcaagcatcgaagtgttcagctacgttgtagccagtagacgatgccactgacccaagcgtctctgccaaggagggtccagcctcctctatcgtgggagcatcctcccgacatctgcaaacgtgatgtggttcacgctctgcagcgccaggaccacttcttatggtgcgttagcctcacataacttgaagcatggtcgcccgtaccccatccacgacagcgatctctgaggatctcatcgccgtcgaaaagccgtcgtctccgtatcgaagtggcgactctgtctaaggaccgccgaagagcgcatcctgagaggtctcgtcaactcctgcatcaggttgcgcccctcatcctggctgccaataacaactagaaggcggaagccctcgctccccaatccggatttgcctcgaagaaggccttcatggccgcaatgcccagagcggttcctcgatgcctgtcgttcataggcagagtgcatcgcaagctggcggcatgcccacatccaccgcatggagcgaaatctgggtgttggagagattgccccaagtcgatccccaacgctatcggagcgatttcgcgaaagtctggtagggaatcttcgcctcgtcgagtatcgcaaggagtgcgagcggctgaaaggcatcagaggtatagagctggtttgccgctccttgataacaatgccgtgttgagctggcatctgacctcatccgacttcgaggatgtttcggatgcacggcgtgcgcattgtcggcactcaccagaaaggactttgcatatgcctcatggagctcctctgcgctccagcccaggccggaagcgacacggaagcgtatcatcagagtgtcgacaatcgcgccctgcttcgtgttcgagcccacttcctcgttgttcgaagcaggcaagaacgctcacatcggcgggttctcgaggagagaaggcttcgagcccggcgtagccgctctgggatcgtccagtgttgcactcacgaactcattgccgctccccattcgtaggcttctcgcggttcacgagatagaggtcgcgcccgaggatatcctctgccttgcagcccagctcttctgccagaagagtccgtccatagagtcctgcttcagctttccagccgaccagagcggcaggagatctatctgctgttcgggccgaaagacttgttcacgtcgcggtccatatgtacgccaggaacgggatcagagagaatggtccgatcgaagggacaagagctcctcgctcccctgccctcgcgcacatagaccctgcctgcccagcgttctggacgatcgaaccctgttgtagtcatctgccgcgtaggcttccacatcaagaaaggtaggactcggggcctagagcactcaacattcttgagcttgaaggtcggggaatcattgtgcgccgcgaacgagcggaaatggggcgcatcgagcgtcctcccctgccttcagccaatgaggctcgagtctttcctgacggtggtagtactttccgcccttgcctgtgtccaggacccctcaggaagataggcaaagcctgctttatcgagacgggcgcaagcgccttgaccgtgaagaatgcacaggggctctcgcagatgaactgcaggagcccctgggatgccgtacgtgaatccaagatcgtgctctcctctctctccgcttagaccagaaggccgagccagcagctgcacctcccagagcatcgtgacgggaagggtgacaaaccagcctggccgatatcggccgcaacaccccatgacctcctgaggcccttggcggaaccggcacccatgatcgctcgtttatgacctgggtcgtggagacggtgcgccgaattggtcagatctggattgcgatggcaaggaggtctcgagacaaagcccatgacgggctcgagcttcgtgacgccgccgccgaccgtcttcatagcgcggccgccgaccgggtgcccagagccatcgtcgcagcgcagaagatcttacccagagggacacacagagccaggagcgatgaggccctcggaaatcagcgcaatcgtgatgatgcccatcgtcttctgggcatcattcgagccatgactgaatgccatgaactggaagagcagatctcaggcggtggaagagcagtgttcgcacggtgcggcacccgttcgcaagagctcgaacacaagcttcataaggaagaagccaggcagaggccttcagaggagagggatgaggggaatgacgaccttgtcgaggacgcccgtcccagatgagtcctgaagacctccggtcgcgacgatcgtggcaccaatcagagagccgatcaggcatgggaagacctcgggggacggacttccaccaggtgaagaggtcccagatgatggcaaccgacaagcgcggccagaatcacatagagctccggcgtgatgctcacgagcccctcgacatgtcagggcgacgccctcgtgcgtgagggcaccgtgaagttcatgccagccgccatgaggatcgcacgcaggcggaagggctctcgttatagaccgtcgtcgcaatggcattggctgtaatcgtggaagccgttgatgagctcgaatacaaaggctgccacaagcacgcccacaaccccgctaagcattcttcagccacccatgccgacgagggcttgccacggtcttgcagtaggagtcgaggatccttcctgcttgttgtagatcggtgtccacttgagaagatgggttgcacaggatccttctcatcgaaaggcgtgcgaggcatcgtggaagacagcatcgccctcatcctcgatcttgtggatctttccgccgcctcctccatcaccacaggtcgcggcgaagtcatgaagtgctggaagagcgtatccatgtagtggcaggcttcattggcaagacgtgccatctccgtcgcctcaggaggatcgtgttcacgtggaagagctcgtagcgcctcgagacatctccatcccatccaccacatcatccatcttgaggatcagagacgagtgtcctcgcggtcaagggcgtgatgagactcgctcagatgctcgaagatgcgcgaaagcatcttgtcgcagcggtctcatactgcttcatctcttcgagacgttccatgtgctctggataggtcgagatgatatcgaagtagcagtcagatgctacagatcttgggaaagctcctggaacatctctagaactggtctttcctcttgctgactcgggacatggggctccaacctacacagagagtaaagacaacgttaagtataggtaaagcgcacgttaggccccaccagattggccgttttgtggagaaatgtacgccttctgcgagatatccgacagctttcgcggaatatgtgtatgaaatcgggccgaagcgcttccatccatcttcgcgcatgcggcatccggtgcacacagaaaacggttcatccatccagatgacgcatccctgaagcccagcatatcctgccatgccccaagcctcgccgcactgtcagatgcacaacgtgctaggctagagtgaatcagaagcaagctatccggatgcaggcaccacatgaatctcgcacaggccatcgagcatgcaaactccatcgtgtttcccggcttcctcgtcggcgacgaggcaatgacggaagagcgccacagaaacgaggaagcgctcgtcctcctcatggacgcctggaagacggcgcctctgggccaggagcccttcggcttcgataccgtgaggagctcgccgacaggaaccgcgagctctgcgacctctatgggccagagaggctgagagacgagccggtagcgacgcttgcaaggaagcttcccactcagaccttgtccacgccgcgccgtgatgcagcaccgctccgatgcagatgtggcacgcaccgcaggcagggacctgcgcgatctgggcttgcctggcaggaggctccggtctcaggcatgatactgggcatcgatctcgagacgaccgagcgcgcaccagcacgcggctacatcatcaatgtcggcttcgagttcatgtatatgtctcccaaggccaagcccacgaatggccatgctgcctatttcggcatccccgagatgtacaaggagaagggcgtgcccttgaccgaggtgcaccactcactggaagacctcgacggcaagactcccttccgcgagcaaaggctgtcaggaagcgctcatcaagatcctcgagcgctatcccttcatggcacacaatgctgccttcgaggattcctggctgacacctccacctcgatggctatgccgaaggcaggaaggccggcaggatcgtgccgatcgacacgcgcgacatctgcaggagatgcgacccgaggtcaagaaccttccccgcgaggcaagacctttgcccttgagtcctgggcaaggcgtcgcaaggtcctgaagaagagccagaaggagcgccacttggggcttgaggacgtggactcgatgttagacagtccaggcagagttctcagagcgcacgatgttcgcgtcctgattgaagaccccatagatacgaaagccccgcagtgcctatgcgcatctgcgggctgcaatctttattgggaagtgagagaggaaggggttcgaaagagggtttccgaacttactcctcaggctttgcctcggcctcggagacggacgaatgtcctcgccgggcagcgtacggggactcggtcgccgccgatgccgtggaggaagtagaagccagagcgtttcttgaagagggactcctcgtaccggctgctctccgacaccggaagtcgcaccgatgtcggtcacaagccttcggcgagtttcggcgacgcagccgctacgaggagtgcccgctcaataccgcctggcttctacttccttgcctccacggcatcggcggcaacgagtccccgtacgcctgccggccgaggaatcattcttccgatcactccgaggccgaggcaaaggcctggggggcaggagtaagttcctgaaacccctctttcgaaccccttcctctctcacttcccaataaagattgcagcccgcagatgcgcataggcactgcgggctgctttcgtatctatggggtcttcaatcaggacgcgaacatcgtgcgctctgagaactctgcctggactgtcttgaacatgaggtccacgtcctcaagccccaagtggcgctccttctggctcttcttcaggaccttgcgacgccttgcccaggactcaagggcagcaggtcttgcctcgcggggaaggttcttgacctcggggtcgcatctcctgcagatgtcgcgcgtgtcgatcggcacgatcctgccggccttcctgccttcggcatagccatcgaggtggagtgtcagccaggaatcctcgaaggcagcattgtgtgccatgaagggatagcgctcgaggatcttgatgagcgcttcctggacagcctttgcctcgcggaagggagtcttgccgtcgaggtccttccaggtgatgtggtgcacctcggtcaagggcacgcccttctccttgtacatctcggggatgccgaaataggcagcatggccattcgtgggcttggccttgggagacatatacatgaactcgaagccgacattgatgatgtagccgcgtgctgggtcgcgctcggtcgtctcgagatcgatgcccagtatcatgcctgagaccggagcctcctgccaggcaacgcccagatcgcgcaggtccctgcctgcggtgcgtgccacatctgcatcggagcggtgctgcatcacggcgacggcgtgcacaaggtctgagtcgggaagcttccttgcaagcgtcgctaccggctcgtctctcagcctctctgtcccatagaggtcgcagagctcgcggttcctgtcggcgagcttcctcacggtatcgaagccgaagggctcctggcccagaggcgccgtcttccaggcgtccatgaggaggacgagcgcttcctcgttcttgtggcgctcttccgtcattgcctcgtcgccgacgaggaagccgggaaacacgatggagtttgcatgctcgatggcctgtgcgagattcatgtggtgcctgcatccggatagcttgctttctgattcactctagcctagcacgttgtgccatctgacagtgcggcagaggcttggggcatgcaggatatgctgggcttcagggatgcgtcatctcggatgcgatgcaccgtttctgtgtgcaccggatgccgcatgcgcgaagatggatggaagcgcttcggcccgatttcatacacatattccgcgaaagctgtcggatatctcgcagaaggcgtacatttctccacaaacggccaatctggtggggcctaacgtgcgctttacctatacttaacgttgtctttactctctgtgtaggttggagccccatgtcccgagtcagcaagaaggaagaccagttctatgagatgttccaggagctttcagccaagatcctgtcagcatctgactgctacttcgatatcatctcgacctatccagagcacatggaacgtctcgaagagatgaagcagtatgagaccgactgcgacaagatgctttcgcgcatcttcgagcatctgagcgagtccttcatcacgcccttcgaccgcgaggacatctcgtctctgatcctcaagatggatgatgtggtggatgggatggagaatgtctcgaggcgctacgagctcttccacgtgaacacgaatcctcctgaggcgacggagatggcacgtcttgccaatgaagcctgccactacatggatacgctcttccagcacttccatgacttccgccgcgaccctgtggtgatggaggaggcaggaaagatccacaagatcgaggatgagggcgatgctgtcttccacgatgcgctcgcacgccttttcgatgagaaggatcctgtgccaacccatcttctcaagtggaacacgatctacaacaagcaggaagagatcctcgactcctgcaagaccgtggcagccctcgtcggcaatgtggtgctgaagaatgcttagcgggctgcttgtgggcgtgcttgtggcagcctttgtattcgagctcatcaacggcttccacgattcagccaatgccattgcgacgacggtctatacgagagcccttccgcctcgcgtcgcgatcctcatgtcggctggcatgaacttcatcggtgccctcacgcacgagggcgtcgccctgaccatcgtcgaggggctcgtgagcatcacgccggagctctatgtgattctggccgcgcttgtcggtgccatcatctgggacctcttcacctggtggaagtccgtcccctcgagctcttcccatgccctgatcggctctctgattggtgccacgatcgtcgcgaccggaggtcttcaggacatcatctggacgggcgtcctcgacaaggtcgtcattcccctcatcacctctcctctgataggcctctgcctgggcttcttccttatgaagcttgtgttcgagctcttcgcgaactgggtgccgcaccgtgcgaacctgctcttccaccgcctgcagatctgctcttccatgttcatggcattcagtcatggctcgaatgatgcccagaagacgatgggcatcatcacgattgcgctgatttccgagggcctcatcgctcctggctctggtgttcccctctgggtcaagatcttctgcgctgcgacgatggctctgggcacctcggtcggcggccagcgcatcatgaagacggtcggcggcggcgtcacgaagctcgagcccgtcatgggctttgtctccgagacctcctctgccatcgcaatccagatcatgacagcaatcggcgcacccgtctccacgacccaggtcataacgacgtcgatcatgggtgccggttccgccaagggcctcaggaaggtaaactggggtgttgcggccgatatcgtccaggcctggtttgtcacccttcccgtcacgatgcttctgggaggtgcagcctgctggcttatcggccttctggtctagcggaaggagagcacgatcttggattcacgtacggcatcccaggggctcctgcagttcatctgcgagagcccctgtgcattcttcacggtcaaggcgctgcgcgcccgtctcgataaagcaggctttgcctatcttcctgagggcacgtcctggacacaggcaaagggcggaaagtactacaccgtcaggaacgactcgagcctcattgcctggaaggcaggggagacgctcgatgcgccccatttccagctcgtcgcggcgcacaatgattccccgaccttcaagctcaagaatgttcctgagctctcaggccccgagtcctaccttcgtcttgatgtggaagcctacggcggcatgattgactacacatggttcgatcgtccgctcacgctggcaggcagggtctatgtgcgcgagggcaggggagcgaaggagcatcttgtccacttcgatcgcgaccttctcctgatcccgtccctggcggtacatatggaccgcgacgtgaacaagtctttcggcccgaacaggcagatagatctcctgccgctctggtcggctggaaagctgaagcagggctctctggacgaccttctggcagaagagctgggctgcaaggcagaggatatcctcgggcgcgacctctatctcgtgaaccgcgagaagcctaccatctggggagcggcagatgagttcgtgagtgcaggacacctggacgatctccagagcgtctacgccgggctcgaagccttcctctcctccgagaacccgcacgatgtgagcgttcttgcctgcttcgacaacgaggaagtgggctcgaacacgaagcagggcgcgatgtcgacacttctgagggatacgctctcccgtgtcgcttccggcctgggctggagcgcagaggagctccatgaggcatatgcaaagtccttccttgtgagtgccgacaatgcgcacgccgtgcatccgaaccatcctgagaagtcggatgaggtcaaccgctgccagctcaatcacggcattgttatcaaggaggcggcaaaccagctctatacctctgatgccttcagccgctctgcactctctgcgatactcgacgaggcgaagattccctaccagactttcgcgaatcgctccgatatgcgtggaggatcgactctgggcaatctctccaacacccagatttcgctccatgcggtggatgtgggcatgccgcagcttgcgatgcactctgcctatgagacgacaggcatcgaggataccgctctgggcattgcggccatgaaggccttcttcgaggcaaatctcgagattgagggagcggagagcttccgcttctagtatgtattggcagccagagatgaggggcgcacctgatgcatgagttcgaagacctctcggatgcgctcttcggctgtcccttgagcagagtcgccatcttcgatacggagacgacaggcttttctgacggcgatgagatcctcgagatcgctgtcgtggatgggtacggcgagaccctgctctcaagctatgtgaggcctcagcaccatacgaagtggcctggcgctgcagaggtgaaccacatcacgtttgcagatgtcggagacgctcccacgatagaggagctggcaccctccttggcagagacgcttgggtcagctggcctcgtctctggctacaacgtcagctatgacctctcgatgcttcgccgtgtgggagtcctctcttcctggccccgcaataccttcgatgtgatgaaggagtttgcccgcgtgcatggaaagccctcgaggaaatggggcagcaagcggtgggtgaggctctccgagtgtgcagcaacctatggatatacgttccatccgcatgatgcagaagatgatgcgagggctacggccttctgcttcaggcatcttctggcagacggcagctacctgaggattgctgcccaggagcgctccggacgccttcagatggcgctggggcagaggaaggcggctgtcgaggcggcggcatccctgctggagaagcaggggccaggcacctatgctgccgagctctgctggatcgaaggtgcatgcgcaggaaaacagaatcttgcctgctgtgtggacggggtgcctgtcggccttgttcccgccgcttccttctggaaggtgcgtaccttcttcggagaggaggaggcggaggatgggatgccttcctgccaggtacgcctcggcgaatcacggggcaggccccacgcgcagcttgtcctcatggatgaagaggaatggctggatgagctggtacgtctcgcgcgcattgcccattcctcatgaaaaaagagcctgaagcttgcgctccaggctctttccggaagggctgcaattggcgctttcggccttactcgtcgccgaagctgatgcccagaagctttgcctcctggaccaggtccgacttcgggtcgacgtacttgagcttgcctgcaacatcagcaagcgggacacgcaccatcttgttgttgaccttggcaatcatgcagccatagtcatgatcgaagagggcacgggctgcctcgacgccgcactgggtcgcaaagatgcggtcctgggcatcaggggtgccgccacgctgcgtgtggccaggaatgccgacacggacctcgcgggacgtgagctgtgcaatctcgtctgcaatctcataggcaacggagtagcggcgctgggccacgagcttcttgtactccttcttgggcattgctgcctgcttcttggagatggcgccttctgcgcaggcgacgagggcatagcggccgccggactgctcgcgggactcgatggcgcggacgacgttcttgatatcgtaggggatctcaggaagaagaatcacgtcagcgccgccggcaatgcctgcatagagagggatccagccgaccttgtggcccatgatctcgacgacgaagacgcgattgtgggaagatgccgtggtcttgatctcgtcgaggtagcgggtggccacatcgatggcagaggtgaagccgaaggtgatgtcggttccccaggtatcgttgtcgatggtcttgggaagggcgataacgttcaggccttcctgggagaggcggtttgcggtcttcgtggagccgttgccgccaagcatgaagagacagtcgagcttgaggctcttgtacgtcttcttcatggcagggaccttctggactccgtctgcttccggaacgtcgagcatcttgaagggggtgcggctcgtgcccaggatcgtgccgccctgggtcagcacgccggagaagtccttccacttcatctggcgatagcgcccatagatgaggccctgatagccgtcctcaaagccgtagatctcgacgttctccttcgagttgtggagaaccgtcttcacgatgccgcgcatcgtggcgttgagggcctggcaatcgccgccgctcgtaagaaggccgattcgaagcatgttcctctcctttgtgccggaagcttcagcttccgcaattgtacgtctttgaggcgcaatgaaagacttgcatagacaaccggatatctggatatgccagatggcaggtcatgccatgtgccgaaacgtgcagctctgctcggcagagatggggcagcaaggctgggccctgcccttgctggtgccagaaacgacatatgtcctgcataaactctgaaagatatgcgtcagcagggatagcgagacgtgaaagacgtgtcttgtggaatgcagcctgcacaagcgatatccggatgcgggtgacgcttcgagagatcgagggagcctcaggacaatatccttgaaatcctgcaggccctcgcgttctttgcggggattctgaaaaccattctcgagatcgcggaagaggtggtcaggatcagaagggaacataaagcatcataaggaagacgcactttaacgaatgaagcccggtggccaccgggcttctgagcaatcaacacctgcgccgcccgcgccgcgttaaggatttcgggcattgctgatgcatctctattgcacccgcatctgccatctgacaacaatggctgatgtttgcaagaaggcttcaactcaccttctcatcgcttccacagttctgtggctccggcaacgctgaataggcaaccgctcacgggatgcagcgttcagccgaaatggaccggacatagaaggcggctaggatgtagtgcgcccgggctcaggttcggcgcagagagagttaggaacagaaaggtgagaggcatggagtctaaggaagacatcctgacgctgccgcacgaccagattgaggcgctgcagctcgagggaatcaagaagaccgccgtccagtgttacgagaagatccccttctacaagaagagcttcgacgaggcgggctttgatccctattccatctccagcctcgatgatgtgaagaaggctcccttcgttacgaagcaggacctgagggatgcctatccgtatggcatgcttgccgtgccgctttccgaagtgcgcgagatccatatgtcctccggcacgaccggtgtagcgaccgtcggcgcctatacagagcatgacctggacttctggggagagtgcttcgcccgtggcatcaggtatgccgacggcggaccgaacgatgtggcgcagattgcctatggctatggcctcttcacgggcggcctcggtgcccactatggtgccaaggcagcaggatgcacgacgatacccatctcggccggcaataccgagcgccagatcagggttatgcgcgagatgggctcgaccatcctctgctgcacgccgagctatgccatgcatatcgcagatacggccatctccatgggcatcgatcctgcccgcgagttccatctgcgtgtcggcatccacggcgcagaggcattctccgacaacttcaggaaagagcttgagaagaagctcaactacaaggtcctcgatgtctatggcctgacagagaccatgggaccgggtgtcgccgtggagtgcctggcacagcaggggctccatatcgcagaagaccacttcctctgcgagatcatcgacccggcaacaggccaggtgctgcccgacggcgagtggggagagcttgtcgtcaccacccttgaccgcgaggcatcgcccgtcttccgctatcgcacgcgcgacattacaaggattcttccgggctcctgtccctgcggacgcacccacagaaggattgaccgcatccatgggcgtacggacgatatgctcatcatccgcggcgtcaacgtcttcccgagccagatcgagaacgtcatggagaccttcgacgaggtgtcctcgtggtatcagatcgagctcacgacgaagaactatctcgacgtcgtcacgctcaaggcagaagtcaatccggacttcgatttcgactcgactggtgccatcgagaacctgcagaatcgtatccaggcagcgctcaagacagcactctccgtcggcgtgaaggtgcgcctcgtcgagccgcagtcgctgcccagaagcgaaggcaaggcaaagcgtgtcatcgacaagaggggacaggagtagcgatggtagaccagctgacagtattcctggagaacgaagaaggacgcctcgcaaaactctgccgtgctctggcagacgctggcatcaacatggatgccttgaccctcatggatacacctgaatacggtgtcgtgcgcatcctctgcgcgaacccttctgccgcacgcgatgagctcaacaagcgcggctaccgggcgtccataacgaaggtatcgctcatcaagctgcctgaccgcccaggctctctggcagaccttctgggcatcctcgatgacctcgatatcccggtcgagtatggctactgcttccaggtggcaggagactacgccgtcgatgcgctcaagatctccgaccctgcagcagcctcgaaggcgaccttcgcaattgaggaggcaggcttcaaggtgctgagcctcgaggacctgaagagcctctagattggtatctctctgttagaccttgattgacctgagagggtccaaaagtatccggaccctcgcctatgatgattgtcgcccaaacagaccatactagagcggagggtccggatggattccatatactgcagcagtcgagaagatgggcatctcggagaagcgctgtctctcgagaggctgaaggcgctcatagccgaggagatggcaggctctgccctcagggcacgccgaacaggtgtccgagatgcggatcggcggacttctgccgcaagggccatgacgcccatggcttccaaggatggaggtgcaggtcatgcggcaggaccttctctgccaagacgggattggtgctcgcgatgtccaagctcgatgcggccacctgggctgcatatgcggaaggcacgcgtgcggcatgtcccttagggagctcgcggacagctgcagcgtctgcctcaggacgtcgtggttcatgaggatgaggctcttcgagtgtgtgggtccgcccttgcgcccttcaggaagggaccctccgtctcatgccagcgggacggcctctatctcgaacagtcgctggcgggcaacaggggaaggtcggacatccattgcccaggaagcgcacgcgcatggccatgccgtgcttcccgcgggatatccagcctcaaggtctgcgtcgagtgctgcgtgaacgacctgggagacgaatatccgccgtctgcggcagggggcgtccgaccgacgacagctaaggatgccctctccgcatcgtcgacagctcatggtcgccactgacgaccatgcaggatatgcgcgcgtgctgcccgcctcgcgtgggacatgcggcgaccgtcgccagggaggcaaggaacggagagctcggcctcgtcaatgccatcaccagaggctgcgcgagttcctgctcccttcctatggggtctcgacaagcggctgggccactaccttgcatgcttcctctggacggacaggcgaagcattccgaaggagaggaaggacaccctccgccacttgcggaccgccggtgcgcgagctgagagagcccatgtagggcagtcactcatcagctgggagatggcagaggtcgtccatacaaggcgcgatgctgatagacatgggagcagccttctggagctactggaaggaccgggccgccacgtcaatcaaggtctaacagagagattggtataaaacacgtgaaaaaggaggtgcagctgcatggctgcacctcctttcgcaatgtctggtatgtgtccggtcgctgtggttttaagggaagatgcgaggacatgccgtctcgtggcatcctagaatgcattggctacgcgagagaaaggagctccatgagcgatacaaccatcctggcgattgttgttgccgttctttggggtgccttctggaatgctctcgtctgccgcagctgaccgcaagcgcaggaggcgcgaaggtacggtcgagatgcgcagaggaggaaggcacgaggcttcccgccacagcagatagcctcccatagcagctggctggcccgcttcggtgggcccgtttctttgtgcagaggcatgcctcgcgccggcctcaaaaccaaaggctccctgttcttcggcgtgctgccgcacatgccgcatcttcggtccggcagatcattgtctgcgctctccaggaagaagcgggccctggctgcctgccgtgcgcccgtgcgcatctgtgcggccgttgccggcatgagcgtctcctgcgggacctgctgacatgcaggaatgccaggggccacctgcagcgtcctgatgcatctgcgcttcttgtcctgaaggatgaagagggccttttgcttcggcgctgccatttcctgcgggcaggatggcatgctagagccagatggcattggccagacctgcaatggcaggcaccgtcaggatggagaggagcaccgatatcacgacagtctcgacggcgtaggaatagtcggcatcgtgcagctgggcatagacggccacattggatcctaccggcaggcagaggcgatgagcagcgccatgcgcatctcgtagctcgagatgggcatcagggtcagaagcgccagagaggcaagaggggcagcacgatgcggcaagcgcgacacggtagttctggctgcgtgtgaacatctgcttcaggtcggtcttggccagatagacgccgatctgaacatcgcaagcggggtattcagggctgccacatcgtcgaggcatgtcgcaatgacagaaggcagcggtgcctgcgtcgcatagagcacgatgcctatgagggctgcaatcatgaagggagccgaagcaaggctgtgcagcacctctttggcagtaggtgcgggctctcccttctcgtgcgtgataaggtcacgccgtaggtccactgccctatgttcatgagggcaatgaagccgacattgtagaagacgctctgggcaccgacggtcgcgttaccagagggatgccgaagaagctcgggttcgagaaggtggcagcgaagttgccgatagcgtcctgccgcagacgatgcggccaccacagccgcaggacaaggagcagaagcgagacagccttccttcgacgagcgctgccgtatgctctgccgtgtgctcgatgagagggacttatgatgacagcagaagggaaagatagatcaggatgttccgatgaccctgtttccctccatcgtgatcttgccggcacggaacagcgcatagccgatgccgaccagaagaaacatcacgagcaccttgagagccagcacggcagacatgttcacgggaagcctccagagcctccaaatctgtgctgccgagccctgaggagaggcacctgcagcctctagccatgatagggcagaaagactgcctgccaacatgaggatctcttccggcaagatttcctctctgtggaacccagtcctgtgctccaggagcgaaaaggaaagagggactgacactgacggtccagagccttctggccaggatgctctccgatgaggccctgcgccatttcggcccctcggtacgtcgtccctgcgctttccggactcttcccgatcgggtccttgccatctgccctgatgtttcagccggatccgcaggaaggggagagacctgggctgcagcaggcaggcatctgcctttcatgcccatggcctgaaaggtcgttcaggaaacttctgcccaatacgtcagtttgggctaacttctcggctgaatggggtagtatcgggagcggaacggaacatatcgggctcttcggagccttgggagaaagcaggcagcacatggacaggagccagaagcaggcagaagcctccactctcggctcgctcgagataggcgatgtggcgcgcatcgacaaggtcgggggatcgggcgcactccgccagcacttcctcgatatgggcgtcatcccaggagcggaaatcaggctcgtgaagtacgcaccgatgggcgatcctatggagttcgagattcacggctacgagctgacgctgcgtgtggcagatgcgaagaagatcgactgcaccctgctttcgcccaaagaggtggcatcgcagcgcaaggcagaggaagagcacgtcgaagtgctcgagcatgagccggcgcagacccacccaggtctgggcgagccttcgcagggcgcccatacggacgtccgcacgagcgaccactcccatccgcttccggcagatgcgacgctcacgtttgcccttgctggcaaccagaactgcggaaagacgaccctcttcaaccagctcacgggatcgaaccagcatgtgggcaacttcccgggtgtcacggtcgaccgcaaggatggcgccatcatcggacatcccaatacgcgtgtgaccgaccttccgggcatctattcgatgagcccatactcttcggaagagatcgtgagccgccagttcatcctcgacgagaagccttccggcatcatcgatatcgtggatgccatgaacatcgagcgcaatctctacctcacgatgcagctcatggagctcaatgtccccatggtcgtggctttgaacatgatggacgaggtccaggagaatggcggctccatcgatgtgaaccgcatggaggatatcctggggcttcctgtcgtgccgatctcagccgtcaagggcgaaggcgtggacgagcttgtccagcacgccctgcatgtcgcacgctaccaggaaacgccgggtcgccaggacttctgcgatgtccatgaccatgggggagcggtgcaccgctgccttcatgctgtcatgcacctcatcgaggaccatgcagagcgtgcacagattcctatccgctttgctgcgacaaagctcgttgagggcgatgctgccatcgagaaggcgctgaagctcgaaccgaacgagcatgatgcggtagagcacatcgtgcaccagatggaagaggagcgtggcctcgaccgtgctgccgctattgcagacatgcgcttctccttcatctccaaggtcgtgcgcgcctgcgtgatcaaacccgaggagtcgaaggagacagagcgctcccgcaggatcgatgcagtgcttaccggccgctatactgccatcccgatgttcatcctcatcatggcaacgatcttcctgctcacgttcaatgtgataggaccgttcctcggtgacctcatctcgcagtttgtggactggataagcggcatggcagatgcaggccttactgccggcaatgcgaacccggtcctccattcgctcctgatcgacggcgtcttcaatgcaatcggcacggtgctgccgatcttgccgaacatcgtctgcatgttcttcttcctgtcgcttcttgaggacacgggatatatggcccgcgttgccttcgtaatggacaagctgctccgccgcatcggcctttccggccgctcgatcgtccccatgctcatgggattcggctgcacggtgcctgctgtcatggctacacgcacgctgccgtccgagcgtgaccgcaagctcacgattgccttgacgcccttcatgagctgctccacgaagctcacgatctatggctatttcacggcagccttcttcctgggcaatggcggcttcgttatccttgccctctaccttgcaggcatcctgatcggcatcctctgcgcgaagattgcgcacatgaccgtcgcgaagggcgaggctgtccccttcgttatggagcttccgaactaccgcatgccctctgccaagtcggtgcgccagctcctctgggagaagtcgaaggacttcctgacccgcgccttcacggttgtctttgctgcagccgtgatcatctgggcgctcgagaccttcagcccgaccttcgatatggtgagcgatcctgccgactcgcttctggctgctgtcgcaagctggctcaccccgatcttcgcgccgctcggctttgcagactggcgcatcacgaccgcgcttatcgctggcttcatggcaaaggaagtcgtcgtctcgacgctctccgtcctcttcggcagcctggccgagctcacggctgcgctcacgccgcttgcggtcatctccctcctcgtcttctgcctcctctatacaccctgcgtcgctgccatctctgccatcaagcgcgagctcggcggcaagtgggcgaccggcatcgtcttcttccagtgtgcggttgcctgggcggctgccttcctcgtccatacgatcggcatgctcctcggcttcgcgtagcgcatctgaactgatagcctggagatagcaaaaagcccataaagccggaatgcatacggctttatgggcttatcatgtcttgaggagccttcagccagggaagggagcgcatatggcacagaagatggactccgcgagtctcgaagattacctgagggcgctcttcgagctggcagacgagacaggaacggttcacagcgtggaggtggcacgttcgctcggcgtctcgaagccaagcgtgcatcgtgccgtcggaatcctcgcagagcatgggtatctgacagctgagccgtattcgccaatcgtgcttaccgaggcaggcaaggagcgcggacgtgcgctcgagcgccgctaccagacaatctatgacttccttgtgcaggagctcggtgtcgatgaagaaacggccgccgaagaggcgcatggcattgagcatgcactctccgacggcacgacggaaaagtggatggagcgcttcggcagctagaggatgaaggatgcgggaccctgcttgggcaggtcgcgctcgggattgaccttcctcgagtctgcatagctgatgatgaggccgccacgggcagcatagtaggagcagagggcgccacagcgcccgagcgtgatgtctgcctcgggccagaccttcctgagctcgtctctcatgaactcggctccgcctacattgtccacatgggagatgtagcaggggccgcccgaatagcggtgcatctgcatttcgtggatcatcgcacgcgcagccttcttggcgccacggaccttgcgcagcacctcgatctcgccttcggggctgccggtgccgatcacatgcacatcgagcgcattcgcgaagcgggcaactgccggattcacgcgaccacccttcgcgaggttcgagaggtcggcgatatcgaagaggacatgcacgtggtgctggtaggcaagaagcatgcgcatgagctcctcgaaggggatgggctcctctccgagctcggcagcacgtgctgcaagaagcgccagatcctctccggcggagcgggaatcgacgacggcgatctttgcctctgagtgctcttccagatactgggcagctgcaagacgggcggcattgcaggagcctgagagcttgccggtgatcgtgattgcaatgatctcatctgcgccctggaaggcagcaagccacgcatcagggctcgggcaggaggtcgaagccgatccctggttgagcgacatgcggtcgcagaactcggcgagatcgaggccttcctcgtcgacgtaatcggtcccatcgagcgtcacggtcagagggacgctccggaagtccacgccgtcgagcgcatacacattgctggaagagtcgcagacgaccctgattcccataccaccatccccaatcggtgcgcacactgtttcaggaccattatcggtcaaggcaagacgaggtcaatgaatatggacaaagaccagctgtcttgaagagaccttgaagccttacgagaagctctcgacgagggcttcatattccttcgcctctgctgcctcgacgtcttcgtctgtcccctcatcgagatgggcgaggcgcgcatggtcgaagtcgttgagggcggtggcaatagaggcaagcaccggagctgcaggagccaagatctcgatgtcctgggtcttgcgctctgagtctgcactctgatctgcatccttgtccttgccggtgcccgtgccgacgaagccacggctcttcaagtgccccagggcgcgtgctgcctggctctgcgtcacgccggcataggctgcgatctccttcatgggaccgcaggtgccgcagtccctgagatagagcaggaccttcatatcggccagctccagatcatgggcagaccctgcgacatcgaggtagcggtcgaggagcttggcagaaagatagaggagcccgagcgggtttgcctgcatatcgggatcgagctgtgcggtcacgcactcgcgtccgagctttgtgctcagaggtccgggcaggacgccgccgtctgaggccgagtcgatatagaagcggtagatgtccggacggcgtgcggcatagtcgtcctcgtccatgatctccttgtagaagttcttgtagtactcgatcacgttgatcttcatgcggatggtatttgcaagcgagacaccctgcgtcgcaagagagcccctcgtcttctcgtagtagtagatcggcacatgcaggggatagatcctggcagtgtggagcacatactccatattgaagatgaagtcctcgcaccagctgatcgagggatccatgcggatgtggtggctctcgatgatcgagcgcttgtagagcttgttccagacgacgccccagtagaagtcggagggagactccatcatgaggtcggcgtactgctcgcgcgtgatcacgtcctcggagtcgatgtcgctcttccttgccacgcggctgccgatgacacgatagaagtctgcgatgaccatgtcgcagctgttctcctcgatgccacggaccagaagcttcgtcgcatcgggcgtgatccagtcgtcggagtcgaggaactggatataggtgccctgggctgcatccatggcacagttgcgggtgctcgagacgccggagttcggcttgtggatgacatgcacccgggggtcgcgcttcgcataggcatcgcagatggagcccgaggagtcggtcgatccatcgtctgcgaggatgagctcgatatcggtgaattcctggccgaggatcgagtcgacgcagcgctcgagcttcttctcggcgttgtagacgggcactataatgcttaccttgggttccatgggactccttcacataggttcccttcaattctatacatcgaggcagaaaggttttgcggggtgcaggaaagaccgcagatggaagaagcacagcaggcgcttgcagagcatttcggctatcagagcttccgccctggccaggaagagctcatcgaagcgatcctggcagggagagatgccgtagggatcatgccgacaggggcaggaaagtcgctctgctaccagattcctgcagcggtgctttcaggcctcacgattgtcgtctcgcctctgatctcgctcatgggggaccaggtgcgctcgctcaaggaggcaggcatccgtggctcctatctcaacagctcgctcactccgggacagcagcgcgtcgtgctcgcgcgtgctctggccggctggtatgacctcatgtacgtggcgcccgagcgcctccaggaccctgcgtttgtcgcctttgcacatgaggcacagattccgctccttgcggtcgatgaggcgcactgcataagcgagtgggggcaggacttccgtccggcctatctgggcatccgggagtttgccgaagcgctgccgaagcgtccggtcgtggctgccttcacggcgactgcgacccgcacggtcgagcgtgacatcaagagccgcttgggccttcaggaccccgtctcggtgcatacggacttcgaccggccgaacctttccttcatcgtcaagaagctcgcgccgaaggagcgcctgcgctatatcgagcgctatctggctgcgcaccgcgatacctcaggcatcgtctactgcaggacgaggaagcgcaccgaagaggtcgcagcagcgtttctcgaagacggcttccgtgctgccacctaccacgccggtatggaggcggacgagcgcacccgcgcacaggaggcctttgtccaggacaatgtctctgtcatcgtcgcgacgaatgccttcggcatgggcatcgacaagtccgacgtccgctttgtcatcaatgacggcctgccgctcacgctcgaggaatactaccaggaggcaggacgtgccggcagggatggagagcccgccgagtgcatcctgctttggagcgacggcgatatccgccttgcgcacttcctgatcgaccgcaccgaggtgccggaagggtcgggacctgatgtcctgaaggagcgcatccgctgccgcgagcagcttttgggctccatgatcggctacgccgagagcacggtctgcctccgtgcccggatgcttcgctatttcggcgagaaggcagacatggccggaaactgcggcggctgctctgtctgcgtgcccacgctcggcgagcttccggcggcacgtccgcatgtcttcggcggtgcggctgaagctgcttcagtctcttccttcgacgaggcgggagacgatgcagaagagatgttccagaggctgcgtgccttgaggaagcgccttgcagacgagcgccatatcgcgccctacatggtcttctccgatgcgacgcttcgtgccatggtccgccgccgtccccagacggaggacgggatgctcgagatatcgggtgtcggccaggccaagctttcccgctatggcgcgtatttcctcaaggaactccaaagctagcggcaacaatctgcagcaaaccgggtaggaaatgtgttattagaggtgacagacaggagcagacgtggcgacaaagccgaagatgaaggtgaaggcacaggtctcgagcacgaagggaagtgctgaagagcaggagcgcatgggctccgtgcgcaagagcgtcgtctttctggctatcgtcgctgtcatctatatggcctaccttgtcctctccgggcagttcggggagttcatggcggccttgggctccatagataagggctgggtcgcggcagcctgtttcgcctatgtcatctactacttcttcggtgtccttgcctatgtccttgctgtcatcaaggacccgaagtgccccttgggcatccgcgacctcatgagcgtcgaggcgtcgggcatcttcttctcgaacttgacgccgaacggcgcaggcggcgcgcctgcccaggtctaccgtctcatgcgggcagggctttctgtcggagcggcaggtgctgtccagtacacccgcttcatcatctacgaggcaggagagggcatcttcgctgccctcatgctcatcttccgggcccagtggttcatggacacctatgccgatgcagcatggctcgtggcgcttctcctcttcggcttcaaggtcatcgaggtcggcgtccttctggccatctgcttcttcccgaaggtcgtgacgaaggtcggcctctggatcatcaagatcgccacgaaccatggatggatgaagaatccggacaagtggcgggagatggcaacggtccaggtggacgagttctcgcgcggcttccgctccgctgccaagaatctgcctgagctcgggctcacgcttctcgtgacgctcctgcagctcagctgtctctatgcgctgccgtggttcgtgctccatgcctttggccaggatccggatcttctgacctgccttacggcaggctccatgctcgagcttctgacctctgcgattcctcttccgggcggtaccggcggcgccgaaggcggctttgccgtgctctttggcggcatgttcggcgacgcgaatgtcgcagcaggctatgtggtgtggcgctcggtcgagtatttcctgcctgtgctcgcggcgatccctcttctctcgcttcgttccgacagggggcagagcatcgcagcgcgctgggcacgcttcaagcgccgtaccggctcagcgaccttgaagctcgcttcgggcggccgctcgaagggcggcatcagcgtgaatccgaagaagatgcagaacaaggacaggaagtagcctcctgcatgccgtctgccgacgcttcggtgcagggcgtccgtttggagcagcgcaacccctatttcctacgcatactgggtatgttgcaagtctattgctgcacgagcagccagccagggaatgcgaggatcatccatgaacatcatcgagcgctttgcgtcgaaccccgaatactcttcgaaggcaccggagaggctgacctttgtggcccagccccgtaccatctatgcgccgcttgcaggcgagatcgtcgaggacgaggtcgagaccatgggcctcttcggcaagggcgtagcccttcatccggcagcagagatcgtctatgcgccgatttccggacgcatccgtgcgacgacggtcacgaaccatgctatcggcatcaccaccgctgacggcatcgatgtcctcatgcacatcggcattggcaccgtatccatgaacggacgcggctttgtccgcttcgtgcaggcgggagacgaggtcaaggcaggagatccgctcatcgccttcgacgaccagcgcatcctcgatgccggctacaaggacaccgtcgtcgttatggtcacgaacgcagacgagctcgggcctgtcacctacgaggtcgtcgctcttgaggacacgggatatatggcccgcgttgccctcgtaatggacaagctgctccgccgcatcggcctttccggccgcctcgatcgtcccccatgctcgggattcggctgcacggtgctgctgtcatggctacacgcacgctgccgtccgagcgtgaccgcaaactcacgattgccttgacgcccttcatgagctgctccacgaagctcacgatctatggtctatttcacggcagccttttcctgggaatggcggcttcgttatccttgccctctaccttgcaggcatcctgatcggcatcctcgcgcgaagattgcgcaacatgccacgcgcgaagggcgaggctgtgccccttcgttatgggagcgcttcagaactacagcatgccctctgccaagtcgagtgcgccagctcccggagaagtcgaaggactttcctgacccgcgccttcacggttgtctttgctgcagccgtgtatcatctgggcgctgcgagaccttcagccgaccttcgatatgggtgagcgatcctgccgaatcgcttactgtgtctgtcgcaaggcgctccaccccgatcttcgcgccgctcggctttgcagactggcgcatcacgaccgcgcttatcgctggcttatggcaaagaagtcgtcgtctcgacgcttccgtcctcttcggcagcctggccgagctcacggctgcgctcacgccgctgcggtagtctccctctcgtctgctcctcctctatacaccctgcgtcggccatctctgccatcaagcgcgagctcggcggcaagtgggcgaccggcatcgtcttcttccagtgtgcggttgcctgggcggctgccttcctcgtcttacgatcgggcatgctcctcggcttcgcgtatgcgcatctgaactgatagcctggagagcaaaaagcccataaaagccggaatgcatacggctttatgggcttatcatgtcttgaggagccttagccagggaagggagcgcatatggcacagaagatggactccgcgagtctcgaagattacccgagggcgctcttcggctggcagacgagacagaacggttcacagcgtggaggtggcacgttcgctcggcgtctcgaagccaagcgtgcatcgtgccgtcggaatcctcgcagagcatgggtatctgacagctgagccgtattcgccaatcgtgcttaccgaggcaggcaaggagcgcggacgggcgctcgagcgccgctaccagacaatctatgacttccttgtgcaggagtcggggtcgatgagaaacggccgccgaaggaaggcgatggcattgagcatgcactctccgacggcagacggaaaaagtggatggagcgcttcgggcagctagaggatgaaggatgcgggaccctgcttgggcaggtcgcgctcgggattgaccttcccgagtctgcatagctgatgatgagagccgccacgggcagatagtaggagcagagggcgccacagcgcccgagcgtgatgtctgcctcgggccagaccttcctgagctcgtctctcatgaactcggctccgcctacattgtccactgggagatgtagcaggggccgcccgaatagcggtgcatctgcatttcgtggatcatcgcacgcgcgccttcttggcgccacgaccttgcgcagcacctcgatctcgccttcgggctgccggtgccgatcacatgcacatcgagcgcattcgcgaagcgcggcaactgccggattcacgcgaccacccttcgcgggttcgagaggtcggcgtatcgaagggacatgcacgtggtgctggtaggcaagagcatgcgcatgagctcctcgaaggggatgggctcctctccgagctcgggaagcacgtgctgcaagaagcgccagatcctctccggcggagcgggatcgacgacggcgatctttgcctctgagtgctctccagatactgggcagctcgcagacgggcggcattgcaggagcctgagagcttgccggtgatcgtgattgcaatgatctcatctgcgccctggaaggcagcaagccacgcatcagggctcgggcaggaggtcgaagccgatccctggttgagcgacatgcggtcgcagaactcggcgagatcgaggccttcctcgtcgacgtaatcggtcccatcgagcgtcacggtcagagggacgctccggagtcacgccgtcgagcgcatacacattgctggaagagtcgcagaagaccctgattccataccaccatccccaatcggtgcgcacactgtttcaggaccattctaggtcaaggcaagacgaggtcaatgaatatggacaaagaccagctgtcttgaagagaccttgaagccttacgagaagctctcgacgagggcttcatattccttcgcctctgctgcctcgacgtcgttcgtctgtccctcatcgagatgggcgaggcgcgcatggtcgagtcgtgagggcggtggcaatagaggcaagcaccggagctgcaggagccaagatctcgatgtccgggtcgcgctctgagtctgcactctgatctgcatccttgtccttgccggtgcccgtgcgacgaagccacggctcttcaagtgccccagggcgcgtgctgcctggctctgcgtcacgccggcataggtgcgatctccttcatgggaccgcaggtgccgcagtccctgagatagagcaggaccttcatatcggccagctccagatcatgggcagaccctgcgacatcgaggtagcggtcgaggagcttggcagaaagatagaggagcccgagcgggtttgcctgcatatcgggatcgagctgtgcggtcacgcatcgcgtccgagctttgtgctcagaggtccgggcaggacgcccgccgtctgaggccgagtcgatatagaagcggtagatgtccggacggcgtgcggcatagtcgtcctcgtccatgatctccttgtagaagttcttgtagtactcgatcacgttgatcttcatgcggatggtatttgcaagcgagacaccctggtcgcaagagagcccctcgtcttctcgtagtagtagatcggcacctgcaggggatagatcctggcagttggagcacatactccatatgaagatgaagtcctcgcaccagctgatcgagggatccatgcggatgtggtggctctcgatgatcgagcgcttgtagagcttgttccagacgacgccccagtagaaatcggagggagactccatcatgaggtcggcgtactgctcgcgcgtgatcacgtcctcggagtcgatgtcgctttccttgccacgggctgccgatgacacgatagaagtctgcgatgaccatgtcgcagctgttctcctcgatgccacggaccagaagcttcgtcgatcgggcgtgatccagtcgtcggagtcgaggaactggatatggtgccctgggctgatccatggcacagttgcgggtgctcgagacgccggagttcggcttgtggatgacatgcaccggggtcgcgcttcgcataggcatcgcagatggagcccgaggagtcggtcgatccatcgtctgcgaggatgagctcgatatcggtgaattcctggccgaggatcgagtcgacgcagcgctcgagcttcttctcggcgttgtagacgggcactataatgcttaccttggttccatgggactccttcacataggttccttcaattctatacatcgaggcagaaaggttttgcggggtgcaggaaagaccgcagatggaagaagcacagcaggcgcttgcagagcatttcggctatcagagcttccgccctggccaggaagagctcatagagcgatcctggagggagagatgccgtagggatcatgccgacaggggcaggaaagtcgctctgctaccagattcctgcagggtgctttcaggcctcacgattgtgtctcgcctctgatctcgctcatgggggaccaggtgcgctcgctcaaggaggcaggcatccgtggctcctatctaacagctcgctcactccgggacagcagcgcgtcgtgctcgcgcgtgctcggcggtggtatgacctcatgtacgtggcgcccgagcgcctccaggaccctgcgtttgtcgcctttgcacatgagcacagattccgctccttgcggtcgtgaggcgcactgcataaggagtgggggcaggacttccgtccggcctatctgggcatccgggagtttgccgaagcgctgccgaagcgtccggtcgtggctgccttcacggcgactgcgacccgcacggtcgagcgtgactcaagagccgttgggccttcaggacccgtctcggtgcatacggacttcgaccggccgaacctttccttcatcgtcaagaagctcgcgccgaaggagcgcctgcgctatatcgagcgctatctggctgcgcaccgcgatacctcaggcatcgtctactgcaggacgaggaagcgcaccgaagaggtcgcagcagcggttctcgaagaaggcttccgtgctgccacctaccacgccggtatggaggcggacgagcgcacccgcgcacaggaggcctttgtccaggacaatgtctctgtcatcgtcgcgacgaatgccttcggcatgggcatcgacaagtccgacgtccgctttgtcatcatgacggcctgccgctcacgctcgaggaatactaccaggaggcaggacgtgccggcagggatggagagcccgccgagtgcatcctgctttggagcgacggcgatatccgccttgcgccttcctgatcgaccgcaccgaggtgccggaagggtcgggacctgatgtcctgaaggagcgcatccgctgccgcgagcagcttttgggctccatgatcggctacgccgagagcacggtctgcctccgtgcccggatgcttcgctatttcggcgagaaggcagacatggccggaaacggcggcggctgctctgtctgcgtgcccacgctcggcgagttccggcggcacgtccgcctgtcttcggcggtgcggtgaagctgcttcagttcttccttcgacgaggcgggagacgatgcagaagagatgttccagaggctgcgtgcttgaggaagcgcttgcagacgagcgccatatcgcgccctacatggtctttccgatgcgacgcttcgttccatggtccgccgccgtccccagacggaggacgggatgctcgagataatcgggtgtcggccaggccaagctttcccgctatggcgcgtacctcaaggaactccaaagctagcggcaacaatctgcagcaaacgcggtaggaaatgtgttattagaggtgacagacaggagcagacgtggcgacaaagccgaagatgaaggtgaaggcacaggtccgagcacgaagggaagtgctgaagagcaggagcgcatgggctccgtgcgcaagagcgtcgtctttctggctatcgtcgctgtcatctatatggcctaacttgtcctctccgggcagtggggagttcatggcggccttgggctccatagataagggtgggtcgcggcagcctgtttcgcctatgtcatctactacttcttcggtgtccttgcctatgtccttgctgtcatcaaggacccgaagtgccccttgggcatccggacctcatgagcgtcgaggcgtcgggcatcttcttctcgaacttgacgccgaacggcgcagggcgcgcctgcccaggaccgtctcatgcgggcagggctttctgtcggagcggcaggtgtgtccagtacaacccgcttcatcattacgaggcaggagagggcatcttcgctgccctcatgctcatcttccgggcccagtggttatggacacatatgccgatgcagcatggctcgtggcgcttctcctcttggcttcaaggtcatcgaggtcggcgtccttctggccatctgcttcttcccgaaggtcgtgacgaaggtcggcctctggatcatcaagatcgccacgaaccatggatggatgaagaatccggacaagtgggggagatggcaacggtccaggtggggacggttctcgcgcggcttccgccgctgccaagaatctgcctgagctcgggctcacgcttctcgtgacgctctgcagctcagctgtctctatgcgctgccgtggttgtgctccatgcctttggccaggatccggatcttctgacctgccttacggcaggctccatgctcgagcttctgacctctgcgattcctcttccgggcggtaccggcggcgccgaaggcggctttgccgtgctctttggcggcatgttcggcgacgcgaatgtcgcagcaggctagtggtgtgggcgtcggtcgagtatttcctgctgtgctgcggcgatccctcttctctcgcttcgttccgacagggggcagagcatcgcagcgcgctgggcacgcttcaagcgccgtaccggctcagcgaccttgaagctcgcttcgggcgggcgctcgaagggcggcatcagcgtgaatccgaagaagatgcagaacaaggacaggaagtagccctgcatgccgtctgccgacgcttcggtgcagggcgtccgtttgagcagcgcaacccctatttcctacgcatactgggtatgttgcaagtctattgctgcacgagcagccagccagggaatgcgaggatcatccatgaacatcatcgagcgctttgcgtcgaaccccgaatactcttcgaaggcaccggagaggctgacctgtggcccagcccgtacatctatgcgccgctgcaggcgagatcgtcgaggacgaggtcgagaccatgggcctccggcaagggcgtagcccttcatccggcagccgagatcgtctatgcgccgatttccggacgcattgcgacgaggtcacgaaccatgctatcggcatcaccaccgctgacggcatcgagtcctcatgcacatcggcatggcaccgtatccatgaacggacgcggctttgtccgcttcgtgcaggcgggagacgaggtcaaggcaggagatccgctcatcgccttcgacgaccagcgcatcctcgatgccggctacaaggacaccgtcgtcgttatggtcacgaacgcagacgagctcgggcctgtcacctacgaggtcgacgagtccgtgaagctcggctcgcaccccgtcgtgaagcgggcgagctcctgatgagggtcgccgagaagtaggccagcggcgcttctttggaatgagcagcgaagacggcaggaaggcgcagaccgcggcgccttccggcttgccggctacggtgaagcctatggctccgagtgcaggataacgaacttggcaggtgtcggcttgagccaggagcgcttgcctccctgagctcgcggtcggtctccgaccctctctgtcttcctctgcctcttttccttggacgtgtgggacgcggcattttgcctgccagtcgcccctcttcatcgccgtagtccccagaatgtcttgccgttgccacctctatgctttgagcggctttgtgcgcggctttccgtaccagggattgcgcagcagttcgtggaaggtgaaagcgcagtctgcctctgaagcagctgtcgtctctggtgccttgccgctgaaataggtggacgcactcttcaagcgtgaggccttccaggagtcggttgccgggtccataggcgccatgcgcctctgagaactcatgggcaaggtcgagcgtctttgcctgaggcagcgtgatgcctgatttcttcaggaaggcaggaacatcctttccgtagaagacgatgagctgggcagaggagagaatctcctctatctcgggagcctgctcgcgcggggtcttcctgccctcgaccatggcggggagatgcgggtcctcgtctctgccctgcttccagctcttgcgcctctcgggggcacaagctcgtcgaagaggatctctccggtgccgtctgcaacggcgagggcaagcgcttatctccggctttgcgttgggtccggtcgtcaggcaccctatggctgcgatggctgccggtgcatacgatttgagcctcttctttctccccaagctcttgccttcctgagatggttgcagattgattctggcacaagccgcccttcgtgcgtattcgtcctgccagatgccgccagcctgttaacaataggggaaagacctgaaactatctcatagccttggatacaattctatactgtccatcgaaggaggggctcatgggatacagcgacgaagatgctcagaaccgcgccatatcacgtgctcggcagcgaccgatccggcattgttgcagccgtgacgggagtgacgcacctcggacgcaagcacgatgccaatatcctcgatacacagagcggaggaccgcctgcaggaggatcgtcacgagaggggagcgctgtggaacgagttgacaccactggcgacgttccttcaagcgccactcggcagagctgcagacttgcagaaccgatcatcaccgcaagtgtccttagtatgcatcgtggcgaaacggcctcgggcatatgccgctggaccctcagtcgtgcttgcttataagcacagagcgaccctcacgcgcaggtgtggatcgagttctggaaggtcctgattccgagcgctacgaacgtcggtgcagtccagatgatctgaagtactcaggaatctaatagagtttggagctggtccaactccgcacggaaaaatgacggatggttcgtgccgcacgtgtgaggcgggttctgagcatcttcgtcgatgtatcccatgagccctccttcgatggacatatgaagaattgtaatccaaggctatgagataggttcaggtcttttcctagtgttaacagtggcgcattgtgcaggcacacgaatacccacgaaggtgcggctggtgccagaatcaatctgcaaccatctcaggaagcagagagctatggggagaaaagaagggctcaaatcgtatgcaccggcagccatcgcagtcgtcatagggttgcctgacgaccggaccccaagcaaaggccaggagatgaagcgccttgcctcgccgtgcagacggcaccggagtagatcctcattcgacgagctctgtgcgcccgaagaggcgcaaggctggaagcagggcagagacgaggacccgcatctccccgccatgggtcgagggcaggaaaacccgcgcggagcaggtcccgagatagaggaggattctctcctctgccacctcatcgtcttctacggaaaggatgttccgtccttcctgaagaaatcaggcatcacgctgcctcaggcaaacgctcgaccttgccctatgattctcagaggcgcatgcggcctaggaccccggcaaccggactcctggaaggcctgcacgctgaagaggtgcgtccacctatttccagcggcaaggcaccagagacggacagcgcaattcagggcagatgggcggctttcaccttccacgaatgctgcgcacaaccctggtacggaaagccgcgcacacaaggcaccgcttccaagagcatagaggtggcaacaggcaagaccattctggggcatacggcgatgaagagggggcgactggcaggtcaaagatgccgccgtcccacacgtccaaggaaaaaaagagggcagagggaagccagagaggagtcggagacgacgcgaggctcagggaggcagagcgctccttggctcaagccgaccacctgccaagttcgtaattcctgcactcggagccatcggctgcacccgtagccggcaagccggaggcgacgcggtgtatgacgcctcctggcctgtcttcctgctcattccaaaagaagcgccgctggcctacttctcggcgaccatcataggagctcgcccggcttcacgacggggtgcgagccgagcttcaccg

SEQ ID NO: 73 - DNA, 62310 bp, Unknown
  Metagenome-assembled genome
cttctcttgtgagctggaggagctccagtatagactgaatggggacaagcaccgaaacgaaggaggtctccgtgctcttttctcatatctcccgcccaagcagatgcagctgagacaacggattctcgctcggctccaggagccgcgcttccctgtccgaggcagaggagcttgccggcgctctctgctctctgggaagcaggcgcccagaagggtgtggcgcacgagcgcacgcttacgggcgtgccttgggagatcacgggcacctgccggaagaagcttagcttacggcgtgcgcacccctgctgctcatggcatatgctgcatcagtaccgctctggcgccttctgtcatacagagaaggacgtcctgtggctcgacctgcatctccggattcttcggggcctctatgggggtggcaccgatgacggatcgtcccgtaaggctcgagatgggatcgactcgctgtgggcaggagggccgaggatctctacagcttctggggaggaagtatgcagcatctcttgctagggagccgaggagggagaccttgtgcgtgcgcctcgtctcgaactgatatggcggcggccgtgctcctccgcatgtgccggaggggagtggctgtcctctctgcgcgagtttcatggcacccacggaagcgggatggcaagctcgccgaggcagcgcctgaggtcagggccgcgcgggctgcttcgtgcgctggtgttcgcgaagaaggcatagagattcgtcagagctcgtgcctttgccgaggcgtggctaccgcttcgcgcctacttcttgtcctggagggcatctcgtctttgtccggggcggcctcggacctcaatagtccatatccgcgtcgagtcctgcctgccgatgccgaaagcgatgctgctgctgcgagcccagagggtctgcgtggtggcctcgaggcagctcttcgagtgcggcgtcgatcttttcgcggagaggccggccaggtatgccctgccccatgggggatgtcctggggcatcctgcctggggcctctctcggtgcagggctcgctagcttcgttcttctcaaggtcgagcttgtgcagaacgaggagaagccgagcgagcgtgtccatgtcctcggcgcccttcagcgaggcgccgagcggcctggcggatgtcagccgatccgaacgtgaggatcgtgcccgaggtcgcgagagcggaggatgctcttgacggcatgggcgtgccgtgcgcacgggctaagtgtttatctcgagtccatggccgccctcgatcgtcttctcgaggatggcagccacgatatcctctgtgctctcgaacggaagcggccttcgcctgagtagcgtgatagcggatgaggtcgaggtgcgcaggcacggaccaggaatcgaaatgctcgatgcagccgagcacggcctcatagtagccgcgcgtgaattcgagctgcgtcttccttcctgatactcgttcgtccagaactcgaggttgccgtctcatgcacggagagaaggaccatatcgaggtggtcctgccactcgccgaagagcttctcataggcagggatggtctctttctggatgccgaactcgaggccacgacaccgcaccagagcaccttgccatagcgctcgcgcatctcttcgagctctgcgaagtaggcggataggcacagttcgtgagggggcgtccgttctcgaagcgggcaccttctggtggtcccagcagtccttcacgccgtagtcgacccgctctgtgaggcatatgccatcgaggttgagcctgaggcatcgatcgtggcctgcccatcggatagcggactcgggagagtagctggagggactggcagtcttggagcatggaggcccttttcggtctggaaagctgcatgagcatggcgcaggaagagggacagttttctgaggattcctgaaggggagctgtcgattccgtgaagtgcctatagagaagctggaaagtggctgcaggttttctggaggcatgagggcctccccgaatggggtacgacctcaatctacgagactcagaaggaggatcatgcatcttttcaagaagaatgggaaagacccgaagacatctgcgaagggctggcgtcctctggtcctggcagcgcttgccggtgcagtccttgctatcgtgcttttggcagcgttctcgaatttccagacagcgcagccgtcatctgccgcctcgacgacatcaagaattcgctctcggacatctcggagctctccacgaagagtacagcttcgcgaatgtcggcaagtataccgaagacgacctcaaggtcctcggcatctcgattccattcacggcagctcctttgtcgcaacctacgaaggcaccgtgaaggcagcatctctgatatcgaggcagccgatgtcgcggtcgacgacagcacgaagaccgtgaccgtgacgcttccggatgtcgagatcctgagctgctcgatcgatccctcgacgatcgaggcctacgaccagacgttcaatccgatcaaccagattcaggtctcggatgtctcgagcttcctctcgtctgaagaggacaaggaggaagcggaggccaagacgaacggcacgctcgacaaggcacgtgcgcatgcagaggagatcgtgaaatctgtcgtctcctcgatcctttcgggcacaagccgcgatggctatgcggtcaaggtgtcctggaccacgtccggaaccgatacttcagcggatgctgcataaggaggccttggaggcatgatgcttgaggagcagggtgcgtcacgccgcctctttctggcgctgcgcttcgcagatgcggaaagagacgagcttgaaggaatagcctgtgccgctgctgcaaggatgaggcgcggcacgcctgcactcagagagaacctccatctgacgcttgccttcctcggcatgtgcgatgccaggaccgaggaggcggcaaggcttgcaggggcggcagctgcagaggcagcgggaccagtttcagagaccctcggagaccttggctccttcacgcaccggcgctcttctgtgatatggcgaggagtggctgaggagtcggggcttcgggaactgcaggccagaatcgccgcagagctcaaggagcaggacgttcccttcgacgacaggccgtttgtgccccacgtgacgcttgttcgcggagcggcagcgcagcaaggcgaggatatcgataagattcttgcagacctgtcggagaagctccatcctctctatgcacaccatgcagaggtcgcgctcacgtggagccaccatccggaggggtcgcctttgatctatacgccggttgcccgcttccctctgcttgcgtaggttttctggacgcagggtccgtatgcgggcaagggtctaggatatgagagggcgcaatggttccatgcctgcgctctggtctgcctgcccggcagacgaaacgaggaggaatgactcatgatttgccctcactgcggatccgtgataccggacaacagtacgttctgtgcgcagtgcggagcacgccttgctgagcctcagcaggatggcgctcctgcagctgagccggccaaggcacaggctccgggtaccgaggcaaatgcgcgcgcagcagagattgcggggagcgtgcctcctgtcgatgctcctgccggtacggcagagcctgccgctggtgcaggagagacccagctcatgcctgagggggcagctggcgcatcttcttcacccagcccagagcaggtgcccgagatagacaagaccatggtgcgccccggtgcgttcgctgcgcacagagactctgccgcagccgaaaaggagctggcccagcttccccgcatcgacgagcctcctgctgacatgcctcctgccatccctatcgagggaacgcctgtcgcagagccggaaccggacatctccgatttcctgccgaagcagcctgcggtgtctgaggtccccgaggcttccgatatgccggaggttcctggtgtacccgaggtgccggcagcgccggagcgtaccgagcagaggatgcctgagccggagcgcatcgtgcagagcaatgctcctgcagcggcgcatcctgagccgttccagacattctctccatctgctggtgcaacgccgcttctcaaggtgcccgtgaattcgcatgacacgtccgactaccgcaacagcgtgaagcgccgccgccatgcccgtgccgaagcccagcagtcgcatccgttcgctcagacggtctctcgctccgtgtatgaatcccgcatgcaggatgagagctatacggaggcagtgagcgaggcctccggcgcagcgtctcagcgcagctcttcggccttcaggccggaggaggggcagagcttggaagagcatgcccgccgtgcggagagcgcgctttcgggtggcgtctatgtcgcagagcgccgccgctccaagggtcccatcattgtcgctatctgcctcatctgcgccgtcgcggctgcaggctatctgatctatcagaacatgcaggcagctgagaccaccgccgatacagagacgaccgaggccgctgcgaccgatacggaagccgctgcacccgagccggcagtgacatctccggtcacagcatccgacgaggtctcctacaactccgatacggggcttctgacgatggagaactacggcttctccgtgacgcttccgaccggcatgaccgcggctgtctcctctgacggctatggcctcgatctcacggatgagacggacggtgtccagatcaatgcctgggtgaagcccaatacgcagggtgcaaccctggaccagctctcggatgaggccatggacgtgacgaacctcacatatgcctacgtctcgaccctgaacaactggttcgtcgtgagctactggaagggatcggaaggctactacatccgcgagtatgtcgactcagagcgcatccttgcactcgagttcacgtggcagaaggcaagcgagacggcagccactgaggtcatcgacagcatgacagacacgatctccatggcgggggagaagtaggcacaggtctccagaaaagccattcggaagggctctcttcgcaggaagggagcccttcttctgtcacgagaagtcgaggagccaggcatcggggcagaggcgcaggagatctcggtcgagcgagacccaggacgcagcctcgtctatcacatgggaatcgttcgaggctgcgcaccgagctttgccaagcgttctgtcgcaggtacggtcaagcgtgatggagaccggataggggagattcttgagtttctcctcataaagccctgcgagctttcctgagttcgagactggctcatcgaggaggatgtgcgcttcggcaagaggtgctgcagcgagtgcctgcgcgacgagcgagagggcctgctctgttgcaggaatcgggcgccaggtgcccgagaggccggcaaggtctctgacagagccatcttctgccaggatcgcaggtcctcctgtgagggcgacttcgagagggatcagcacattgaagccatcgatgaggagcactgcgtctgcgcagtcagaaagcgcgcggagcttcttctggcgtgcttcagcggcacgcttccctgcagtcgcacgcaggagagcaaggcgctggcgctcctggaactggtagcggttgccgacgaaggcggcagcggtgtctctcggatagccatgatcgagaagatagccgagctcctcatgtgccttcctgaggcgtctgacattctcaggcgagaaggtccttctgtccttcgggtcgtatccgcggtgtgttcccatgagctgcgcctcctgcaagaagcataagtcttgctcctgcgggcaggcgagggaagattggaggacctgagcgctacgatagtgtccagtcgattccaggaggctgccatgggcgcacatatcttcatccttgcatccgattcctacaagggctctgccacaagccaggaggtcgagagctctatcgcagaaggcatccggtcgcttctgccggatgccacaatctattcctatccggtagccgatggcggggaagggacggttgcagcgctggtgacggcaggaaaggggacgctccgtacaaggcccgtgcatggtcctctcggggatatggcagaggcatcctatgccgtgctcgaagacggctctgccctcatcgaatgtgcggccgcttccggcatcacgctcacacatcagacagaagatgaagcgcttcgtgcctccacgtacggcacaggcgagctcatccgggatgcgctcgacgagggatgccggcatatccttgtcggcctcggagggagtgccacgaccgacgggggagcgggcatggctgaggccctcggggtgcgcttcctcgacagtgcaggccagtccataggttccggcattgcagggctcgaagaacttgcggaggtggacctttccgggatagatccgcgtcttgccgcctgcacgttcgaggcgctctccgatgtgcagaatcctcttgccggaccggatggcgccgtcttcgtctacgggccgcagaagggccttcctgccgcacgcctctccgagcttgaccggacactcgagcgctatggggagcttgtcagcaaggcagtaggcagtgacatatcctgtcttcctggtgcgggggcagcaggcggtctcggcgctggccttgccgccttctgcgcagcgaagatcaggtcgggaatcgatgccgtgctcgatgcactctccttcgacgagcacctcggcgaagccgatctcgtcgtcaccggcgaagggcgcatggatgcacagaccgccaagggcaaggctcctgtcggcattgcccggcgtgctgcgcgctacggcgtgccggtggctgccatcgtcggctcctgcgcagatgatatcgaggcggtgcatgaggctggcatcgatatcgtgctttcctgcgtgatggcgccatcgaccctcgaagaatgcatcgagaagacaccggatgctctgagtcgtgccggaaggaggcttgcccgcatcgtagcccttgcggagcgcctccgctaggagctgactccttctttgcatcttgaagaaggttctgcctgatggaaatccctgcttctatactccacagcatatggcaggcaaggaggcaggcatgttttccatcgacaaggatgtcttcgatgtgctgccgacgctctgcgtcggcctcgtcgtagtccatagcatcgacaatacgaaagactatccggcagtcgacggcgtgctcgacaaagcggtggatgaagcacgagagcgtctttctggcatgaatgcatcagaagacccgagagtccagccctatcgggaggccttccatgccctcggtatgagtccctcgcgctatccttcatcgaacattgcgctgctgcgccgcatcgtgaagggcaaggcgctctggcgcgtgaatcctgtcgtcgacctcggcaatgccatctcgatcggctatggggtgccgttgggcgcccatgcgctcgagacgcctgacgagcatctcgagcttcgcttctcgcgtccggatgatgtcttcatcgcgctcggagaggatgcgcccgatccgacgctcgagccaggcgagctcgtctacgctgtcggcaacctcgtgcacacgaggcgctggacctggcggcagagcgagaacggaaagatcgtgcccgagacgacctctgtcgccttcccgatagatggcttcgcggacaggaatctcgaccaggttgagtgcgcctgcggagacctcaagaaggagctcgaagacatcttcggctgcacggcgacgtttgcgctcgcagaagccgagcatccaatcgttgcgtaagcgagaaggaaggcgcgcgtccacaaggacccgcgccctcctggctgatatatatatgcactcttagtggcagcagtggccacccgcgccgcagtggccgccttcatgatgatgggcaccgcaggtcggtgccgccgaaggcgtgagcgtgcctgcgaggaaggccttgacggcctcatctgcagagcctgaagcgcccggcacgacgcggatgccctgcgaagcaagtgccgcgagcgcgcctccgccgatgccgccgcagatcagtacatcgacgccgccctgcgcaagaaggccagcaagcgcgccgtggctcacaccgttcgagctgacgacctcggagcgcttcacctcgccgtcctcgatatcgtagagcttgaactgttcggcccttccgaagtgggggaagatctctccgccggaataggttgcagcgatacgcatgatgtttccttccttccctgtccaggaggcttctggctcgccttcgaagtcggcagcgccgcggacgacttcgatcgtcttgccgttcacgagggcatctgccaccttccggtgtgccgaagcggcaatgctcgcgatggtcgcacgcgagacgccgagcgaggcagctgtttccttctggcttctgccttcgtagtcgaggattctcaggacttcgagctcatctgctgcaagctcgattctccagcagcagcctgcgggcactcctacgggtgcgaatcccgtatattcgggtacgagctgtacctgcctgcgcttttctggccttcctgccatgaagcctccaattactgacatatgtcagtaattactatagcgagcagatgggagcgtgcaaggaagagatcggggaagtagaagatgaatggtactcctttattaatgataaacagtatcaatatgaaggaactgtgaagaagaaactaagaacaaatctcattaataaaaactgtttggtgggtatattgtcactaacaaaaacaagtcccagcaaaggaaaggaactgatatggcaaccaccaagaacatcgacgctctcaaccagctcctcgcagatcttacggtcgactaccacaagctccagaatgcccactggtacatcacgggcaaggatttcttccaggtgcacgcaacgctcgaagagctctatgacggcgtgctcccgcacatcgacgaggtagcagagctcatcctccaggaaggcggacgtcctgttgcctccctcaaggagacccttgcgctttcgaaggtcgaagagcgtccctccgaaccgctatcgagcgaggaagccttctcgctcgtgaaggctgacttcgagcttctccagagcgatgctgccaccgtgaagtcgctcgcagatgagtccggacgcacggtcgtgagcgccgctatggacgatatcctggccgagctctcgaagaatctctggatgctccgccagcaggcgcaggagatctagaccatccccagggccttttggggaaggaggcccgcataccttcatcggagggaggaagcaggtgcgcttcctccctcttcttctgtctcggcaagaagcctctcgaggaaggcacgccaatcctctctgagccaggacggtcctgcaatcttcaccatgccgcccatgccggctatccagccgaagaactggtctgattcgaagaccttcacatgggccaggacccagccatctcctgccggctcgaatgtggccgatgtcccgaagcggtcgcgcactatctcggtcttgccatcacgtacggcaagcaaggcgtctgccttccttcccttgaagcgtccgaatgcctcataggcactttctgcatagtgccaggaggctatcgtctcgttctcatctgcaggggcatcctcgatccgtacggggcccatgcggtcgcatctgaactctgcgatatcctgccgtgcttcctcccaggcgctcagatagtagaagccctcgtcgtagacgatatcgagcggcgtcacgacatagcgcttgccgttgtggacagctctcggtgtgcctgtcgcatcgaggtggaaatagggaaacgagatctgccgcctctctctcagcgcttcatggatctggtcgatgtttccaaagacgctcctgttctgcgacttgatgcgtcccacgacgtggatccgtctgtcgagcttctcctgctcatagctgtttgcaagcgtcttgatgcttgcaacgaggtttctggcctgccgctctgtgatggcacggcaggattcgattgcatcgaccatgagcatgagctcgccgagcgtgaagtcgggatgtgccagagcgtagcgcggaggatgcgtgccataggtctcgattgcgatatcgaaatcgcggagtgcctggatgtcgcgatagatgctcttgcgctctgcctctatgccatacgccttgagcttctcgatgagctctgccatcgtgagtccatgctcagggtcggtctcctcctggaagatcttccagagatagaggatcttgagcttctcgtttccggtcttggccacgtgccctcctttgctgttcggaccccatgataggctcggcgagccccataacctccatctgtcccataaacggtactgtcccataactgggacagataaaggaaggacgatggataccataagctttgagaacggaagctgaaaggggcagatatggcagaggattcaaggcatcttgcagacttcttcgtggctggcatgcgctattgggatggcgctctcgtcgtctccgacctgaagccgggaaagaagctccgccttatggcagagcccgacaatgcctacgaccacaacgccgtggcaatctggcgcaagaagacgaagctcggctatatcccggctgacgagaatgcgctcgcagcccagctcctgcgcttcgggcacggcgatgttatcgagtgccgagtgctttcggtcgacccgaccgcagatccctggaagcaggtcagggcaggactcttcatcaccgacgcacgcaaggatgcgcagacgcaagaatagcgtccgcggagaggaaggagcagctatggagaaggatgaagacaaggcgccagcgcccgtacagcctgaggagggaaagcctgagaagaagcatgggaggggacgcgtcgtcctcattgccgcaatcgtcctcgtcgtcctcatcgttcttgtcggtgccttcggcggcagcaagaagaaatcggacgagcccttcgatccgagcacctatgagagcatggactacgcggcagtcgcgcagaatcccgactcctacaaggacaagaagctctatgcgaagggtaaggtcgtgcaggtcatcgaaggcgactctgagacggatctgcgcgtcgcgactgccacggacggctacgacgatatcgtcttcgttgcctacgatcccgatatccttgacggtgcgcatctgacggaggggcagtatatcggcgtctatgggcactgcaagggccaggtgagctatacatctacgctcggtgcaaagatttcgattccgggactcgatgccgactccatcgaccagaccgtcaagagccctcaggaagtccagatcgaagccatgcaggcaatgcttgacggagcagacttcgagaaggtcgacacatcgggatacggcacctgggggtacgttgcaaagatccagaacacgacggagaacgactacagcaatgtctctcttgtcctcggcatctacgatgcatcgggcatgcgcatcggcgagacctatgccaatgcgacaagctgggctccgggagagaccgtccagttcgaaggctatctcgacagcacgaaggccgatgcggccgtctctgtgaagcccgagattcagagcttctcgatcgggtcggactattattcgccaagccagctctcgtaagcgagcttgcttataggaagggaagaggaggaggccttcgggtctcctctctcttgcgtggagcggcaaggctcaggatttccttgccttatgtgcgacatagcaggcaagcgcgaagaaaccggccgtcacgatggggaggataacctgccagaaggcggcaaaggcacccccgacccaaatggcaagacacttcacggcgagcatgaggccgaggacgcaggcggcgtagaggctgtattcctggaacgagatgtctcccatcatggcctcccggacaagaagcggattgcagcctatgctaggcagctccgataagcgcagagaaagccatctgtcagccatctgttacggagattcgaacagggcgctgaggactctgcacaaaagctgaaggaaaaagcgggcgaaccgtaatatggccgaaacagaatctctgtatgctcgtcttatcgtccacaggaaggatgcagttcatgttcgcagccaccgacaatgcagctctgagcgctcagcgcgtgctgggtgcatggtggcgtacaaggacttcgaaacttccggcgtgacgacggccttgtcttcatacacatctggggctctcggttacgtaccgggagccccttttttgtatgcagacgcacagcattccctgaagagaaagaggagcaagatgggcgcagaagcagcaaagaccgatccttaccgcatctatctgaaggaagaccagattccgaccgcctggtacaacctgcgtgccgatatgccggaactgcccgagccgatgaggctgccaaatggcaaggtcgcgacggtcgacgatatcaagccagtctttgcagacgagctctgccgccaggaactcgatgacacgacgcgctacttcgagattcccgctcctgtcatggagatgtacaaggtctaccggccgagtccgctctgtcgtgcctacaacctcgagcgcgcgctcgacaccccggcgaagatctattacaagttcgaaggcaacaacacgtccggctcgcacaagctgaactccgcccttgcccaggcctactatgcctatgcccagggcatcacgaacatcacgaccgagaccggcgctggccagtggggcacggcgctctccgaggcagcagcgcacttcggcctcaacctcgacgtgttcatggtgaagtgctcgtatgagcagaagcccttccgccgttctgtcatgcagacgttcggcgcgacaatcacgccgtcgccgtccgatacgaccgaggcaggcaggaagatccttgccgccgatccgacgtgcacgggatctctcggcaccgccatctccgaggcggtcgagcatgcgctcaacgtgccgggcaacaagggacgctaccagctcggcagcgtgctcaaccaggtcgtgctccatcagtcgatcatcggcctcgagtcctatgaggcgctccgtgagctcggcgaatatcctgacattgttatcggctgctgcggtggcggctcgaacttcggtggcctcatcgcccccttcatgcgcgacaagctgacaggcgtgcatcctgatacacgcttcatcggtgtcgagccggcaagctgcccgtcgcttacccgcggcgtctatgcctatgactacgctgatgcgggccagacctgcccgctctgcaagatgtatacgctcggcaatggcttcatcccgagccctgaccatgcaggtggcctgcgctatcacggcatgagcccgatcgtctcgaagctcaagcacgatggctatatggaggctgtcgccgtgaagcagactgatgtcttcgccgcagcagagaagtttgcaaagcttgagacgattctgccggcaccggagagctcgcacgcaatccttcaggccatccgcgaggcagaagcctgccgagagacgggcgaggcgaagacgatcctcttcggactcactggcaccggctacttcgatatggtcgcttatgacaggtacaacaagggcgagctcgaggaccatatcccgacggacgaagagctgcaggctggcttcgatacgattccccatattcagggcatccagtagaaggaagcatctgccgctggcaggtctgagataacaagacagagacaatgtgtgcgattgtgctcatgtccagtcgcatttcgggtaagctcctccctaaaagaccttctggcctacgggaggagctcatatcatggctgatttgaaacggacggctctggtgtctgccggagcagcagtggcaggcgtggcatctttggcgtcggtgaagacggcacttctcaagcctgccaggcccaaaggtgctccgatcggagcggatggctatgaggcagggatggatgcggtcgagcgcttccaggagctcctccggattcctacggtctcgagagacaatgtctcggtgcgcgacgatgaggcattcaggcgctggatcccgacgctcgagcggctctatccgaagacgcttgcggcaacggagcttcatcgcatcgatgatttcggcatcctcctccgctggccaggacgcgatgcttccctcgatcctgtcatcgttatggcgcaccaggatgttgtgcccacagaagggcaggcctggacgcatgatccctttgcggcagagatctccgacggcgaaatctggggcaggggaacgctcgatacgaagtgcatcgactgtgctctcttcgaagcgatggaatatctgatcggtgagggctatgtgccgccacgcgatgtatggttcttctcttcggacggcgaggagatcaatgcgccgacctcgaagcatgcggttgcctggctcaaggagcacaacgtcacgccctatatggtgctcgatgagggaggggcgcttgcaacagatgcaggcctgggcgtcacgaccccgattgctatggtcggcgtctccgagaaggggcatgtcgacctgctggtgaaggcgtatgccgaaggcggccatgcctcgacgccgggcagaaacgatgcggcggcactgctctcccgtgtcgtttcgcgcatcgtggacaacccgcccgaaccgcacctgattcctgtcgtggcacgcacgctctcagagattggcgcctgggcaggagggccgtatccggccgtgtttgcaaacctctgggcgacgaagcctcttgtcgagcagctcatgagcaagagcccggagacggccgcaatgcttcggaccacgtatgccgtgacgcagctcaaggggtcggcagcgcacaacgtgctgccggctgttgccgaagcgaacctcaatgtgcgtgtcgctccgtttgagacgatctccgatgcactcgagcgcgcacgcatgcttgcagcagcagaatgcaaggcatcgggtgtgccgcccacgagggtcgaggtctcgatccgtgaggagtgcccctacggagagccggctcccatcagcccctgggagcatgagcgcgccttcgactatatccatcgctgtgtggcaggcgtctatcccgaagcgggctttgcgccctacgtgcagaactcctcgaccgattcgctccagttctgtgccatctgcaagcgggtctaccgctttgccggcttcatctattcgaaggaagcccgctccctcattcatgcggcgaatgagcgcatcggcgtcgatgtgttcagacgcggcattggcttctatgtggcgtttctgggacgcctcgaggagctggcatagagcaagaagatatccattggcaggaggtttgcatgagcgggaaggatatgcgcaagaaggcagcgaagatcgactacgcgacggttgcattcgcgagcctgccattcatggggatgatcagcttctggcaggtctttgacggcatcattccgaagatgctcacgcagaccttcggcctctcgaatgccgtgactggattcgtgatggcaatagacaacatcttcgggctattccttctgccgctcttcggcatcctctcggacgctgcacctcgaagctcgggcgccgcacgcccttcatcattgcaggctcgttcctggccgttatcggaacgccgctcatcgcaattgcgaacaatgtcggcagcctggcccttctgatctctgccatcatcctgacgcttgtcgcgatctgcatgtataggaccatgaccgtggcaatcgtggcagatatcacgccgcgtcccctgcgcatgaagaccgactctgtcaagaagcttgtcggctatgccggtaacggtgtcatgcttgtctgcatctcggccatggtgccgaagacagagcatcctgactatctgccgctcttcctcgtgcaggcaggaatgatcctggcctcgcttcttctctatcttgccaaagtcagggagccgaagctcgtcgaggagatgcatgccaagagcctcgagatgggcatcaaggaagacgagatcgagaaggacgactcgcctgaggcgggcggcaaggacaagatcacagaccctgacatccaccgctcgctcgtgctgcttcttgcggcagacttcttctactacatgagctacaacgcaatgaccacgaacatcagcaggtatgccgacacattctacggaatgcagggaggctcctttgcgatcatcaacatcgtgacgatcatcggtgcccttgcgacctatgtgccgctggcgaacctgtcgcttcgtatcggcaggaagaaggtcggcctcctctgtggcgctgccatggcagtgtgccccgtgattctgtggcttgtgccgggcttccatcctgccttctatgccctcttccttgttatgggtgcaggcctgggcggcgtcgacctctgcgtcttcaacatgatcctggagctctgctcggcccgctccgtcggacgctattccggctactactacacggtgtccatggcagcgcaggtcgcaacgcctatcctctctggcctcgttatggatgtggcgcctgggacgctcttcctctacatcgccctcatgggtcttgctatggtcatctcgctggtccttgcgaagcacggcgacgcaatcttgatcgacgaggtcgcggcacgcgaggagaaggctgaagcgcactagatggagctttgctgagccgagcttccactctgctacgctttgaagcggatccggacttcaaggaggaaaccatgcaggcacgcttcatccaccgctgcacccacgtgctcgatctcgaagccacgaaggagttctacgagaaggcgctcggcttccacgtcgtgagggtatcgggacctgaggacggctcctggtcgaacacgttcatggcaaacgacgcagcgcccttcgagctcgagcttacctggaacaggggacgcacggagccctacgacaatggcgggagggacacccacatcgcctttgcggtcgatgacttcgaggcctaccacgagctccaccgccagatgggcgtcatcgacaaggagaatcccgcgatggggctctacttcatctgcgatcctgacgggcagaggatcgagatcctgcctgagaaataagtggcagggaaacctgcatctcaagggcttccggaatattccggaagcccttcttctttggacgaaggcatggacggaagaccaactcgacagggaatagtctcaactcgacacccatgagcatgaactcgacaggggcttctgaagatgccttcaaggatgcgtttcgggagtgtgaatgtatgggctgatgctgaggaatttcggctatcctcgaggtcaagacctttctcggcgctatgattcatgcgcatgaatccttcccgtatggatatcccttcccaagaccgcatggcagagctctctctgccccacacaagatgaaacccccggctttgccggagcggcaggtcctgcaggaagagacaggaaagatctcacgggaaaggctgaagacagaatcgtccgcctggcaggcaccaggcaggtggagtgatagcaatgacagacaagcagcatgcacgccatttcaaggaagaggagccgaagcgccggcgcagagagagaaagaccaaggaagagaaggctcctcagcgtcccgccaagagggaagaggccgctgcgtatcccgaagctgaaccagaagacgaggatggcttcacgcagatagccgatgtcgtggattctgcggcaggagatgcgtgggacgaccccttcgacctcatgcctgagatgcaggaagagtctgaacctgttcagctgaaggcagagcctgagccggagccgaagaagcatcacccaatccggaacctgatcgtcttccttcttgtcctcttcattgcagcgacaggtgtcttcggctacgagttccatgagagtgcccagtctgtcgcctcctctgcacgtgctgtggcagcgacaggatctgacttcatgtcgtcggtgcagtcgggctcgaccacctcgctttccgggaatgccgagagccttgcgcgctatgccgcctcgatggagcaggagaccgagagtccggtctggaagattgcagagcaccttcctgtcatcggagacgatgcgtcgcgtgtggctacgcttgccgatgtggtccaggacctgacggacaatgtcgcgaagccggtcgcagagagcctttctgccgtctcaggcgagcagccctttgccgatcatgcaatcaatgcctcggtcctgaagacctactgcgacgcactggccgatgctgcgccttcgcttgccgccgcgcaggagacggtcgacagtctcggcacagcagatttcgccgaggttgctgaaccgcttgctgccatacaggagaggctcgacacgattggcgctgttgcaggacgtgccgaggagctctcgccggtgatctccggcatgctcggggcagagggggagaggacctatctcttcgtcgtcgaggacacctccgacatccgctcggtcggcggtgctgcgacgtctgctgcggtcatgaccatagacaatggagcgatcaggctcgagagcttcgaggatctctccgatgagcttgtcagagatgatgcgctgaccgacgacgagcagacgcttctcggcctcatggggcatgacggcagcttcacggcagacgacgcaggctcgcttccgagcttctcccgcgccgcgcaggtcctcatccaggcggcagaggcttctggcaagacgaagattgacggcgtgattgcggtcgacccgatgttcctgcagagcatgcttggccttacgagtggcgtcacggcatccgatggcacgaagatcgacgggacaaatctcgcagccctgctgcttgcccctgatgatgaggtctccgccaatacatcgtttgcgcagaccgcgagccttgcagtcaatgccgtgctctcgaacatggacgagatgtcctacggcagcctcgcaaaggtcctgaatgccggcgtggacgaggggcgcctgctcttctacatggcagaagacgacgaggagaaggtgctcgatgctatcggtgcggctggctcctttgcagaggatgcctcgacgtccgagaccggcttcttcctctccgatgtctcggatacggggctcggcagctcgatctcgatcgaagggaccatcggcgatgcggtggtcgcatccgatggcagcatctcctacgacgtgaccgtgaagcttgccaacagtgccgaagacacagacgaagagcggacgctttcggctccgggcaagaaggcagaggagccctcgacattcatgggctttgctatcaccgcccctgcaggtgctgcaatctccaagctttcctgcgatgcagcgtccgagtcggacgatgagctttcgctttacgggaccgatgcgtgggcgggtacgttcagccttggtccgggagagtcggcatccttcacctacacggtgacgcttcctgcaggagcagatgccgcgctcacgctcaggatgacgccgcagccgatggctgcctgagaggactgcaagatgcgagaaaggctcctggcggatggtccgccaggagcctttccatgtctggaccctctcccgcgatgtctatctcttcaggccctgaagtcccagaagcgctgctccgatggctccgcagagctgggagtcgggatgcgtggcgacaggggagccgagtgcctcggagagggctgtgacgacacctgcgttctgggcgacgcctccggtcatgagatagggaccctcggcgtgcacgcgctttgcgagcgccacggtcttggcggcaaccgagacatcgaggccgtggatgatgtcagggacaggcgtgtcctgtgcgacgaggctcacgacctccgactcggcgaagaccgtgcacatgctcgagatcttcacctcgtgcttccaggtgaggccgaggcggcagaactcgtcgagcggcagctcaagcgtccttgccatcatctcgaggaagcggcccgtgccggcggcgcacttgtcgttcattgcgaacgagagcatctcgccttcgggggagagatggatcgccttcgagtcctggccgccgatatcgatgatcgagcggacagagggcatgaggaaatgggcgccggcagcatggcaggtgatctcagtgatggtcgtatccatgccagggatgttcatgcgaccgtagccggtagccacagagaggccgatgtcttccggagaaaggcctgcctcctcgagcacggctgcctttgccgcttcggcggcgcggctcgccttggcgccggtagccaggatcttcgttgcgaggatatggccatcggcgtccatgaggacggcgtcggtcgaggttgagcctgagtcgatgccgagaacatagcggaccggggcatccgtacgtgttgcggctggctgcttcttggcgccgatcgtctccgtgaatgcctcgatgcgcgtggcaagctggcctgcgctctgggagcttccgtctgtctctatcttcacggtgggcacgctgcctttcatgtcgcggcattcgaagccgtagtagtcgcagaatttcatcgtgtggtagatgatgccgcgctcgcccttttcgctgaagagcttctggcgtgcagtgtcgtcctgcatgcgcatgcacggcatctggtcgaggagcgcctctgcgtaccagtcgaggaaggcagaaagaggctctctcttctcttcagggccgcaggcttcgcagtgcccctgcctctccatgcggacgaggcttcggggcagcgtatcaggaagatggcgggaagtgcaggtcgcattctcgacaggaagcgctacctcgcgcccgacagcagagagcagggccttcgaggcatgggcgccggcaagcgtcacgtgatcctgcgcaagcgggactgccggctcgagagcggctagcgcacgtccgaggtcgaacgtcttgccgcaagtctcggcatagcttttcgcaagcgtctcgagccgcgcgcgaaagagggccacctctctcggtccgcgcttcctcggaagatcgagcagatagaggaagcggtagcgtccggggtgcttctcttcggtctctctgagcacgtcgaatacgcgcttcacggcgtcgcagcacgtgacaagcacgacctcgtgcacatcgtcctcgagcaggcgctcgagcatgccctttgcgtagccgcagaggtttgcgtgcgcgagcgttgcggcagcctggaagtcggatgtgtctgtctcggcgaggtgtgctgtggtgccaaagccggcaaagagctccgtcggcgtgtacttgcaggcgtagaagatctcgtcagccacggtgtgcctccagaagctcgaggaaggcatcgaatctcgtggtcatctgtccttccatgcagtttgcgcggtcgaccgcatcgccgtcgagcacgaggaccggatatcctgcgtcttcgagcatctggcgcatgagctgtgaggcgcctgccgtctggcggcatccccaatggcagaagatcaaggcgccatcggcatgcgtcgcctgagcgaggcgtacaagcgtgcgtccgcggcgctcggcagggccgttgaagcagttcctgacgaccctttctgccatgaactcatagggagtctctggtccgaagagaagcccatccgcacgggcaccctgaagcctggcctctttgccctccggctcaaggaaatcaaacatcatgtccgacgctacgatctgggcacgctctgtgcagtcgatctgccttcctatgccttcgaggaaatacggggagacatggccccagacaaggttcaggccctggtacgtatcggcgtaggcgatatcgtgcttcatgtgtgccgcaaatcgctctgcctcaggcgtgccaagcaggagatgcaggtcgagcatctccatcatctcgagcgtcatcgtgttcctgagattcttgccgctgcggtggggaagggtagagagaagcgccttcctcgtgcgttcggagctctcgcagagctctgtgagcttcgcctcgctgagcttctttccgaaggcttcctctgccatcttccccatgtccctgagctcgtctgcgacgtagaggattgcattgcaggagagctcgtaggggacatcgatgaaggagaagggcacgccccagcgcgcagcgagcgtcttgaagctcagattgttcgcgtcgcaggcgacggaggtcgcagcaagcatgcggggcgcctcgagcacgcctgtcgtggcaaggcccatgagcgtcttgtggtagctgcagtaggtctcggggatgcctgaggcttctgcggctgcgatgatgccggactctgcctgggcgccgcttgcaaagcttgcaatggcttcggctgtcgcaggcagggcatcgagcgcatggaagatctcgttgggcgtgaagatgctcgtcactgccatgcgctcaggatgtgccatggcagagacgacgcgggacatgaagagggcatagccctcgcgtcccgaaggcaggaagcgcctgtctcctgctatctgcgtctttgccgccatgcccttgtagcctgccatgagccaggcgcgggcaaaggaagggcgtgtggccagcgcattgtcggccacacgtccataccaggcgataatgtcgtctgccgtcatctatgcctcgtccggtgacatgagctggacgacctcgaacggatgcttcgaggaggcgatgatgtcagaagagccgaagacgcaggacacgtggtgttcggcacaccaggcaagcggcgtggccaggcccctgatatcgtctgcagacgtctcgagcacctcgtgcctcagatcctgccgccacgtggcgggacgctcctggaagcgtgcgccatcctggagccgtgcccaggagcggggcttcttcggcgcatcgatgccggcgacggtcgagacgaggtatcccgtgagctcgccgtcctgcggctcccagtccttgagccaggcagcctggccttcgtagcgcgcaagcgtctcgtcgatatgggggtcgcggtaggagtagttctgcgtcattccgttcgactgatgacggatgccggcgccgtaggcgccgcccttcacgcggacctcgttccagaggtagccgaaggagagcggacgggtgccgacctgccagacaccgagcgaactcgtgtcgtcagggcagggaagcgaggacgtcccgacatagacgacgttcgatggcacgacgaaggcctcgtcgacaggctctgcaggcggaatcttgagattctcctcggtgacctggccgcccttgaagggaaggccgaggtcgcctgcggcatcccagaagcgggcaaggtcctcgtctgagccggtgaagctcactcggatatcgtctgccgtgaagatgcggccagcaaggttgtagagcacctcgacggtcggctgcttcctgtactgccagcggtccaggagcttcttcaggaacagatagaagtcgacgcccgagagcttgtccatgaagcgggagagcggcaggatcttcgacgtggccctgttcatcgcaaggatgtggccgttgttcatgaactcctgctccattgcgacacggcgctgctggaggatctggtagatcttgtcggtgtcctcgccgaagagcgtctctgcccagacctcgcgcggaatcgaggcaagggatgccacattctcggagagtgcggaggcgccgacgacgagcttcggattcacgaagccaaggtcgtcctgcttgccataggcctcgcagaacacgctgaagctgccaagcttcgtctcgacgagcgtgtcgagatcggatgccgtgtggtgctgcgtcgagagattgcccagaaggtcggaaaggatcgcgacataggggagctcttcgaagccgacgcgcttgaggtcgaagtagtaatagacatagtcgatgtggtgcgtctcgatcctgtggtgccagcagggaagaggcgtgctcgactctgcgacttcaggatctttcgctccctcatcgatatcggagaggacaagggcgggaagcttcgccaagttctccgggctgtcggacgcctcctgctcggccctgagcgcagcctcctcgtccatcacctgctggagggcagcgtcgtccatcttggccttgaggtcggagagctccttctcctcttcggcgtggcttccttcctcgacaggcacgagctcgacggcggcggtgtgtgcgctttcgcagatgagctcggagaggagcttctcgaagtagcccttctcgatgcctgcatgcatatgggccagtgcatcctcatagcgcaggtagtcatagggacgatcgtcgtcgtagagccagctcgagagggcctggatcgagagcgcgacaccgtcggagtagccccagtcgccttcgcgcagattgaactctgcctgggcaagggaggcttcgagcttctcatggtcaataccgtcggagacgagctttcggcagaagtcctcgacgaagggacggaacttctctgctgctctgtcgtggagccccttgagctcgaggaaggcaagcggctgctgcacgccgtcgacaagcgtcgccgtgaagtcgtctgcaagccctgcttccatcacggcatgcttcaagggcgcctcgttcgagccggcaagggtatcgagcaggacatctgtggccagcacgcgctcgcggtcatgcgaggtgccgatcacatagcccaaggcagcggaagcgttctccttcgctgttgccatctccagcctcttcatctcaaggctcttgagaggcttctggagcggaagcggattggggtctttggcatggcggtcggcggcgccttcgaagcgctcgccgatgaaggcaagctcgcgctcgatatccatgtcgccgtagagcacggtgtaggaattcctgagctggtagtggcgggcgtgggtgtcgaggaactgctcgtaggtgagcgtcacgatcttcctcgggtcgccgcccgactcgaaggcatagggcgtatccgggaagagcgcttcctgcattccgtggtagaggacatcgtcgggatcggagagggctcccttcatctcgttcaggacgacaccgttatacgtgagcggggcgtctttcgaggcaagctccaggtgccagccttcctgctcgaagatgcgcggacgcgtatagatggcaggatgcagcacggcgtcgagatagacgtccatgaggttctcgaggtccttctcgttcgtggaggacacgggatagaccgtcttgtccgggaatgtcattgcgttcaaaaacgtctgcatcgacgtcttgaggaggttgacgaaaggctcctttacggggaacttctccgagccatcgaggacggagtgctcgaggatatggaagacgccggtcgaatcctgtggcgccgtcttgaagccgatcgcgaaggacttgttcgtatcgtcggctgcaagccagagcaggcgtgctcctgtcgcctcatgcttcatcacataggcgcagccggggagctccgagatgggctcggcagagacgaccttaaatccatggtggacggtgcccggagcaagagacggatcgggcttgaggaaatcgggagcctttgctccctcggaagaatcaggcatggagcctccttgcatgtgttgcgtacgagagctgcctgacagctcttatgtgtcatgcttcaagactttagcatgagtcggggcggtgcttcaggcctgcgccaaggcaacattgttgccggcggcacgcgctgcgctttccacgggggaaaccaggcactctctggaagatgtaccggaaagcatgggacgggaggagaagagatatggagcggatagacacgagcaagctccatcagatcagatgcgtcgtgaatccctatctcaggcatctcgaagcacagggggcgctctgcccgaagtgtgcagcaaagctctctattgagcctgcttcctaaagccctgatttcggcctctgggtctgcccgaggtgcggcgtcgtggacggcgtgcaggctcctgagttcgcatcgatatccatggatgaggcgattgcggcggacagggcaatggcagaagacccagatgagaagagccgccagcagagcggcatgctgcagaacgggaggcagcttgctcacggagatgcttcaagcctgtctaggggctcggaacttattcatgtctccgcatgccggaaggacgccagaggtcctgaaggaagcttcctctcgggcgctacaatctggatggaacagcaaatcgaggaggcgccgtgcagatgatgacagaagacgagctcgacaaggcggaaagctactggacaagccaggaaaaggatgccaagaagatgccggccgaggtgctgcgcgagaaagccgaggcattcctcacgtcgcacaatacctgcgcgcttgcgtgcggtgcaggcgatttcgtgcgctgcacgccgctcgaatatgtctggcgtgacggggccatctggatcttcaccgaaggcggactcaagttccatgccctccgcaagaatctgcgggtgagccttgccgtgttcgagccgtatgcgggcttcggcaagcttgcgagcatccaggtcaccggcacggccgagatcgtggaccccgagagtgcagagtatgcggcagctgccgcagcgaagggcataccccaggagatgctcgagcgtgtgcggacccgtctccatctcctgaagatagagccctcccatatggatcttctcatgagcggcttgcatgatgagggctacagcccgcgccagagcctcgactgctagcttctgtccgccaagacatcctggctctgtcctgcttgggtgttgtgccatcgctatactctttgtgcggactctcgggaggagcgttcggcacttgaggggagcggcatggcagaggagaagataagcgagcatccggcacggcctgtgctggtgcgcggcatcctgatcacgcttgcaggagcggcactctggggaatgaatggcacgattgccaaggtcctcatggagcgctatgaggcagatccgctctggattgcgtgcttccggcagcttggcagctgcgtgctcttcctgcttgcggcccatatcgcgcagaaggggagggtcggcgagcttgtgcatgaccggcaggcgctcaagggtgtcttcggcgtggcgctcggatctttcctgctgtcccaggttgcctacctcatggccatcaaatggacgaactccggcacggcaacagttctccagagcctgcagatgctcatctgccttgcctatgtctgtgcgaaggtgagaaggcgccccaagaagcgcgagcttctgggggctgctctggccttggcaggcacctacctcatcgcaaccggcggaaatccaggcacgctgcagctgccgcctctggggctcttctgggggcttgtcgctgcccttgcaggtgcaatacttgccatccagcctgcaaagctcctcgacaggtggggaagctttgccgtgaacggcgtcggcttcctgatttcgggcctgatcttgacagccttcttccagccctggaaccatatgccggcacttgacggattcggctggcttctcatcacgctctcgattgtcctcggcaccttcggtgcctacggtctctatctccagggcgtgaaggaagtggggtcgctccgggcaacgcttctcggcacgatggagccggccatggcaacagtgacatcggtcgtatggctcggcaccatgttcgacccggcgacgctcgtcggctttgtcctcgttatcgcaatggtctatctcaccgcatagaagaagcggcgcctgcgggcgccgcttctggcatatcagctgctgtgatttctgctacttcacgacgagcacgtcgcacttcgagctcctgatcagataggtcgagatggagcccagaagggcatacttgatcgacgagaggccacgggcgccgcagatcacgatatccggctggatgatatcgagcatctcttccttcaaggtctcgcggatgcgtcctgccttcacgacgacctcgaccttcttgatctgctcgatgccttcggcacgcttgacctgatcggctatggagtcgcggaagtcggcttcgagcgtcgggatgagctcgagcggataggttcctgccgtctcgagcgcggtcgagtcgattacgtggccgatgtagagctctgcattgttgtttgccgccacgatgatggcgcggtcgagcaccttgtcctgctgctccgatccatcgagagagacgaataccttgtcgtagccgagatcctggaagcttgtcatgacaacctcctcgcacggggcgccttttttgtgtctagcggcgccggtaaccctcaaaggggcatctgttcgtcctgtaccccggaaatgatgcgctttgcgcgaaagcggcggactttgcggcgagcggcagctttgctgtctatgatgggtttgatgaaacgtcagagaaagattgtgggcatgcagggtgcgtgcccatgtaggaggtagatacctgtgcccgttatcgagcttctgaaagctgcgctctacggcctcgtcgaaggcatcaccgaatggctgccgatttcctcgaccggccatatgctccttctgaaccagttcgtcaccctcgatgtctcgcaggacttctgggacatgttcctcgtcgtgatccagcttggtgccatcctcgctgtcgtcgtgctgttcttctatcagctgaacccgttctcgccctcgaagggcaaggacggaagaaaggtgacctggcgcctctggggccagatcatcgttgcctgccttcctgctgcgatcatcggcgtgccgctcgatgactggatggaagagcatcttggcagccccttcgttatcgctgcagcactcatcgtctacggcattgccttcatcgcaatcgagtcccaccgcgagcacaaggcgaagcgccttgcagacgagcaggcagcagagggccatgcaaagcacttcgcggtccgcacgttcgaggacttcgatacgccgtccgagcttgctgacgccgatgcggctgtccaggatgtgaaggagatgccgtggaagactgccttcggcatcggctgcttccaggtgctctcgatggtaccgggaacctcgcgctctggctccacgatcatcggtggcctccttctcgggtgctcgcgtgccgtggcagcagagttcacgttctaccttgccattcctgtcatggtcggcgcatccggccttcgtctcgtgaagttcttcttgaagggcaacagcttcacgacgaccgaggcccaggttctgggtgtcggctgcatcgtcgcctttgtcgtctcgcttcttgcgattcgcttcctcatgagcttcgtgaagaagcatgacttcaagccgttcggctggtaccgcatcatcctcggtgccctggtcattgcctacttcgcgctggtggcctagtgggagcttctcctcaacagaagagcgtgccggagctccttgctccggctggtggccccgagcagctgctcgaggccatccatttcggtgccgatgccgtgtatctggcagggccgaggtggggcatgcgcgcaaaggcgaggaacttctcgctcgaagagctcgtgcatgctgtgcagactgcccatgcggccgacgtgaaggtgcacgtgacgctcaatgccgtgatgcgcgatgcagacatggcagagcttccggcctaccttggggcgctcgaagaagcaggcgtcgatgccctgatcgtggccgacctcggtgcgatgcagcttgcacggacatatgctcccacgatcgagctccatgtctcgacgcaggccaatgtgacgagcgccgagacggccaaggcgttccagagcttgggcgccaagaggattgtgcttgcgcgtgagatgacaatagaagagattgcgcatatgcgcgacgagctgccgcccgagcttgaactcgaagccttcgtgcatggctcgctctgccttgcctatgcggggcgctgccttctctcttctgcccttatgggacccgagcgtgtcgcatcgcgcggtgcctgcgcacagccctgccgctggggctgggcgcttgcagacgagcgggacccctcgcgcaggcttcccctcatcgaggaaggcaaggagagcttcatcctctcctcgaacgatatctgcatgatcgagcatctcggtgacctcatcgcggcgggagtcgactccctcaagatcgagggcaggaacaagggcgcctactatgtggcctgcgtcacgaatgcctataggcaggtgctcgacgggggagaggcgggcctgtggcgcgaggagctcgagcacgtgagccatcgtccctattcatgcggctactactatgggcatccggaagagaaccagggcgagcccgagtatgcccgcgaccgtgcgctcataggcatcgtcgctgacgtgaagacggaagatggcacgtgctgggcagagttcccgctcaggaaccgggtcgacgcaggatgtgcgcttgcggtgctctctcctcatgagccggtgcgcacgttcgtgcctgagcatctggaagcctgggatgaggagagcgcatcctggaaggacgtgccctcgctcgcaaagaccatggggcgctgccgcatggaagttccctttgcggtctcttccggagacgtgcttgcgcgggagctctagctctcctcttttcgcggaggagcgcatgcgcgctcttgcctgtcgcgtgcagccattagacttgaatcttgcaaacgactgatctttccaaggaagcacatatgcctttgacccaacgctcgcttttccagcccgaccatgcacctcaaacgccccaggcacccgaggcaacattcaatggacccgacctttctgccctgaatccccagcagagggaggcggcgctctgcacgaagggcccgcttctcgtccttgccggcgcaggctcgggcaagacgcgcgtcctcacgatgcgcatcgcgcacatgattgccgatgaaggggtgcgtccctggcaggtccttgccatcacattcacgaacaaggcggcgactgagatgcgcgagcgtctcgcccaggtcgtgccgggcggcatccgtggcatgtgggtctgcacgttccatgccatgtgcgtgaggatgctccgcgaggacggcgagcttctcggctatacgaattcgttctccatctacgacgacgatgattcgaagcgtctcgtgaagtcgatcatgacaagcatggatatcgaccagaagcagttcccgattcctgccatccgctcgcgcatctcgaatgcgaagaacgcgatgatcggtcccgacgagcttggctcccagtcgaactctccgctcgaccagaaggcagcccgcgtctggcgcgagctcgaccgcaggctcgagcgagccaatgcgatggacttcgatgaccttctgctcaaggcatatgagctcctgagcaagcatcctgaggtgctgagcaaatatcaggaacgcttccgccagatcagcgtcgacgagtatcaggatacgaacggcgtgcagtatgcgctcacgaaccttctggccagccgctaccgcaacctcatggtcgtcggcgacgacgaccagtcgatctattcctggcgtggtgctgacatcaagaatatcctctcgttcgagcaggactatccggatgcgaaggtcgtgaagctcgagcagaactaccgctcgacgggacacatcctgaacgccgcgaatgcggtcgtggcgcacaattcgaagcgcaagccgaagcggctcttcacggacaagggggacggggagaagatccgcgtcttccaggcagcagacgagcgcgatgaaggacgctggatcggtgccgagatcgagaagctgcacgatgcgggcacatcctacgacgatatggcgctcttctaccgtacgaatgcccagtcccgcatcctcgaagatatgctcctgcgtgccggcgtcccgtacaagatcgtcggcggcacgcgcttcttcgaccgtgccgagatccgcgatgtgatggcatacctgaagctcgtcgtgaaccctcacgacgatgtcagcgccctgcgcgtcgtgaatacgccgaggcgcggcatcggctcgacctccatcgggaagattcaggcattcgcacgcgatgaaggcatctcgttcttcagcgcctgcgaggctgcggcgacggagacggggctgctctctgccaaggcacgaaatgccctcatgagcttcacgcagacgatcgaggcggggcgccactacacaggcgagctttcccaggtcgtctcgatgatcgtcgaccagtcgggcctcatcaaggcactcgaggcagagcattccgaggaagcggattcccgcatcgagaacatcaaggaattcttcggcgtcgcgcaggaattcgacgagagccatgaggacatgacagcgacgctcgagagcctggaagagctcaaggaggcgggtgcgctcgatgcacggacagcctcgagcgtcgggacgcccgaggaggcggcgccccagggcgacatcctgccgcctccggcatctgacaagctccctgccttcatggaatggctggcgctcaggagcgacctcgatgcgctcggcgactcgacgagcgctgtcacgctcatgacggtacactccgcaaagggcctggagtttccagtcgtcttcgttgccggcatggaggaaggcatcttcccgcactccggacaccaggaggaccctgcgggactcgaggaggagcgcaggcttgcctatgtcgcaatcacgcgtgcagagaagcgcctctatctgacatatgcggcaacgaggcgtacctacggctcgacccaggcaaatcccagaagccgcttcgtcgatgagattccggccaaggatatcgagcccgtcggcgtcggctctgcaggattttccggtgtcggctgggagaagaggggagaccgccgcggcacgttcggcagcggccgaggctctcaggtctacggcggccatgtcttcggctcggtcacgcgctccacgaatgccggtgcccatgcgcaggcgggggcacagcgcgctcctgagcgtccgcagccgacgcgtgcggcgcagacgtcctttgcgccgggcgacaaggtcacgcacaagacgttcggtcctggtgttgtcatcaaggccgaccgcgatacgatcgatgtgcgcttcgaccgtactggcaagacgaagaagctcatgaagggctttgcgcctatcgtgaagatcgagggatagcatggactggggagcaatggcggcattcttctcgctcgatgcaatcggcggcaagatcctgtatctcgctgtcgtggcaggcatcgcctatgtgatcgagcgggcgctctcagccttcctctcgcgcgtcttcgatgcgacggatatcccggctgcctcgatcttcgtgaacatcgtgaaggccttcatttgggcgcttgccctgctcgcggtgctccagcctgtctttggcatccagccgactgcctttgtcgcagccctgggcgtcacctccgtcgtgatctctctgggcctccaggatacggtctcgaatgtgatcggcggccttgccctcatgctcggccaggtcgtgaagccgggcgactacatcacggtcggctcccagtcgggcatcgtgaccgatgtcacctggaggaacacccttctcgcggatgcgacaggatcgacccagatcatcccgaactcggtcctcaacaagacagctgtgacgatccgctctgcctccgatgtcacgtcctgcaccgtgccgctcctgctcagaagcgatgtggatgtggatgaggcgacagcagacatcctgaagaagggacaggaggcgctgggcgactgggcggaccccgatttcaagccgcttctctgcctcatctcgttcgggacgtatggcatagaggcaaaggccatcttccatgcaaaggcagaccagagctcgcttctggctgccgacagggtggcgcgtgccatcgccggcacgccctggcttgcgaggatggaccgtgaagtgccagaacatgggtctgcatccgagcaatctcgcctatcctgagttctgtcagcaaccgtgaaggagttcgtaatggaaaagattgcaagcttcacgatcaaccatcttctgctcgagccaggaatctatctgtcccgcaaggacaaggaccctgagacgggctgcgtcatcagcacgttcgatctcaggctcacagcacccaaccgcgagcctgtcatgaacacggcaggggtccacgctatcgagcatctcggcgccacgtatctgaggaacgatcccgagtgggcgcaacgtatggtctacttcgggcccatgggctgccgcaccggcttctatctcgtcgtcttcggcgactatagctcgaaggacatggtggatgtcgtgacgaggctcttcgaattcatccgcgatttcgaaggggacattccgggtgccacgccgcgcgactgcggcaactggcatgacgcggacctgaacgaggcaaaatggtgggctcgccgctatctcagcgagacgcttgatggtatcgacgaagcgcacctcaactatcccgaagcgtaaaggagcatccatggaggcaatcaaggtcggcatcatcggtgccatggcagaagaagtgaactggctcaaggcccagctcaaggactctcagacaacgcagattgcccagcgcgatttctgcgagggcaagcttggcggaacggatgtcgtggtctgcgagtgcggcgtcggcaaggtcaatgccgctatggtcgcgcagaccctctgcgagcgctaccacgtgacccatctcatcaacaccggtgtcgcaggctcgctcaacaacgacatcaacatcggtgacatcgtcgttgcgaccgacgccgtccaccacgatatggacgtctgcaacctcggcttcaggccgggagaggtgccggggctcgataccgtggccttcccggcagatcctgagctccgcgctgcagcgctcgatgcagtcgctgccgtcgctccggagatcaagggcttcgcagggcgcgttgcctcgggcgagcaattcgtccgcacgcaggagcagaaggaccgcatcaagtccctgttcgacgctgactgcaccgagatggagggcgcacctatcgcccaggtcgcctacctcaacaaggtgccgttcgtcgttgtgcgtgccatctccgacaaggcagatggctctgcctctgtcgactatccgacgttcgagaagcaggcagcagagcactgcgcaaagatcgtcgagtacctcgttgccaggctcacggcctagacgcttcaagaggcccagaaggaagggaggccggatgctgcaggcatccggcctccctcatgtctatctgccgcagcctcagagatagagattgggcctgcgctcatcgagccaggtgcgctcgctgcggatcttggcaacacggccgaggtcgatgtctgcgacaaagaggctctcctcggctcctgccttgccgacgagcgtgccatcgggtgctgctacaagcgactccccagcaaagacagggccgtcgttcggctccttgcccgatcggttgcagagtgcgacatagcaggtgttctggaatgcctggacgcgcatttcccattcgaagagctcgagcggctcgtcctcgacattcacggtcggcacgagcacaagcgcggcaccttgggcagcgcagctcctgatgctttccgggaagtggcggtcatagcagatcacgacaccgatcctgccccagggggtgtcgtagacctgaaagcccgaaggggagggcgtatagtagtcggcctcgaagaagccaggatagcttgcgacatggaccatgcgggcaggctcgcccagaagcgtgccatccggacctgccgtgatcgacgtgtcgtaggcatggccatcaggccacctgcaccagagattgaacgaggcagcgatgccaagagagcggcaggtgccgaggagctgccccaaggcaggagatccgaggtcggggcacatctcgtcgagctttccgctataggggctctcgtcttttctccaggcagggaagaacggcgtgagctgcgcttcaggaaagagcacgaggtcagcctctgcggcatcggcctgcctcagataggcaatgctcgcttcgagattgcctgccatcgattcctgcatctgcatctgtgccagagcgaggcgcatagggactccaaacgacaaagggcggcatgcccaactgcatgccgccctctcagcttatctgagtttctgcctgatgtcttcgatctgtgccttcagatcctggatgcgctcttccttctcctggatccagccttccatgttgtcgaggtactcctggctggtcgtcgtctccatcttgtcgcggaggtggtcgatctggccctggaggttctcgatctgtgcctctctgcgctcgatggcctcctcggacttcttctgggctatctcgtgccgtgcctcatggtaggcacgcttctggagccagaacttctcctttgcgtcatggaagctctcccagagcgcatcgttcgtcttcgggccggcatagccgatggccttccacttgacgtccaggcccttcatcgtctcggtcgcctcgggaccgaagtccatagcggcagagacgcgcttggcggtgtcgatgagctcctgcttcgcctcggcgttcttcttgtactgtgcctcgaccgcagcgtagtgggcatgctgggcatcgaagaacttctggcggagtccattgaactcttcccagagacggtcgttctcttcgcggcctgcctggccggcagctcgccattccgtcatcaggtcatggacctggttcgtctgtgccttccactgcgaggcgccccaggactcgtcaggctccggcagcgcgcgcaggcgctcgatgagctcctgcttcttggcgcgggcctttgcgtggagggagtcaagctcctggtaatgggcattcctgcgctcgaagaactcatgctgggcgccattgaacttctcccagaggcggtcgtcctcttcgtggccagcagagcctgccttcttccacgcatccatcaggaggtggaagcgctcggtcgtggccttccactcgcgcgaatcgcggagcttgtcggcttcctcggcgagcttctcctttgcggcctgcgatgcttcccgctcatgggtgcgctctgcatagatcgtgtggcgggcggtctggaaggcttcccagagctcgtcctccttggcggtatgccagttgtggatggcgcgccaggcgtccatcgtcggcctcagctgctgcgagccgtggcgccagtcggatgtgcgtacgaattcctggagctcgctgacgagcgcttccttctttgcgatgtcagcctcgcgcagaggattcggctgcacttccggctctgtgctggattctgtctttgcctcgtctgccttctgcgcatccggcacgctttcctgtgccgtggtctcggtcgcctcggtgtcgcgttcctcattcaaagccatggtcactccctgggtgggcgaagagtagaggtgatgtgtggatgcagttcccacaagccgaaagactaccacgtatggcttcagattttcaccacatctccggctttgggcagctggattctgtaggtggacgccgtaacagaagcgtgcgcaatcagaaacttggaagagtgcttcgggaaagcttcacggcaccaagccatcctagactggcctcaggcgagcgggaaacgggaatctattccagccgaccgtaagcccctccctccctgttgcctctgcctgtccaagggattggcagaggcatatcaggcagagctgcagggctgtctcgtgggattcctggcgactcggccgttcggcgccaaattggcaccgttcggcacgggaatcccgaaagaggcgaaggacctgggtaggaatataagcgaacagaaaagggtcgcaccaatgaggctgcgacgagagaagggggtgagtccgatgggcatagatgagagctctatagtgcgtctgcccgaggaccgctgaccttatttgacgggtgtgggtttcagccccccgcgtaccggctgtccgagacagagcaatgccagtcgggcaatcgggcagacgtatgatatttcagctgggtgagctccggtgcttcgtgcatccatttcactttggtccagcacgtgacgagcgcgtggctgcggcggcgggaatgggcacagcgagcctgaggaaggttccgacgtctgtttcggcatgatgcaggaagcaaagttccgattccgttttggcgcctggcgccgagagggatgacaccaaagttctgagcagcaggggatttttccccacatcaggcatctgtagtccgtcatctgaaatggggatgacaccaaagttctagcgagcgggagcagaagctccctgattgaggcatctatcggattgctgcacttcgatggaaggcggcagagcggaggaggggataccgaagtaatagagacgatctatccaatcgttcggtttttcgctatcctcgctctcgatgatagctgagctgtggggcggaccgcgcaatcgggcacggtccgccctgtttcatgtcgggcgtgtctgaaaagctgcaggctgggtatagcttggagccagaaagacaacttggggaggcatgatggacgaagaagctgagtacgtggtcccgtcggatgaagaggaacgcagggaggcacgcgaggcaggagagcgtgcgctcaagagcctcagggaggcccggggctaccttgcaaaggcaagcagctggggcctggtcgacctcttcggcggcaacttcatctccggtgcgctgaagcatgcccgcctcgtcgaggcgcgcgaggcgatcggccaggcaaagcgcgacgtccaggctttccagaaggagctcggcgacgtccgggatgtcgagcatctcaaggtcgatgtggatggcttcctcgagtttgccgatttcgtatttgatggcgcgattgccgacatcctggtccagtccaggatcgagaaggcaaaagactcggtcgatgatgctatcgccggcatcgagcgctcgctcagagacctgtaagagaagcgggagggacacgaaaagcctctcccgcttctgcatttcttcggatgttcttactgggctgccgtgaacgtcagatgcccgagcacggtatccagatcgtccatgccagaggcatcgcgcagatagatgtagttctttccatcaggcacctcgatcagggcctctgcgataccggagtccgtataggtgatgacagaggagccgttgatctcggtcgtcgtgtagtctgaagcggattttgcagaggcgacgtaggagtcgtagtcggccttcaggatcaggaacccataggctgcgaccttgccgtctttcgagacatcgaagttcacgccctgctgcacgaggtcatagccatccgacgtatcgcagctgatggcgacatcggcattctggaggatgccggtcgtgatcgtcgctccggatgtccgctgcgatgcagcggtcgtggtctcgcccgtgcttccgcaggcagaaaggcttgccgcaaggagcaggcccgacacgagggcacagatgcggtgtgcgagcttggccggtttcatggatgctcctttcgggacggtctgaaaagcatgcccttcatgctacccgaagatggcggaagctgtcgggatttgatgattcctgcacctcgtgcaccggcggcttgctaggcttgaagcagaagctgtgaggaaggtgctgctatggattctcaggatatcgatcggctggcgcgcttgatcttcgaatacggcgagagtgcagattcagagcttatgcctgcatctgccatcctggccttcggaagccacgacgagcatgtggcggagcgggcagcggagctctggcatgaggggcttgctcccttcatcatcttcacaggtggcctgggacgcataacgaagaggctctggcaggaaccggaagcagagcgctttgcccatatcgccgaggaggcgggcgttcctgccgatgcgatcgtcaccgagcccgattccacgaatatgggcgacaatatccgcttcacacgggagctcatgaggaagaaggggatcgcgaaggcacgcctcattgtcgtcgagcgtccctaccgtgcgcttcgcacaagggcgaccgtgagctgcctctggccgggactgacgttccaggttgccgtgccggatatcggctacgatgagtatgcacgctggtacgcaagcggcctggcaccgatctcgaagcatgagttcatctcggtgctcgtgggcgatgtcgagcgcaatgtcatctatcccgagcgcggctggcaggaccccgtcatgacgccagagatggtgctcgatgcaagcaggatgcttgcacaggcaggctacacagaacagctgctgcccgatgtgagcatctggtaggacagcaggggacccgaaagattgggggcagacatgatcgaagcgattctgctcgatgtggacggcacgctcacgaacggcaggaaggagatcacgccgaagaccgaggctgcgctcagggctgctgaagcggcaggcatccggcttgtgctggcaagcggcaggaccgacaatggcctttcgcgcttcggacgccagcttggcatgtatgagcacgacggtgtcttcgtctgctacaacggcgcaaaggccgtggactgccagacgggagagatcctcttcaaccaggccatgagcgtagatgctgccaagcgtgtcctcgagcatatgaagcgcttctgtgtgtggccgatcatggaccacggctgctacatgtacgtgaacgatgtctttgccggcatggtcacgaatccggatggcacccgccgcaacatcatcgagtacgagtcgcgctcgaacagctacctgctctgcgaagagcgcgaccttgccgcgttcgtcgactgggagccgaacaagatcctcgtcgccggcgagcctgcctacctcgaaaagcattggcaaaagatggcagagcccttcgagggcgagctcagctccatgttcacggcaccctactactacgagttcaccgccaagggtgtcgacaagtcgaaggcgctccgcgagagcttctctgctctcggcatcgctcccgagaacgtgattgccttcggcgatgcgcagaacgatatcacgatgctcaggtgggcaggcataggggtcgctatgggcaacgccgtcgacgagacgaaggaagcggccgacgaggtgacgctctcgaacgaggaggacggcatcgccgcttccctcgcgaagcatctgccggatatctgtggatagggatggcttgcatggatgtgcagacggccgaccccgatgctctggcagaggcgctcttcggcaccgatgaacgtgcgatgcgtgcctatgcccttgccaggcgtgcccatgcagggcagcgcgacaaggcaggagcgccctatatcctgcatcctctgagcgtggctcagggagtgatggcaagcggagatgaagatgccctcgtctgcgccctgctccacgatgtagtggaggatggaggcgtggacctcgatgagatacggcaggagttcggagacgcggcaggggatgccgtggggcttctgacgcatgaagagggcgtgccctaccttgactatgtaaggcgtatcgccgagagcggctctgccgcggcgatccggtgcaagatctcggaccttgtgcagaacctcgatatcgcgcgtctttccgaggcaggccagaaggattttgagcgtgtggagaagaaatacctgccggcactccgcatcctgctcgacaggctcgagaaaggtgtggcagacgcagccgatgaatgagctttcggttgcttgcgcagagcatcttgccggcgaagatgaagaagccgtcctggcacttcttgaagagacggaaggcgagttcgtgccgccgctctccaagaggacatcgacccatcagacagacttgagcacgcctgcagcctcagacaggactggggtcgaagcctactttgcagagcttgcaggccagccgttcctgcttgcgcgggaaggcaggaggtttgccggctttctctcctatatcagaggcttcgatgcgggatggatccgtctcggtgcagacgcggtctacatcacgaccatctgcaccgcgccagaatttcgccatcgcggtgttgcttcggcgctctaccgcgccctcgagaagaggatctgcccttctgccatgctcataaggacctggtcgacaaatggggcgcagcgctcgctgctcgagaagggcggctatcgcatggtgcgctgcctcgcagatgaccgcgggcctggcatcgacacgctctactacctgaaggagctcggacaggtctcaatctaggggagaagaaaaggacccggtgccttctggcatcgggtccctgcatgagcattgatggctctgcgctagcgtgcctgctggaggctcctcgaggggatgggtgctgtctttgcagcaggcttggccttcgccttgccggagagctccgagaaggctgcgccgccgaggatgaggacagctcctgcaagctgcgctgcgctcatgggctcgccgagcaggatgacggagaagacgacagcagagagcggctcgagatagccgcagaccgacacggtctggactggcaggtcgtgcatcgcagcgaagtagaggaagcagccaaggccggtattgacgaagccgagcatgagggcaggagcgatatcggtggcagcaaaggaaggaagcgcctggcctgtcagaagagcatagatgaagacgcaggcaaagctgccgatgagctgcacggtcgcattctcgaggccgcagatgtcggtgaccttcttcgagaagatgaccatgagggcatacatgaccgcggacatgaagccgcagataaggccgaacagagagagcgtgccctgaagtccctggccgacgacgaggaagcatccgccgacgacagctgcaaagccggcaagcttgcgggcatcgaggtgcatgtggaagaggatcggcgagagggccatgacaatgacagggccgcaatagtagagaagggaagagacgccgacgccgatcagacggtaggcctggaagaggaagatccagccgccgccaagggctgctcccgaaagggcaaggaagagcgcctgcttcgggtgtgcggcactctggagcgtctcatggctgcggagaaggccggctgcgagtatgacggcgaggaggaggctgccgaggaacgtgcgcacgagcacgatctgggtggaaggaaggagcatctgtgccgctacaatgccattggagccaaagagaagcagcgctgcgagatagcggagcagggatttcctcatggatgcacctttccggatgattgccgtgccacccattttcccagagcgtttcttacaataaaagcgaatatgataaatatgttgtattatgaattgtgatggaaaggagcggggcatggacacgaacatccagaagtaccgcgcccttatcgaggcagtcgatcagggcagcttctctcgtgcggcagaggtcctcgaatgctcgcagccgggcatcagccgcatgattgcagatctcgagcatgactggcgcgtccgcctcgtcgaacgtggccgcggcggcgtctcgctcacggctgaaggcaagaagatcctgccgtatgtgcgccgggtcgtcgaagaggaccgggagctccacagccggatcgacgacgtgaacggccttgcggtcggcacggtacgcatcggctcgttcacgagcgtggccacgcactggctcccgcatgtgatcgcgcgcttccagaaggacttcccccagatcgactatgagctcgtgatgggcgactacaccgagatagagcgctgggtgcaggagggcagggtcgactgcggcttcattgccggaaagccgaagagcaccctcatggacaggctgctcgaccgtgacgagatgctggctgtggtgcccgaagggcaccggcttgcttcccaggaatcctgcgctctcgaggacctctgccgcgagccgttcatgatgctgcagcagagcggcgacaccgaggtctcaggcatattcgaggctgcgcatcttgcacctgacgtccgcttcgtgacctgggatgactatgcaatcatgtcgatggtggaaaacggcctcggcgtctccgtgctgccgagtctcgtgctcaagcgcaatccctatcacatcaagctgctgcatctcgaggagccagccttcagaaatatccgcgtgatcacacgtccggacatctcgaagatcgcctcgaagttcctggaatacctgaagtacagaaacgagacagtggaggactagcgcagcttctccaccgctatgccttctggcgcatccttgcagacaaagagctgctctgccagagccttgccctggcggaactctgcgtccttgaagaggcagaagcggatctcgtcgaaagagggcgcttctgcaaggaggatctcgagcgccagaggcagtgcctcttcgaggggatagccatagacgcctgtcgagatcgagcagaacgagatcgtgcgcgcgcctgcatgtcttgcctcttcgcatgaggtgcggtagcaggaggcaagctgctcgcgtgcgcgctgaggagtctcccttgcatagatggggccgacggtatgaacgatgaagcggcagccggtgcgggcttcaaggctgaaagacggcgtcacgacagcctgtcccgtcgggcagaagccaatctttctgcaggcacggtcaagctctggaccggcaagcgcatggatcgctccgtcgacgccgccccctccggcaagcgcgcggtttgcagcattgacgattgcgtcggtcttctggtctgcgaccgagccatggatgagatagagcatgaacattcgccccttcttttgccatacactatagacgtttgcagaaatgcgctggcagagaggtgacctatgcagatagcgtcagacggagaggcccttgtgcctgcactcgaggagctggtctcgagggagcatccagtcctcatcggttctgctgtcgatacagacgagaggccccggacagacgaagtgtggctcaatggcttcgatggggagggcctcgcctttgccgcgcgcgcaggcacggcgctctcgtcgtctcttcgccataggcgctatgtctcggcgatgggagtcgtcgtatgggagggaaggcctgcgttcgtgggatttgcaggacgtgtgcatgagctctcccagagcgacctttcgcttcgcctcagggaggcaggcacggatgcggacagcgtgcttgcaggaggctatgggagtcttgccggctttgtcctcttcgatggacggggaatacttcgccaggatggcaccgaatggaagttcggcgtcggcacggcagagccgcctgcaacgtattacgtcacgaactcctgcacaggctgcggcatctgcgtcgtggcctgcccgcagcttgcgatagatctcacgaagagcccggtcatgatcagccagccgcgctgcatccattgcggcacctgcttcgagagctgcccgaatcatgccatcatcaggctctagcagaaggaaggtcatgggttccatgggacaacatgagggatgggtcggcgtcttcgattcgggcgtcggcggcatcagcgtgctcgagcatctcgtgcgcgagcttccgcatgagcgcttcctcttctttggggactcggcgaatgcaccgtatggagagaagacggacgaagaggtcatgaagctctcccgtgccatcgtggagtacatggtgcatgaaagctgcaaggccattgtcattgcctgcaatacagcgacctcggtcgcggcggcgacgcttcgtgccgagcatccagatcttccgatcatcggcgtcgagccagcgctcaagccggcaacgcttgctccgaagcacagaagagtgctggtcatggcaacaccggtgacgctcagactcgacaagtaccatcagctcgcagctacctggggctccgactccgaagtcatctcccagccctgtccggggcttgcggcaaggatagagcatggcaacctcgatgctcccgacctcacagagctcatcgagcgcctcgtcggccagtatgccggaacggtcgattccgtcgtgctggggtgcacgcactatcccttcgtggctcgtcagatccgctcggtcgtcggcgatgtgccgctcttcgaatcgggtgccggcacggcgcgcgagctcaggcgccgtctcgaggagacgggcaggcttgcgcctgcgtcgcaggaaggcacggtcgagttccggtcgagcaggaatacgccggaggagcttgcgctctaccgctggttcttcgcacaggaggtataggcatgatccagggtgcaatcttcgatatggatggcctcatggtcgactccgagcgcgtctggtgtgcccagtggccccaggtctgcgaagaggcgggagtgccctatcgccctgaagtcgcagacaggacgcgcggcacgacggacgagcggggagctgaaatcctcgaggaaatctatagcgacatcaaggatgtcgacggggcgcagatgatcagaaggcttcatgagcttgcaggcgtcgtcttcaggacccagggtgttcccgcaaagcctggcctcttcgaactcatgaactatctcggcggctggcatataccctgcgccgtggcgtcatcttctccgctcgagctcatccatctccacctcggccatctcgggctcgaaggagcttaccaggccatcgtgagcggcagggattccggcatcgcgcacagcaagccggcacccgatatcttcctcgaggcagcgcgacagcttggggtagagcccgagcgcacgcttgtgctcgaggattcctactcgggtgtcaaggcaggagccgcagggcatttcataaccatcatggtgcccgatctctcgcccgtgacagatgagatgcgaggcatggcatcctacatctgccaggacctggccgaggtcgcagaccttctggaccagggcttcatcgatgcctgattgagacttctctcagcttcataggcgttccgtgtcggtttcctgccgatcctaagggccggcaggaaacctgcctcaagaggcgattatggagtgtggcatcctcatcgaaaggaacacatgaacaggaagacctatatcgttctcatgatcgtctctgcggttgttgccgtgctctcgcttgccatggtcctctggacgcatatgtccaagagcgcctacgagtcgctcgtcacggcctccatgggcctgcagcttgcctatatcgtctcttcgcccctgcttgtcgagagcatcgcctttgccggcatgatcacgctcgtgcatctcgggcacctgcgcctcggcaagacccagaggatcgtctcgcttgtgcttggctgcgtgcttacgctcttcgtcgtcgcaggctcgctcgtggcagcatatctgccgtcggcccttcaggtcgtggtcgtcgtctgcgtcctcattgcggcccagtacccgctctgcatgattgtacctgccctcatgctcggatttggccttgcgcttccgaaggagcaggcagaggcctaggcccgatctgggctggtttaattcctctatgtaactaggaattaacagagcaatcccatattcccacttgaatggtaggaatataagtgccattctgtacacaacgagcttgcaggccatccaggacttgtgtccccggccaaaccaccctcgtatccagcagatagcaacagaaaggcacgaacatgaaggtcgcaaagcacgtcgaggcactgattggcaccaccccgcttgtggacctctccgccctcgtcgacggcaagactacgattctcggcaagtacgaggcaacgaaccctggcggatctgtgaaggaccgtatcgcgaaggccatcctcgatgccgcagaggcagacggcaccctgaagccaggaggcacggtcatcgagccgacgagcggcaacaccggtgtcggtcttgccatgctttccgcagcgcgtggctaccatatgattctcgtgatgcctgagacgatgtccatcgagcgccgcaagcttgctgcctcctatggtgcagagatcgtcctcacgccgggcaaggatggcatgaagggcgccatcgcaaaggcagacgagctcaaggcccagacgccgggcgcaatcgttgccggccagttcgtgaatcctgcaaacccgcgtgcccactacaagacgaccggacctgagatctggcgcgacaccgaaggcaccgtcgatgcagtcgtcgcaggcgtcggcacgggcggcacgatctccggcaccgcgaagttcctgaaggagcagaaggcttccgtcaagggcatcgctgtcgagccggcagaatctgctgtgctcgagggcaagccggcaggcccccacaagattcagggcatcggtgctggcttcatcccgaagacctatgatgcctccgtcgtggacgaggtcgtgcctatcgcttcccagactgcaatcgacacgaagaagaagctctccgacgacttcggcatcctcgtcggcatctcctccggcgctgctgtcgctgccgccgtcgagcttggcaaccgtcccgagtatgctggcaagacgattgtcgcgatcatgccggataccggcgagcgctatctctccatggacctctaaagcagatatgcacagatgggggagggcagcctgcatcgcaggatgccctcccttttcttggctcgagacgtgctgctcctgttgaccggagtgcccttcgagcggtataactgtctctgaaataccgctacgcaagtatgatttagaggggccggtgctcgatgcaaagggctggcaggagacagacgggagccgccttgggccatgtgccaggcgcgctctgtatatcccgctaggtcatatcggcacgttcggcaaggaggctgccagtggctgaagctgttgcagcagcggaatgcggcattttctctggagaggcaatgaatgcagatgagaggggcttcctcgaagctccggaagatatgagccgtgaacacggcaagatcggccttatcaagatgatgaaggaggatgcacgtgcggtcgtcgcacgcgatccttcggtgtcgtctgtgcatgaggtcgtgttctttgcggcgggcctgcgtgcggtctgggcctataggcgccagcattggctgtggacccacggcatgcattcgcttgccatgtggtcgcagagccatacgcgcaagcgctatgccatcgatatccatcctgccgctacgatcggcaggcgtttcgtgatcgaccacggcatcggcatcgttatcggctccaccgccatcctgggcgatgactgcatgctctatcagggcgtgaccttgggcatgacaggacaccatgccggcaagcgccatcctaccctcggcaacaatgtgatggtcggcgcgcgtgcaacggtgctcggagcgatcacgataggggacaacgtgaaggtcggcgcgaatgcagtcgtgctcgaggatgtcccggccaatgtcacggttgcaggcatcccagcccacatcgtgaaggatcatcgctgctgggagatgccccagttctcgctcgtggacggcgaggctgcggtgaagagcctcttgggcgaggagaagggcaataccctcgacgacgatgagaacaagcgctggtcctgtgcactctgacagcttgcttgagcctcgctgaaatagtttccgtctgtttacaggtccgagacatctccggacttgcacgtaccatagccacaactcgatagtccgctgcaggggatatctgcagctatccttgaaagcgaggttccatgtctgcaaatttcaagaggcgccttcccatcccgcaggatctcaagaaggagatgccgctttccgatgagagcgccgagcgcaagaaggcagtcgacgccgaggttgcctcgatcatccgtggcgagtctgacaagaagctcatcatcgtcggcccctgctctgccgacaacgaggacgccgtgctcgactacgcgagccgtcttgccgtgctccagcagtgcgtccaggacaagctcgtcatcgtcatgcgcgtctacacgaacaagccgcgcacgaacggcacgggctacaagggccttctgcaccagcccgatcccgaaggcgctcctgacctgctcgagggcctcaaggccatccgccacatgcacctgcgcgtcatcgaggagacgggcctcttcacggctgacgagatgctctatccggagaatgaccgcttcctgaacgaccttctggcctatgtcgccgtcggcgcccgctcggtcgagaaccagcagcaccgtcttgtcgcctctggctgcgaggttcctgtcggcatgaagaacccgacgggcggttccatgtccgtgatgctgaactccgtctatgcagcccagcatccgcagaccttcatctaccgcaactgggaggtcgagacgaccggcaacccgcttgctcactgcatcctgcgcggctaccgcggcctcgacgatatcaactacccgaactaccactatgagtacctcgaacgcctcgctgctgcctacgaggagaacgagaagtaccagaatccggctgtcatcatcgacacgaaccacgacaactcgggcaagcgtcctttcgagcagatccgcatctgcaacgaggtcctcgattccgcccgcaggaacgaggccatcggcaagctcttccgtggcttcatgatcgagtcctacatcgaggacggcaaccagcctatcggcggcggcgtgtacggcaagtccatcacggatccctgcctcggctgggcaaagacgcagaacctcatcatgcacattgcagaccgcatctagcggctgtttcccaagatcttgcagggaggctggctttcgggctggcctccttttttgtgcttgggcattccgtgcatgcgctgccggaagtgcgtgttgcgggtaggataggggagcatacaagcggcagcacgcgctgccaaagacaagaaggagcatgattctatgccttgcacaacccttctgatcggcaagaaggcctcctacgacggctccacgatcgtggccaggaacgaggattcaggatcgggcagcttctgcccgaagcgctttgtcgtcgtctcgcccgaagagcagccgcgccactacgtctcgaagatcgcccatctcgcaatcgagcttcctgacaacccggagcgctacacggcactgccgaatgccatcctcgacgagggcatctgggctgaggctggcgtaaacgagagcaatgtctccatgagcgcaacggagaccctcacgacgaacgagcgcgtgctcggcgccgaccccttcgtcgtctacaagccggcaaagggcacggaaggcgaagagggctatgagcctgaggtcgcaggcggcatcggcgaggaggacatggtcacgatcgtccttccctacatcaagagcgcacgcgagggcgtgaagcgcctcggcgcccttctcgagcagtatggcacctatgagatgaacggcatcgccttctccgatgcggacgagatctggtggctcgagacggtgggcggacaccactggatcgcaaagcgcgtcccggacgatgcctatgtgacgatgccgaaccagcttggcatcgatgccttcgacttcgatgatgccttcggcgcccagaaggactacctgtgctctgccgacatgagggagttcgtggagaagaaccacctcgacctcacgctcggaggcggcctcatgaatccgcgcgatgccttcggctcgcactccgattccgaccacgtctacaacacgccgcgtgcctgggccatgcagcgcttcctcaatccccatgccctcaagtgggacggaccggatgccgatctcacgccggaagcggatgacatcccctggagccgcgtgccggagcgcaagctcacgatcgaggacgtgaagtatgtcctgtccctgcactatcagggcacgcccttcgacccctacagccgccgcggcgacgagaggcgcggcatgtatcgtcctatcggcatcaaccgcaacagccagctctctgtcgtgcagctgcgcccctatgggcctgaagcgtgccgtgctgtccagtgggtcgccttcggcagcaatgtcttcaatgcgctcgtgccgttctacacgaatgtgcggacgacgcctgcctatctcgagaagacggatgcccacgtcacgactgagtgcttctactgggagaaccgcatcattgcagcgcttgccgatgcacacttccatgatgcagcagcagatgtcgagcgctaccaggagaaggtcggcggtaggggacatgccatgctccgcgagacggatgctgccgtggagaagggcacggacgatgtccaggctgtgctcgaggcagccaaccagaagatggctgacgagctcaaggaagagacggatgcgctcctctcgaaggttctcttcttcgcaagcatgggcatgaagaacagcttctcgaaggatgacatgtaggatctttcggagagcagagaggcagtgcctgaaggcgcctgggtttatccgggcgccttttctgaaagctttctaaaaatgtatatacgagcttgcccgatataacatatctgcatcttttttggggcggtatcgaaccgcttacggaaaagtaccggccgccggctcatcgctgttcaatcttttacgcctccgaaatgaattttggccaaactaaggggcagcgaggggcgagagtcatggccggaatgaaaagaaggaggaagtgccatgtcatccgcagagaaacgctttcaatcctttatccgcaaactcgataacagcgattatgtgtatgacgtgctgaggatggggccatctcccattgtctcggtcgtcttcggagccaagccgcgctcgggccattcgaaggtcttcgagcatgtcggcaagaagcagctgcctcagctctatgtctatgccatcttttccaaggacggggaagaagtgcacttccagacgtccccgctggtgcgcgttccccagaaccagcgctcccaggcgctttcggtatgcaatgccgccaacaaccagcagcactggatcaagttcaatctgaactcctccgactacatcgtcggacactacgatcttctgctccagggccatggtgcaagcgatgcctgcgtcacgatcgctcagcgtgtggctgatgtggtcgacgagaccctgccgctcctccaaagctgccttgagcaggatgcctctgaagaggaagtcgcgtaaggaaaagtccatctgcaggagagcgctggaatccagagcatgccgaagctccggaaaccagtgcttttccatgtctcgatgctctcttggcataaaaaagatccagcagggagagggtctgctggatctcggacacgtctgtgtccctgggaatgggctccgaaacgagggggaaggaagagctaattcccatctgttggctaggattaaacacctttggcctgatggtgtcaatagtaaaccaaagaaaactttgttgcatggaggaattgcgcactgaattgtgcagcgtttccgctggctgacaggcgtgcctatgcatggcgagtaaggccctcatgcatgttcggacagggctggctcgaatatgtgccacatcgctggctgatatcaggacattctgtttcaggcaggaaaactcataggtaacgtagatgcccatctgcttgcgcgtgcgctagggtacgcatatcaagaaagcaacaggctttctttcagccagccggaaaggggatcgagatggaatgcgcttcttccaagcacgctgaagcagctctctcctctgtcggtgcagcggctgtcctcggcctacgaattaccatggccgtacctcgcatctggctatagccggcggggggaggccttctgagctgcgggaatggtagccgcagcgcttctgttgcagcagcgaggacagattgtttcagaaaagaatctcaaagttactgatacatcaaaacctgtcggttcttgcaaagctgctttccaattggtcctaagttctctagcagagcttcaaggcacaacagaaagggagaatctgttatggcaagcatctcacgtcgttcgttcctgaaggcaaccggcgcttctgccgctgcccttggcttggcagcctgcggcaactcgggctccggctcctctgactccagctcgatcaagctgggtgttctcggcccctattcgggctccgtcgcacagtacggcctggccgtccgcaatggtgtggagctctacttctcgctgaacccaaagatcaatggcaaggacgtcgagctcgacgagatggatgagaagggcgatgccaccgaggctgtcaacgcctaccagaagatggtcgagaatggcgatgtcgcaatcatcggcgacgtcacctcgacgccttccatcgctgtggcccagcagtccgtgaacgacaacatgccgctcatctctgcatctgcaacggctgctggctttgtccagtatggctccaacgccttccgtgcctgcatcaccgacccgtatcagggcaagctcatggcagacttcgctgcaaagcagggctacaagacggtcggcacgatctacaactccggcggcgactacgagaagggcgtcaacgacgcattcgtcgaggaagccggcaagaagggcatcacgatcacgacgcggcagggctatgctgacggcgacgtcgacttcaacggccagctgaccgccatcatcgctacgagccctgatgccatcttctgcccgaactactaccaggacgacggcaagatcgtcacccaggctcgccagcagggctacaagggcgtcttcatgggcgccgatggctggtccaacatcgtgggcggctccgaggagtacgcatccgctgaggacctcgagggctgctactatgactgctccttcgtctccgagaacccggacgagaaggtccagaagttcatctccgactacaaggcaaagttcaacgacgagccgtcgaacttctgcgccctcggctacgacgctgccatggtcatggccaacgccatcgagaccgtggagaaggatggcaaggccaaggctggcactgccgactactcccaggccatcatcgatgctatcgcctctggctccgttgacggcgtgaccggcacgatcaagtacgaaggcacgggcgacccggtcaagccgaccctggtcattacgttcaagggtggcgcgcaggaggtcttccagaccgtcgaggcagagtcctaagacgcaagctcatagctcagccaaaggagcgggcatccggccaaatgccgggcgcccgctcttcttgggctcgaggatacgcaggtaaacggcctgttaccattgagatactagctatagcaatttcttcttttcttcttgggcgaagctattctaaatatcgagtatttaaccattgctatgaaaggggtggtcaggcatgacactcgtcacgcagatcatgaacggtctgcagctgggcagcgtctatgcgcttgtggccctgggctacacgatggtgtacggcatcatcctgctgctcaacttcgcacacggcgacatcatcatggtcggcgcctacatctcatggattgtcatgtcccagctgggcatgcctccatttgttgctgtcgtactctctatcgcaggctgcacgctgctcggcgtactcatcgacaaggtcgcctatgcgccgcttcgcaatgcgccgcgtctgtcgatcctgatcacggccatcggcgtctcctacttcctggagaacggcgcacagctcgtcttcggcgctgacgcaaaggttgtgccttccttcatcgattccacgacagtcgagatcggcggcatgcagatctcgtcggtcgcccttcttacggtcatcgtgacggccatctcgacaatcatcctcacgcagctggtggacaggacgaagctcggcaaggccatgcgtgccgtctctgaggatatgggtgctgcacgcctcatgggcatcaatgtgaacaacacgatctccttcacgttcgctgtgggctctgcgcttgctggcatcggtgctgtcctctactcgatggcatacagccaggcgacgccgaccatgggcatcatgctcggcacgaaggccttcgttgcagcagtcctcggtggcatcggctcgattccaggcgccgtcatcggcggactcctcgtcggctttgccgaggtggctgtctctgctgtgggcctctccgtctggaaggatgctgtcgtcttcctcctgctcatcatcgtcctcatcgtgaagccgacgggcatcctcggccgtccgatgtccgagaaggtgtaggggataacaatggctgaagcaatcaacagggcgtaccgcacgctctctaccaagcagcgatacctcatcaattcgatcctggtcgttgctttcctcgcaatcggcgagctcatgatttcgggaggcgtcatctcccgctatcagacgacggtcctggagcaggtcggcatctacatcatcatggcagtatcgctgaacatcgccaccggctacctgggacagcttcctctgggccatgccggcttcatgtcggtcggcggctactcctgcgccatcttcatcatgcgcatggctgacgtcttcggtgtcggcacccgcgacttctcgacgggcacaccccaggcaatgctgctcttcgtctgcggcctcatcttcggcggcctctgcgctgcccttgccggcctcatcatcggcatcccggccctgcgcctcaagggcgactaccttgccatcgtcacgctcggcttcgctgagatcatccgtgttgtcatgctcaacatcgacgacgtcctcggcttccagctcacgggcggcgccaagggcctgacgggcatcccgtcctacacaaacttcctgaacacgttcatagtcgtcgccatatcgctcttcctgattcacacgatgatgaagagcaggcacggacgctcgatcctgtcgatccgcgacaacgagatcgccgcagagtctgtgggcgtcaacacgacgtactacaagacgctcgccttcgtcgtctctgccttcttcgccggcatcggcggcggcctctatgcaggctgcgtcggcgtcatgatgcctgccaagttcggcttcatgaagtcgatcgagatcctcgtcatggtcgtcctcggcggcatgggctccatgctcggctccgtcctctctgcgaccgtcctcacgatcctgcctgaggcgctgcgtgccttctctgactaccgcatggtcgtctacgcagtcgtcctcattgtcgtcatgatcttccgtccgcagggcctcatgggcacctacgacttctcgatgggcaatacgatcgagaagatcatgaacggccagttcccctggaagaagcagaagaaggaagaaacagtagcagaagagacgaaggaggtggcgaaagatggccgatagcccgaatgaaatcaagcgcaagcgtcagcgcgaggtgctgcttccggtaccgacgcccaacctggtcaccgagcgcgacttcggaaagccgctcgtcctcgaggtcgagcacctcggcatcgacttcggcggcctcacggcagtcgatgacttcaacattgcaatgggcccgaccgagattgccggcatcatcggtccgaacggcgccggcaagacgacgatcttcaacctcctcacgaaggtctaccagccgacccgcggcacgatccttctgaacggcgtcgataccgccggcatgaacacgatccaggtcaaccgcctcggcatcgcccgtacgttccagaacatccgcctcttcagccagatgacggtggagcagaacatccttgtcggcatgaacaactcgatgaacacctcgcttctccaggacctgctgcgcttcccggcgcactggaaggaagagaaggagttccacgacaaggcaatggatctcttgggcatcttcaacatgcagaagtatgccaatgagcttgcaggaaacctgccctatggtgcacagcgtcgcctcgagatcctgcgtgccctgggcacgaatccgaagctcctgcttctcgacgagcctgccgccggcatgaacccgaacgagaccgaagagctcatggagaacatccagaagatccgcgatgacttccagatcgccatccttctgatcgagcacgatatggctctcgtcatgggcatctgcgagattgtcggcgtcctcgactacggcaagatcatctgcaagggcacgccggaagaggtacagtccgatccgcgcgtcatcgaggcatacctcggcaagcagggtgccaaggctgccaaggaggcggtggagaaatgaccatgctgaaggttgatgaccttgaggtctactacggcgcaatccacgccgtgaaaggaatctccttcgaggtcaacgaaggcgagatcgtctccttgatcggtgccaacggcgccggcaagtcgacgaccatgaacacgattgcaggcctcatcaagccgaaggaaggcaagatcgtctacaaggacgaggacattacaggccttcctgcccacaagatcgtcgcgaagggcatggctctctgccccgagggcaggcgcgtcttctcgcatctgacggttcaggaaaacctcgagatgggcggctacttgaggacagccgcggagaacgcggacacgatggagaaggtctatacgtacttcccgcgcctgaaggagcgcaaagcccagacggccggcacgctctccggcggcgagcagcagatgcttgccatgggccgtgctctcatgagccacccgcagctcctcatgctcgacgagccttcgatgggtctggcacctatcctcgtcgacgagatcttcgacatcatcgagacgctcaacaaggtgggcacgacgattctgctcgtcgagcagaatgcccagatggccctctcgattgcagacaggggctatgtcctcgaggtcggcaatatcgtcctcacgggcaccggcaagcagctcctgaacgatcctgccgtcaagagcgcctaccttggcggctgagaccgtacagcagacagatcgagcgctacaggaaggagagcatccacgggatgctctccttccttcttgccgccgaaatgagcgtgtgagctagcggccgggtcatgaggctccatgcttctgggattcgttcatctgacttcaggatagcgggacctctggccagattcgataagccagctataggtctcgatggagcagatgtcgtaggctgcacggtgctcgccatctatcacggcatcttccttgtagtaccagatcttggcttccacctcatcgccaatcttgggctctgggccatatgtcctctcggtgtggtcgttccggatgagcatcagggtatcgcctgcctctggcagggaggagccgtccttttctgcctggactgctgctgcaccggttgcgtccgcatctgcgactctgatttcgatataggcgatgctgccatcgtcgtcggacgcatcggagacggttctgatatcttcgacggttccggcaacagtcgcgagaggcgggacatagttcgatacgccttcagcgtgggaaaagctcgctatgagagcgatttcggcgatagccaaggcagccaatgcggcagctgccaccatgaatgcctttcgcatgggagcctccggtctttggacgcaagcaaaacatgaggagaatcggtctgcgcatgagaatccgaccaagggagaagcttcttatcggacagctttcttcgcaggtacgagattgagggtgcagagataggcgaggcgcagggctttggcacgggtgtacgttctgtcagagacgcggcaggaagccttgcgccaggagatgagcatgcagcaggagaagagaaggacaaagatgatgagagcggggcctgcccagacagatgtgtccgctgccgatgcgatgagcacaagatagcctgccaggagataggcatcagctgtctctgcgaactttatcttccgcttcttcatctccggctcctcttgctggcggcagaaaaaggatattcgtagcctccttgcagggaagcgtacccgatggcgggaaagtgcggcacctggcgtgctgggtttcggccaagggaacattgctttcgggaagtgctcctgctggatggcagggcaaagccgaagtgcgcactttccggtacccaggtgctggaggcccgggctgtgcggatggcaggttttccgccgcaggcggcatattatcctgcttcgatatcgctttcatctggttagacatgtatttgttcgcaataacccatcgttcgttaagaatctgcaatacaaggttcaataattggtatatctgtacagacagataacgatgcggcgcttcttgcaggacacgccaaaaaaggtggttgccatgaagggtacgctctcggagaaagcactgcgaacatccgaagagattgtccgcgccttgtggagacaggatccagagccctgtcgtccctatgtgcatgagggcttcacctatatcggaccgagcgcggacgagtactgccttgtcccccagtcgcttgatgcctatatggaccatatgccgaaggacggcatcgaggccaagaagatctccgaggagtatttccaggtgcgcgtgcagagcccgcacgggatgcttgtgacaggacacgtgcttgcgtcgtatccgacagggccacatgaggtggccttccactgcttccgtgtcacgctgttctggaccgtcgaggacgacaggctccagcttgtgcatctccatatctcgacgccgacgtggcagagccatgggcagaggacgatgcatggagaggagcaggagggcggtaccagcacggtctccgtccgtcttcatcctgattcccatcctcttgtcatgcgcgattcctcgggtgtcgcccacttcctcgatgcagatgctgtcatctatctcgaggcagagcggcagtacacgatggtgcatacggcggagggcatcttccgcctggcaaaggtcctgggcaaggtcgcagccgagctgccgccgaatttcctgcgtgtccaccgcggcttcgtgatcaatgtcgcccatgtgcgggagatccatacgcgccagatcatcctcgatgaagggacggccattcccatgccggagcgtcgctctgtgcaggtgcgcagagaggtggaagaggcaatccgcgcgcttggaagggcatagcagctttctgtcttttgcgtttgcgcggggatgcagcagcaaagaccggcaacgccgagctttctgttcagcgttgccggtctttcgtgacctcttcgactttttcgctgctagggaaacgatgattaaagcatagctcaccaggccgaatcgcaccgcccggccttccgctgcccgccaggttgccgcgcatccggtagaaatggcactctacctgcacaaacgttataatatgggattatcgtggtggctgtgcggcgggaagggctgcgatgggcgatcagatgagcttcggcgactggtaaatcgcgatagggcgcagaggaggaagaggaagacgaggcgcgaggaagttcctgtgaggcgatggatgcgatcgtcctgggggacaggtggaccgccctcatcgaggaccaattacagctaaaaggcagcgcggcatgcatgtccgcggaagccgaggcggaatgtaggatgtacctgctctccagggcctgttcggcttcggactcgcgcacggcggatgccatctctgatcgcgcgccagcagaggttcatgcacatcggaccctcatgcgcgagaaggaggtcccggacgccacgaacgctcgcgcaaagagtcgcagagtgatacgctgacggacagacatgacgcg

SEQ ID NO: 74 - DNA, 22056 bp, Unknown
  Metagenome-assembled genome
gcgcgacatgaaccgaggtgcttcacttccttcttctgcgcgaggctctacgggagacgtgccccagcaccgcgccgagagcgccctcgaggcggcgagccgctgatggaggccgtcaaggtcgcgctcgaccccacgccccaggcaggcccgcatgctcctgtcgcatgcgggtgccgcccggttcgcatacaacgcgaaggccttgcccacgtcaaggggcagcttgaagcaaaggaagagcccacctctcgcactacgcgctcaggcgctggtggaatgccagcaaggacgtcctttgccccctggtgggccgagaactccaaggaggcctactcctacggcctcgagtgctgtcccgcgcgctcagtccttctcgactcaaagcgcggcaagcgcaaaggaaggccgtcggctttccaagttcaagagcaaggcagctcaacgcctaaattcgcctacaccgaccggctcgttcggcctcatcgacggcgaccccaagccactcaacttccgaggatagggcgcgtccactgcatggaggacgtggcacgccgggtcggaggtgcccatgtgacgacgaatgaccgttttcctgtcatgccggtcgctggttgcctccctcacgtcggacgggcggacgtgacctcttcccagcccaagggccccgcggtggggtggacctcggcgtctcccacctcgccacgctttccgcgacgggcaacagtcgtcgagaacccgaagcataccagaagagcctgagacgccgcgcaaggcacagcgcggcctctcgcgcaggcaaaggggtcaggcggtcgcgcgccaggcgtaggcaccgcgtccagcgcatccagcccccgcgtcgccagccagcgccgcgacagcctcgagaagctcacgacccacgttgccaggtagctactcggaaatctcgatcgaggacctcaacgtcgcgggaatggtgggcaagccacaacctcgcccaggccgtcgagacgcctcgttcggcgagttccgccgcgagctcgagtacaagtgcgtacgcacgggcaccaccatacacgttcatagaccgttggtacccaagcagcaagacatgctctcgggatgcggggcagtgaaagccagctgccccctcccgtgcgcacgtaaccagctgtgaggcctgcggtctcgtcatcgaccgcgacctgaacgccgcgatcaactcatggtcgccgggagtgccccggagaccctaaacgcgcgtggaggggacgtgagaccggaggaccccatggtcccgggcagagcccacgaagcgcgaaccgggcgggcgcacagcgccgcaaggcccggagctggcggaggcaaccccccatgcaagctggaacaactagttttgcaacggcgtatgccaagctccctgaaatgacgtccggcgatgcgtgcctgggcatggccgcgttcggtcagaggcgaggtcgcaccagccctggttcttgtggcggacattgaagagcgtctcgccgtgccgcatgagatagagcgccttcatgtctgtcttattctcctggatgggtcctggcctgagcatagcaggagccggatgctctgtctgacacacggctttcaggtggcttctgcctgcgttcagcctggttttcatcctcttcaaatgtctcgagcaattgtgctgctgtctgcattgtcgatgccacaagcgtccaggcaggcgtgacacgcggtatatctaggccaaccaatcgagctttatggaatggaagggtccgtcatgaagcgaccgagcagcctcgaaggcgtttctgtgcagacaggacggaaggcgttccggaaagatctcgcacgagttggtgcattcgcgctgacaggcgtcctcgtcttctcgtctgcgcctctgtaggcctttgcagaaggggcacctgccgcaccgagcggacagtcccagccgggcgagccgctgacggcgggctggcggcatgggccagggtgccggagccgatacgatggcctacgactacacagggacgctttccggcatcctcgtcgctgacggcacggagagcgactcgaccagcacgaccgtgagcacggcgaaggatgtgaatgctgcgcttgtccagaatgcggcacgctcacctgatgctgcgacgctccaaagtcgggtgacgatacggatggagactcctgcaaacttctacggcgtgaactcgatcctgcttgctgtgggcgaaagatcgactgccacggtgcagagaagcaccgctttactacctcctgggtcgaacggcatctttgcaccgatggtcgaccgtccttgcctacaggatgagatcgcgacacacggcaggcaactcgcgcggtctcgatgcacctatggaggtaagatcctggcgtcggagctctcgatctcgaccgaaggcgaccattgcgccgcgcttgcaacaaccgcggcgcggcacgtctcggtcacggcctcagatctttcgacggcaggctccggctcgcctctctgctctattcgacgggcgatgtcgaggtctcgggcgtcacgggaaccgccaccggctcgcagatctccggcatggaaggcctcaacacgatcctcatcgaggactcggacctcacgagcacgatgacagaagcgacagcgtccgaccccatggcagatgccgtgatcatctaccagtcgacctcaggcgatgcggagagcacgacagcgagacagccaagtttcagcagcggactgacgccgctctcgagctcgatccagtcaggctccttcttctatctgacgaacacgtcggccgatatcgtgctttgaacacgacgctcgattttgactccgacgcggcggcgctgctgacagcagagggcacagctcgaacaattggggcagtgccggctcgaatggtgcgacggtgcgcttcacccgctatcggcgagacgctttccggaaagatctctgcagacacgatcagctcggctgacgtctatctgacgcggcggcacgacatggaccggtgcggcggacatcgagcagagctctgccgctcgacatccgagacgcctctttcggtttcagtcgatgggacctcttcctccgtgacagcagactcgacgttctcgaacctcacgcttgcagatggtgccaccgttgtggacagctcgggaaacgacgtccagatcgtcgatgcttccgcaaggtgctcagatccggcacctctgatgtgatcgtgacggtcgaagggagctatggcacggcctacgatgcctcctctgctggcacgcttgcgacgagcacggcagaccgcagcgccttcgatgaggcttttcggtaccgatacatccttcacgatgggcgaaggcttcactcaggcaagcgataccgaagacacatcggcttcttccgaggcgcttctgatgccgcatccagcacggagagcacgcaggcaagcccttcgtggtgggacagcatcgtgaacttcttcagagcatcttcggatagaaagactgcacggccctgaggcttctctcggggccgtgctctgtgcgaggatgcccgatccaagcacgcgcacgagcgcctcggcatcctcgtctttcgtggcccggcttgtcgcagacacacaatcgtgtgatgctcgtctggcttctcccgcgaagcttgcaagcgccacttcgccgagacgctttgcctgggagttggaaggatgggaagacctggttcgtctcggtcggatgggcaagcgcgatgccggcatcttcgaaggcatgagagatctcgtgcgcgtgggcgatggcaggcctgccgatgcgctcatagagcccatcctcgaagaaggcctcgaattggacgccgagcagacgtcccttggcaaggcgggctccttgctgctgcttcacgaacgtgaagaagtgggggacaagctcaggcttcgggaagacaagcgcctcgccgaagagcgcaccgcacttcgtgccgccgataaagaaggcatcggtgagatgtgcggggtcttcgagctgttcatcgttttccggtgcagcaagggcataggcaaggcgtgcgccgtcgcagcagatcttgagatggcgggcatctgcgaccgaacgcagcgcctcgagccctgccttcgtatagatagccatactcgtctggctgggagatgagatgagtgccggctggaccatgtggccacgtttgccatccttctcccagagcctcatgatgatcgacatcccctgctgcaagcttgccgtcgtggccggggatttgcgggcaccttgtgtcgcctgcttcgatagcgcctgcctcatgcacggcgatgcgtcccgaggtggcgcagatgacgccctcccagggagcaggcagggcacagatcgcgacctcgttcgtctgcgtgccgccgacgaggaagaagacctgcggcggagggcgccttgcaggcactctttatgagctgctgcgcatggaggctgtgctcgtcgagtccatagcctgcgctcttctcgtggttcgttgccacgagacggtccatgatggcatcggcaaagccctcgagataatcggaagagaaatcgagcttctcctttgcggcctgcgatgcttcccgctcatgggtgcgctctgctagatcgtgtggcgggcggtctgaaaggcggcaatacggagatggaccagtggctcaacgccacgcggccgatctctgcttctgcgcaaagctggcgcggggcacctgctacgactggaaggcactctatagggatgagatggtcatgtggctgccgaaggaccatcctctggcaggggctgcgagctatccgatccggaatctcgagcacgaggcattcatccatgcgcttgccgaccatgatacggaccaggaccggctgatccgcgaggaggcgctccacatcgaggaccgctatgagacgaccgatggcttcacgacctgcagcatggtctaggcaggactcggcgtgagcttcaaccagcgtcctcatcagcagaaatggcgggagccgtggcagaggtccccttcgaggagccacactatatctctctcgcctcgctgtgccatctcttgctgaagcctctcctgcagcacagcgcttcattgcctgcatcgagggcctcatgccgcgcctggcagcccttgcccaagctcctgcctgagctttctgcatagccaaggaccttctctctccgttcgcggagccttacagaaagctgcacatggataagccgctttcctcgagaatggcaggtgcctcatggtgggggcatgctgcattgcgaatattgtgaggcttgccgtatcatttgacagatgcaggcagagcgtctgagggggcctcagcctgcatcatagccaggaaggcgtctggccatccatatgcagggagcgattcctgccacgaagaggggttctgctgtgggatatgtgctcacgcgggatggattcgacagctcatagcgaagctcggcgaaacctatcgcatctatgctccggtgctcaagaaggagaggacgcttaaccgacgtcgatgtcgtgcgctatgacttcgtggcgtccggctccgagatgagctcgagaagaagaccgactatccggcgaaggagtcctgagcccgctgtcagagacgctcttacttcacggaggattccgtcaaggaacagattcgatccgcgcgacgtgatcgtgttcctgcgtgcctgcgacctccacggcgtccgtcgtctcgaccagatctatctcgacaacggtccctcgaaggactacttctacaagcgcatccgcgaccacgtgcactttgccctcatcggctgcacgaagagctttgcaactgcttctgcgtcgatatgggcacgaatgtggcgcccgtgggctggatgttctcagtcgaggaagcagggacaagatcctttccgctgtggcagacaaggacctggacccatcttcgctgcctgcgcagaagaagaggagagcgtcacaccggcttccgtcacggagaacgaggtgcatgtgacacgccccgaaacggtgccgaatgcgatctatcgctccgacatgtggaacgagtacacggaccgctgcatcgagtgcggccgctgcacgatcgccctgcccgacctgctcctgctacacgatgcaggatgtgttctatacagagaaacggccgtgtcggcgagagcggccgtgtgcaggcaagctgcatgatcgacggctactccgtgtcgcggcggcggctcctacagaaagaccgcggcgagcgcatgcgcttcaaggtgctctcacaaggtctatgacttcaggcgccgcttcggctacgacatgtgtgtggctgcgtcgctgcgacgatacttcccggaatacatcagctttgctgctgcgtgaacaagcctcatatgctgcctgcgaagcctacgagaaggaagaggaggcgaaggagaatgcctagccagaacggtgacgttcgacgctgtgaacgcggcggcgcgtgaacccctacatccccttctcgtcagagatcctcgatgtgatcaagcacacgaagaaggaatacacgttcaggatggcatatgagggagaggtccccgggcccagttctttcgaggtatccgtcccgaagttcggcgaggcaccgatctctgtctccggcatcgtgcctggcagagtccatcgacctcacgatccgccgtgtcggcagggtcacgaacgaggtcttcgagactattgtgggccagaactcttcctgccgggcccttcggcaatggcttcgatgtaagcctctaccagacaggcgggtcgtcgtcgttgccggcggcccgggcgtctctctctccggtccgtggcgtcatcgactctctttgcctcctctccgacccagagaacaagtacgtgatcgtcggcttcaagagcccggacgatatgcttttccgtgacgaccttgcccgctgggacaaggcgctgaacctgacgctcacagtcgacggggcgcctgaaggcgacgagggcaatatcggccttgtccgaagtaacatcccggacctgcctctcaaggacccgaagacagcccagcgcctccgtcggtcctcctcccatgatgcgcttctcgatcaagggcttgcttgagctcggctttgccgaggaagaacatctgggtcagccaggaaaggcgcatgtgctgtggccttttggcaagtgcggacactgccgcacggcgagcactattcctggccgtcgatggcaccgcattaccgaactcctcggcaatctccacaattcctggccatgctctttgaccgagacgagcagcccgcggatgcggagtaaggcttgccgtctcgccgcggaccttgcgtagcggaaggcattattcttgagcgccttgacatgtcgtcctgcataatgcgtcctcctaatccagcagtccttgagacacggtaataagttgaagaccgggcatcgaggcagaccttagttgctcgccgatgcggcagtgtcacgcactttccaggccacagcacatgccctttcctggctggacccgatgtttcgctggcaaagccgagtctcaagcaagccttgatcgaagaacgagcatctgggaggaggaccgacgacacggcctggctgtcttcgggtccttgagaggcagtccggtgttgtatcttcgtgaccaaggccgatattgcctcgtagccttcaggcgcccgtcgacacgttgtggcgcaggtttcagcgccttgctcccatctggcaaggtcgtcacggaaaagcaatcgtccgggccttgaagccgaacgataacagtacttgtttctgggtagggaaggagcaaaggagtcgatgacgccacggaccggcaagacgacgccgtgccgccggcaacgacgacgactcgccttgtctggttaagaggcttacaatcgagccattgccgaagggcccgcgagcggaagagcttctggcccacatagttctcgagacctcgttcgtgacctgccggacacggcggatcgtgaggtccgtggacttgccagcacgatgccggagacagagatcggtgctcgccgaacttcgggacggactacctcgaagaactggacccgggcgacctctccatcatatgccatccttgaacgtgtattccttcttcgtgtggcttgatcacatcgaggaatctgacgagaggggatgtaggtggttcacggccgcacgtcacaggcgtcgaacgtcacgtctggctaggcacttctcctcgcctcctcttccttctcgtaggcttcgcagccagcattgagcattgttcacgcagggcagcaaagcctgatgtatttccgggcagatatcgtccagcgaccgcaagccgaacacactgtcgtaccgaagcggcgcctgaaggtcatagaactgtgaaagcacctttgagcgcatgcgctcgccagcggtctttctgtaaggagccgcccctgcgacatcggagtagccgtcgacatgcagcttgactgccacgggcctctcgccgacacggccgttctcgttatgaacacatcctgcatcgtgttagaaggagcatggtcgggcaggcgatagtggcagacgccggcactcgagtcagcggtcgtggtctagttccacatgtcggagcgatagatcgcattcggcaccgtctcgggtggcggtcaatatgcacctcgttctccgtgacggaagccggtgtggacgtcatttccttctcggcgcagggcagcgaagatggggtccaggtccttgtctgccaacagcggaaaggatcttgtcccctgtcttcctacgactgaaacatcccatcccagggcgcccttcgtgcccatatcgacgcaaagcagcttgcaaaagctcttcgtggccagccgatggaggtgcaaacgtcaccgtggtcgcgatcgctgctagcaattagtccttcgagggaccgttgtcgagatagattggtcgagacgacggacgcagtggaggtcgcaggcaccgcaggacacgatcacgtcgacgcgcggatcgaatctgccttccttgacggaatcctccgtgaagtagaagagcgtcttgacgcgggctcatggcctaccttcgccggatagtcggtcttcttctcgagctccagctccggagccggacggccacgaagtccatagcgcacgacatctacgtcggtgaagcgtcctctcaccattcttggcaccggagcatagtatggcgctagggttctgcgagctcgctatgagctcgtcgatccagtcccgcgtgagccacatatccacagcgaacccctctcctcgtggcgcaggaatcgctcctgcatatggatgatgtgccgacgcctcctggctaatgcatgcaggatcgaggcccctcacgaacctctgcctgcatctgtcaatgatacggcagcctcacatattcgcaatccatgcccacaagaggcacctgccattctcgcaggaaagcgggcttatccattgtgctcagcttctgtaagcctccgcgaacggagagaatggtctcttggctttatgcagaaagctcaggcaggagcttgggcacagggctccaggcgcgggcatgaggccctcgatgcaggcaaatgaagtcgctgtgctgcaggagaggcttagcagagatggcacagcgatgcgagagagattatagtgtggctcctcgaaagggaccttctgccacggctcccgcccattcctgctgatgagacgcgggaagctcacgccgagtcgctgcactagaccatggctgcaggtcgtgaagccatcggtcgttcattagcggtctcgatgtggagtcgcctcctcgcggattcagccggtcctggtcctgtatcatgcggcagcgcaatggatgaatgccctctgttgctcgagattccggatcggatagctcgcagacccctgccagaggatgtgtccttcggcagcacatgtaccatctcatcctctataaggtgcttacagttcgtagcagggccccgccgccagctttgcagaagagcagagatcggccgcgggcttgttgagccactggtccattccgtattgccgccttccagaccgcccgcccacacgatctatgcagagcgcacccatacgggaagcatcgcaggccgcaaacggagaagctcattctcttcgattttatctcgtaaggggcttgccggaacgtgcccagcatggacccgtctcgtgcactaaccacgagaagagcgcaggctatggactcgacgagcacagcctccatgcgcagcagctcataaagagtgcctgcaaggcgccctccgccgaggtcttcttcctcgtcggcggcacgcagacgaacgaggtcgcgatctgtgccctgcctgctccctgggagggcgtcatctgcgccacctcgggacgcatcgccgtgcatgaggcaggcgctatcgaagcaggcgaccacaaggtgcccgcaatccccggccacgacggcaagcttgcagcaggggatgtcgacgaattcatgaggctctgggagaaggatggcaaccgtggccacatggtccagccggcactcatctgcatctcccagccagacgagtatggcctcatctatacgaaggcagggctcgaggcgctgcgttcggtcgcagatgcccgccatctcaagatctgctgcgacggcgcacgccttgcctatgcccttgctgcaccggaaaacgatgacacgctcgaagaccccgcacatctcaccgatgccttctttatcggcggcacgaagtgcggtgcgctcttcggcgaggcgcttgtcttcccgaagcctgagcttgtcccccacttcttcacgttcgtgaagcagcaaggagcccgccttgccaagggacgtctgctcggcgtccaattcgaggccttcttcgaggatgggctctatgagcgcatcggcaggcctgccatcgcccacgcgcacgagatctctcatgccttcgaagatgccggcatcgcgcttgcccatccgaccgagacgaaccaggtcttccccatcctctccaactcccaggcaaagcgtctcggcgaagtggcgcttgcaagcttccgggagaagccagacgagcatcacacgattgtgtgtctcgcgacaagccgggccacgaaagacgaggatgccgaggcgctcgtgcgcgtgcttggatcgggcatcctcgcacagcagcacggccccgagagaagcctcagggccgtgcagtctttcctatccgaagatgctcttgaagaagttcacgatgctgtcccaccacgaagggcttgcctgcgtgctctccgtgctggatgcggcatcagaagccgcctcggaagaagccgatgtgtcttcggtatcgcttgcctgagtgacgccttcgcccatcgtgaaggatgtatcggtaccgaatgcctcatcgaaggcgctgcggtctgccgtgctcgtcgcaagcgtgccagcagaggaggcatcgtaggccgtgccatagctcccttcgaccgtcacgatcacatcagaggtgccggatctgagcaccttgccggaagcatcgacgatctggacgtcgtttcccgagctgtccacaacggtggcaccatctgcaagcgtgaggttcgagaccgtcgagtctgctgtcacggcccaggaagaggtcccatcgactgaaaccgaaagaggcgtctcggatgtcgagccggcagagctctgctcgatgtccgccgcaccggtccatgtcgtgccgccggtcagatagacgtcagccgagctgatcgtgtctgcagagatctttccggaaagcgtctcgccgatagcggtgaagcgcaccgtcgcaccattcgagccggcactgccccaattgttcgagctgttgccctctgctgtcagcagcgccgccgcgtcggagtcaaaatcgagcgtcgtgttcgaaagcacgatatcggccgacgtgttcgtcagatagaagaaggagcctgactggatcgagctcgagagcgtcgagtccgctgcctgaaacttggctgtctcgcctgtcgtgctctccgcatcgcctgaggtcgactggtagatgatcacggcatctgccatggggtcggacgctgtcgcttctgtcatcgtgctcgtgaggtccgagtcctcgatgaggatcgtgttgaggccttccatgccggagatctgcgagccggtggcggttcccgtgacgcccgagacctcgacatcgcccgtcgaatagagcagaggcgagccggagcctgccgtcgaaagatctgaggccgtgaccgagaccgtgccgccgccgcggtctgttgcaagcgcggcgcaatggtcgccttcggtcgagatcgagagctccgacgccaggatcttacctccataggtagcatcgagaccgcgcgagttgcctgccgtcgtcgcgatctcatcctgataggcaaggacggtcgcaccatcggttgcaaagatgccgttcgacccctcggaggtagtcgaaagcgtgcttctctgcaccgtggcagtcgatctttcgcccacagcaagcaggatcgagttcacgccgtagaagttgcaggagtctccatccgtatcgtcacccgacttctggagcgtcgcagcatcaagcgtgagcgtgccgccattctggacaagcgcagcattcacatccttcgccgtgctcacggtcgtgctggtcgagtcgctctccgtgccgtcagcgacgaggatgccggaaagcgtccctgtgtagtcgtaggccatcgtatcggctccggcaccctggcccatgccgccagcgccgcctgtcagcggctcgcccggctgggactgtccgctcggtgcggcaggtgccccttctgcaaaggcatacagaggcgcagacgagaagacgaggacgcctgtcagcgcgaatgcaccaactcgtgcgagatctttccggaacgccttccgtcctgtctgcacagacacgccttcgaggctgctcggtcgcttcatgacggaccccttccattccataaagctcgattgctgttggcctagatataccgcgtgtcacgcctgcctggacgcttgtgggcatcgacaatgcagacagcgcacaatgcttcgagacatttgaagagagatgaaaaccaggctgaacgcaggcagaagcgcacctgaaagccgtgtgctcagacagagcatccggctcctgctatgctcaggccaggacccattccaggagaaagacagaccatgaaggcgctctatctcatgcggcacggcgagacgctcttcaatgtccgccacaagaaccagggctggtgcgactcgcctctgaccgaacgcggccatgcccaggcacgcatcgccggacgtcatttcagggagcttggcatacgccgttgcaaactagtttgttccagcttgcatggcggggttgcctccgccagctccgggccttgcggcgcttgtgcgcccgcccggttcgcgcttcgctgggctctgcctcgggaccatggggtcctcggtctcacgtcccctccacgcgcgtttagggtctccggggcactcccggcgaccatgatgttgatcgcggcgttcaggtcgcggtcgaggacgagaccgcaggcctcccacggtacgtgcgcacgagaggggcagcttggctttcactgccccgcatcccgacatgtcttgcggcttgggtaccacggtctatgacgtgtatggtggtgcccgtgcgtgcacttgtactcgagctcgcggcggaactcgccgaacgaggcgtcctcgacggcctgggcgaggttgtggcttgccaccattcccgcgacgttgaggtcctcgattgagatttccgagtagctcctggcaaggtggttcgtgagcttctcgaggctgtcgcggcgctggctggcgacgcgggcctggatgcgctggacgcggtgcctcgccctggcgcgacgccctgaccccctctgcctgcacgcgagaggtcgcgctgggccttgcgagcctgcgaagcgatgctggtagcgcctgggattcccgatgaccgtgccgtcggaaagcgtggcgaggtgggagccgccgaggtccacccccaccgcggggcccttggctgggaagaggtcacgtccgcccctcgaccgtgagggaggcaaaccagcgaccggcatgacagaaaacggtcttttcgcgtcacatgggcacctccgacccggcgtgccacgtcctccatgcagtggacgcgccctatcctcggaagtctgagggccttggggtcgccgtcgatgaggccgaacgagccggtcgtgtaggcgaatttaggcgttgagcttgccttgctcttgaacttgggaaagccgacggccttccctttgcgcttgccgcgcttttagtcgaggaaggacctgagcgcgcgggacaggcactcgagccgtaggagtaggcctccttggagttctcggcccaccagggggcaaggacgtccttgctggcattccaccagccgccgagcgcgtagtgcgagaggtcgggcctttcctttgcttcagctgccccttgacgtgggcaaggcctgcgttgtatgcgaaccgggcggcacccgctgcgacaggagcatcgggcctgcctgggcgtggggtcgagcgcgaccttgacggcctcaatcatcgcggctccccctcaccctccccctgcccgtctcccttcctcctccgcaaggaagtgagcactctgtcatgtcgcgcacaaggtcgtcgtcgagctccgtgtcgtccaccacgacgacgcgccgtccctgggccgcgagcgcgctctcgacgaggcccgcgttcatgcggacaggcgttctctgtgctccacgatgatggtggtgacggtggggtccgcgaggaggcggctgagcttgcgcctcttgtcgttcatgccgttcccgatctctgacacaacctcgggatcccccactcccatggagaggcaaaggccttcaggcgatcggcctgcctcacgaggtcggacttctggtcagatgagctaacgcgggcgtagcagacggtgcgacccgctgaggcaggcgtggaaccaagctcgtacttcgggtcatgcacggccagacgccggtcgccgtcttctcgacgggcaccggcatcttgccctcgcgccaaccacggttccacacggtttgttcgttgaggccctctcgctcggcccattccctggctctcatagagcaaagaatagcagattcaaacaatctatcgcaagccaaccgactagcagattgttaccccattgccgagcttccttccatctttgccgcccggaaggcctccgttgcgcttgcaggaaagctggcctccgagctcgggcatgcaaaggcagaggaagggacgctccagcttgcaccggagcatgcgcaggatatcaagcttcaggatgtcttctttgcctatgaggaaggaaatcctgtcctcagaggcatcgcggccgagtttgaggccgggaaatgctacaccgtggtcggtgcttcaggttcgggcaaatccaccctcctctcccttctcatgggtgcacgcagggattatgaggggaaggtcacattcgatggatccgagttccacgacgtcagcctcgattccctctatgggaccgagtcgctcgtgagccagaagacctttctcttcgatgccagcctgaaggacaacatcacgatgttcggagatgcagacgcagaagctctctcctctgccatagaacaggcgggactcaaggacttcgtggcagcgcatggcctcgactacgcatgcggcgaggaaggcgcgaacctctcgggtggcgagcgccagcgtgtctgcatagcaagagcattgctccatggagcgcgtacgcttctcttcgatgaggcgacctctgccttggaccagaaggctgcagaccaggtcacgagagcggtcttgagcctttctgcgacgacgagagtcatggtgacacacaggctcgatgcggggcttctcaggggctttggcggcatcatggtgctcaaggacggaaaggtttgcgagtccggcaccttcgacgagctcatggcagagccagacggctacttccatgccctctataccatcggcatctgattacgagaccctacacagagacgaagcgccatcggaacagcggctccggtggcgcttcttgtatgcagcctctagatatgaatgaagccaggacgtgatgtcctggctcgcagaattcatggtggagacgatggggatcgaacccacgacctcaggcttgcaaagcccgcgctctcccagctgagctacgtccccgaataataaccgccccaacggcgactcggctagcgttggggcgactattcgcgaaggaagtggtgggcccgacaaggttcgaacttgtgacctcccggttatcagccggacgctctgaccaactgagctacgggcccaacgcgagaaaatatattatgctcatcccccctctccgtcaacaactattttgagaaaagttgagaaagtttgtagcaggtcttctgcctgcagttttgtgtggaatcaatcttgaatggggcaaggtacgggcgctaaacctcttcttgtcaaggacagggcgatgcctcgtccttccatcttctgtcagtgcagacttgtggaaatggcaaatcgcaccatttgatcaaggggtttggacagggatctcggaagcgagacagagcaggtcgagttcaagaagtcgacttccggagcttcgggaagggatggagtctattgcatccatcctcaactagcatgaatcgggacagctctatttcggtgttcgtccggacgaagaagtcatcgagcagaaagagtccgaaaagacgctgcggcaggtcagccgagccataggcaaccgtatccggcctgtcatccatccccttgtcgaggagcttgaagatggagacggcctacatacattcacattgcctcctcgggacaagagcagccatattcctgcgatgggcgctatcgcatacgagttgctgatgaggacctcatcatgtcgggagatcagctcggacgcatgcatctcgagcgtgcggccaaacttcgcccttgggacgaatggccttccggcagatatatagaggatgtagacgaggcagccctttgggattttgtcgagcgcggcagacagaacggaagaatcctctcaaagttcgagacatccgtagatgtccttgaagccttcggactcatgagcggagccgaacttaccaatgctgccgctgtccttttctgcccttcgcaggacgtgcgtctcaagatggcagtattcgagaaccatgctaggaccgaggtgctcgacctccagcaggtacagggtaccgttttctcgctcatagatgctgcagagcgctacgttctcgcaaacacacgacggcggctgatcatcaaggatggagaaccgcgcgaagaagtgcccgaaatccccagacaggcagtgcgagaggctgtcaccaatgcattcgcccatatggattggacgcttggcggagcggtgcttgtggagatctatcacgatgatatcgagatcgacagccccggctggttcatcgaaggtcagaatcccgacgagcatctcagcgggcttagcagatcttcccggacacgcaactcgctcatagctcgtaccctctaccgttctggagatatcgaatcggaaggtacgggcattccgcgaatcaagatgctttgcgatgaagcaggcatacggatcgagtatgtccatacaccagacggtgcacggctcataatgcgtcgagatgacgccttcatggaggaatcccctatagaatccgcctctgaggatgcggggactgaagataccgcgacagacacgccacattcacagcatgatgtgacaccagctgtcgcgacttggcgcgacttggcgcgacttggcaatgcagtgggacaccctctcaaagcgtgacaaggattttttggaataccttgcagggcatggtccgtcacgcactgccgatatcgccaagacagaaggtgtatcgcagcgaactgtgcagcgggtcgccaagcagctgctcaataagggtctggtcatacgtcagggcaaagcaaatgaaagccgttatgtcctcgcacatgaaagcgataatggtaatgataatcgcatcggctgaaatacctatacagagatagcgtcggttctatagaacatggcgcggggtggcgagccacctatgccaacctccggcttattgctgctgtcagactcaatctgcgcccgctccaggcatagtcacagaaaggaatcattttcgcagcttgaaattgaggcagcatgtccagttcaatgccacttcagtcaccatctccgcatttttgccattacctcttggcaaaggcgtcgagacgggtaccatatgcacgcaaagaagcatgtgagcgaggctggtagcatggcattgatacagatggacatacagacgatcgtggtaggcggaggccctgtggcttcccttctggtcctgaagccccgcattcccgaagaggcccctcatgacgcacagctgccgatcaagatcggtcctgtggaagccatggccatcggggtgggtgtgaacgactcccaccgcacaacagacaggccgatgacgcacgaccttctcaacaatgtcatcgaatccctcggcgcccatctcgattctgtcatcatcagcgcggtctccggcacgaccttcttcgcccagctgaggatcgagaaggaagacggagaggccatcttcatcgattcgagaccgtccgatgccatcgcccttgccgtacgcacgggcgcccccatctacgccaggagcgacgtcctgaccactgcctcctaccccgacttcaagggtgtggagaaggaagaggaagagcacgagatggaggagttccacaagttcgtggagaacctctcgcctgatgacttcgcaaacgacagcaacggcagcgcaaagtagtgcttggctgcatatcatgacactgctccagacaggtgacaccgattcctgtctggggcatttcttttagcctttgcagcaccattcgaacgatggctggtcgatcggggctattgcttcttctttatcatgtcgcgcaggccacgggccggcgctgtgatacagcgccccacgtggaacgatgttgtggaatgttcgaacccctctatcgccgtctctttgagctctacttgatgctccagctcggcaatacgccgattgactcgtcaatctcgctgtgcagcttggcattctccatccgtacgcgcgatgcatgatcttcgcagccatcgtcctgatcttgaggtctgcatagtgagcgaagacaagctccgtcagaggaagatggagatgtcctggatgcgctgctgatgccaggggctctcgagcgacgagatatctgcatctaccagatcgagctcctgaagtccacccttcttcatcttgttggctatggttgcgaagccctcaagagatcgggcaacctccaagttggcaatgacgcgatagctgcccagctgatataggaatcgtgggtagactcccaagtcccctgctccttcatgtgatccctcaaggctatagcgcctcatagaattcgagaggatacctgtcgcttgtagccattgcgctgttggcatgtttgatgcgaaacctatgcagatattcgtcaagcaaagcaatgcggcgcgcttccgtcaggcgcgcaggtaaagagaaggtctgccgtcctatggagaggctggaagacgattgcgttcatggacataggaagctctgacagcttgttgtgaacccagttctggaatgagttgaggatgcgtttgggccactcatgcggatcgaagacatcgatctcctcaggcagccattcgcgcatgtaggagcagccaatcggcagccctcgcctgtcacgtcattcagcgtgaagtacggaaaatcacgaggtcggcatcggtgttttcgcctctggcaatggcatgctcaagaagctgtggctccataaggtcatctgcatcgaggaatagagccacttgccagtttgcggcacaaagcctttcctgacgtgcagacccttcccctgccgtcttctcttcaaggacctgtatgcggctgtcttctgcagctgcctgctccaggatatctcgggtggcatccgtcgagttgttgtcgacacagatgatctcgatatcacgttccgtctgattccgggcactcatgagcgtgtcggggagatacttctcgcgttatagcagggaatgatgattgagccttgggcatgttgctctcctccgatcgaaacgtcatttccctcataatgcaaactagggtatttgaatgcagcgtgaatttacagatagcaatgggcggacggaaaaggccaggccgcgcaagtccgtactgttcggacaacgatgccagccagccttcaccagcatccctatttcagctgtcttttccaccatgattgatgctgctgataccaggcatagtctcagatagcccctcttcgaagctagtatggagtggcttccacccagctctctttgaatcttcgaagcatcgagtgcatatctcagatcatggccgggacggtccgaaactgactcgaaccaatcctcgtctttccccatcatgtgcaggatatcctgaagcacctcagagattgcttcttttctccttcagcccctatcagataggtttctccgctctgccccgcgcataattgcccatatggctgtcacatgatcttccacatatatccagtcccggacattcctcccgtcgccatacagctgcggcttctcgcccgagagaatcctgcttatctgtctggtatgaattctctcgatgtgctgatatggcccgtagttgttcgagcaattcgagatggttgtatagagcccatatgttctgtgccaggcacgtacaagcatgtctgcagatgcttttgacgcctgtagggagaagacggggataggggctctcttccgtgaacctgtcctcgctttcgtaaggaaggtctccatcacctcatcggttgagtacctggtgaaaccggacgacgccttcttcgctgcctcctgcagcaggcaataggtcccctcaatattcgtcttgatgaaaggcccgggttctgaaatggaattgtcgttgtggctctcggctgcaaaattgacaatcgcatcatgtccaggccctacaccataagaaggcctctgtcacagatatcgccgactacgagctcgacctgcgtggacggcagtccaacgagattgtccaccgatcccgcataggtaagcttgtccagaacagtcacatgagtctcgggatggttcctggctacccagtgcacgaaattcgtgccaatgagccacacccccggtcaccagagtattgtgcgggccttgcgtctccattgaacgtcctctctcctattcagccttccctatacggtagcatagccatcttgcaatagtgtgagcatcacacccctcaacctcttgccgccctggcgccaccgtaccccacccatcatgctaaaaccgcgtatttaaagtatctgacagtcatagataatgagggccgccagacctacgccgactgcggaaactcgcatcggccatgagcatattggcggaccacccttgcagtctcgggccacctgtcccggggcctggttgacccgaacagtgaacataccatttgaggtagctctgcatgttggacatcgacatccccgtgaaagcgccagagtatctcttcagccaggagcagaggttgtgttcacgagctccatgctctcgaggtattcggggtcccgccacatctgccttgtaggattcggaacgctccggcatcccgatgattccgttgtgtgcgcgctccctgtcatgcacgacgcagcgccctcggctatgtggccgccgaatcgtccttcatcctcttcgtggagggcttcccgtgcccgcataccacggcgtatgc

SEQ ID NO: 75 - DNA, 31944 bp, Unknown
  Metagenome-assembled genome
gcaccggtccctgccggcacagagcccgagctcaaggtccacgaggcgggcagatggcttgcccacagatctttttctgtggactggctcgaggccgaccgctccctcgtgaatgccatcggccttgcgtgggaagacatcatccaggcagaacagttctaaggagaccttatggatgatacgatggccggcactgagacaccggcgtctatagtcggtccaagctcgacgaatgaccccagaaatgcaaagtcaggtccggtagctctgatcatcgcaggagccgtcgtcctctgcctcatggcagcagcgacgagctgcgctgctggcctctcaggcctcatctaccgctatctttcgagctatgagtcgtacagcagctcctcttccggcctcggcaatggctacggctacaacgacgaatacggcttgggagatggctccggcagcaacggcctgggctcgaactccggctccgatgaatactggtatccgatccgctagatagcttcatttgagaaaggagcctgcccatgagcaaggccgatgacctcttcatcgcgatgtgccgcgatatcctggacaatggcacgacgaccgaaggacagaaggtgcgcccccactgggaggacggcactcctgcctacacgatcaagcgcttcggcgtctgcaaccgctacgacctgagaaaggaattcccggcactcacgctcaggcgcacggcgctcaagagcgcgatggacgagatcctctggatctaccagaagaagtcgaacaacatccatgacctgcactcgcacatctgggacgagtgggcggacgaggaaggctcgatcggcaaggcctatggctatcagatcggccaggtctcggagtatcccgaaggcaggttcgaccagatggaccgtgtcctctatgacctgaagcacaatccgtactcccggcggatcatgacaaacatgtacaacttccaggacctgcacgagatgcatctctacccctgcgcctataacgcgatctacaacgtgacgcaggacaagggctccgaccgcccgacgctcaacatggtgctcgtgcagcgcagccaggatgtcctggcggcgaacaactggaatgtctgccagtatgccatcctgctcatgatggtggcgcaggtgtgcgatatggaggcaggcgagctcgtccacatgattgccgatgcccatatctatgacaggcatgtgccgatgatcgaggagctcatctcccgtccgacctatcctgcaccgaaggtcacgctcaaccccgacgtgcatgacttctatgccttcacgacggacgacctgatcgtcgaggactaccagcatggtcctcagataaagaacatccctatcgctatctaggagcgcgcatgagagcaatcgtcgctgtctgctctgactggggcatcggaaacaagggcaggctgcttgtccgcaacaaggccgacatgcaccacttcgtcgcctgcacgacagggggcaccgtcgttatgggccgccgcacgctcgagagcttcccgggaggccgccccctcaagaaccgccgcaacatcgtcctcacgcatggcggaacgacgctcgatccggaagccgagaaggttgcctccatcgacgagcttctccacgccgtcgagcatgatgacccggacaaggtctgggtcataggaggtgccagcgtctacgaagagctgctcccctattgcacggaggccatcgtcacgaaggcagactgcgtgcgcgaagccgacgccttcttcccgaacctcgatgacgacccggcgtggacagtcatcgacgagaccgatacggatatgacaccggaaggcatccctttccgcttcgtgacctaccgcagcctcaaagcgaaataggtatccccctggcacacagaaagggccgcccaaggcggcccttttcatttggatggaatcacttgagcgcctgctcgagtgcctcgatcagaggttccggcttgccatgcccgcatacaagcctcgtccagatggcaccctcctcatcggtcacgacaaagagcctcgaggcgatgcctcctggcacccaggcattgcctggagcgcagaggatgcgtcccttcacatcgcagcgaggctttctgagacggaaatcgacgcagggcccaaagccccgctggagcgtgcgcgccgcaatcggctgcgtcggatctcctttgagtccggggtagcggacctccttcacagccggatggcagacgagatagcttgctgccacctgtgcgttgtccgaagcagcgcgtctcctctcatcgaagctccgaagtgcccgcgcgagctcatcgagcatcctgcccgagacctcgggcctctcgtcgaacgatgcggcgagatcctgcaaaccctgcggcatatccttcgcaacgcttacggcgataagaccgcttccgagccatcccagcactgcatcgagcgactcgactgcaagagaggcaccgagacgcaccgcagggcagccataggagctcgcaatcgtattgtcgacgacgaggagctttccttctgcctgagccttggcagcttctgccttcacatcgagacaggctatgggcacgtgcccaagcgtctctccgagcactgccccttgaggcagtccctcagagagatgctcggtccctcccggcacaatccaggtcctggccgccccgaggcgcttcgagaagcccttcagaatctcttccagcgtctgatccattcctatcagctccttccatcttccatcttacgcagattaggcccctatctctgtacggaaacgtccgtaggcgtactctgttacatgcacgatgcatgctggaaagggcattgtcttcgatgcatccatacatgacagggaatggatgcatgtgcagacagacacttttgggtatgtctatttacgtttcgaattcgcgcggtccccttgcgggacattgttgggatgatgaagatggcaaagattcagcttgggcaccagctctatatctatcagctcattgcaaaggaatatgggacagggcaccagatattcctgccaaagatcgaggagctcttcaaggccgaaggcatagagccagaagacctcggcttcgagacataccgcgatgtgatggcagcctgctccgacttcgtgacgctcaccgacttcaagggaggcaggagctacgtcacgattgtccagaacgagcagtgggacgaggcgcttgccgcaccggtccatgaaaagggatcgggcaaggcaggaaagccctggaagaaaaagaagggctcccagctcaaggccgtgaagccccgccatatccagaagaagcagaagaaggcaaagccggaagagacacagaagcctcaggacaaggcaaaggctccagaggcagatgctgcagctgtgcctgaaactccatcagcagaaacgcagcccgaagcagcagagccgacagctcaggcagcgcccgaagccaagcccgagaccgtggcagccgaggaagaagagccaaaggcagatgagacccctgcagtcgaggatgccggccatccccatgtctttacgctcgatgagatccgtgcccttccggacgagcctgaggccgaagaggaacccgcatccgaagaagcggcccctgaaacgcctgccgaagcagagcctgagcctgaaccggcagcggcggcgcctgcccctgagccgaaggcagcagatgtccccgtgcaggaagcgccacaggcgcctgtgcccgttactcctgcaaagaagacgccagcgcccgccaaggagggaccggaggcgtccgtgcttccgagaagcctgcccaggagcttttcagccgaggttcactgcaaggacgagcttctgagccttctcacccgcatgctccccttcgatatcgaccttacgcagatcctcgacgaggactggcaccatgccctcgcgaccggtgcggtcgaaggctcgaggagccgcgtgagcttcccgattcgcttccttgcagaagatggcacgagccccatccgccttacgatccgcaggagcacgcgtccgattgccggcaagcagtggtcgctcatcctcgtcgacggcgatgacggaacgggacacgcccatgacgcggtcggcatcgaaggtctgccgcatgtcgacgaaggcgcctggagcgatctgctttcacagggtgctgccgattccgccaagagtcctgaccgcgcattctccgacttcgcatcgttcggctcctgggagtcggtccttggcacgctcgcacgcatggctgcgccagaagtgtggtcagattccggcgctggaagcgagcgctacccgatcctccatgagtatctcgtctctaccttcgtgcgtctctcgcacgaagggaagattctcgaggtgcccggagcaggattcgctgccttcaacacgggccttgtgaccgccttccaggaagacatctatgcctgcctcacggcagcgacggcccaggacccctctccctggcagcttgctggcttcgctgtcgcaggagcaggcgagctcggccagaagctcgttgccctcatgaatccgctgccccagcctgcacgctacctcacatcccttgccgacatcgagcccgatacgacacggctcgtgagcatcgactatcacggcatctttctcggcgagactgaacgcctgccaaaggcctggcttgccgcgcaggtcgaagggacgccagcagcctcgcttgtcgacgacctctttgcagctggctctgctcctgccgcacgcatgcaggcaaagacgaagcttggccatgcactcgcacaggacccctccgtctggcgcaggctctgccgcgacctcgatgaggcgcttcaggcctcgctcgtccatacccgtacgagctaccgctggtgcgcccctgcctatgagccctcaagcgacagcctgaggctcctcctgccgctcgcactctccgatggccgcaccgtcgatgcagccctctcgctcgagctcatgccgtccggaagctatcaggcctcttcggtcgtgacgctcgaccgtgcacgtgcctgcacgcgtgtcatctcctccgagcagccatcctggctcgaagcctagaagcacaaaacaggctctctgaaacttctgatgggtagcacaggttgctcctcccgaccaccgaccctgaggcggtttgattccatcggctggcggatgcgacgatcggagccgtgcatggacgcgcaggccgggatgctggcgcagctcttcgggaggtttatggtgctcggccccgagtgggaggtgtccggcgtctggtccgaggagcgcggcagcgccccgagtgcgggaggcgctgcggcgcccgcggcgcccgcgagcgcacctgaggaccatctatacattcattccctgcgttcctataaacccagcagttcgctatggcttcccgtgcgtgtggcaacaagcacgaggccctcctcgtcgatgaggtagatgagcagccagtcgggttcgatgtggcactcccggtgcccgtggtacgttccgcccagcgtgtggtcacgcatcgaatcgggcagggcctccccgcgcgcgagcgcctcgagggtcgactcgagcttggagaggtccttgccctgtctcttgatgcgcttgtaatccttcttgaacttcgctgtgaacctcagttccagcatggcctactcctcgtcgagcgcggccatggcctccctgacggtgtggtaggggccagagaggttcctgcccgcagccgcatcatccatcgcggcaagcgtctcggggctgaacccgtaggggttcgaggggtcaaacggaaagccgccccggcgattgaaggcggagacgaacatgcggatggcattgctcggggaggtgccaatctcgtcgcagacggcgcagaagcggtccttctcgtctttgcggagctttgcggagatggattcggacgcgacggcagtagccatgatgacctcctattacatatgattacattgtcttacattgtataccattattgccgtgcttctacactcagccatccgcgataggattgccgcagcgtgaaaagacacaaggcttttggcggtcgcgggtacacgtacccacggccgcatctttcttgcgccatgcagaagctctcatctgcccagtccttcaggctgaatggacaggagtggatatgagcaacttccagatagtctgttcccacttaaacgctcgcctgcgccatcccgaacgtccgcccacgatcggccccgtcacgttctcatgcgcgatgccgttgcgatgctggatggtaccgttgcgggtgatgacgaacttgggccagctgtcccgaatccgctcgagcaggcagtgctcgtggccctcggtcgcgtggtcgaccatgatggccatcgccacctgcacgcaggcgcaccccatctcggacaagtgcaagatgaaattgtactcgagcatgccgatgcaccccacgctcacctcgtagcccaggcttctcgcgtagctgtagatgatgttctcgagcacgccggctttctgggctctctgaaacttctggtgggtagcacagattgctcctcccgaccgccgaccccgcaggcggtttgattccatcgactggctgacgcgacgatcggagccttgcatagacgcgcaggtcgggatgctggcgcagctcttcgggaggtcgatggggctcggccccgagtgggaggtgtccggcgtctggtccgaggagcgcggcaggggcgctcgggcggctgtgcccgtggatgacgcactcgaacatgccggagatgaaggtggtcgcgaggacgctccgcaaggagcgggaggacgtcctcgactggtggcggtggggctcgatgagcgccatcctggagggcctcagctccgtgattcagtccgccaggagggccgcaagggagttcaggaacaccggctgcttcgagacgatgatattcctcaggctcggtcgcctggacttcccggcccaggtcgccttctcatctgctacctactagaaacagcgaagagcccaaaaatccaatgcacatgaagggaggcacccggcgctgccggatgcctccctttctcatgccttggattgttccagagacgcgggaactagcccctgcgctcttcgatctcggctgtgatatctgcgatgaagtcgtcgaggttcctctggacagtctcgttcgagcggtcacggacggagatgtttccggcctcggcctccttctcgccgatgatcagcatgtacgggacacggtcgattgagcgggcctcgcggatcttgtagccaatcttctcgtcgcggtcatcgaccttgacgcggaccttggcagcgcgcagacggtctgcgacctgatgagcatagtcgcgcgtcttctcggagaccggaaggatcttgacctggcagggagacagccacgtcgggaacttgccggcgtactgctcgatgagcatgccgatgaagcgctcgaaggagccgaagcctgcacgatggatcatgatcggctgcttcttggagccgtccttgtccgtgtactcgagctggaagttgtgcggaagctggaagtcgagctggatcgtgccgcactgccactcgcggccgaggcagtcctgcaggtggaagtcgatcttcggtccgtagaaggcgccgtcgcccgggttgatcttgtagtcgacgcccatggcctcgagagcatccttcaggccctgctctgcgcgctcccaatcctcgtcggagcccatggagttgtcaggacgcgtggagagctcgaccctgtatgggaagccgaactgcgcatagtaggccgtgatcagatgggcgacatcggtgacctgctccgtaatctggtccggacggatgaacaggtgtgcatcgtcctgctggaactcgcggacacggaagaggccgtggagggcaccacgaagctcgtggcgatggtcgatgccggcctcggcgagcttgagcggcaggtcgcggtagctcctcggcttgctcttgtagatgaggcaggcacccgggcagttcatcggcttgatcgcgtaatcctcgtcgtcgatcttcgtcgtgtacatattctctttgtagtggtcccagtggccagaggtctcccagagcttgcgggacaggatgatcggcgtctgcacctggtcatagccgaacttgtcctgcatctccatccagtactgcatgagggagttcctgatgcgcatgccgttcggcagccagaacgggaagccggggccggcctcgttcatcatgaacagctccatctcctggccgatcttgcggtggtcgcgcttctccgcctcctcgaggagcttcagatgtgcctcgagctcgtccttgctgcggaaggcgacgccattgatgcgggtgagcatcttgttgttcttgtcgcccttccagtaggcgccggagacgcccgtgagcttgaaggccttgagtgccttcgtataggtgatgtgagggccgacgcacatgtcgacgtactcgccctgcttgtagaacgtgatgcgggcatcctcaggaaggtcgccgatgtgctcgaccttgtacttctcgccgcgctcctgcatgtgcttgatggcctcttcgcgcggaagctcgtagacctcgaacttcaggttctccttgcagatcttgcgcatctcctcttcgatgcgcgggaagtcctcctcggagatcttctggccctcaggcaggtcgatatcgtagtagaagccattgtcggttgccgggccgaatgcgaagtcggcatccgggtacaggcgcttgatggcctgcgccatgatatgggctgcggagtggcggattacgtggagctcctcgtcctcggggcattctgcgacgtggccgtcgttgtacagaaccttcatctgatttcctcttccattgatggctgcttgcgctgttcacaaaaagagcccggcagtcggcatctccggcctccgagcatttcatggcgcctgtcacttggcctgtaggcctgtcaggggacagacgcctacatagtctccggaaccgctcttctgtatgccagaaggcactgtatggactgcatcaagccaagcctttcattcgaactggcaacagttttaccacatatggagacgaagcgttgctgaaggaccccaagcctttgccatctgcggccaaataccacgaactcgtgacggatggacccgatctgcatggtcttcagggctcagaaagcagctccgaacgagctatctacaattcagatagcctgatgcctattttccatgtatcccccaagcttgaaaaatccttaagccgcttgtatggttgaaaacatgattactgagacgatgacatactccgcgcagatgatgcagatgcccaagcccgggcacctggctctacgttcatgcgtggccaggaccgggcgcagctgatggctggcctccggcgggatgtcagtcgcttactgtatatcctgatctggagtctatcgtgatagctatttcgcatctaacaaagcaatacggcaatgcctcttccgagcatgctctggacgatgtctcgctcgagattcctgacggcgacatcttcggtatcatcggcatgtccggcgccggcaagtcgacgctcgtccgctgcatcaacctgctcgagaccccgacgtcgggttccatcgtcgtggatggacaggatgtccaggggctctccggtgcagcgcttcggacctacaggcgccgcgtcgcgatgatcttccagcagttcggcctcctggcgcagaagacagccctcgagaacgtgtgcttcccctatcttgctgcagatggcaaggtcacgcccgagcagaagaaggaggcagaaggcttcctggctgaggtaggactcgccgacaaggcaggctcctatccagcacagctctccggcggccagaagcagcgtgtcgcaatcgcccgtgccttggcgtgccatcctgcctacatcctctgcgatgaggcgacatctgccctcgacccggccagtaccgcatccgtgctcaagctcctgcgcgagatcaatgagcgcacgggcgtcacgatacttgtgatcacccactcgatgcaggttgtcgaagacatctgcaagcatgtcgcagtgcttgtgcacggcaaggtcgtcgagtccggcacggtccaagatgtcttctcagatccccagcacaccgtgacgaagcagcttctcggaaaggcaggctgggatgaatagcttccaggaattcctcaatgtctatgcatcgcttctgggacagggcatagccgatacgctcgcaatgcttcttgtctccacgttcttcgcctacatcatcggcctcttcctcggcatcgtcctctatgtgaccgaacccacaggccttcgcccccacaaggcgctgaacgctgtccttggatggatcatcaacatgggacgctccatccccttcatcatcctgctcgtggcagtcatgccgatgacaaggacgcttgtaggaacgacgaccggcgtccgcggcgtcatccctcccctcgtcctttcgaccgcacccttcgtcgcccgcatggtccagcagtcgctcgccgaggtcccgaaggatgccatcgaggcagcagagtcctgcggcgcctcggtaccccgcatcgtcgtctctgcgcttctgcctgaagccctgccttcgattgtccgtggcatctcgatcaccctcatcacggccctcggctacacggcgattgcaggagcagtcggcgcaggcggcctcggcgatatcgcaatccgctacggctactaccgctacgaagatgaggtcatgctcgtcaccgtcgtcctcatgatcatcctcgtccagatcatccagagcacctgcgacgcaatcgcaaaggcgattgaccaccgctaggctcagctcctgtccgcttctctacatggcactgccgcagaaggcatttcgcccctgcgtttgtaacttgcaccctaaaacacaagatttgaaaggaaatcagccatgcttacccgcaagaacttcctcgctggctctgccgccctcatcgcttcctctgtcctcgccgcctgcggcaattccggctctgcgagctcttctgcctccgagacgaagacactcacggtcgcagcctctccttcgccgcacgccgagatattgaacaacttcgccgtgcccaagctcaaggaccagaacatcgacctcgaggtcaaggagtacaccgactacatcatcccgaaccaggtcacctcttcgggcgaggttgacgccaactacttccagcacatcaactacctcaacaactacaacaaggagaacggcaccgaccttgtcggcgttgccaccatccactacgagccgttcggcatctacgccggcaagtcctccgacctcaagaacatcgcagatggtgctaagatcgctgtcccgaatgacccgacgaacgaaggcagggccctcctgctcctccagcaggaagggcttgtcaccctcaaggatcctgagaacctcgaggcaacgcctgtcgatgtcgcagagaacccccacagcctgaacttcgtcgaggtcgaggcagctgctgtcccccgccagctccaggacgtcgacttcgctgtcatcaatggcaactacgcaatcgaggcaggactgcatgtctccgacgctgttgccgtcgaggcagcagatggcacggctgtcgagcagtacgccaactacatcgtgacgacgcccgacaagcaggacgacgaccgcatcaaggcactggtctctgtcctcacctccgacgacttcaagacctacctcaagggcacctacgacgaggatgtcctgccggcattctaggatctcatctgagaccgcaagacagcgaggggcgcacatccgtgcgtccctcttttcttgtgcggagacatgacttctcaggcgtcgacggcagcctgcctttgctatggcctggcacagccggagaccagcggcaggcatccgcctgcacaaggacgaggagccacgtcccgatccgagcaagacacacatgtatgtgtgtcttggctttgcagcgcccattctctttcagacacgccgatctgctgccgtggacaccttgcatgcatagcggtgctcctcgctcaggcaggggccgcctcgaagcttctgcctctgtacggcacaggccctcagcagaagaaacgctgtcctctcccgacaagaaaggaaccccatgccgtccggcacagggctcctgaaacgttctcgcgtgtggtcttactggatgcgcgtacggcagtacgggcagaccttccattccgcattcagcggacggtggcaggtcgggcagacgttcctgacctgggtgttgcagaccgggcagacgacgaagtcgcggtcgatcggcgtgccgcacttcgggcagatgccgtaatgggagagctggtgctcgcgcagggcgatatcgaggtcctgttcctcgcggtcgacgagataggagctcggacggaggatcacgtaggcaagaaggccgacgataggaatgaccgagatgatggcccagagccaccagggctcggcgccacggcgctgtgcatcgcggatcacgtaaacgatcgagaggatatagaggatcacgacgcaggcaaccatcaggtacagcaccatgcgtacttcaggggtaatgatctgatcgagaagctcttgcatgtgaaaggcgctccttctgttctgggacgatgctgcattcctgcgcacgttctctttcggcaattgcagacaagcataccgctatggacgcagatgcccaggccacaacacggccgccggtgcgttcatgagccaatcttcacaaaaagcaggaccttcgtcaagccttcacgccagactgcgcatgtcttggaggtggatgtaaagatacccgctacctgagccagggacgatagatggcagcaacctcgcctgctgtcgtgatcgatccgcaggcgcagaagggcttgcccctgagcgcctcgaccgcctcaggaaccgaaggatagatgccttctggctctttgccatgggcgcggaagacctcagcaagctggcccgccggaagggcgcggggagatgcggtctgcgcacagacgaccttcggaaaggcagcagagagcctctccacgatgccatccacatccttgtcggcaagtaccgcacagagaagatgcggcctcttctcacggtctggctccacatcggcgacagctgtgaggaaggcatcgaccgactgcggattgtggcaggcatcgatgaggacgaccggcttcggacagacgatatcgaagcgtccgggcgtcggcgtcgtcacgatgccgcgataggcacggtctggatcgagcgcacgtccgaggaagtcctcggcaaggcagaccgcacaggcgatgtttgctgcctgatagcccggcttcaaggcgccaagctccgcaagcgtctggcgcggtgtcgtgacatcgaagatgagggagccaccgatgcgccccggcagctcacggatgcggaagcttgcatggggaaggtcgggatgcgcagcaggcacacctttctccatctcccctgccgcatcttcgagcctctcgggccgaagcagcgtcggcacagtcccagcctgctttgcctgcttgaggaagacatcctcgacgcttgcaggggtcgccgtgccggcaccgagcacgcaggtgcgtcccggcttgatgatggcagccttctctgcagcgatcttctcgagcgtatcgcccagaatcttcatgtggtcgaggcctatgcccgtgattgcgaccgactcgatcgaacggcaggcagacgttgcatcccatcttccgcccatgccgcactcgagaaccgcgacatcgacgccggcttccgcgaaggcaacgaaggcagcgacggtcagaagatcgaactccgtgatatcgaagggaggaaggccttctgccgcacgtgcggcaaggacccgtctgcctgcctcgtctgctgcagcaaccgcatgggcaaacgcttctttcgagatgggcttgccgcctatctccatgcgctcgttgtagctcacaagctcaggcgacgtatagaggccgcagctgagaccttctgccataaggagccctgccgcatagcgtgccgtcgaggtcttgccattcgtgccggcaatctggacggaacgatatgccttgtcaggatcatggagctcttcgagcatcgccgtgaccggatctaagctcggagagatgccgaaacggagcgcccccttcaaggttgcaagcgcctcatcatatgtcatgtcctccacagcgaagggaagcgtatatcccactgatatctcctctcaagcatgcctgggcatgcagatctctcaatcctgtgcaagcacggcttcggcctctgcaatgacagacgtcgtgccaagaaggcatacgggacgtcctgtcgcgcgtgcctcagaaagcgctcctgcaactgtcggaacgaagcgtgtctctatcccttcagccgcaaggcatcttccctgcctctccgtgaagacgtagtgcggattctgggaggccgtgagccagatctcgtctgccacccccgccatctcatgcacgacgccagcatagtccttatcgtcgggaatgccgacgattgcgataagaccaggaccgcagccgagatgggcgagcgcctctcttgcttcctcagcgcttgcccggttgatgcaggcatcgacgacgagcagcggttccttcgagacaagctccatcctgcccggaatcctgagcctgcccaaggcttcgcgcaccttgcgctccgcgagctcatgtcccagaagcgcttctgcaagcgcgagcgccagtgccgcattgcgtgcctggaactctcccagaagcggcagctccacgtcttcgagcacctggctctggttcttgagcgtacagatgatgcctgccttgccccagcggatggccgtggcctcgaagtccctgccgtactccagaagcggtacgccgagcgcacgggcccgctgggcaatctggaccagagcctcttcctcctgcgggcctatgaaggcagcttcgcattcaggctgtatggcataggccttgtcagcggcgatggctgagaccgtagggccaagctcgcgcgtatgctcgaggaagatggtattgattgcacagaagcggtgcggcacgttcgtgacatcgtcgaagcgtgcccccttgccacactcgaggatgtctgcctcagtgccttgcgtacggaaccacgaaagcgcagccgcgcactcgatcccgatggggctcacaaactcgccgggcaagagcctgtcctcgatcttctctatagcgggcgccaccgccgtcaccgcttccgcaagctcactgtccgatatcggcaccccatccacgcagaagcgctcgttgaagcgcctgatgtgcgggcttgtcatgagcccgacacgccgctctgtctggacaagcgcggctgccatgcgagcagccgaccccttgcccttgctgcccgtgacgatagcggcatccgcatgggcaaggctcctcagaagatcgcgcgtgagctcggggtgccgcttttcggagtcaggtgcatcgaaggaaagcccaggcgctgcagccatatacgacgcatagatgaagtcttctgcttcgtctctcctcatgcaagatcgtccctgaccgtgcgcatcacgaggcctgcgacattgacgccggagacggactcgatcccctgcatgcctgccatcacattgatctcgcagaaccagtagcccgcatggtccacaagaaggtcgagcccgaagaagtcgagccccgtctcttcccagacatcatgcaccgctgcacgcatgtcccgatcgatctccttcttctcgagctcagcaccaagcgcatagttcgcgcggaatccgtgctccgccttcctcctcatggcagccacagcctcgccgcggatgccgaagacacggatatcctttcctaggctctcctcgatgcactgctcgaagagaagctcgcggtcaggtcccacctgctgctctaggcgcgcgaggtcatcctcgtccttgatgagccagatctcgcgtccttccgagctcgcaagcccctttgcgacgaaaggcacgccgacctcggatgcaagcatctcgaagccggcaccggcatgtgcgagcacccagcgcggcatgcggaaggcagaggagctgatgtcttccacctgtgcatgcttgtccacatagcgcgcgaagggggcgatgctgttgtagctccttgtggcaagcgcatttgctgccgctatgaggtgtccccatttgtagcggttcaggacgaagtcagcaggcgcaagcggctccccgtgaaagagcagcgttccatcctctgtctttcccatgtcggcaatgccggtgatggaaagatccatagagagggcatgcgcctcttcgacaagacggcggcaggtataggcagagcccatgtcgctgtagcgctctatcagatagccagagagcctcatctgaccttcaccctttcttcgttgagggccgcccaggagatgatcgggaagaggacgaggcagatgagcatctggatgggcaggtccagatcgagctggaagaccgcaatgaccgtaccgagaagcgccatgagctggaggtccatgctgcgtctcaggatatgcgactccttccgctcgaccgtgaccacatcgttcacggagtcgatgcccaaggctgcgcgggttccggcaggcaggctcacgcgcgcgtcatcaatgccctcatccacaagcacgcggagctgagcctgcgcgctgccgaagcgcacacagattcggtcattgtcctcgacgcccgcaagcttcatgaggtcgggagagaggcgggcgatgccatttgcatcgtcttcgtccttcgcataggtcgaaaggagccagagcttgcgggagcctatccaccggtccaggaaggcatctccgatgcgtcccaggcgccccttctcctttgccttcggcgcatcggcaaggacaagctcgagggccctgtccacgccgagcgcacgctcggcctgggcgagacgcctgaggtcgtcgcccgagcagtcctcccgaagacggcagaacgggtccgaacgcgtcgtgctcgggccatagcttctcctcatgagctcgcacgtatccgcatccgcacggtcgagaagaagctccatctcctcctgccggatctgatggaccggcagctgtccgataccgagcagggccttgaagtagcgcggcacatagacgctctcctcatgcgccacgagcgcatagggcgcatagtcggcgccatgagggtcaatcacgagctgcgtatccgacacgcgcgagtagagcacgcactccttcggacgtgcggaatcccccgtctccttctcgatccactcagccacatcatgagagacatagaccctgtccacatgctctgcaacagggacgcggaccatgcaggcacgggcaggcgtcctctggacaagcacaggcatcccggcttccggctcgaggagcccttggccagaagcacctccgaagagccgcttcgtcatgcggttcggcaggaagatggcagatgagcatgcatcttcacccacagcagaagatgccagctttgcctctgcataggcgcggtcagccgtgcgcacatggacgagcggagcttctccggaaggcccctggaggcagagcgtacctgaaatgccctcatgagatcctgcactgagatagcagacatcgcggggcagctgctcctttgcctggaagaggtgcatgacctgaggatcgggagcttccttgtcccagcgtcctgccatgaggcagaagagcgcaaggccttttgccagggcagcgactgccgaaggatttgccacattccggagctgtccgtttatctcgagctggagcgcaggcgcctgggctcgttcggagacattccttccaatcgtatgaggacctgccgccgcgaacacgccgtcatgcacgactgcatcgtcgaagcggccgagctcccccaccgtctggacaagcgaggcatccatcaggtcgagaaggaacttgtgtcctagaagggacggatgctccttgccgcctgtgccgatatcgacaccgaagccgcgatctgacgcagcaccgtggagatcgaggacgcaggatatccgatgctcaaggcaataacggacaagctctctctggtacgtgttctcctcgaaggcatcgaagttcggatcgtgcccgtctgaccttgcgtggcagaagacatggatgcctgcctcctcatggagccagagcgcgagagctcctgtcaggatctctgcacgcttgtcctttccctcccgcgtctgcatcaccgcatgcggcgccgagaccaggatggggatgctgccctccttgatgaggagggcaggtcctctgccctcatagctatggctcgagaagcgctcctcgagagacgagaggcgctctgccagggcatctgccatgcttgcttccatcatctgctgcttctgccagcccctgcaagctcgcgtgcctcacgcctgagctcgcaatcatccgcaagcacgccacgcgctgcctcggtcacggtgagggacccggtgctcttgatgcccctcatggtcatgcagctgtgctcggcagagaggatgacaagagcgccctcggggtcgagctcctccatcagggcatctgcaatctgggccgtcaggcgctcctgcacctggaggcggtgggcatagccctggacgagcctcccgagcttcgagaggccgcagatccgtccatgcttcggcagatagacgaccgcagctgtgccacggaacggcaggatatggtgctcgcagaaggactcgaatgggatgtcgcgcacgacgacgagctcgtctgaatcaggagcctcgaactgcttcctcagatgcgccttcggctcttcccacatgcccgagagcagctcttcggtcgcccgcgccacgcgtgccggcgtctccttgaggccttcacggtcagggttctcgcctatcgccagcaggaattcgcgcacggcatgctcgaggcgctcctcgtcgatctcggcaaagccctgatcgttgagctcgcgtccataggcgtccttggtgccggtcagatgtgccggctcgaatgtcgaagattccctcatgcctcagccttggccctttctgctgcctcgatcgtgtgctcggcaagaattgcgcaggtgaccgcgccgacccctcccggcaccggcgtgagcgcacccacgacctctttcgcctcttcggcgacatcgccgacaaagcggccttccgagggaaggtagttcataccgacatcgatgaccgtctggccacgacggaaggcatcggcggtgagcatctggggcctgccgacacaggcaacgacgatgtccgctgcacgcgtctctgcaaagagatccttcgtgtggctatggcagagcgtcaccgtcgcattgcgcccgagcaggagcgaggcgagagggcgtcccacgacaagcgagcgtccgacgaccgtgaccttggctccatcaagcggggcaccatagtggtcaagcatcgcgacgaccgcagctgccgtgcagggagcaaagcccactcggctgccggagaagacgccgtagagcgagccttccgtgatgccatccacatcctttgcaggatcgagcgcggctgccgctgccttctcgtcgagcgtcttcggaagcgggcggaacatgaggcagccatggatcgagctatcctcattgatgctgcggattgtcgcctcgacctcatcctgcgtgacatcctccggcagcgcaaagagcttcgtctcgatgcctgccttggcacagcgcttctctgcggcatgctggtaggagatgtcatccgggcgctcccccacacgcacgaaggcaaggcagggctcgatgcccgcgcctttaagctgctcggtccgtgctgcctgctcctcggtgagcgcacgggcaaccggtgcccctctcagctcctctgccatctgattcctctttccactctgagataggcctcatcagccttggcacagccatcttcgagcatggcctgggtacgggagacgaggatctctgcataatcgcggtctttcatagccttcgcattgatgaagacattgaggcaggctgccttgagcgacgccgagagcagcgctgcgcctgcccctgcatccgtaagcgccatcttcgaaccgatcttcgtgagatcgtcgacgatcacgatcgcctcgcagatggcctccatcagatgctcaggcggctccgatgcctggcgcagcgcctcctcaaggacgcgcgtgcgctcttccttctcttcttcggtatcccgcggcatcctataggcacgggcaagcggcctgaatgcttcggcatcctcttctgcgagcgtgaacatgcggcctctcagctcttcgagcttcgggagatattcctcgatcttcggctgcacctcttcatagcggcgcttgtggtgcgtgaggtttgcgaccatctcgcccagggcgcatcccaccgctgctgccatggctgcccctgcaccgccgcctggcgtcggctccttcgaggcaagcgcctccacgagctcctcggccgtgcagtcgcgcattctcttctcttctggttccgtcacgtctcttccttgtctgcgcagcagcaaggccgagggtgcctgtgcgcccccggacctctgctgactatcttcgaatcttatgctgctctagaagaggccgacgatctttccgtccggcgtgacatcgatcttctctgctgcaggcaccttcggaagtcccggcatggtcatgatgtcaccggtaagggcgacgatgaagccggcgccggcagataccttcacgtttctgaccgtgatgcggaagccagcgggcgccccgagcttcttggggtcgtccgtgaacgagtactgcgtctttgccatgcataccggaagtccgccgaagccctgctcctcgagctgggcgagctgcttctgtgccgaggacgcgtagtcgacgccgtctgcatggtagatgcgctttgcgatggcctcgatcttggaagagatcggctggtcgagctcgtaggcatacttgagctcgctcggctcgccgcagaggcgcacaacctcgtcagcaagcgcaagtccgccctcgccgcccttggcccagacctcggagagcgcgacgttgacaccgagctcatggcacttctgctcgacgaagtcgagctctgccttcgtatcggtcgggaacgcattgattgcaacgacagccggcaggccaaagacatcgcggatattcgagatatggcgaaggagattcgggatgccgcgctcgagcgcctcgagattctcctggccaagctctgccttcggcacgccgccgttgtacttgagggcacgcacggtcgcaaccagcacgacgcaggaaggagcgatgccggcagcgcggcacttgatatcgaggaacttctctgcgccgaggtcggcaccgaagcctgcctccgtgacgacgtagtcggcaagcttcatggccgtcgtcgtcgcctcgacagagttgcagccgtgggcgatgtttgcgaacggacctccatgcacgaaggccggattgttctcgagcgtctgcacgaggttcggcttgatagcgtccttcagaagcgcgcacatggcgccctgggcatggatatcggagactgtgaccggacgtctatcatacgtgtaggcaatgaccatgcggccgaggcggtctttgagatccatcagatccgatgccatgcagaaggcagccatgacctcagaggcaacggtgatatcgaagccatcctggcgaggcatgccattgccgacaccgccaagaccatcgacgatgctcctgagctggcggtcattcatatcgacacagcgcttccagacgatgcgtcgcgggtcgatgccgagagcgttgccctgcttgatgtggttgtcgagcatggcagcacagaggttgttcgccgcgccgatagcatggaagtcgcccgtgaagtggaggttgatgtcctccatcggcacgacctgggcatagccgccgccggcagcgccgcccttgataccgaagacgggtccgagggatggctcgcgcaggcacaggagcgcattcttgccacggcggcagagagcatcctcgaggccgaccgaggtcgtcgtcttgccctcgcccgcaggcgtcgggttgatggccgtcacgagaatgagcttcgccttcttgggaaggtccttcagggcatggatgtcaacctttgccttgtagcgtccatagagttccagctggtcttccgagaggccggcacgctttgcgacctcggtgacaggaagcatcgttgcttcctgtgcaatctcgatatctgactttgccatcttggcttcctttcgcttcttggctcctgccaatggttaccgggtttcacggggcgatctgaccatgcttccattgtgtacctcaaagcctacagcgccactctcaattcggatatgtggcagttgtgtgcgcctatatcggttcttcatgcacatccatagccaaagcctatggacctgatgcagccggaaggcaccgggcatgccttcaagcttccctgctggcatgatgcagccatgcatgccatcctgctgccccttgaaacgaatgccaagatggaggcctggattgtcaaggcggcacctgagccatacgctccagggcagcctgcagaaggcctgtgggggcttggtctctccgaggatgggattgctgcgctgcggcatgcagctgcgcggagatcggcgacagagcggctgctgctgtcagcttccgccagcggttgcaaaagagatgcaccggcaatgcctcacagtcttgcagcagacaagcggcgccggtgtaggctgacagcatcaggaacggccatcttgcagcagggatggagatcttgatccggccgcaccatacgcttccgcgcttgcagaagccgaaaggttgccgggctctttgccctggccgccgcacgccctgagcacacgaagaaggccgcacctcacggcacggccttcctggctagacgatatgttccagctgctactcgaagtcggcaatctgggccttgagctgctctaccgtagcggtgagctctgctttctgggactgcttcttctcgatgacctcaggcgctgccttggcaacgaatcctgcattgccgagcgtgcgctcgacggaagcaagatccttctctgccttggcaagctccttcttgaggcgctttgcctcggcatcgagatctaccaggccacccagggcgacgaagatctcgagcgagccatcagccacggagacagagcctgcaggcttcgtctgctcggcaccaagcgccagctggtcgacacggccgacgctcgtgatgaagtcacgctgggactcgagcacggcagcatcttccggcgtggacttcacggccacgtcgagttctgccttcggggacaggcggtagcgggcacgggtggagcgcacgacggagatgacgcgctttgcgagatcgaagtcatgctctgcgcgctcgttcacgaactgtgcaagctcgtcgggctcaggccacttggcgaccatcaggaacttggcgctgtggtcatcgaggccggatgccggcagggcatcccagacgctctctgtcacgaacggcatgaccgggtgcaggagcctcatcgagacatcgaggacatacacgaggttgcgctggacctgcagcttctcctcgggcgtgccatcaagcaggcggcccttgcagagctcgatgtaccagtcgcagacctcaccccagaagaagctctggagattcctggcgtagtcgccgaagttgtaggtctcgagctgctcggtagcctctctgacctccttggcaaggcgggaaagcatccaggcatcctctgccgtctctgccttcggggcgcccggcgtatagccgtcgaggttcatctgcacgaagcgggaagcattccagatcttcgtgacaaaggagcgtgcctgctcggtacgcggcgagtcgatgagctttcgcgtcttcttgtcgatgttggcatcgaacttgacgtcctggttcgtcgtgatgagcgtcagaaggttgaagcgcatagcgtcagcgccgtacttttcgatgaggtccatcgggtccacgccgttgcccttggacttggacatgcggctgccatccttggcaaggatcgtggcgtagatgtagacgtcgtggaacggaacctcgtccgtgaagtagagcgagctcatgatcatgcgggcaacccagagggcaatgatgtcgcgggcggtcacgaggaccttggtcgggtgatgcccctccatctcctccggatggtcaggccagccctgtgtcgcgaaggtccagagctgagaggagaaccaggtgtcgaggacatcctcgtcctgatggatgttcttgcttccgcacttcgggcacacctcggggtcctccatgagggcgtcttcccagccgcagtcgtcgcagtggaagaccggaatcctgtggccccaccagagctggcgggagacgcaccaatccttgaggttgtccatccaggtaaggtaggtctgcgtccagcgggcaggatggaacttgacttccccatcgcgcacgacctcagctgcacgctccttgagcttgtccacagccacgaaccactgctcggaaagccaaggctcgagtgctgtgccacagcggtagcagtgcatgacagagtggctgagctcctcgatgtgatcgagcaggccgtgctcatcgaaccagttgacgatagcggtacgggcctcatcgcggtccatgccggagaactcgccgtagccatccacaacgtgtgccgtctcatcgaagatgttgatctgcggcaggttgtgcgtctggcccatggcatagtcattcgggtcgtgcgccggcgtgaccttcacgaagccagtgccgtagtttgcatcgacgtgccagtcggagaagatcggaatctcgcggttcacgataggaagcatcacggtcttgccgacaagcttctgcttctcggggtcctgcggagacacggcaacgcccgtatcgccgagcatcgtctcaggacgggtcgtggcgaccgtgatgtactcgatgccatccaccggctcggtcagaggatagcggaggcaccacagatggcccttctcgtccttgtactctgcctcgtcgtcggagatggcggtacggcaggaggggcaccagttcacgatgcgcttgccgcgatagatgagtccatcgtggtaccagtcgcagaagaccttgcgcacggcacgggagaactcggggctcatcgtgaacttctcatcggagaagtcgatggagcagcccatacgcttgatctggctgacgatggttccgccgtactcatgcgtccagtcccagcaggcctcgatgaacttctcgcggcccatctgaaggcggttcttgccctcggacttgagcttcttgtccaccttggtctgggtggcgatgccagcatggtcggtgcccaggatccacctggtggagcagcccctcatgcggctgtagcggatgaacgtatcctggatggagtcatccattgcatggcccatgtgcaggattcccgtcacgttgggaggcgggataacgacggtgcagtcgcctacgcccttgcttctctggtagcagcccgcatccatccactgctggatgagctgaggctcatgctcttggggatcgtaggtcttcggcatctctttcacggcaacgtaccttccgacatgtcccgtccgaccgcgttggcactcgtgtattgagcgcgcacctcgtccgagactggctttccctcatgccgccttgtcgcggcatggattcttacgataccacgataaggttggggcaggcatacgctggcagaggttgctccaagcccccatagagccctccaaaagccagctcggggcctctctccctttctgctggcccaggcatgtccgggaatgcagcttctgccgaatgcagcagctgccggggggatatcggatattgatggacatcgtccagacatcattgaacattgttggaaggcagctcgtgccatcccggccgtccggccggccatcgggcacatggcgctgtctcgcgctgcatctcggcagctccgtccgccgaaaagccggcgccgggggctggccaatgaagcaggcatgcgaggggctcgcgtcgcatacctatcgctcccctcttcatgcatatcggccgcagctgcaggaacgtctgctgtccatcccgcaagctgcaaccaggaagagaaggaggcgcgcatcatccagcagctctggttcaatttcaggccggcactgcatgtgggctacggaaggaggattgcaggctttggcatcacctacttcctgatccttgcgctctgtgcccttctcggctcatggctgtccgatggaatgcctgaggtctgggcaggctttgccgggccctgcctcatcacgcttgccatcctcacgctcacattcatctacgccttccgcaagcgcagcgccgagcatcaggacctgctcgaccgcttccatgggaagagcgaactgctgcaaagaccttgaggcaactgcctgcacggacacaagcaagcgcctcatacgggccccctttccctacggaagggagggctcatctcattccgctcgatacgcaacatgtcgtgcatctcaccgatgcggtagcatgtgagttcatccgatatagactcacacaaggagcgctgcaccatgcccgaaaatgccactgtcgaaacgccgtccgaccgcctgaagcttgtcctcggcgacaagcgcctgaagcgcctccaggatgcgacggtcatggtcctgggactgggcggtgtcggctcgaactgcacggaagcccttgcccgtggcggcgtaggacatctgatcctcatcgaccgcgatacggtggcaccttccaacatcaaccgccaggccattgccttccattccacaatcggcctttccaagtgccaggtcatggagaagatggtcctggacatcaatcccagctgccaggtagagacccttcaggccttcatcccgaaagacggactcggggaaatgctctcccagtttccccgtcccgattacctcatcgatgcgatagacaccgtctcgcagaagcttgcccttgcccaatggtgccaggacgagaggattccgctcttgagctccatgggaggtgccaacaagctcgatccgagcaggcttgccttctccaagatcgagaagacctcaggagaccgtcttgcgaaggccatgcgcaagaattgccggaaacgcggcatcaagggactcgaggtcctctactcgacagagaagggaactggccccaagcctccgaagaccgaggatggaaagaggcctgacaagggcctgacgctggggaccatgagctacatgccgcccatcatgggacagatgattgccggcaaggtcatctgccgcctggcaggcttcgagcccatgccctactcaggcgaggaagacctgcgatgctaggcagagggcaggatggcaggcaggcacagcgccgctacgacatgcactgccatgtcgacttccaggaagaccctcaaggctttctcgatgctgcagatgcgcttggcctctccttcctttcctgcacggtcacacctgtgggatatcaggaagcaaagagctggagcggcaaggataacgtggctcttggccttggtgcccatccctggtgggtagcagatggcagggtggatgaggaagctctccaggagcttctatcccttgcgccagatgctcccctcatcggcgagataggcatcgatctctcacgcaagcatgtcgaccttgcatccaaagattgccaggcagatgccttcagacgcattgctgaagcctctgccaaggctggtggcaaagtgctctcgatccactctgtgaagtcggcagacctcgtgctcgacatcctcgaggacactggctgcacgccggaagcatcaggctcccttcccatcctccactggttctcaggctctacacccgaactctggcgggcaataaagctcggctgcttcttcagtgtcggcgagcccttcctccatacccgccatgcgaaggaatatctgaagctcatcccgcatgagaagctccttctcgagacggactatcctcctgagcatgcagatttcaagcccgaagactacgagcgttccctttctgcggcaacagagctcattgccgcgtcctggactgctccgctcgatgaagctgctgaattccttgcagcaacgagcagcaagatcttcgaccgtaccaaggacagagactgatcgagccagtctttcctgctgcatcgaggctgcattcatcagctgccgcactgccggatgcctaagaagctttcctttcacctgccacaagacctcatatccttgcacggcgttatcattgaagcaaacgcctgctcatctatgcagcagctgtcttcagtgagcgttttcccaaggaggagaaggaacatggcaacgagaaagtcagggagctccaagccacgcagcacatccacgcggtcgaggtcttcccgctctgcagcaaagcccaaggctcagaaggaggcaaaggggaccaagacgacgaagcccgctgcagcaacagcagcaaaggctgagcctgctccgaaggctacagagcctgtaaagaaggcagctgctgccgcagcacctgcacctgcagcaaagcctgcagccgaagcgaagaagcccgagacgaagaaggagcctgccaccaaggcaccagctccgaaggcagaggctcctaaggctgctgcacccaaggcagagcccaagcctgccgcaaaggcagctgcgaaggcagaagcacctgctgccaagaagtctgagccagaagcaaaggccgcacctgcacccaaggcagcaccggctgcaaagcctgccgcaaaggccgctccgaagacagaagcacctgctgccaagaagtctgagccagaagcaaaggccgcgcctgcacccaaggcagcaccggctgcaaagcctgtcgcaaaggccgctccgaagacagaagagccgaaggctgctccggctgccaaggcagagcccaaggcagctgcccctgcagcaaagcctgctgcacccgccgcaaagcctgagccgaagccgactgctgaagagaagaagcctgcacccaaggcagaggctccgaaggaggagccgaaggcagcggccaaggccgtgcctgcagcaaggcctgcgcctgcaaagaaggaagagcctgccaagaaggcagaggctccgaaggctgcacctgccactaaggaagaatccgtcccgaaggcagaagctgcgcctgcagccaagccggctgtgaaggaagaagcacctgcaaagcccgccgccgccaaggccgaacccgaaccgaagaaggcagcagagcccgagaaggctgagaagccggcagagaatactgccaaggcagtagcgaagcctgaagagccgaaggcagctcctgtaccagccgcaaaggaagagactgctcctgaacctgccgaggaagagcccaaagcagaggaggctccggctcccgagcccgagcctgaaccgctcccccagccgaggcgctctgtcgccttcatcggatccgagtgctatcccttcgtaaagaccggcggtctcggcgatgtcatgtatgccctgccgaaggcgcttgtgaagcagaactgcgacgtgaaggtcatcctgccgcgctatgcctgcatcaagcaggaatggcaggagaagatggtctacaagggcgccttccagatggatctgtgctccgatggcaggcagttctatgtcggcatcatggagtatgtctcccctgacggcgtggtctatgacttcatcgacaaccaggacttcttcacgaacggcaatccctatacgaacctcgtcgacgacatcccgcgctactgctatttcgacaaggcagcgctttcggcactcctctatctgaactggatccctgatgtcatccactgccatgactggcaggcggggctcgtgccggtgttcctccgcacgctgttctcgaataccgaaatcgcgcgctccaagaccgtgctcacgatccacaacctgcgcttccagggcaagtacaacatcccgacaatcaagtactggtccgggcttcccgactatgtcttcaacaaggatgtgctccaggagaactggaccgaagccaacatgctcaagggcgggctcacctacgccgacatgatcacgacggtctcgggcacatacgcaatggagatacagacccccgaatacggcgagggcctcgatgcgcatctgcgctatcacgccggcaagctccgcggcatcgtgaacggcatcgactgcgacatctggaatccggctaccgacaagctcctcgaaactccgtatgacaccacgaacgtgctcgatgcgaagaaagagaacaagaaggcgctccaggaggagcttggcctcgaagtcgacgaggacaagatggtcatcggcctcatctcgcgtctcacgagccagaagggcctcgacctggtgacctcgatcctccaggagctcatcgacggcaatacgcaggtcgtagtcctcggcaccggcgagccccagtacgaggattccttccgctggttcgagaacagcaacaagggcaccgtatgctcgaacatcatgtacgacgagacacgctcgcaccacatctatgccggcgccgacgccctgctcgtgccctcccgcttcgagccctgcggccttacgcagctcatcgctatgcactatggcacgattcctgtcgtgcgcgagaccggcggcctcaaggatacggtcgagccctacaaccagtacacgaacgagggcaacggattcaccttcgaccgctatgagccgggacttcttctcgatgcgatcaaccgtgccaagacgcactatttcacgaaccgctactgctgggacgagatggtgcagagagacatggcgaaagacgtatcctggagcaggtctgcttcccagtaccggagcctctatctcgagctcacgcagtactagagcaccttcaagacgttgccaaggcaggccaagacgttgccagaagacgtcctggcctgtcttcttttgaatcccgctgccaaagccataagacaaggcagataaaatgaaacaggttgatttcacctgtcatccgtacactccgggggcaggtcagggatcgtgtcgtagaagttggtgtaagcacctgattgcctgaaggcactcctgcgggaaagaaggaggaccccgtcctagaatctggaatcgcgacattacaggttcgtggaaaggacgaaggcccaatggacagcatagcagagcaggccgtgtgcacggccgcggcaggagagatgccgaagttcgcagacgggagcatcaacctccaggagctcttccgccagctggcggagtcggtcattaatgccgtgatggatgcggaggccgaggagatgtgctcggcctccggcaacagcaggaacggctacaggccgaggatgctcaacacctgcgtcgggaccctgaacctcaggatccccaggttcaggaaggggagcttcttccctgacgacatcctcgagcgctaccagaggacggacagggcgctcatagctgccgtggcggagatgtacgagaccggaacgagcacgaggaaggtccagaggatagccgagaggatgggaatagacaggctctccaaggaccaggtgagcagcatggccaggagcctcgatgcggatg

SEQ ID NO: 76 - DNA, 38991 bp, Unknown
  Metagenome-assembled genome
cgcctgcatggcccttcgccattgcttcctccgctcttccggatgcatcagccgttcatccatatgatgcagcggagcggcgacaggaattcctgcggttatgccggaggtcctcagccattttccggaaaagggcaggatctgcctcgtgcatgagcagatgctccggcatggcacctttgtactcggacgacaggcacggcccttcgagatggatgccgaccaatgccgccccatcatagggtccgccttcgatgacctctttcgcggcagcgatgcatctgagcgtctgctcaggcgtatcggtcagaatcgagcagagccaggcagtcacgccctgcgaggcgaagaagcgaccgatcttgcggagtcctgctgcactcccctcgttcacatcgacccctgccgcaccatgcgtatggacatccatgaagccgggcagcgcatagagccccgaggcatcgatgacaggaagctcgcctggattgtcgaatccggaaccgacgcgcgtgatgagtccccgctcgatagtgatgtcggcacggaagaccgagccgtcgctcacgacgcgggcaccctgtatgtagacggaatcctccatggctcccctcctagtaggcgcgctcgcgtgccacgtcattcacatagataagggcatcgggatgcttctgcagaagcgtcgccgggaacgaagccgagatctctccataggcagcatggcggacagcaccacgatgccaggtcctgaatacgccgaggcggacctggcgtgccgacagaatctctttcatgccgatggtcacggcacgatgcggcatgtcttcgagggctccgcagagatcggcagcgctgttcgtcgccctggtctcaggacggatagagagcgccctggtctcgagctgcgcgaattcatctgcagaaagttcaggctggggctcattgaaggcaagatgccccgtgatgccgatgccgccgaacgcgatatcgacaccgcccaggctctctatcgcatctccgatggcttcgggatgcgcagggtccgggaagagacgctgagaggccggcatggcaagctcgggatcgagcttgctgtagaccatgcggttcatgaagccgcgaaacgacagcccatcgtcttctgagatccactcatcctcgtctgtcagatactcgtccatattgcagaaccagacattcttgagggagagccgttcctcgttcacgagcttcacgaagtagggatactggcccaccggtcccaccggacagatgaagaccgtgcgttcctgctccctgttatgctcgcggatggtgtggaccatatcctgtgccatctggaagaagacagccgcagagtcgcccggaaatgcaagcgggatcttggcatccttccccagatcctcagctgagatgtgatagtaatccatagctcctccagccattgaaaagagcctctcccacaggaccggggagcagtccaccagaagaggctctcagggacagcatgcaatcaagctgctgtgcgctacttgttctccttgcagagcttgtcgccctcggtgatcacctcggacaggacatagttctccaccggcactgcctcggtgatgcggccgttgtcgaggaagacctgctgctgtgccttgtagtagccgaggatcttgtcggtatcgccgatagcgtcgacagcgccctgccagtcgccttcgccggtagactgcaggagcgtctcctccggaagaccaagcttgtcagccaggagctttgcgacttcgtcgatatgctcggcacgatataccttgcccatatcgagggcagcctcgaagcgctcgagcacctccttgttcgaatctgcgtagtcgggcaggcatacataggaagatgggaaggcgaccttgtcggtgtagtcggtattcgtgcccaggaccagatagtcatcgccgagctgctcctcaagcgtgatcgtattcggcgaccaggtggcacaggcatcgatttggccagcaatcattgctgtcgtcattccgtcgaccttcatctcggtcagcgtgacatcgtccttcgtgaggcccgcatcggccaggacatagttcaggatgacttcggacgaggtgccggaagctacggcaatcgtcttgcccttgaggtccttggccgtgctgattccatggctcttgttcgccacgacgcagtctgcctgggaattgccctcgaacgagaagatctttgcctggccttcgatgcacagggcatgtgcaccatggccgatctgcgcgaagtcgatgtcgccggactgcattgctgcgatctctgccggaccggcatcgaactgcttcgtctcgaccgtgatattgaacttgtcgaagtacccctggtcgagggcagcgaagagcgtgcctgcagagccaaggttcggcatgaaggcaacattcacgctgaccggttcgtacttcgaggaggacccgctgtcctttgaatcgcttgagcctgtgctctgcgcgttcgagccgcaggcggcgagcataaggcctgcaccgcaggcaccgactgcaccagcagccttgaggaacgaccggcgagtaagtccaagcgcatcgttcttgttcatggatggttcctttcccctattgcgtaccgcattccgatccattgttcgggggcgcacccccgcagacaccatgaccgctatttcctgacggagagatactcctgatagacctggctccagatatagttcttgagctcgaggaagcgcggagacatcttcgtctcctgcgtgcgcggatacgggatatcgatgttgacgatatccttcacgcgcccagggcgcgcatacatgatcacgacacgctgggcaaggatgattgcctcctcgacatcgtgcgtgatgaagaagcaggtcttcttctccttctcccaggtcttcaggagctcggactgcagctgcgtcctcgtctgggcatcgagcgcgccgaacggctcgtccatgagcagcacttcaggattcacggcataggcgcgcgcgattgcgacacgctgcttcatgccgcccgaaagctccttcggatagctcttcgcaaaatcctcgagctgcacgagcttgatgtacttctgcgcaatctcgttgcattcttccgggctcttgccctggagcttgaggccgaacttgacattgtcttcgaccgtgagccacggaaagagggcatattgctggaacacgacgccacggtcgggaccaggcccctccaccggcttgccgtcgaccgtcaccgttccagatgtcggcttctcgaggccgccgatgatgttcagaagtgtcgacttgccgcagccggaagggccgaccacgcagacgaactcgttctggtgaatatcgaagctgacgccgttcagggcggtcatctcgcccttgcgggtctggaacttcttgacgacattgtcgatatggaccctcaccggacgcgtatccgagaggtcgtggctgataggtgcttcatcgatctcgaaaacagttttctcgctcatctttagctcgcttactgacgaaggcctgccggaatgtagagtcgtctactgctggaccgtttcctgccaccccgtgaagcgcttctcgagatagcggacaatcttctcgaagatgatgccgatgatgccgagcatgatgatgccgagaagcacgacatccatctggtagtagccgcttgcctgctggatcatcatgccgaggccgcggtcgccgccgacaatctcggatgccatgagcgtcgtgagcgacgtggaaaggcccaggcgggcagcgacgaggatgaagggcgtggaagcagggatgatcaccttgaagaagatatccttctgcttggcgccaagcaccttcgcagccttgatgagcgtcgtatcgacacctttgacgccctggtagatcgtgacgaccatgacaaggaaggctgcaatgaagatgacggtgatcttcgaggtctggccgatgccgagcgctgcaatgatcaggaagacgtaggcaagaggcgggatgttcctgatgaactggatccagggctcgacgatatggcggaacgggtcataccatgccatgagaaacgccaccgggatggagacgacgaaggcgatgccgaaaccggcaaggacacgggagaccgatgcccaggcattcttccagagcgtgccgttgccagacagcttcatgaacgcttcccagacctttgccggagacgcgaagaccgcaggccacttgcttgatgcaagcacccatacgaggatagcgagcgccagcgagatcagtttccatgcccagctgggcaccttgttccagattgatggcttcttctcttccaacgtctgcctccttaggctgccctacccaacaagctgttcgcgaggaagtacttactcgtttaagttgtctgttttttatcacaagaaagataacgattgaaggaacaatttattgcgggcctgtcaaaagaccgctcagcttcgcttctgctaccgtccgcggcacttattaccgtttgaactcggtaaacggttggccatggcaatggtggacgagcggttgcatccagtctgtcatgatatacttgacacgaactgaatgctttctttcacttaatcgtaaaagctatgaaacgaggaggcgctatgggaaggcacacaaccctcaaggatgttgcccaggcagcgggtgtgacgacagccaccgtctcctatgtcatcaacaacacgccagggcagaccataagccccaagacccgcgagcgcgtgctcgaagccgtggcggagctcggatacatgcccaatgcccacgcccgcaccctgaggagccgccgcatctcctgcgtcggcgttgtcatccacaagaatctggcagtcccccgctacagccagatggtctatggcatacaggaaaggctcgaacagcgtggctacagcgtgctgcttctcggcaataccgtgggactccagggctacaccgattatgtcagcgcctatctcgagggacagatcggcggcattatcttcatagggaccgaagaccagacgcccgatccggacagcatccgcatcctccagaacgagcatgcaccgcttgtcgtcttcaactgcaagcaggatgccgacacctacagcacggtcgattatgactatgcaggaggtgcccgcctgattgcagagcgcgtcatgtccacgggtccgaaacggctcctgtatttcgagccacagatcgacacggagcaggagcgccagcgcgagcagggcatacgcgaggttgcctcggcacatcccgacgtcgagctcaagattcgccaggcaccgatcaccaaggacagaatcgagatctgggatgcccatcactttgtgggagacaccgaagaaggcatacgcctgaccgaacgcttcatcgaggcctgccgccaagctctcgacgagctcgaagacggcgatgccgtgattgcatcctgggctacctggacccactacttccgcaaggctgatccagacaagaagatcgtatacgcggagcttgccaacaatggagagtcctggatggcagcgaacttctatacccgtatgcccaactatggagccggcaccacctgtgccgacgaggtgctttccctcatcggcggctcgacaccgcagtcacgcctgatcaagctcacgaacatcgtgaccgtaacaagactcgatctctgagctggtccctctggcacagtctgcttttgctgcagaattactgaatcgtatcagctctattgcgcttctttccaagcagtgcgccacttagggcaatcaagagcgagcggcatcatatggcacgtaagcggccatattttggccttttctccacgtcagcaatctcttttcttgcatttgcagacaaatcattccatagtgttgttagcttaatcgcataagttcctactgagcgagatgaggcgatacctttggatacagcttccaggaagcgcgtgacgcttcgcgatgtggccaaagccgcaggcgtcgcccctgccaccgtctcctacgtgatcaacaacgtgccgaaccagaagctgcgtcccgaaacgcgcgagcgcgtgctccaggcagtgaacgatctgggctacatccccgatgccaatgcccgcaccatgcgcggcggcaaatcgttctgcgccggtgttgtcatcaacaaggacctggcggtcccccgctttgcccagacgctccagggcatccagaagggactcgatcaagcaggctattcccttcttctctgcacggcacggcgccaggcagatggccctgcggactacatccgtgcctacatggagcgcaggatcgacggcgtgatctttctcggcaaggacaacgaaggtccggaccgtgcaggccttgccgccatccgctcaaagcacatcccccttgtggtctatgactgccagatgaagccaggaacgtattcgagcgtcgatctcgactatgaaggaggagcacgctttctggtggaacgcatcctcgaaaagcatcccggcaagctcctctacctgagacccgacatcgcgaaggcgcaggaagaggaacgggagcgcggcgtgcgcgaagccatggcagagcatccagactgccagctttccatctgcaccgtgccggtcaccctcgaaaatctcgagtcctgggatatccgctactctgtcggcatgaccgaccagggcagggagctcaccgaccgctttgtccagaccgtccgctcggcagccgccgggctctgcccgggggatgccgtggtctcgagctggtccacctggaccgacctcttccgcagcttctgcccatcttgcggcctcgtcttcggcgagcttgccaacaacggcgaaacccgcttctcacccggcctctatctgcgccttcccaacgtggaggtaggccgcacctgcgccgatgcgcttctgcgcctgatcgagggaaagcctgccgaggcccgcaccttgaagctcaccgacatcatcgatgcctatccagcaccgcagacgtgaaagcgtctggaatcagaagaccccaagagaaaggtgatgccatgcccctcgttccactcaagcccgtgctcgatgccgccagagccggcggctatgcccagggcgccttcaatgtgaatgccgtctgtcaggccaaggctgtcatcgaagcccacgagatcctgagaagcgccgccatactgcagggagcagatcttgccaatgcattcatgggagggcgtgccgacttccagaacggaactgtcgaggacaagatccgcggcgccaaaaacatcggcgacgccgtcaagaaattcggcgagaacagccccatccccatcgtcttgcacctcgaccacgggcgtgacatggcatctgtcaaggcagccatcgccggcggctacacctctgtgatgatcgatggatcggcgctgcctttcgaggacaatatcgagctcacgcgcgaggtcgtgaagtacgcacatccgaaaggcgtctccgtggaaggcgagctcggcgtcctggcgggcgtcgaagaccatgtattcgctgccacgagcacctatacgaacccgctcaaggcagtggaattcgtccgcgcgaccggcgtcgatgcccttgccatctcctatggcacgatgcatggaccatcgaagggcaagaacgtgaagctgcgccgcgaaatcccgattgccgtacgcgaatgccttgcacatgaggggctcgactgcgcgctcgttagccacggctcatcgaccgtccccgcctatatcgtcgaggagatcaacgagcttggcggcagcatccataatgcccatggcatctcgctcgatgagctcaaggcagccattccggcaggcatcagcaagatcaatgtcgacacggacatccgcctggctgtcacgcgcaacatgcgcgagctcttccacctgcgcccagagctccagaagagcgcatctgtcggcggcgtatacgagcttctgctggcacatcccgaaaaccccgatccgcgcgtcttcctgccacctgtctatgacacggtcatgtacggcaccgtggaagaccctgaccgccaggcgctcgtcgatgcaatcgagcgcggcgtcaaggaagcggtctccaccctcatcgtcgagttcggcagctacggaaaggcgccaaaggtagagatggcatcgctcgacgagatggcagagcgctacgagaaggcaggcatctagcatgggcacccaggatacgctgcttgtcatgcatggaggaggcccgactgccgtcatcaatgcctcgctgttcggggcggtcgacgaggcgctcaggacaccggaagcaggccgcgtgctcggtgcgctcggcggcgtcggcggcattctggatggacgcttcgtcgacttcggcacggtttccagagagacgctcgcgcttctgccgcactccccctcctctgccatcggcacatcgagaaagccccttgaggagaaggactaccgcgcgcttgcccatgccctcaaaagggagcatgtccgctggcttctgccgaccggcggaaatggcacgatgaacacctgcggcgagatatggcgggcatgcagggccgaaggcgtgaatatcgatgtcgtgggcatccccaagaccatggacaacgatatcgctgtcaccgaccatgcgcccggctatgcaagcgccgccctctatatggcagcgagcgtctcggaggtctgctgcgatgtacgcggcctgccgatccacatcgtgatcgtggaggccatgggcagaaatgccggctgggtcacggcagcaagcgcccttgccgatgagtccggcaccggaggccccgacctgatctatctgcctgagcgcgatttcgacgagggccagttcctggagagctgccaggagctcatcgacgagaagggctcgggcgtcgtggtcgtctcggaaggtctccacaagaaaggcggcgtgcccgtagcaccgcttctgatggaaaccggccgctcccggtatttcggcgatgtgagcgcgcatcttgcccgccttgtcgtccagaagctcggctacaaggcccgctcggagaagcctggccttctgggaagggcatccatgccctggcagagcgctgtcgaccacgaagaggccattcagtgcggccgcgaggccgtgcgtgcggcgctcgagggcgactccggcaagatggtcggcatcgaacgcgtctcgagcgcgccttatgccgtgcgctacgtgcgcatcccgatcgagcaggtcatgctcgatgaacggacacttcccgaccgctacatcaatgccgcaggaaacggcgtgaccgaagagttcagaagctggctccgcccgcttcttggacaggaccttccccgctttgcaagctttgtctaggaggcatacatgaagcatatcttcctcaatctcaagcgcttcgatatcgtgtgcgagcgcggcggcgtgaaccgcctgtcagcacccgccacatggggcgcggccatcgcacgcgcggtcgcccctgtcgccacacgctatgaaggcacggccgaattcgctgccttcctgcctgaagcgcatatcatccctgccgtgcaggagaaaggcacggcgcctttcggcatcggctgccagggcgtgcacacagaagacagcgctccaggcggcaacttcggcgccttcacgacgctcaggaccgcaaactcgatggccgagctcggctgcagctgggcgctcatcggacactgcgaagagcgcatgcacctacgctccgtcatggccgaggcaggggcagatcctgccgccatcgaacctgccgtcgaccgcatccttgcccgcgaagtcagggcagcccaggcagctgggctcaaggttctcttctgcatgggcgagcgcacggaagagcaggatgcgtgggaccaggtgctcgcccgccagctcgaaggcggccttgcgggcgccgcaaaagacggcctcaggattgcctatgaaccggtctggagcatcggccccggaaagaccccggcagatgccccctatatcgcaaaggtcgcccgtctcgtgaaggctgccctgcccggcgtggacgtggtctatggaggagggctcaaggcagacaacgcccagatgcttgccggcatcgacgagatcgacggcgggctcatcgcgctcacgcgtttcacaggcgagatcggcttctatccggatgagtatgccgaaatcgtcgacctgtatcttggcaagtagcacagacattcgcttgaaaggaagagggaccatgcatctcgaattcgaatatggcaccggcaagatgggagcggagctccccgattcgaccgatgtcttcatcaccggcaagaccgtgaaggacccccagtgcctgcctcaggactgggattcgctctatgccgcgacgctcgactccatccgccatcccatcggctcagagccgctcgcagaccttgcccaccctggtgccaaggtcgtcatcgtcatccctgacatcatcaagggcggcacccagccgacctcgcaccgccgcgtcgcaatccgcgcctgcctggacgagctcttcgcgaacggcgtgaagcacgacgacgtgctgctcctgttctcgaacggcctccatccccgcacgagcacggccgaggccaagcagatcctgggcgaggatctctacaacgaattcgcggccacgaaccagatcgactcccatgactcggaaaactacgacgacctggtcgacctcggctatacgccccagggcgatcatgtgatcatgaacaagcgcgtctatgaatcggacatcgcgattctcatcggacacacccagggcaacccctatggcgggtattcgggaggctacaagcactgcgcgaccggcatcacccactggcgctccatcgctgcccaccatgtcccccgcgtcatgagccggcctgacttcgtgcctgtctccacccattcgatgatgcgcgacaagttcaaccagcagggcatgttcatggaagagaagatgggcaagaagttcttctgctgcgatgccgtgctcgatacctggagccgccagatcgagatcaattccggctgggccaaagagatgcagcccattgcctggaagtgcgccgacaagcgcacctacgtgcactgggctgagaagaaatacgatatcgtcgttatgggcatgcccacgaagttccactacggcgatggcatgggcacgaacccgatcatgatgatgcaggctgtgtcggcccaggtaatccgccacaagcgtatcctttccgaccactgcgtcttcgtgattgcctcttactgcgatggctggttccacgacgagcgctggccctacctgcgcgaggagtgggatgtatggaactccgacgagatgaacaccctgaacgacatgatcaagtacggggagtatttcgcgacgaacgaggaatatatccgcaagtaccgctttgccggcgccttccatcccttccatggcttctcgatgatgagctgcgggaacctggccgagaaatacctgtccgcaacctacatcgtcggcgcgaagaagccgggcatggcccgctcgatgggactcaagacgcgtgcgaccttcgaagaggccatcaaggacgcaaccggcaagtataccgatgggcatcccaacatcctggcgctgccgggcgcctatgtgagcgccgtgccgcatctgtgcatgaaggatccctcgcagaattcgcactaccgcgacgatgcgccggcccatccttgcggatgctaggagggcttccgtgatacgcctgaacgaagaggggctgggctgcaaggtcagcacgcaggacatcgagcgctccctggcccagcatccttccctcatggaaagctgctgggcaggcacgccgcatggcacggactggctcggctggctctctgtcgaccagtgggcagggccccaggagctagcccgcatccatgcgcttgccgaccggctgcgcaagaagacagacaccctggtcctcataggtgtcggagggtcgaacaatgcggcacgcgcggtcctctcggcacttggtctagccgatccttgccaccgtgtcgtctatgccggcaacaccctttccgcctggaccctgagaaagctgctcgagagccttgagggccacgaggtggcactgttctgcgtcgcgaagaacttcaggacgctcgaacccggaagctccttcaggctcctgcggcagcatctggtctcccagctcggcaagcgggcagcagcagagcgcatcgtctgcaacggcaccccaggatccgatctcgagcggctctgctcggatgaaggctacacgttcacgaccttcccgccgaatgtcggcgggcgctatacggcgctcactgccactcatctcctgccgctcgcctatgccggcatcgatatcgatgcgctggtgaaaggagcgcgtgctgaggaatcggagctacgccgtctgcccgaccacgcaaatccggcactgcgctatgcgcatctgcgctctctcgccggacgatcggggctcaccatcgagcttcttgcctccttcgagccacgtcttgccgatttcggcctctggtggcagcagctgttcggggagtccgaaggaaagcagggccggggcctctttccggcctgcgcccgctactccgaggagctccatagccttggccagtatgtccaggatggcacgcaccagctcatggagaccttcctcgatatagcagagcccggaccggacgaccatctcgtcctcggcaccagcgatgtcgcggacggcttcggctatctcgatggagcggatttctgggatatcaacaagacgagctttcatgccgtgctgaaggcacacgcatcggtccttccctgtgcgaccatagagatcgggcgcctcgatgagcagcacatgggagcgctcttctacttcttcatgctgagctgctactgctccgccgagcttctgggggtcgatccgttcgaccagccaggagtcgaagcctacaagcagctcatgcaccatgcattgggacgcgtcgagtaaggagcctcatccgtgtcagagatgtaccttgtcttcgtcgttgccttcctggcatcgcttctgggtccgctctgcggcatcggcggcggtgtcatcatcaagcctgtcgtcgatgcgatggggatccttccggtcgcggtcgtctccttcctgtcttcggtctcggtcctcacgatgtctctggcaacgcttctgcagaatgccgtctcgaagacgtcgaccatcaaggtgcgctccatgctgccggttgccctcggatcggcagcaggaggcgccgccggcaagatcttgttcaacctgctcagccagaatctccacgacagggagcttgtcggcgcctatcaggcagctatcctcatcatcctgaccattatcgtcttcatctacacgctcaagcgctcctcgctcagaagcttccgcatcggccgcccgcttgccagcgctctcatcggcgctgccgccggcgctttatggtccttcctcggcatcggcggcggtcccttcaatcttgcaatcctcatgttcttcttctcgatggattccaagcctgccgcccaggcatcgcttttcatcatcgccttctcccagacagcaagcctgctctattcggtcttcctcggaggcctgccagcgttcgagccgttcatgcttgccggcatgtgcctggctgccctgctgggctctgtcatcggccgccagattgcccggcgcatcgattcccatgcggtcgatgtgctctaccgctgcgccctggtcctgatcatcctgatctgctgctacaacttcgcaaggttctgcggcatcctatgagcctcaaagacatccggctttcccaaggcccgtgcagcatccatgctgcacgggccttctcctgccgcgcacacgctgtttcctgccgttcacaggctctcgtctttctctatttacgtcagaaatttccgatgtatacttcgtttgtgtctgatatatccgatattataaggaatcaactatgaagcatgaggaatgccaagagagcatgcggcatatcggcgagagcctgaagcgctggcgcacgatagcgggcatcacggccgatgggcttgcgcaggagctcggcatatcgcgcgatacgctctcgcgtgccgagcgcggagacctcgcggtctcggtcggcaccgtgctcgatatggcagcagatttcggcctcctctcgaaggttgaagcggccttcgatcctgcacaggacgagataggacgcatcggcattgccaaaggccttccgaagcgcgtgcgcaggacgaaggaagccgtgccacaggattggagaagcagcatgaactggtatgaaggaagctttgtctatcagatctatcctctggggctgaccggcgctccctggagaaacgatggctcccaggaaggcgccacaaataatgatgagcaccgtctcctcaagatcgtgaacgatggctgggtcgaccatatgaagaagctcggcgtcagctgcctgatgctgaacccggtcttcgagagcgactcccatggctatgacacgagggactatacgaaggtcgacagccgcctcggcacgaaggaggacttgaaggctgtcgtggatgcctgccatgaagcagggatacgcgtgctcttcgatgccgtgctgaaccatgtgggtcgtggcttctgggccttccaggacgtcctcgagaagcatcagcagtctccctacgccggatggttcaatatcgactggaacggcaactctgcctataatgacggattctcctacgagacctgggcaggcgtccccgagctcgtgaagctcaatcatggctgcttcgagctcaatgactatctcgccgatgtgatccgcggctgggaagccgactacgatatcgatggcctccgcctcgatgttgcctactgcctcgacgatggctatctcggctacctccgccagattgctgatggcctcaccgcaaagcgcggggagaagttccttctcctcggcgagacgatgttcggggactacaaccgctggatgaacgaccatgcctgcgattccgtctacaactacgaagcctacaagggcctctggtcttccatgaacgcagcgaacatgcatgagattgcctatgccttggagcgccagagcggcgacaagccctgggacctctacacaggaaagcatctgctcgatttcgtggacaaccacgatgtcccgaggatcgcaacgcagctcaccgacaagaagcagctgaagccgctctatggcctcctcttcggcatgtgcggcgtaccctgcgtctactacggctccgagtggggcatcgaaggcgtccaggactacggcgaccacaagctgaggccggctctcgacaagcctgaatggaacgatctcaccgactggatttgcgccctctccgaggcgcgcttcacgacggaaggcgcagaggctctctgcgagggcgactaccatgagctcctctgccagccgcagcagcttgtcttccagcgtgctgcccaggggcgccgtgtgattgtcgctgtcaacgcctcgaaggacccggttgtcctgcacttcgatgcaggctgtggacgtgcccaggacctcatcacgggcgaagaccatgacttcggtgcaggctccgaagttggcccctattcctgccactactggctctgcgaacgctaaggcagaaacataccccggagatgctgatggccgccctgcctggcaggacggccatctttcctactcccctatgacgccacgggcacgctctgtcgtcgtcgatatgacgcagcggtttgctggcagccacacggtgccccattcgaaggggactccattgtcgagcgtcacaagctgctcgagattgagcacgggcgccttgtcgtcgcacttgagccagcgtgcccgctcagagccagcaacgcaggcacagtagcgctgttccgaatggccgatagcatggcccgagcagcgctcgactgccgcaaagagcgactcatgttcgaagtccacctggtcgagaccgggcgctgccttgaggttgaggtggctctcgatgaacatgaccggcacatcctcgaccgtgcggatgcgtgcaagatagagatagggttcccctggcttgatgcccagagacgtcgcacagaggccctctgccttctcaatccgcatctcgcagacgatcgtgcggaagcgtatgccttgcacgctcatggattcgccgaacgagagcagcctgtttcctgatggccttgccatgaccggctgcgtgacgaaggtgccacgtccgcgctgctgcgtcaggagtccctcgtccacaagggcgcgtatgcccttctggaccgtgccgcgggagagcccgagcatgtccatgagctcatgctcagaagggatgggaacgtcttggccccactccctggaatagatcttctcgcgcacatagtctgcgacctgcacatggagcggtacagcaccctgcctgacaaacttctccatcctagcaggctgccttcccgaagcgcaggagcccctggcgcaagatctcgtcgaccctgtcccctgtcgtcctgaagaactcaggcgtcaggagagaataggtcggtgcgtcagcaagatggcgctcgttgtttccgtcgaggagcacgtctgctgccttcacgccacgctctgcatcctctgcgaggataggatactgcgggaagactgcacactcatctatgagagacggggtgagcgggacacggcgctcgaggaagaacgtccttccatagagctcgaagtccttctgcttcctgatgcgggtccgatctccgggcttcacgccgatctcagcgatgtagcgcctcgtcgcaccgttatagccagcatcgcagaccaggtgtgcccaggcaccgagcacgatatcggtgacctctgaagggtccttgccctcgatatagaggtcccagaacttctggtactggggcacagggatggttgccgtctcggccatatgcgtcatcccatacggcagcttgtgggagacatcgggcaccatccagccgacatagaggtcgggcaggaagttcccgaagaggaaattcccgatatcgcggatgccaagagcatccgttttctcctccctgaggagacgttccacgtgtgctgcatgtatgttccagctgggcatatgccttcctgtaccgatctggcccggggcgtgcgccccgggcccacgagactcgttcctagcttctgacttcgccgttcacggcacgcatgaccttcttcacgagacggtcatgcgccttctccacctcatcagaggtgagcgtgtggtcggctgcacgatacgtgagcgagaatgcaagcgacttcttgccttcgccgacacgctgcttatcgcggaagacgtcgaagaggcgcacatctgcaaggagcttgccgccggcagactggatgcgctgctcgacggtctctgccgtgacatcctcgtcgacgacgattgcaaggtcgacagagacacccgggagcgtcggcacctcctgatagggcagctcgcgcttggcaagacggagcagcgcctcgacagagagctcgaatgccacgacatcctgctcgacctcgaagttctgaaggacctcaggatggatgttgccgacccagccgatgagctccccgccgtgggcgtagatctcggcagcgcagcccggctggagccacccatactcttcctggtctgccaccttgtagcggaccttcgtgatgcgcagcgccttcaggagctcctggacgacacccttcgcatcgaagaagttgagcttcgggtacttgcggttccactggtcatcgtcccaggcgccggacatgacgccgcagacgaagcggggctcatccggctgggacttgtgctcatggccgaagaatacacggccgatttcatagagcgcgatgttcttctcgccgtggctgatgttgtactcgaccgagcgcagaaggcccggcagcatggagcggcgcatctggctctggtctgcgacgagcggattgatgatctggaccgggatgccgcggcccttctcgctcatatgcaggcgctcgagatcgcgggcatcggcgaagttgtaggtctgggtctcggagaggccaagagccctgagcgtggcgccgatcttgcggatgcgctgctggtcgaccgtaaggccgcctgcatggttcctggcagcaggaagcgtcgcttcgacctcatcctcgccccagaggcgcaggatctcctcgatgaggtcgacctcgcgggtgagatcgggacggttcgtcggcgcgacgacatcgaagccatcttctgtcggcgtaaccgcgcagccaaggcggcgcaggcgctgtgccatgaaatcaggctcgatatcggcaccggagagggcgcagacacgctgggttctgagatggatatgtgcaggctccacaggtgctggataattgtcgaccttgcctgcgcagacctcggccccgcagcactcctcgaagagggccgctgcgatgtctgcgatgcgcgagcaggcggcagcatcgacctgacgctcgaagcggatcgaggcctcgctcataaggtcgagattgcggctcgtgcgggagatgtggcccttgtcgaagcaggcgctctcgagcaggacatccgtcgtgttctcgtcgatctctgagttgaggccgcccatcacgccagcgagtgcgaccggcgtctttccatcgtcggtaatcacgatcatgtcggacgtgaggtcgcggtcggtgtggtcgagcgtcgtgaccttctcgccgtcctctgcagcacggattacgatgtggcgcttgccgtcacggacaccgagcttgttgagatcgaaggcatggagcggctggccggtgagatacatcacatagttcgtgacatcgacgacgttgttgatcgtacgggagcctgccgcctcgacacggcgggcaagccactcaggcgaggggccgatcttcacgttcttcacgacacgggcgacatagcgctggcagagtgcagaatctgcgatcgtgacatcgacgaggtcctcggcgcgcgtcgcaatctcagacttgatctggggctccgtgatatgggtgtcctcatcgaagatggcagacgtctcgactgccatgccctccatggagaggcagtccggacggttcggcgtgatctcgcagtcgacgaccgtatccgagatgccatagtagtctgtgaagtccacgccgaccggcgcatcctcaggcaggatcatgatgcccgagtggtcggagccaaggccgagctcgcgctcggagcagttcatgccatacgactcgacgccacggagcttcgacttcttgatcttcacatcgcccggcaggtgcgccccgatcattgcgacgacgatatggtcgcctgcattgaagttctgggcaccgcagacgatctgcagcggctggggcttgccgtccttatccacgttcttcatgcccacatcgaccgtcgtgagccacatatggtcggaatcgggatgcgggaccttcgtcaggaccttgccggtcacgacgtgctcgaggtctgcacctaccttctccacagcctccacctcggtgccggtgtggatgtattccttcacgaggtccttcggatcctcggggacatcgaccatgtccttcagccactcataggaaacgcgcatcgtatctgcctttctgttgcgcggaaactgtccaaagaagaggatcccttagaactgggacaggaacctcttgtcgccggtcatcagcatgcggagatcggggaggtcgtagcgcagcgctgccacgcgctcgacgccgatgccgaaggcaaagccggtgtacttctccgagtcgatgccgcagtagcggaagacgttcgggtccaccatgccgcagcccagaatctcgagccagcccgtgcccttgcagaaacggcagcccttgccgccacagacgccgcaggacacatcgacttcgcagctcggctccgtgaacgggaagaagtgcggacgatagcgggtagcgcggtcctttccgaagatctcgcgcgtgaagtagtcgagcgtgcccttgaggtcgccgaacgtgatgccctcatcgacgacgagaccctcgacctgcgtgaactggggcagatggtttgcatcggccgtatcgggacggaagaccgtgcccgggcagatcatatagatcgggggcttcctgttctccatcacatggacctgaacgcccgaggtctgggtgcgaaggagcacgtcggactcgccgagcacatgctgctccttgccttcaggagcgttgtcgacgacgtagaacgtgtccttggaagaacgtgaaggatggtcttcaggcgcattgagtgccgtgaagttgtagtaggtcgtctcgacgaacgggccgtcctcgacggtatagcccatgccgcagaagatgtcctcgatctcctcgcggatctgcgagatcagatgctcggtgccaagcggcttcacgcggcctggcagcgtgacatcggtcgactcggctgcaaagcgggactgcaggacttccttcgtgatctcgaccttgcgcttctcgatggcagccacgacctgcgcacgcacgtcgtttgccatcttgcccatgatcgggcgctcctcaggatcgagcttgcccatctggtgcatgacctgggtcaggctgcccttcctgccgagaatctggacgcgcagctcctccagcgcttcaggcgtgagcgccttggcaacgccttcgcgcacctgatcctgaatcgatgtgaggtcatcgttcattgacataccgatttgccccttccatagaaaaagccgtcctcgagcatacttgctcaaggacggcctcatgaccgcggtaccaccttgattgacactgcacgctttgtgcgtcgcgagcgcccactcgttgagctccgttccgtggagcagacggcttccctactggcagatgcgttcaggttgcagctggtggagtgaacttcgtccgccagccttcgcgaggacctctcagcctagggtcccttctctgtcctccagctacgcggcagacgaacctctccgtcattgcctgtgggcaagcttagcacaggcatcgcgacttgtatccggatatatgaacatttcccttctgttcacatccagtaggccttcaaacaaatcatctgctactgatgagatacctattgaacgcttttcggcaccgtaatatcccgcggcctgttcttgcgaagttcagcttcaattgcaggagggaccttgctgttcggaatcagctctccgataagcaggggaatgtccgttacgccatccagactcagcatttcgctattcaacttttcaaaggagattagagccgcagcatcatttggcgtcatcagtcttagcgtcgatgcatcagcagccagaataatggcaagctccattccctcttttttgcaaactttcattgcgtcgagaaaatctgagcccaagctcatttgatgtctgaacgtaatgcgtatccaggtgtgctccttatagaagcatccgctatcgccgtgccagccttttctaagaaaacgttcctcaagcactttattgagcgtgccttgcatacctttgggggcatgtttccctgcacggagctttgcgtcgcgttccgcataaaatctcacacatgcatcgcgccacacgttatctgccataagcgcaaaagcctcttcagcttctggcgttatttgcggcgcaccccaaggtggagcaacgagccggactttcatttttcctccttaacaacgggtggccagaagtttggacgattcgggcaaatcgtatcctcatccaatgtgtactcaagattcagcgcccctgtatcggctagcgtatttggaagttcccccgacaggtatatggaatcaatctgacgagcatgcacaatgtcagacaaacactctgtcttaagccagctagacaggtcatctttcgaaatgaaggcagcaggatttccctgagcatcattgacggtcccgtattttccgaggtcgaaatcgagcatctgccaaggcttggacttaagcgagatgctttcctctttgccttcaagtgccgtaagcttcactttttcgcccgaaaggtcataaactttgacgtctccattgtcttccaagcaggcaaagttctcgtcgcagagctgcataagctcatttcgaattaccctgcttgttgttagctgcctttccttcacgctccagagtcggctcagtgcttgagactgagtagcattgcgaatgttctggagctcagcaccgctgtcatcttcctgttcacgatcctcaagaacgagatctttaatcccatcagcaactacttctgggaattcgccaacagctagattcgattcatccagacgcttctggattcgcctatacattctggcttcaacgctgtctggataccagacgttataaacatctaccgacggagccacttgcccaagcctcgcgatacggcctattcgctgttcgagccgagccggcgtccaaggaacatcgacattgatgagcacacgggctgcctgaagattcaagccctcggatgccgcatcggaacagaacatgatttttactctgccggatttcagcgcagtcttgatatcgtccttcgtgcacgcctgctccacacccgcgtcgacaatgacggacttattgccgatgtagatgccatatgcatatttggcattggcgccccttttgcagaaagactccagcaatgcatccacagtatcggtataacgcgagaagagtaggacctgatcacctctgctgaggctttccagcgcaaggtcgatggacttcccaattttcatgtccccacatgagcctaaaagctcatccgcctcattgatgagcggcgaaattgctgtcgcttctacctccacagcatgaaagagcttatccagattgacgtcagaattgcttaaagccacttcatataggtctttgccctcatttaagagctcgtcttcatcgattgcatcaaaatcatttgcgatatcaaacagtccaagcgcatcggtgacactatcgcttttaccatgtttgagattctctcgaagggcaagcaccttgtgcagacggttttctaagctcttcttgcacgaatgaagagacgaagatacacgctgctgatagctgatacgaacgaaaccaacgttaagcttgcggtctggatagagctcgcgctcgatcgagaaatattcatcactgatatatttattgacttttagataaaaaatctgcattccctcattgccattaactggcacctcatgcaagcgacgcttaggaaagacgtatccgacctcttggagcgaccttcttgtattacggaccgtaagaagttgagcgggatgaagcttgatgaaagcggtctggaaagacggccattctttctgaaccatctctccgattgcatagctatcagatttgtcgatagattccaatgcactaatcgcatcgatttcaccatcattcattgaagcaaacgaaggcttcatcgaagcgagcgtcgccagcagcaaacgcccggcaactgcagcatcattcagactcggcatctcgttatcgccgataactcgaagcgacgtcttgaacttcctggacttttgccattgcgtgggcaacccaaggagcttcaacagtgcgtggtattcctccgaatcgcgctgcattggtgtcgcagttgcaagaatcaaatgaggaatcttgcctgcaactgcctccaaagctttatacattcgggttgcttttctcttgccagagatgtccacgctgatccgtgcagaatgggcctcatcaagcaccagtaaatctggcaggacagaaccttcccgttcgaagatgctgccttgctttccactgccacgagcatattgtgcagacatcagaagcagctgcggagcctgtgctccaatcgggtttgctttgccgacgggcttcacggtatccgacgagccatctccgtgtttcagcacataggaccgcttgccagagtcgtacatccaggcatcaatgccaaagtgctcatgaagctcagattgccactgcgaaagcaccgatttcggggtaagaataagcactcgctttacaccgcagtatttgacaaggaacgtgaccgtagcggcagcctcgaatgtcttgcccagaccaacctcatctgcaaagagtactctaactggccaacgcgaaagcgcatctagcaccgcacgctcttggtgctggtagagggcagggatatcgccagaaacaaagaaatatgcaggcatccgggaagcaagcgacaacgctccaggattgtccaaacttggtttaatcttattgtttcgcggcctacggcattcctttgcaagcttctttctgagcgtttcagcgagctcgtcagtcacatcagcaacaattgcatcttcagatttgttttcccatagcagctcgaagaattcttcctgctcctttacgccatcctccgcctcccaagattttgcaaccatgagctgttcaaaattgcctccgagtccactgggagtctcatttgggctacctacggccgctattcgattgccgtaatcatctgcgaagataagtgttttaggatgaaagatgccatcgccaccggaaactgcagccgccttcacctcaagaagattatcctcgatcatccaggcaagcgtggcgagccgtttgcgttcaagcgcatcgccaattgtctcgatgccttcttcgattgcactgcgtacctctgcaatctggttactcatgtactcttttctcagcgcagcatcggccagctcaggaggaaaactatggacgccaatgatcaggcgcatatggccaccgcgttcaaaaagggattggataccttgagacactgcgagaagcgaatcgatagtaaagaagctcgtaactctgtcatagcgaacggcagcatccatcaaaggtaggaggaactcgtgtaggatatgggtccccttgccaaagtagctatgtttgattgggatgtccttcaggctgtccatcatcgatccaaagcatcaagaatctgattgcagatatcctcgtccccatcaatgctattgcgcacgattgctcccgcatcagccatgcggttaagaatatccatcagccatttggtctggcgttctgaaaggactttgccgcgcttcttataacctgctacggatttaatgaacttctcttctttctcagacagcagcttgaaatcctgtcccttcttcaatacatggagaaggatatcgccagacaggttccccaccttctgctctgtagtcggaccagcaacatcaagcatgaccgtatagacatattcggtcattgcagttactctctctgacggctcggcatcgcgattcttcttgagtgcagcgagtgcgccatccagctcttcttcgcttgcgttggcgagcataatccacgttgtcttcggaggattgacttcagaaattttatctatatcttcgtcgtcaagctcaccaagcgtcaggaatgcatccagttcagaaggcgttgcatttaggaaagcggccgtccccgcaagatctaagccgttggaatagtattcgctcgaaatagaccgaatcttatctcccagagagatatctgttgcattccagatactttttatcgtttcgagggcttcgtacttccccatactattcagcctctcccgacgttcgcttccatacccactcatttctgatcttgagtgcttcggaagaactcttgtccagtgcctctacaagaagacgatagattgcatccgatgtggcaaggactttcacaacctcgtcgcctgctttatcatgcttcagcgactcccacagtggatgatctctataaagaatgacttgaagctctgaagatgcacctggctcatcgtctccatcgaagatgtaatcaaacggagcgtgtacctcatcgcctccttccttctcgagataggtaatctcaataacctgagtttcatcgccatcctgcaaggtcaaggaacgttccgttacgacattcttgactgaatcatggatgctcggcttcttactagatttcgtagaggctttcgagtcatcttccttgtccttgcccttggagtcttggacaacaggagcagccccataagtatccctaagttcagagactatctttttacgcatctgcggcttatcgatattgtgcttcttgctgattgtctctgacgcctttaccatgcctttgaggtattgatgcatatgggcagtaacaatagtccatacttcagattgctgaagaccctgcttataaaaagtcgcatccagaaaatccatattgacttctccgactatgcgcgatgtcatcaggtgaatacggaaccacgacttattccatctatccaccagctgattatggcgatagatgttgaatccatagttgccatcgttatgcgtctgagtgctgaggcccatccagccgacaatgtgataggcattatccggaccgcagtacgtatcgatatcaatcttggtgcctgttatcagctcatactctactggcttagcgtcatgaacacccgtatcatccagaatctgaatgctgtcgcctgtcttgagatgacctttgaaggcagccgaaagatacgtaagcactgcactcacagatgcattgcgctccttgagcttggaaataactatcgccgttccatgttcaatcttgccgagagggccatcttcgtttgctggattgctgtcgatgatgacatcccaagcctctgcatcatttttgcgatgtgcatagtcagacaagttaaaacgaacatggtattcgttttcctctccgacggggcgagtgtatatgtcgtaaatcctgccgagagtcgcgcatgaggtcttgagacccattccgaaagtgccttttgcatccttgcgccggtccagatactgggacatatcttcgccgatacagatagccttctccaaaatcggctctgtcattccttttccgtcatcaataatggcaatcttgttgcctcgcatgtcgacaacgatatggagcttctcttcttggtaacgcgcatcgaatgaattagcgacaagctcaccaatagcttctggaaccgtctggttggtggccccaatagtctccatcaagcgaggcgaaggcgtgttcttaactctgatttgtgccatcttctcatcacatccaagatgctctatatcaacgctttatctcaatccagatacatgcttgctaatacctgtccaagcttgtgaggtatgcctactaccaaggcgtttcccatacagaatgctcgatgtccatcgctcattcccttggtccagcctttcgggaacatttggatggcatcaagctcgtctgggacgagccttctgtacctgcccgagctcccctgtatggcatgtttcatgcggctggcacctctgccaccctcagctgtcaagatggttcgggcagccttgtcaagtgagtcaggccattccatagcaccctcggaatacatgtactgataacccgtacggctcgttctcggtatcttctttgcctgccgggtgaactcccattccttaagcttctcttttggaatgaagaattcctcaggcacttcggcatcgtcaacaacgagatcgcggagatgctcatatttaccgtcatatgatggctcgaccttggcggtaagacagattccgtcctgcatgacgccagcattctggaagaaggaaaccttgtctccaacgccgaagtctctacttgcaatatagggatcttttggaatcgcacgaagctctccaaatgtcagcggctccataatcggaaaagccttggccatcacgccgctcacaaagagcctgttcctcaagtcgtataacgcgtcatcacgaatgccaacgatatagattctcctgcgccgctgcggcatgccataatcagccgcattgattacgcgccattcaacggaatagccctctctggcaaggcatgaaagtatgacagcaaagtctcttccgcgctgactaaccggagacttgagcaagcgatcgacattttcaagcatgaggaatttaggctttttgagctgcaggaatcgatatacctgccaccacaagacacctttcttgccctctattccattggccttagaaagcggcttggcaactgaataatcttgacagggaaatcctccgacgaccatgtcgacgtcaggtatctccgtcttaccggcctcatagtcgtcaagcgtctgcttgatatcctggttcacacagctaccctcgccaaaatggcgttcgtagcattgccaggcaaactgcctggctcgagttccaggtggctcccactgattggcccaaattgtcttgaatggaccggcaggctcgaacttttccgaatcaaagctcgatttgtccgttacatcggacatgccgtccagcgcgagacggaatccacccacgccagcaaaaagctcggctatggtgacaactccatccgacacaatgcacccaccttttagacatagaactcacaagcctaaaagtatagggcattgttcagaagagcacgcgaagtatcgctgggcggtgtatctgtgcgcctgatgtctcggcttctgtgcatccaagtcaagaatcaaactagctcttatgtcaaaatgtactggtatgtatcccccatggacacgaagcccaccggtacggaatccgtcccgagcgcctccggcagccatcccgccatgcactccatgcccggctcttcgaggtcgaaatggccgaccgcgatggcgcacttgccctttccaagcagcgctgcatcgcggatgtattcgctgaccgtgaagtcgcagagctccatcgtcacgacagcatcgatgccttcccgctcgatcgtggcaatctctgccgtatcggcctctgcattgcccatcacatgcatcggaatctggatccgcgcgacggaagcatccgcatcgcctatgaggcgcgttccggaaagcccgagcgcagagacgatgctttctgccagctcgcgccccgtcatttccggaatcaggaaatccctcgaggcaggcacatcgcccacacgatattcgagccagcccatcttctgtgcaaacccatagaagatgtcatcgacatacttcccgccatcgagaggcacgccggaatggatatagtcgtggcagcgccagacgcatcctccccatccatcgaggagctccttcttcgccgcaaagaccgcattgcccgagagcacatcctgcctgtccccatggttccagaagagcgcctcgtggcagatgatgaggttggcaccacgccgggcagcttcgcggaccacgtcagatgtcgcccagaggcagcagacgacaccggtacactcctcttcgagatgctcttgcccatatgtcaccttgtcgcgggtcgtcgcttcctctatcggaagcccggtccaggcatcgatgccccggcagaagcccttggccctctctatcgcttcggcaatcttcatagcaggctccctcacgccgtgaacggccagatgccgcaggcaagcgcctcgatcgcttcggcgactgcatcgtctgcgcaggcaccgatatgccacttcgcagcggcagcagcctcctcggtcgcattcgagacagcgacagagttctctgcgacatcgaacatcgcaaggtcgttgttcgcatcgccgaagacgacgacctcgtcggtcgtgcagcccagcgcacggcagagcacctcgataccgtggcccttgttccagccggcaggcatcacattgaggtatcccggaaatgcgagatcgaagtcgaggccttctgcctcctcccccagcgcgtcgacgagctcctgcgtctcggggcgcgtgatgccagggcagaacacgttcgtcttcgtaatcttgccctcaggcaatccatcggccatcttggccgcctcggcatatgccggaaaggattcagacagctcctttcgcgtccctctcacaagatagggcaccttgtccgtgaagcagagaaggccgcacccaggatgggacgagagcacgtccagaaggtccgagagcgccctgtggctgaagtactcatgatggatgcacgtgccctcgagatagacctcgaggccgttcgtggcgactgctgtggcgcagcactcctcgtcccctgcaaacatcggcggcacccagcttctggccctgcccgaggaagggcctatcggaatgccagcagagagcgccttccggaacgcttcatgcgtacgcacgcttacggtcttctcccctttcggcaggatcgtattgtccatatcggaaaggatgaggcggcactcgtgcacgctgccatccgctgcaatctctttcactgcatcctctttctgctccaggtcctagatatagccgagacgtgccagcgcatgggcgacgccgtcgtggtgcacatcgtccgtcacgagggtcgcggcatcctttgctgcctgggatgcgttgcccatcgccactgcgacatcggcggcgcgcaggagcggaatgtcgttttccgaatcgccgaacgcaagcgtgcggccgatatgccttcccgcctcttcgagcgcatgcacgaggtcatgcgccgccgcatccttgccgacaccgggacagacgagctcgaaatagtcgggcgccgactggtagcaggcaaaatgcgtctggaagaagctgctctcgcgatagcgctcaaggtcgtagtagcgaaaggccagctttccgacctcgagcgacggcatgacctgaagcaggtcatccatgctctcgacctgctttgcgttccattcgaagccatgccgctcgccggcaaacgccctgccttcaggaccgctgaagaggatgcccatatcgtgctgacgtacctcagagagcgcttcttcgagatcctgccttggaatgaaatgcgcagatacccgcctgccatccaggagcgccagcgctccatcgaagcagagcatgccggaaaacggcagatcctggaggcattggggcacaccctgcggggcccttcccgtcgagagcagagcgacgttgcctgacgcgcagaagcgcctgatcgcatccttcgaagccggcgtggcctcgtttccccagccggtcttcgggtcccgccatgtcagcgtattgtcgatatcaaagaatgccacatccattgcctagcctcccgcgcctctccccacaagagtataccggggcaggtgctgtgccatgcccgtctgccggacagggcgaaacaggcaggaaaaggtgcagaaacacgacacagtgctttcggaccgtcacgtttcggctgcctttcgcttgccggcgcctggatgggtatgttgtagattagacagcgtcggcaaagggaacctgtacccgggaagagagcggaggccttgtatgacacaggtgtattcggagataggacgtctcagaaaggtgatgctccaccggcccggacgcgagctctgccaggtgcttccctctcagctttcgggcatgctcttcgaagatacgccgtatctggcagaggcccagaaagagcacgatgcctttgccaagatcctgacagatgccggtgtcgaggttctctatctcaccgacctcatgaagtctgccttcgagtctccgaaggtccgctacgaattcgtctccgagttcctcgaggcatcccacatcacgagccctgccctcgtggagaagctcgaggacctgtatctgcgcatgtcgccagacgagctcgtcgagaccgtgctctgcggcataaggagcgacgatgcgcgcctccaggatgtgacgtcgttcggaaacctcggtgcccgcgaggccgtctttgccgtctgcccgctccctaacatctacttcatgcgtgacaactcgatctcgctcggccatgatgtcatctactcccacatggagaagcgtgcccgcaagcgcgaggcgatcgtgctgcgctatgtgcgccagcatgcgaaggagtttcaggatacaaaggaagaggacctctacgacctctccttcccgcagcgcatcgaaggcggcgacgtgctcgtcctttccgaccattctgtcatcatcggctgctcggagcgcacgagcccggttgcgatcgaatacatcgctcacagcctcttcgagcgcggctacacggaagtctatgccttcgatatcggcatgcatcgcgcgtccatgcacctcgacatctcgctctcgatggtcgatgtggatacgttcctctacaaccccctgatcgacggcacgaccgacatctaccgcctcttcccggcacccacaggcgtcggctatgactatgtcggcaaggactggcacagagcgcttgcccaggcgaccgggaaccccgatgtgcgcctcatcccctgcggcggagacgatccggtcgatacggaatgggagctctggaacctcggcgccaatgtcctcgctatagctcctggcgaggtcgtgggctatgagcggacaccgatcacgctcgatctcctcgacaaggcaggcatcgcagtccacacattcccctcaggcgagctctcgcgcggacgtggcggcacgcactgcatgagcatgccgctcgtacgcgacctcctctagctcacattccgtcaaagaagaaggcggctgcagccctgagactgcagccgccttccgcatatcccgggcgtgccttactcttcttctgcagagagggcgcagagcgcagctccatacatgccggcctggttgccgaggtctgccggcacgatcttcgtgttcctgcagatcggcaggcagtgggcctggaagcgctcggtgagctcgtccttgaagacatcgaacgagccgacgacgccaccgccgattacgaaagcctcaggatcgaccgcgcacgacagctgtgccatggcgcgagcaagatactcgagcatctgggagatggcagtgcgtgcgcactcgtcccctgctgccatggccttgaagacagagtaggaatcggagcggcccgagagcgcgcagggctccttgcctgccttctcgcaggcctccttgtagagcgtcacgatgccggaggcgcttgcatactgctcgaggcagccatggcggccgcagccgcaggtgcgcgtctcctcgtagttcatcgtcaggtgtccgagctcgccgccggcgccattcgctcctgccacgagctggccattgaggacgacgcctccgccgacgcccgtgccgagcgtgatcatgatgaagttcttgacgcccttggcgccgcccatccacatctcgccgagcgctgcggcattcgcatcgttcacgaaggcaaggcgtgcctggaagaacgtctccttcagggcattcttgagtccgtcaggatcgagcttgatgttcggaaggaagccgacattgccattcgcatcgacaggaccggggatatcgagaccgaccgcttccacgtcggtgatcgcaccatcgaccgaggatacgaggttcgtgaggccgtctgtcacctcggcgaaggcctgaggtgacgtgaggtccgaggtcggaatggtgcggactgccttgagctggccttcaagcgtgaagatgcctgccttgatggatgtgccgccgacatcaatgcccaatacatacttcatcggatcttccttccgtaaacgtttccgggactccaagtatggcgcaaggaagaatcccttgaaacgagatatccagcaatggtgcatcctgcgacacgattggcaccaagcacgcatgtatggccatctatctgccattgctgagcgtatcccgttctgtcccttaagctgaagcacgtctcaggctacactggaagctattcataggaacatgcgcgcagacgcgcgagaggagctcgaatatggctgatacgaacgaaagcggcaagaccgaggcccaggtgagcgagcctgcgcagaaagctgacacgcaggcagcacccgctccagcaggtgtccctgctgcttcccctgccgccgtcatgaacccgaaggcagatctcgctgccctgaactcgctcgagatgcatctctatgcccacaggtatgccgagacgatgatgggctgcttcggcccctcgatcgaccccaagaaggccgtgcatgaccgcggcgaggcacaggccatcctcgacgaggaggaccaggagcttctgtgcgcaaagaacaccggcgagcttctcgaccgtctccagaggagctcggcgctcctcgaccgcacgcagcgcgcacaggtgcgcgtgctcaggcgcgagcgtgcccgtctcgagaatgtcccggcagcagaccaggcagcattcacgcgcctgctcgccgagtctggcgccgtctggcatgccgcaaaggctgcaaacgattgggcaagcttcgagccctatcttgaccgtgtcgtcaatgccatgcgccatcttgccagctgccaggacccgcacaggaacccgtacgatgtgtggctcgactacttcgagcagggcacgagccgcgcattctatgaccacttcttccgcgaggtgaagaagtgcgtcgtgccgctcctcaaggagatctcccagcgtccgcagctctcccgcagggtcgtcgagggccgcttcgaggcagagcgccagtgggccctggcacgcgacctcatggacctcgaaggactcgatccggatgtgatggtgctcacgaagaccgagcatccctactctgatggcatcacgacgaactatgcgatgattgcagcgcacgtctatgaggacgatgtgctctcgaacctctacacgatgctccatgagggaggacacgccctctacgagaccggcgtcgaccccgccctcaactacacgtcgctcaagggcggcacgtccatgggcatgcatgaggggcagtcgcgcttcttcgagaactatgtcggtcgtgccgaagccttcgcgccgtctctccttgcgcttctgcgcaagcacttcccgggccagttctcccgtgtgagcgcccgccagttctacatggccgcaaaccgcgtcgagccgggcctcatccgtaccgaggcagacgagctcacctaccccctccacatcatcatccgctacgagatcgagcagctcctgatggagggcgacatcacggcacagcaggtgccgatgctctgggccgaccgctacaagaagtatcttggcgtccgcgtttctgactacacgcacggtgcgctccaggatacgcactgggcagacggcctcatcggctacttcccgacctatgcgctgggtggcgcctatggcgcacagttccgccaccagatgatggcagaaggcatggacttcgacggcgtccttgcgaccggcaatctcgagccgatccgtgcctggctcaagaagcatgtctggcagtggggccgcacgttcgacccggcagagattgtcgtcaatgcctgcggcgagcccttcaatgtggcctactacacggactacctcgtgcagaagttcacgcgcctctacgggatcgagatgtagcgtgcgcgcgctcatccagctcatagacacggcagaggtcacggtcgaaggaaagcttgtcggttcctccggccccggcctctgcatattcctgggtgtcgtgcccgaagacacggaagttgccgccgcgcgcctctggaagaagatcctgcgcctgcgcatctttcccgatgctgccggaaagacgaatctctcccttcaggacacgggcggctctgtcctcatcgtgagccagttcacgctctgtgccgactgctcacacggcaacaggccctccttcacgggagctgccaagccagagccggccaagaggctctatgaggcgttcctcgaagatgcaagggcagacctcggagagagccgcgtgggacacggcgagttcggcgcgatgatggatgtctcgcttgtgaacaagggtcccttcacaatctggctcgataccgaaacgctctgatgaaatcggcctccccgcccacagggcagggaggccgcttctttctcgtctgaaatcagctcttacgagcctatggcacggcggagatcgtctgcaacctcgcgggtgcgccttgaaggcacaggcaggctcgttccctcgtcgagcatcacatagcccggacgcatgccttccacatggtccacgttcacggcaaagccacggtggatacgtacgaacttgccatcgagacgcgtgagcagatgcgtgatgccctcgctcatgcgaaaggtgcctgtcactgcatggacaagcgtcgactggcgggaagcctcgatatagacgatatcggagaggctcaggaagtgcgggatgccgtctgcatcacgcagcacgatcgattccctgagcgcgtgggccactgcccctccatgctcctccgtcacggcgaccgagaaatgggcatggcagatcttgagctcgcccttgagctcctgccagatgagcgtaaggcggcagggaatcatgccttcgcgggtgatggcagcaaagcggcttacggtcacacaggcatcttcatcgagcgcacaggcatgcacatcgcgcttgccgacgcccctgagctcatacgcttctgcaagctcttcgagctcctggaggaaatcatgccggtcgagcagccaatccccttccaaggggcctacagcctggagcgtttcagcaaagagcggctcgagcttctgcgccgcgtggtcagggagccggtccacaaggctctccgccatgcggagtgcatcttcctgaagctgcttcctcatgcaggagatcgcctccatcctgacccgatcaggcatggaacccgcaagctccagacatgaatcgtttcgtttcttacgtatgtgcgtaatgagtttaacgtgcctagcagcgaaaaagtcgaagaggtcacgaaagaccggcaacgctgaacagaaagctcagcgttgccggtctttgctgctgcatccccgtgcaaacgcaaaagacagaaagctgctatgcccttccaagcgcgcggattgcctcttccacctctctgcgcacctgcacagagcgacgctccggcatgggaatggccgtcccttcatcgaggatgatctggcgcgtatggatctcccgcacatgggcgacattgatcacgaagccgcggtggacacgcaggaaattcggcggcagctcggctgcgaccttgcccaggacctttgccaggcggaagatgccctccgccgtatgcaccatcgtgtactgccgctctgcctcgagatagatgacagcatctgcatcgaggaagtgggcgacacccgaggaatcgcgcatgacaagaggatgggaatcaggatgaagacggacggagaccgtgctggtaccgccctcctgctcctctccatgcatcgtcctctgcccatggctctgccacgtcggcgtcgagatatggagatgcacaagctggagcctgtcgtcctcgacggtccagaacagcgtgacacggaagcagtggaaggccacctcatgtggccctgtcggatacgacgcaagcacgtgtcctgtcacaagcatcccgtgcgggctctgcacgcgcacctggaaatactcctcggagatcttcttggcctcgatgccgtccttcggcatatggtccatataggcatcaagcgactgggggacaaggcagtactcgtccgcgctcggtccgatataggtgaagccctcatgcacatagggacgacagggctctggatcctgtctccacaaggcgcggacaatctcttcggatgttcgcagtgctttctccgagagcgtacccttcatggcaaccaccttttttggcgtgtcctgcaagaagcgccgcatcgttatctgtctgtacagatataccaattattgaaccttgtattgcagattcttaacgaacgatgggttattgcgaacaaatacatgtctaaccagatgaaagcgatatcggagcaggataatatgccgcctgcggcggaaaacctgccatccgcacagcccgggcctccagcacctgagtaccggaaagtgcgcacttcggctttgccctgccgtccagcaggagcacttcccgaaagcaatgttcccttggccgaaacccagcacgccaggtaccgcactttcccgccatcgggtacgcttccctgcaaggaggctacgagcatcctttttctggctcttcgacgtttctagtgggtagcagatgagacggccagctgggccgagaagtccaggcggccgagcctgaggaatatcatcgtcttgaaatactcaacgttcctgaagcccctcgctgccctcttgatgactggatgacggaattgagcccttcgaggatcgcttggtggcttcctggagaaccagttcaggatgccctcccgctccttcctcacggtccccgccacgaccttcattcggggacgttcgagtgcatgatccaggagacgacgcggtccagctcctttcctgcggactccctgtccgggcaggcatagacggccctcatggcctcggactggcgcatgccctggcagtcagcagtgctcgcccatgaggaggccttcctcgcggcctggcgcctcgtgaggttctcaggccgcttcagcagcagtacttcgtgcccctgggcaggctcctcttctcctcggagagcctggcttcccggcagcggaccttgtcggtggccctggagaagagagctgcgacacatggaagcggtcgacggtctggattgcctccggaaggcatggcagcccccagggctaggcttccgacatgtcgcgcgtgacccccggatggcgagccttgagcctccgtgggcctccagctcctctgcgagcctttccggagcgcccctgtccctgccttccgtgacgccgcc

SEQ ID NO: 77 - DNA, 10214 bp, Unknown
  Metagenome-assembled genome
cgcccacgatcgcgaagatgaagtcgttgtatgccatgggcagataggcgtacttctggtgcgagaagccgatgccgacaccgaagaggccacccgatccgaaggcataccagccctggatgagctgatagccggagccgtaggggtcttcccacgggttcatcatcgtgatgattcgctgcctcgaatagccatccagataggaatagacgccgaagatgatggcgcccgccacgaacgcgccggcgacgaccttccacgagaagccggcaatgagggccatgacgatgagggtggcgccgatgatgatggtcgtgcccttgtcaggctgcaagaggatgaggagaagcggcactatgatgcccgcgccaatctgcaggacaagctcctggcggtcgatcgaatgctcctcatagtaccgggcaagagcgcctgcaccggcgaggatcacgacaggctttgcgaactcggagggctggagcgtgccgaagccagggacggcaatccagcgcgttgcaccataggcatcctgaccggcaaacggcgtctcgacgaggaggagcagaaggacgacgagcatgacgagcgcaaggaacaccggcccgcgtgcccagaagtggtagtcgcgcgttgctatgacgacagccatcgcagtgccgatagcgaggttgatggcctgatgcgtgaggaagtatgtcggatcgttgccgaaggacgcagaattgagcgccgtgatcgacgacgacgaatagatcatgaggaggccgaagagggcaaggaagacagagcaggcaatgacgatcagccttggtgccatgaaccgtgccggcacgcccctgatggcgcgcatatgcttgccggcaaacgtttcccggctctgtttccttgtcgcttgggcacttggcatcagcttcggactcctgcacaatactcggctgcgagtttcttgaatagctcgccacgttcctccatgttgtggaactcatcgaacgaggagcaggcgggtgacaacagtaccacgtcttcggggatggccacagaaacggcacgtgcgaaggcttcgcgcatatgcggctcttcgaggacctcggctgtgcctcctgccgcacgtatggctccggcgatcctcggaccagcagcgccgtagcagacggcaacgcggcagcgcgacgcaaccttcttcgcaagcgaggtgaggtcggtccccttgtcgtggccgcccagcaggatcacgatatggcccggacggaaggcttcgagcgccttctcgaccgcatcggtgttcgttcccttcgagtcgttcacgaagcggatgcctcccgcctcgccgcacggctcgatcctgtgctcgagggcatggaaggagcggaggccctgcctgaccgtctcgaccggcacgccgacatggagcgccagcgccgatgcagcaagtgcattctcggcgttgtggatgccttcaagcaccatgtcctggcggctcagaagatcgtgctcggcaccgcccaggcgcacgatgagctcgtctcccctgaggaaggcggcatcggggccttccggctccgccttcacgctgagcgagcatacacggacgccacgggcacggacacgccctgcgatggcgcggcaccattcgtcgtcctcagagatgaccgcaaggtccccttctccgaggttctggaagatcttctccttcgcggcagcatagttctcgagcgtcttgtgccactcgatgtggtcaggcgtgacattcaggagcactgccaccttcgggtggagctttttcgttgtcgcaagctggaagctcgagagctcagccacgaaccaggagccctccgacctctcgtcgagcctgctcgttatgatcgtgccgatgttgccgacggtctctgcctgcatgccagcctcctcaaggagcctgcaggagagcgtcgtcgtggtcgtcttgccgttcgtgccggtgatggcgacccagttctcggggctctcgcgataggcgaactcgggctcccctatgagctcggaagcatgctccttcgccgtctggaagaaggaggagaactcggagatgccaggcgaggcgacagcaaggtcgtatgcaccctcgatatcttcggtcccaagctggaccgtgcatccgagcgagcggagctcttctgcgagcggcccctcgtggcttgccttgccgcctacgatggtgacagactccaccctgccgccgagacgcttcgcgcagtagcgcgccactgccgcaccggttccgccaagaccgaggatgaggacacgtccgagcttttccgtatttttcgccatcgccaaagcctcctagccgagctggaaatagagcgcgaagcccagtaccgcaaatgccgccgacacgatccagaagcggatgacgaccttcgtctcgctccagcccttcttctcgaaatgatggtgcagaggagccatgaggaagacacgcttgccacgcgtcttgaagctcacgacctggatgatcacggagagcgcctcgacgatgaagaggccacccatgacaagagagcagatctcggtcttcgtgaggatggcaagggacgcgaaggcgccacccagggcaagggagcccgtgtcgcccatgaagatcgaggcaggatagcagttgtgccagaggaatccgacgcaggcgcctgcgatggatgctgcaaagaccgcaaggccgagctcgtcctcgttgaaggcaaccatggccatgacgaccatgacgacaagcaccgtgccgcctgccaggccatcaaggccgtccgtgaggttcacggcattcgagaagccggcaaggagcaggaacacgaagatgagatagagccagggaatgtgcacgccgttgatcgtggtcatgaggacgccgaggtcgatggcggctccacccggaaactcgatcgtgggggcgatgccgcagacgttcacggcgacaatgccgaagatggcgcagatgatcgtgaggccgatcatcttctgggacggcgtgaggccgagcgagcgcttgtgggcaaccgactcgatatcatcgaggaggccaagagcgcctgtggcaatcatgccgaagatggcaagagcgagcttcggggagcccggtgccatgagaatcgtcgtgatgatgatgcctgccaggatgatgatgccgcccatggtcggggtgccctgctttatgagatggcgcttcgggccatctgcacgcacctgctgccccagcccttcatgcttcatgaggcggatgaagggcggcatgaggatgcccgtgaggagcgcagccacaccggaggccaggaatacctgatagcttggataggcagcagaaccgatgagaatcattatgcaagcacctctctgacaaatgcgtcgagtccctcggcacgcgatgccttcacgaggacgagatctttcggctcaagaaccggcacgatagccttggcggcgtctccgaccgtggcaaacgatgcgatggcatcttcggagagtcccatagtgcgggcaccttcgaccatggcggccgcaaggtcgtggcctatggtcacgaagaggtcggggcgcacggccgccacgtaggcgccgacatagccatgcaggcgctcagcttcggcaccgagctcccccatctcgccgaggacgcagatgcgcctgccctcgcacttcatggagtgcaggacgtcgagtgcctctgccatggatgcagggcttgcgttgtaggtgtcgtcgatgacgcggacgccgtttgcagcgaccttcacgtcgaggcgcatgcgataggcttcgaggccctcgatcgcagctgccgccttctcgcggtccacatgcaggcggtctgcgattgccatggcatagcagaagtccgtcacagcatgcctgcccgggatgcggagcttcaccgggcgcgtatagccgccctccatatggagcgtgaacgaggcgcgcccctcttcgtcgagctcgacatcggtcgcggtgcaggagctctccctgccggcaaccttcacggcttcaaggccggcaggacgggcaaagcccttctcgatgaacggcgtgaagtcatcggtcgcattgaggacaaggcagggcgatatgccggcaaaggtctcagccgatggtctcatgccggagacgatctctgccttcgcacgggcgatgttctcgcgcgagccaaggttgccgatatggctcgtgccgacattcgtgatgacagcgacggtaggcctcactgctgcagccaggcggcggatctcgccagcatggttcatgcccatctcgacgacgagcgcctgggcatcgtcaggagcggcaaagagcatgaggggcacgccgatcaggttgttgaagttgccttcggtcttgtggacacgccagcgggcagagagcgccgcggcgcacatgtccttcgtcgtggtctttccgaccgagcctgtgacaccgcagacgatccagtcaggatgcttctggcgccaggcggtggcaaggcggagcatgaactcctccgggtcgtcatgtgccgcacggacgatagcgcagcctcccttgcgggcatatgcgagcgcgtcctccttcggctcctccgtgaccacggcacaggcagctcctgcctcgagagccttggccacatagaggttgccgtccaccttctcgcccttgaaggccacgaagagcgagccttcctgtgccttgcgcgaatcgatcgtgcagccctcgaacgtgtgcttggggctgccggccacgagctctgctcccgttgcgtggatcagctcgtcaatcgtcattttcagcatgctgtttcagtatctcctctaggacacgggcttgattcccatatctttaagcgcctcactcataatactcgagaacatgtaggctgatgagctttctgcaagataaggcgtgccgttcaaaccgacatagacaagcacctgagggtcgtcggcattcgcatagccgataagggagcttatgtacttgccttcggcgtagccttcctcgtcttccgtcatctgtgccgtgccggtctttgcggcgaccttgtagccttccacggctgcatgctttgccgtgccgttctcgatgacagactcgaggacgttcgatatctggtcggtcacatcctgcgtgcagaccgttcccttcgagtcccactgcatggtctcgccggccttctctgtcaggaagtgtggcgtcatgagcaatccgccgttcgcgatggcaccgacagcctggaccatctgcacctgaggaatggccaggccctggccgaatgccatgtccgacatcgtcgtcgatgtgtagttgtcgtagtccgtgaccatgcccgtcgcctcgccgggatagtcgatgccggtcctgtggccaatgcccagactcgacaccgtggaggagaagccttctgcgccgacggcacgggccataaggatggcaccgacattcgaggattcctcgaggatgtgcgaaaccgtcatgtcttcggtcgagtagcgcgtgatggcatccgtgacatagtcgtcgccgacctggatctgaaccggcacgctgaagatcgtatcggtgctgaacgtcccgtgcaccagcccggatgccatcgtcagtatcttgaagatggagcccggctcatagaggtccgataccatgcgcaggttcagcgcctcgttcgtgagctcggaggtatccgagagatcggccagaggggtcgatgcggttgccaggatctctcccgtattcgggtctgtcaccatggcggacgacgagtctgccttgtacttctccgtgccttcggtcaggacctcttcgagctttgcctggatgttcacatcgatcgagatcacgatatcggagcctgcggtcgccttcgtgacttcagcgacgccgcctgcaataggcgtgccgtcagcgcctgtctccatgatcatggagccatcctggccggagagcacatcgttgtagtagagctcgaggcctgtgaggccctggccatccgagccgaccatgccgaggacctgtcccgcgacagagccataagggtagatgcgcttcgtgtcatcgaggagatagacgcctgcgatatcggcttcgtcgagcttgtcgtcgagcgtcgaggcggtcgtcgtgtcgaccttcttcttgatataggcaaacgtcgtatcctcatcgacaatctcgagatagtcgtccttcgagccgccaagcgtctctgccatgatctcagctgcctggtccttgtccttgatgagcgaaggattgcagtagatggtctttacatcgacgctcatggcgaggacattgccgttccggtcgtagatcgtgccacgctttgccgtgagcgtgatctcgttcgtgcggctgtctgctgccatctgcgtgagctcagggccctggaggatctggagatagaagaggcgtgcgcacacgacgagtgccagcgcggcaaggatgcagaagaccgcgacaaggcggccatccatgcccttcacatgggagaggatgccgccgccgtctgtgtgtccatgccgccaggactgcctgtccccacgctgtgcgcgctcttcgcgcctgcgggcacgcgcctcgcggttctggaccacttcatcgtacgacgagcggcccctctcggggccgttcgctctgctgtgtctgtcttgtctttccatgtggatgagcttacgccagaaggagcgcgcccctactccacattcgaagaatccgcagtctctgcgtcagtctgagaaagggatgccgttccatcggtcgaagaggcagcggcgctatcagaggaggatgccgtcgaagagatgacctcggggtcctcgaggaccataccgtagttctgcgtcgcgatgcgctcgatgcgcgacacgctcgacagcgccgacttcgacgccttgaggtcgttgtagagagccgtggcatcgccaatctggctctcgagggactcgtttgcctggagggctgagacggtcgccgccggtccgccgtcgcgcttgtcgcggcagccatctgcgcgctcggctttgccctgttgcgatctcgacggcgaccgtctcagccctccaggcaaacgagtccctcgagagccatatggcgatgccacggctctctacaacgacctcaaggcgtcgaagtcggcgctgtcgagcgtgtcgcgcatcgagcgcattgcgacgcagaactacggtatggtcctcgaggaccccgaggtcatctcttcgacggcatcctcctctgatagcgccgctgcctcttcgaccgatggcacggcatccctttctcagactgacgcagagactgcggatcttcgaatgtggagtagggcgcgcctccttctggcgtaagctcatccacatggacagacaagacaagacacagcagagcgaacggccccgagaggggccgctcgtcgtacgacgagtggtccagaaccgcgaggcgcgtgcccgcaggcgcgaggagcgcgcacagcgcggggacaggcagtccggcggcatggacacacagacggcggcatcctctcccatgtgaagggcatggatggccgccttgtcgcggtcttctgcatccttgctgcgctggcactcgttgtgtgcggacgcctcttctatctccagatcctccagggccctgagctcacgcgatggcagcagacaccgcacgaacagatcacgcttacggcaaagcgtggcacgatctacgaccggaacggcaatgtcctcgccatgagcgtcgatgtgaagaccatctactgcaatccttcgctcatcaaggacaaggaccaggcagctgagatcatggcagagacgctggcggctcgaaggacgactatctcgagatcgtcgatgaggatacgacgtttgcctatatcaagaaaggtcgacacgacgaccgcctcgacgctcgacgacaagctcgacgaagccaatatcgcaggcgtctatctcctcgatgacacgaagcgcatctacccttatggctctgtcgcgggacaggtcctcggcatggtcggctcggatgggcagggcctcacaggcctcgagctctactacaacgatgtgctctccggccggatggctccatgatcatggagacggcgctgacgagcccctattgcaggcggcgtcgctgaagtcacgaaggcgaccgcaggctccgatatcgtgatctcgatcgatgtgaacatccaggcaaagctcgaagaggtcctgaccgaaggcacggagaagtacaaggcagactcgtcgtccgccatggtgacagacccgaatacgggagagatcctggcaaccgcatcgacccctctggccgatcctctcggatacctccgagctcacgaacgaggcgctgaacctgcgcatggtatcggacctctatgagccgggctccatcttcaagatactgacgatggcatccgggctggtgcacgggacgttcagcaccgatacgatcttcagcgtgccggttcagatccaggtcggcgacgacatgtcacggatgccatcacgcgctactcgaccgaagacatgacggtttcgcacatcctcgaggaatcctcgaatgtcgtgccatccttatggcccgtgccgtcggcgcagaaggcttctcctccacggtgtcgagtctggcattggccacaggaccgccatcgactatcccggcgaggcgacgggcatggtcacggactacgacaactacacatcgacgacgatgtcggacatggcattcggccagggcctggccattcctcaggtgcagatggtccaggctgtcggtgccatcgcgaacggcggattgctcatgacgcccacacttcctgacagaaaggccggcgagaccatgcagtgggactcgaagggaacggtctgcacgcaggatgtgaccgaccagatatcgaacgtcctcgagtctgtcatcgaagacggcacggcaaagcatgcagccgtggaaggctacaaggtcgccgcaagaccggcacggcacagatgacggaagacgaggaaggctacgccgaaggcaagtacataagctcccttatcggctatgcgaatgccgacgaccctcaggtgcttgtctatgtcggtttgaacggcacgccttatcttgcagaaagctcatcagcctacatgttctcgagtattatgagtgaggccttaaagatgggaatcacccgtgtcctagaggagatactgaacagcatgctgaaaatgacgattgacgagctgatccacgcaacggagcagagctcgtggccggccgccccaagcacacgttcgagggctgcacgatcgattcgcgcaaggcacaggaaggctcgctcttcgtggccttcaagggcgagaaggtggacggcaacctctatgtggccaagcctctcgaggcaggagctgcctgtgccgtggtcacggaggagccgaaggagacgcgctcgcatatgcccgcagggaggctgcgctatcgtccgtgcggcacatgacgacccggaggagttcatgctccgccttgccaccgcctggcgccagaagcatcctgactggacgtctgcggtgtcacaggctcggtcggaaagaccacgacgaaggacatgtgcgccgcggcgctctctgcccgctggcgtgtccacaagaccgaaggcaacttcaacaacctgatcggcgtgcccctcatgctctttgccgctcctgacgatgcccaggcgctcgtcgtcgagatgggcatgaccatgctggcgagatccgccgcctggctgcagcagtgaggcctaccgtcgctgtcatcacgaatgtcggcacgagccatatcggcaaccttggctcgcgcgagaacatcgcccgtcgaaggcagagatcgtctccgcatgagaccatcggctgagacctttggccggcatatcgccctgccttgtcctcaatgcgaccgatgacttcacccgttcatcgagaagggctttgcccgtcctgccggccttgaagccgtgaaggttgccggcagggagagctcctgcaccgcgaccgatgtcgagctcgacgaagaggggcgcgcctcgttcacgctccatatggagggcggctatacgcgcccggtgaagctccgcatcccgggcaggcatgctgtgacggacttctgctatgccatggcaatcgcagaccgcctgcatgtggaccgcgagaaggcggcagctgcgatcgagggcctcgaagcctatcgcatgcgcctcg

SEQ ID NO: 78 - DNA, 10690 bp, Unknown
  Metagenome-assembled genome
tcctcaaggcctttttgtttttcccgtgatcccttcaaccggtgtgctcgcacttcttgcgctcgtgacccttgcgggagatgtgctctttgccgcgcctgaagacaggaatccgctgtccctcctcatcatctgcggcatgatcttggtctccggcatcctgcgctttgtccaggagggcaagagcagcgtggcggcagatgccctggcaagctccatcgagacgttctgctcggtcgagcgggcaggggagggcgtcatcgcgctgccgctctccgagattgtcacaggagatatcgtgcatcttcaggcaggagacatcgtgccggcagatgcctgcctgatatctgcccgcgatctctttgtcggcatgtcctcgctcacgggcgagagcctccctgtggagcgtgtggctggacctgctgcggcagatgagacggtgcccgtggccgatctttccgatatcgtcttcatgggctcctccgtcgtttccggaagcggcaaggcggtcgtcttcgcgacgggctcccatacgctgatcggaagcatggcaagaggactcgacgaggggcgcacgaagacggcctacgacgagggcatcgccgacacgagcaggctgcttctgcgcttcatgcttgttatggcgcctctggtctttgctatctgcggccttacgaagggcgactggctccaggcgctcctgtttgcgctctccgtggcggtgggccttacgcctgagatgctgccgatgatcgtcacgacctgccttgcaaagggcgcacgcgacctggccgagcatgaggtcatcgtgaagaggctcgatgcggtgcagaacctcggtgcggtcgatgtgctctgtacagacaagaccggcacgcttacggaggaccatgtgatcctcgagcgccatctcgatctggatggcaaggaggatgcacgggtcctgggctatgcctacctcaacagcttcttcggcaccggcgtcaagaacctgatggattctgccatcatcgagcgtgcggcgctcgagacgaagcgcacaggcactctcgatgcggacaggctcgcggatgcctggcagcatgcagacgagctgcccttcgacttcagccgcaggcgtgtctcggtcatcgtacgtgcagatgatggcacgctccttatggtcgagaagggggctgtcgaggaagtactcgcgacctgcacggaagctgagctcggaggcgtggctacgccgctgactcctgaggtgcgcagcctcatcgagcgcaaggtggcagatctggggcggcgcggcatgcgtgtccttgctgtggcagtgaaggtgtgcacagggcacgtgggtgccttcacggcagaagacgagtgcgacatgaagcttgtcggctatcttgccttcctggatcctcccaagaggagcgccgcttctgccatcgaggcactcaccgtacacggcgtggcaaccaaggtgcttaccggcgatgctctgggtgtcgccgtgaccgtggcgcagacaatcggcatccccaccgaccatgtgctcgaaggggcgaagatccagacgctttcggacgaagagctcgagcgccgcgcagaggagacgacaatctttgcaaagctcacgcctgaccagaaggtgcgtgtcgtctcggcgctgaggcgtgcgggccatgtcgttgccttcatgggcgacggcgtgaacgatgccggtgcgatgcgggcaagcgactgcggcatctcggtcgacacggcagccgatgtctcgaaggaggcagcagacatcatcctcacgaagaaggatcttgccgtgctcgaagagggcatcgtgagcggcaggcgcacgtctgtcaacatgaacaagtatgtgaagatgtgtgcgagctcgaacttcggcaacatcttctccgtgctcgtggcaagcatctgcctgcccttcctgcccatgaccgccgtgcagctcctgcttctcaacttcatcaatgactgcgcatcctgcgccctgccgtgggaccgcgtggacgaggaagcgctggcacggcctgtgaagtggcagtcgggcgccgtctcgggcttcatgcgtctcttcggccccgtgagctctgccttcgatatcctgacctttgtggccctcttcttctggatctgtcctgctgtggcaggagggagctgggaggcattggctggagatgctgctgcccgtctgctctttgccgggacattccaggcggcatggtttgcggagtcgatggtcacgcagatgctcttcgtccatctggcaaggacggagaagaagcctttcgtggagtcgcgtgcagacgtgcgccttgcaggtctcagcgcaggtgccgctcttctgtcgctcctgattcccgagactgccatcggtgcctctctgggctttgcagcgcttccggcaagcttcattgcgctcctgccggcactggcgctcggctatgcggtctcagtgctgctgcagcgcaggcgctacatcgcccgcttcggcaggctcatctgaatgtctggtgctccgggggatgtcctccggagcactcagcgtctagctgaggccgggatagccgcactgccgaagcgcttcgaagagcacgatggcgcaggcattcgagagattgagcgacgtcacgaccgaggctctcgggtcgacgaagttgccgcaggcgtcgcgctcgagttcggggtggagggcgtcgaagcgctcatgccagctctcggcatttgcaagcaccatatcggtcttcatcgggatgcgttcagccagggcaggatgggctgagatgagctcgcgggaaaggcctgcgctctcctttccgaagacgagatagtcgccgtcgtggtagatgctctcgccgatgcttctctttcctgccttcgtgagcagatgcacgtggatatcggaggccgcctccgagctctcttccgtattgcggacaagggcagcccgcactgcaggatttgcctcgacgaagcttttccagccggggtaggtcacgacatcgaggctctgccagtaggcgaggcctgcacgcttcagggcatgcgcatcgagggagaagccgagagggccgaccaggtggagacgggcgccagcaaggacgcaggtacggcctatgtttccggtattggcaggaatctcgggctcgacgagcacgacattgaacacgatgcatcccttctcttgtgagctggaggagctcccagtatagactgaaggggacaagcaccgaaacgaaggaggtctccgtgctctttctcatatctcccgccaagcagatgcagcgagacgacggattctcgctcaggctccaggagccgcgcttcctggccgaggcagaggagcttgccggcgctctctgctctctgggaaagcagggcgcccagaaggtgtggcgcacgagcgacacgcttacggagcgtgcttgggagatcacggagcacctgccggaagagcttagctacggcgtgcgcacccctgctgtcatggcatatgtcggcatccagtaccggcatctggcgccttctgtcatgacagagaaggagctcctgtggctcgaccggcatctccggattctctcggggctctatggggtggtggcaccgaatgacggaatcgtcccgtacaggctcgagatgggatcgaagctcgccgtgggcggaggcaaggatctctacagcttctggggaggaaagatcgcagcatctcttgcagaggagcgaggaggggagacctttgtgctgtgcgcctcgcatgaatatgcgcgcgccgtgctcccgcatgtgccggagggcgtggctgtcctctcgtgcgagttcatggcaccacggaagcgggatggcaagctcgccgaggcagcgcctgaggtcaaggcagcgcggggctgcttcgtgcgctggtgtgccgaagaaggcatagaggatgcgtcagagctcgtgcactttgccgagcgtggctaccgcttcgcgcctacgctgtctctcggagggcatctcgtctttgtccgggcggcctcggattctcaatagtccatatccgcgtcgaggtcctgcttgccgatgccggaaagcgatgccggtgctgcggcccagaggggctggggcgctcgaggcagctcttcgagtgcggcgtcgatctcttcgcgcgagaggccggccagggtatgccctgccccatgggacgtcctggggcatcctgcctgtgccgtcttctctctcctcatcgcttccgcctttcttgcagcgagcatctgctacaggatgtgatggtgcggctcgaggttctcgaacgtgcagaacgaggagaagccgagcgagcgtgccatgtcctcggcgaccttcaggtaggcgccgagctggccctggcggatgcagcccgatccgaacgtgaggatcgtgccaccgaggtcgcggtagagcgtgaggatgtctcttgacggcatgggcgccttctcgccgtggcacagggctgaagtgtttatctcgagtccatggccgccctcgatcgtcttctcgaggatggcagccacgatatcctctgtgctctcgaacggaagcgggccttcgcctgagtagtcgtgataacggatgaggtcgaggtgcgcaagcacggaccaggaatcgaaatgctcgatgcagccgagcacggcctcatagtagccgcgcgtgaattcgagctgcgtcttgccttcctgatactcgttcgtccagaactcgaggttgccgatctcatgcacggagagaaggaccatatcgaggtggtcctgccactcgccgaagagcttctcataggcagggatggtctctttctggatgccgaactcgaggccacgaccgcaccagagcaccttgccatagcgctcgcgcatctcttcgagctctgcgaagtaggcaggataggcacagttcgtgagggggcgtccgttctcgaagcgggcaccttctgggtggtcccagtcaggcttcacgccgtagtcgacccgctctgtgaggcatatgccatcgaggttgagcctgattgcatcgatcgtggcctgctccatcggatagtcggactcgggagagtagctggagtggacgtggcagtcttggagcatggaggcccctttcggtctgggaaagctgcttcatgaagcatggcgcaggaagagggacagttttctgaggattctctgaagggagctgtcgattccgtgaagtgcctatagagagaagctggaaagtggctgcaggttttctggaggcatgaggggcctccccgaatggggtacgacctcaatctacgagactcaagaaggaggatcatgcatcttttcaagaagaatgggaaagacccgaagacatctcgcacgaagggctggcgtcctctggtcctggcagcgcttgccggtgcagtccttgctatcgtgcttgtggcagcgttctcgaatttccagacagcgcagccgtcatctgccgcctcgacgacaatcaagaattcgctctcggacatctcggagctctccacggaagagtacagcttcgcgaatgtcggcaagtataccgaagacgacctcaaggtcctcggcatctcgattccattcacgggcagctcctttgtcgcaacctacgaaggcaccgtgaaggcaggcatctctgatatcgaggcagccgatgtcgcggtcgacgacagcacgaagaccgtgaccgtgacgcttccggatgtcgagatcctgagctgctcgatcgatccctcgacgatcgaggcctacgaccagacgttcaatccgatcaaccagatggtggcaccgaatgacggaatcgtcccgtacaggctcgagatgggatcgaagctcgccgtgggcggaggcaaggatctctacagcttctggggaggaagatcgcagcatctcttgcagaggagcgaggaggggagacctttgtgctgtgcgcctcgcatgatatgcgcgcccgtgctcccgcatgtgccggagggcgtggctgtcctctcgtgcgagttcatggcaccacggaacgggatggcaagctcgccgaggcagcgcctgaggtcaaggcagcgcggggctgcttcgtgcgctggtgtgccgaagaaggcatagaggatgcgtcagagctcgtgcactttgccgacgtggctaccgcttcgcgcctacgctgtctctcggagggcatccgtctttgtccgggcggcctcggattctcaatagtccatatccgcgtcgaggtcctgcttgccgatgccggaaagcgatgccggtgctgcgggcccagaggggctggggcgctcgaggcagctcttcgagtgcggcgtcgatctcttcgcgcgagaggccggccagggtatgccctgccccatgggacgtcctgggcatcctgccttgcgtcttctctctcctcatcgcttccgcctttcttgcagcgagcatctgctacaggatgtgatggtgcggcctcgggttctcgaacgtgcagaacgaggagaagccgagcgagcgtgccatgtcctcggcgaccttcaggtaggcgcgagctggccctggcggatgcagcccgatccgaacgtgaggatcgtgccaccgaggtccggtagagcgtgaggatgtctcttgacggcatgggcccttctcgccgtggcacagggctgaagtgttatctcgagtccatggccgccctcgatcgtcttctcgaggatggcagccacgatatcctctgtgctctcgaacggaagcgggccttcgcctgagtagtcgtgatagcggatgaggtcgaggtgcgcaagcacgaccaggaatcgaaatgcctcgatgcagccgagcacggcccatagtagccgcgcgtgaattcgagctgcgtcttgccttcctgatactcgttcgtccagaactcgaggttgccgatctcatgcacggagagaaggaccatatcgaggtggtcctgccactcgccgaagagcttctcataggcggatggtctctttctggatgccgaactcgaggccacgaccgcaccagagcaccttgccatagcgctcgcgcatctcttcgagctctgcgaattaggcaggataggcacagttcgtgaggggcgtccgttctcgaagcgggcaccttctgggtggtcccagtcaggcttcacccgtagtcgacccctctgtgaggcatatgccatcgagttggcctgattgcatcgtcgtggcctgctccatcgatagtcggactcgggagagtagctggagtggacgtggcagtcttggagcatggagcccctttcggtctgggaagctgctcatgaagcatggcgcaggaagaggacagttttcctgaggattctctgaagggagctgtcgattccgtgaagtgcctatagagagaagctggaaagtggctgcaggttttctggaggcatgaggggcctccccgaatggggtacgacctcaatctacgagactcaagaaggaggatcatgcatcttttcaagaagaatgggaaagacccgaagacatctcgcacgaagggctggcgtcctctggtcctggcagcgcttgccggtgcagtccttgctaatcgtgcttgtggcagcgttctcgaatttccagacagcgcaccgtcatctgccgcctcgacgacatcaagaattcgctctcggacatctcggagctctccacggaagagtacagcttcgcgaatgtcggcaagtataccgaagacgacctcaaggtcctcggcatcctcgattccattcacgggcagctccttgtcgcaacctacgaaggcaccgtgaaggcaggcatctctgatatcgaggcagccgatgtcgcggtcgacgacagcacgaagaccgtgaccgtgacgcttccggatgtcgagatcctgagctgctcgatcgatccctcgacgatcgaggcctacgaccagacgttcaatccgatcaaccagatccaggtcctcggatgtctcgagcttcctctcgtctgaagaggacaaggaggagaggaggccaagacgaacggcacgctcgacaaggcacgtacgcatgcagagaagattgtgaaatctgtcgtctcccctcatcctttcggcacaagccgcgacggctatgcggtcaaggtgtcctggaccacgtccggaaccgatacgtcagcggatgctgcatagagggccttggaggcatgatgcttgaggagcagggtgcgccacgccgcctctttctggcgctgcgcttcacagatgcggaagagacgagcttgaaggaatagcctgtgccgctgctgcaaggatgaggccggcacgccgcactcagatagaacctccatctgacgcttgccttcctcgcatgtgtgatgccaggaccgaggaggcggcaaggcttgcaggggcggcagctgcagaggcagcgggaccagtttcagagactcttggagaccttgggtccttctcgcccggcgatcttctgtgatatggcgaggagtgtctggagatcggggcttcggggactgcaggccagaatcgctgcagacgcaaggagcaggacgttcccttcgacgacaggccgtttgttccccacgtaacgcttgtgcgcggagcggcagcgcagcgaggcgagatatcgataagattcttgcagacctgtcggagaagctccatcctctctctaccaccatgcagaggtcgcgctcatgtggagccaccatcatccagagtggtcgcctttgatctatacgccgttgcccgcttccctctgcttgcgtaggttttctggacgcagggtccgtatgcgggcaagggtctaggatttagagggcgcaatggttccagtgcctgcgctctggtctgcctgcccggcagacgaaacgagaggaatgactcattttgccctcactgcgggattccgtgataaccggacaacagtacgttctgtgcgcagtgcggagcacgcctgctgagcctcagcaggatgcgctcctgcagctaggccggccaaggcacaggtccgggtaccgaggcaaatgcgcgcgcagcagagattgcggggagcgtgcctcctgtcgatgctccttgccggtacggcagagccgccgctggtgcaggagacccatctcatgcctgagggggcagctggcgcatctcttcacccagcccagagacaggtgcccgagatagacaagaccatggtgcgccccgtgcgttcgctgcgcacagagactctgcccgcagccgaaaaggagctggcccagcttccccatcggaagcctcgggacctcagacaaaccgccaggctgcttcggcaggaaatcggagatgtccggttccgctctggacaggcgttccctcgtatgggatggcaggaggcatgtcgcaggaggctcgtcgatgcggggaagcgggccagctccttttcggctgcggcagagtctctgtgcgcagcgacacgcaccggggcgcaccatggtcttgtctatctcgggcacctgctctgggctgggtgaagaagatgcgccacctgccccctcaggcatgagctgggtctctccgtgcaccagcggcaggctctgccgtaaccggcaggagcatcgacaggaggcacgctccccgcaatctctgctgcgccgcatttgcctcgtacccggagcctgtgccttggccggctcagctgcaggagcgccatcctgctgagctcagcaaggcgtgctccgcactgcgcacagaacgtactgttttccggtatcacggatccgcagtgagggcaaatcatgagtcattcctcctcgtttcgtcctgccgggcaggcagaccagagcgcaggcatggaaccattgcgccctctcatatcctaacccttgcccgcatacggaccctgcgtcaacaacctacgcaagcagagggaagcgggcaaccggcgtatagatcaaaggcgaccactctggatgtggctccacatgagcgcgacctctgcatggtgtgtagaggaggatggagcttctccgacaggtctgcaagaagcttatcgatatcctcgcctcgctgcgcgtgcgctccccgccaaagcgttacgtggggaacaaacggcctgtcgtcgaagggaacgtcctgctccttgagctctgcagcgattctggcctgcagtccccgaagccccgactctccagacactcctcgccatatcacagaagatcgccggtgcgagaaggacccaaggtctccaagagtctctgaaactggtcccgctgcctctgcagctgccgcccctgcaagccttgccgcctcctcggtcctggcatcacacatgccgaggaggcaagcgtcagatgaggttctctctgagtgcaggcgtgccgcgcctcatccttgcagcagcggcacaggctattccttcaagctcgtcctctttcccgcatcttgtgaagcgcagcgccagaaagaggcggcgtggcgcaccctgctcctcaagcatcatgcctccaaggcctccttatgcagcatccgctgacgtatcggttccggacgtggtccaggacacctgaccgcatagccgtcgcggcttgtgcccgaaaggatcgaggagacgacagatttcacaatcttctctgcatgcgtacgtgccttgtcgagcgtgccgttcgtcttggcctcctcttcctccttgtcctcttcagacgagaggaagctcgagacatccgagactggat

SEQ ID NO: 79 - DNA, 14072 bp, Unknown
  Metagenome-assembled genome
ccattaagcggagcgacacggataactcttcacatgcttgtttgtaagtcatcgtgttcacactggagagacctatgaggttgacaaccaagaaatgatccttccctcatcacagaaaaaagcgttcgagcgacactcgtgaacgacagcaatcgccctcatcctacgaatctctgtgtatctattccgatgccctcctccatcaccacagggtcgcggcggaatgtcatgaagatgctcaaggaagagcgttccatatgtggcaggcttcattggcacgacgtgccaatctccgtcgcctcaggaggatttcgtgttcacgtggaagagctagtagcgctcgagacattcactccccccaattcgttttgccatccaccacatcatccatcttgaggacaagacgagatgtcctcacgcgttcgaaggcgcgtagatgaaggaactcagctcaatctacgacacagagcgcggaaaatgcaaaagaacagcgaccaatctttgtcggcagtcgggtctcatactgcttcatctcttacgaacgttccatggctcatggataaggtcgacgatgataatcgaagtagccagtcgaacttcgctggacggatcttggctaaagctcctggaacatctcatagaacgtggtcttacccttctgactcgacatcggacataggggctacccaacataacgagagtacatgacaacgttaagtgataggtgtaaaaaagcgccccgttgccccggacaccaccacccacagaattggcatcgttttgtggagaaagaaatagaatgagaaagtacgccttctgcgggacgatatccgaacagcttttccaagcggaccatatgtattagtacatgaatacggagccgatacggcgtaacttatccatcgcatacattccgtacgcatagccggcaatgccgagtgcacaacagaaaaacgatatgcaacaaccaaaatcgcatcagagatgaacgcaaaataacacccccgaaaggcaccaacagcaatatcctgcatgcccaaaagccaatcatgacatgccagcctgtcagattggccaacacacataaacgttgctaggactgagtgaatcaagaaaaagcaagactatacgtaatgcaaggcaccacaattaatacatcgccaggccatcagtgagcataaaaagcaaacaaaaatccaatcggtgcatttacctccctcccggcttacctcgtacggcagacaagcaatagacggaagacgcaccaacaaagaacgaaggcagcgctcaccgtcctcctcatggcccagacactggaaggacggcgtgcctctggccaggcaagacccttctatcgtggcttcactcataccgatgagagaagacctcgccacaggatgcaaacacgctcacagctcatgacttgcgaacaccaatctattagggacagagagagctgagagacgaaccggtacagcgaacatgctatgcaaggaagcttccctactcagacccaattcgtgagcaacgtacaaaacacaccaagatcgccgtgatgcagcaccgtccttatgtcagaactgttgcacagcaccagcaggcatgggaccatgcgcgatctgggcgttagccctaggcaggaggcctccgtctacagcatagacataccacagggcgaacacaatacacgatcaaaaattcgaagacggaagaaccagaagcgacaaggaaccgacacccccacaacacatcgagctaacaatcacccaatgtacagagcttacgaagttcatgtcctcatagtcatcccccaaaaggccaagcccaacgacaatggaaccataaagctcaagtgccaaatatttttcggcattcccgagaatgtaacaggaggaaaggaaggccaaccgcccacacacacaggggtagggcccccacacgttaatcaatattaaaaatgaaatgcacccttgaaccgagaggtgcaaaaccccacaatcaacattgaaggcccacacacacaaaaaaaaaccaatcgaaacttcaatcacttacacacaaccaaaaaaaacaacacgaaaaacaccctttcccacgggcaaaggactgtacagcaagaagacgctcacaatcatacgtcaatacaagatccaaaccaaaagatcccacacaaacaatcctcaaatcctcgggaggcgcttactaaaaaaaaaatccatcaaaaaaactcaaaatcaaaaatccccttatcaatccaacatcacccttcaatactgatgcaatcaaatatagactctccccaaccaacacgacacccaaaacgcccacaatttaatcaatattacaaaccccaccatcaaaaaacccaacccaacaccactttctcaatcttcacaaatactcctctctccatttcctcttcacgaacacaaaagaatatctcaaacaactaatccactaaaactcaccaaacaaaacaacaaaacaataataccaacacacataacaaaaaaaacaacccaacattactcaacaacaaacaccaaacaacccacaacaccaaatccaatcccacacatattgcttcttatttcgcaccatcccaatcctcattgcccctgtcagtccctacctctgctccactacccaccatcccttgcccctcttccgttgtctagtcactcctcttcgcttgtccacccacccatgtctcaactgcgcgtggattgacctactttctccttcgctctcctcccgctctggctaggatgggaaaacactgaagatgataacacaatacctcgatggctaactgaccaagcagcagaccaaggtggttctgacaccctgatctgactggtagtcaacgcggcaggatcgtgccgactaggcagaaggacagctcaaacgtggctacgatcacacgttcgacaaaatctacagaatcgaccggagcgaggtcggaaccttccccgcgaggcaagacctgctgcccttgagtcctgggcaaggcgtcgcaaggtcctgaagaagagccagaaggacgccacttggggcttgaggacgtgacctcatgttcaagacagtccaggcagagttctcacagagcgcacgatgttcgcgtcctgattgaagaccccatagatacgaaagcagcccgcagtgcctatgcgcatctgcgggctgcaatctttattgggaagtgagagaggaaggggttcgaaagaggggtttccgaacttactcctgccaggcctttgcctcggcctcggagatcggacgaatgtcctcgccggcagcgtacggggactcggtgccgccgatgccgtggaggaagtagaagccagagcggttcttgaagagggactcctcgtagccggctgcgtcgccgaactcgccgaaggtcttgtgaccgacctcggtcgacttctcggtgtcgtagctgtgacgcttgccctggaaggtcatggtcttgcgcatatcagatgctccttcaaaatgtcaatatattttccgccaaatgtactcgacagccgttatattacgcaactcgacatgtcgagcagccggcaacagccaatttgcgcaggttattcacaggatgttcatcaactatcagaatctcgaaacatggatgccctatgtactcgacatcgactcgttgccgcagacggcagaagtcgacctctgctcgacatgtcgagcagagtgatagtgagactatcatccctgtcgagtactcctgttcggcagggcattgcctttgtttcatcagatagcacacgcatgtgcctgccttggcatgcttcccatgcatgcccgctttccaggaacgcaaggccgaaagcagcctcctctgcgtagcatctttcttgcagaacacatctgagcagggagacgcaatggaacgctatacgctttcagatggatatgagatgccaaagattggcttggggaccttccagatgaagccagaagaggcagaagctgcagcagcttctgcgcttgcagcgggatacaggcacatcgataccgccaacatatgcatgaacgagcgggcagtgggccgtgcaatcaagcgtagcggcatcttcgtgccctccaagctctggccaagcgtctgccgcgcaggagcagaagcgataggcgcaacgctctcacgcctggacaccgactatctcgatatgctgatcctccaccagccagcaggcgactatgtcagggcctggaaggcgatggaggatgcctatgcgcagggcaagatacgcacactcggcctctcgaatttcttcgagaaacagatacagaaggtcatggcttcagcgcatgtcatgcctcagctcgtgacggtcgagtgccatccctgccatcagcagcgcgagctcagaagctacctcaaagcccacagcatcctcctcgaagcctggtatccgctgggtcatggagacaggaggcttctggaggagcctgcattcgtgcgcttggcaaagagctatggcaagacgcctgcccagatagttcttcgctggcagtacagatgggcacttccgtcatccccggctcgacgaatcctgcccatgttgccgtgaatgccgatatattcgatttcccgctttccaccttcgagatggcagagatagcagcgctcgatggaaagaggcgctacttccaccaaaaccggatgagccttcttgcctatcgcatgatgcgtcccgacttcgacgctcagagatagcctctggtctagccaggaagcctgcaaaagagcattggacatgcattcccgaaggccatgcgagcacggatcggcacgcaaagaagatgccggccccgcatgagcggcgccggcatcagaccatgggctatgagagaagctctactccatgagctttgtgacctcggaggcaaattcgaccgggtcgtcgataggcaggccctcgacgagcaatgcctgatcgtagaggatgtggccatagagcttgagcctgtccttgtcccctgccttctctgcagcaacaagcttgccgaagaccgggtgtgcagcattgagctcgagcacgcgcttggccttgggggcagttcctgcctcagggccctgggcaatcacacgctccatctcaagggacacggggccttctgcagagacgcgggccggtgcatcctcaagaccagcggccaccgtgacatcctcgaccttgccatccagcgcttccttcatggcagagaagaggtccttgttctcgtcagccgtcttctttgcgtcagccttctcgtcttccgtcgcgaagtccacgtccttgctcgagacgttcgtgaacgtgaggtcgcgggcatcggtgcccttgtgctcggagtcccctgccacagcatccacatggtaggtgcgcatgacctggaacatgaactcgtcgacatcctgcgtgcagagaaggacatcgaagccatggttgagtgcagagctcacgaccggcatcttctggatgcggtcacgggactcgcctgcggcgtagtagatcctgtcctggccttcaggcattgcatcgacgtattccttgagcgtgacgtacttgttctgcttcaccgaccagaagagcaggaggtctgcaagctcatctgccttggagccgtaggagttgtagatgccgaacttgaggccacggccgaagttctcgaagaacttctcataggcttcgcggtcattgtcgcgcatatcctggagctcggacgtgatcttcttctcgacacgacgtgcgatggcacggagctgtgcgttctgctggagcgtctcacgggagatgttgagcttcacatcaggcgagtcgacaacaccacggacgaagttgtagtagtccggaagcaggtctgcgcacttgtcctggatgaggacattcgagctatagagggcaaggcccttctggtagtccttgctgtagagatcgaacggtgcctcgctggggatgaagagcagcgcgtcataggagatcgtgccctcagcgtggaagctgatcgtgcgggccggctttgcccagtcatggaaggtcgacgtatagaactcatcgtagtccttctgctcgacctcgcccttgcgcttcttccagatcggcgtcatggagttcagcgtatcgagctcctggtactcttcgtactcgggcttgtagtcgtcgcctgcatcttccggcttcggcttctggcggctctttgtcaccatcatctggatcgggtggcgcacatagttcgagtacttctcgacgagctcgcgcagaccccactcggagagatacttgtccgtatcgtcttcctcggtggaatcccgcagatatacgatcacatcggtgccgtggtcgtcagcgctcgagcgctcgccttccttggcctcctctaccgtgtagccggagacgccgtcagattcccacgcataggcagcatccgcaccatatgcacggctcacgacgcggaccttgctcgcgaccatgaaggcagaatagaagccgacgccgaactgaccgatgatgtccatatcggagccctggtgctcagcgttctcctccttgaactgctcggagccagaatgggcgattgtgccgaggttcttgtcgagctcttccttggtcatgccgataccgttatcggagaccgtgatggtgcgggcatccttatcgaaggaaagacggatggcaagggagctctggtccaccttcacatccggattcgtgaggctctcgaagctcagcttgtcgatagcatccgatgcattcgagatgagctcgcggaggaagatctccttgttcgtatagatggaattgatcatgagatcgagaagcttcttgctctcagtcttgaactgtttcatatgcatcctctcacattgccttgcaggacagctatgtcctgccctctccatactcttatcgatgtacccgctgaaaatgcatctattcaagatgaggcataaaatctgatattgaagcgcttaggttttcgctttctggctccccaagacgacaatacggagcggcttgctttctgcacgacagttcttcattgcgtgtatggttgacacagcaatccttccgccctgccgctcccggcgaaagacacgttcgatagaggccagcgatgcgtacgatagatgcatcgtccagagattggattgcgcatggccatgactgtcgatagcgacgaggatctcgaaagagagttcacggaggtgtgccgcgagataggtctgtccccctccgagacttttgccatctttgcacgggcggtcatacgcggacgcaggattcccttcatgccttcagctgaaggcatgaaggagcatgcagtgcatgaacctgagctttccatctcgggcggaatcgcccgggacattgctgacctgcaggcaggggatgtcatctctcgcgagaagtctcgtacgatgcgcgcggcacgaagaagagatgcgtgaagtcttggaacgtccatcatgcccggctcgattgcgaagctcaatcctgctggtgtccgctgacgcttctgagatatggaccatgcattcgctcccgaagagcctgaggagatgctgggacggctcaatctcgtcgagagctcacctcctctccatctcttgcatggagagaggcatttcacaagaaagagcgctgccttaagaggaataattcctggagaacacaactcagttccaggagaggagctgcacatatgaagagcgtccttatcaaagacacgacccgcgaagagcggatagagatcatccgcaagggtctgtcattctgtgccgatggcagctgcgagaactgcagcggctgctccatgggtgtggcatcaatcgacacgatgtatcagccctacattgacggcaagctcgaacttgccgaggtcaacatgctgcatgctgcaaagcgctacacgctgggcggtggctacaacgtggattcggacaggaagtaggttccatacacacagacatgacgcagggcgtccggcatctgccgggcgccctgctgcgtttcctgctctgtctttctgctcttacagcctgacgggcgtattcacgagcctgccttctgcatcatggccgacagaaatcgaaaagtcgaagcggtccacatcgacgcagtatgcgaagtccttgacagggaactctggacgcttgggatcgaagaacttggcaccgcaggtggtgtcgaagcctatcgcttccctctggcaggcaaggtgtgccaccttggggtcttccccttcgaggagcgccttgatgtagcgggcacagagcacatcctcatcagcccttgccacgccggcattgcccattgcgacgatggagactgtctcagggttcttctgcttgatatagcgtgccgtcgccgctgcattcgcaagagaggagcagacgacctcggtagcacctgtggcattcacgatgccctgtgtgccagcagaggtcgtgtggatgcaggtcttgcctgtaaggtccacgcccgctacctggacgggcgagttgccatactcgaagccttcgacctgcgctcccccgcgctcgccgaagctcacatactccggatgctcgcgcttgagcgccagggcatcctcgagagagccgatcggatagatcttctctgcgccctggttgaagagatagggctcgagcgtaaaggcacggaacacatcgatcacgacagtgaggccttctgccttcttagcaccctcgacgagttccagaatctgtaccttcatgttctgccccttcctctgagtcgttccgtgcctaccctacgactctgaatcggtgccgtcgatgaaattgatggacttcacctgaggcacatggatctctatgaggttcttgatctgctgcctcttgcctgtcgtgagtgcacggtctgcttccactgtggctacgacctgctgggacggcgtatcgcctccggagacaaactcggtgccgacgtggtactcagtgacggcagggcacgcggcctgaagctcctgcgccgtgagctgcgtctcataggtatccatagagctcacggtagcagcatcgttggtagctgcagcctgcctcaccatgtctgctgtcatgaatatgcacggcacggcgaagagcgccgtagcgatgatgagggtacggcggatgcgcttggcagagcgctcggaatcggcacgtgccgcggcagccggacagagcgggatacgcagggccagaagaacaatctctgccgcaaaggcgatgaagacgacattgagcgcaaactcatagaaggcactcaatgcctggacgatgtttctgatggagaggtagtagccgacagcgcagagcggcggcatcagggctgttgcgaccgcaacgcctgcaatgagtgtcgtcggctcctggttgcgggagtttcccaggcctcccgcaaagccgccggcaagggcgatgagcacatcccagacggtgggcgtcgagttcgtaaggagctcgttcgtctcataggaaagaggcgtcagcacgaagtagagggtcgaggtcgcaaggcagaaggcaacctgtatggcaagacccaggagtgcgtctccgagcgtgtgccggtcgagcgttgccaccgaataggagatagccaaaaccgagcccatgagcgggcaaatcagcatggcaccgacaatggcttcggtcgagttcgtgttgaggccgatcgaggcgatgagcattgcaacgatgaggatgcagagatggggaccatcaagacgcgagccattcacgaagcggcggcggatctcctcgaaggaagccctgccttcacgcacgttgaagaggcttgcaagatgccgcctgagccttccggtcgtgctcttctctgcatgcgttctttccactgccctcatctctcgctttcgccggctatatacccgctgaaaggagacagaaactctcttctccccttctctcgggatgtggccacatgaaagccggaatgcggcatatctggattgcgggaatccgtaaaggttctacgtacagacgttcttatgcgtgcaagcgtgtagaatgcattctgtataggaaaattcgggtctgtgcaggaggtgcagcggatggcaaggagacgttccagagaggaatgggacaataccttggacggtcttctggaagacatgcgcaggcagctccgcggcgaggcatcctttgcccagaccgctgaagatgagcctctcatcatgcgtggctccgacttcctgaataagaaggcagcagctgacgcctcaaagcctgccgaacctgcagcagtaacgaagagctccgctgttccctcagaccccatagaccccacccgcagacgcagaagccagctcatcgaagcatcgaagaaggcggacctcaccgattccggcacgttcgagcgcttcttccccgaagcggcacgcttcgtgaatgcagatgaggaagcggcagacgaagctatcccttcaagggatgagctcaagcctgcccagaggaccgttccagcccacacatcgccgagcacggcatatgacacgggggcaatcgacttcgcgtctgacggatttgcagacgataccgatacattcggctatggcgcaaaagctgacgacttcgatgccaatctcgagagcccggactggttcagcgcagagacgatggcatcagggtcggccaatagcggctacagcagctatggagcaacgtatcgcagcagctactatgacagctatggcggatacaagccacaggaaaggcgccccgcaccgctcacagagacgctcagggacctccgtgccctcgagaagaaggcaggcaggaaccaggacagccctgaggtcttcgagaagcagatcatgcttgcgaaggactatacggaggagcgcgccttccctgaccatagctggcggcagatctaccgtccgacctatagctccctcaacaatacagagctccgtgactacttccgctggaggaccctctggcgtgagggcatgagggaggcggcccctggctgctgcgcccttctctatgcctatgagctcatcgtcggtgccacggatatgggaccggaagagatcctctctgagcttgaccagctcctgaagctcttcagcgacaaagagatctggaacatgacaagagacgcgctgaggtctctgaggcatgactatgcaatattctctggcatcgaccccaagtcctacttctcggatgatgcgcttgccttcttcagccatgtggccaccctccgcagggcacagaatgcggtctatgagaaggaggggcgagaggctcccaacctggaatatggcatagagccgccctctgacgcagagctcctcgaggcctttgccggcatctcgaccttcgaccccacccgctccccgttcttccgcaagaaccaggaacgtgcagcagccgtgacaagaagactcttcgatgcgtatgtgctccactgcgcaaagaggaggaagcagaacctcatcgatggcacggtaggcatcccctaccgctcgatcgtgctccccttctaccacgcacccataaggcaggatcttggtgccgagggaaggcgcttcgatgcagcacccggaacctatcttgtctatgagcggggcacctgggtcgtgcatgagccatgcagctacccggacaagagccgcgagcttgcccgcatcttccgcgagcttgaccgagagatgcgcattgcctgggactttggccatgccctgaagccgcagaacctcccgaagtacatgctgcgcatgatcgatgatgcgatagcagcccagaaggaagaagaggaggcagctgccaaggcaaaggaagcggcagagaagaggcgcttcaaggtcgacctctcgaagctctcctccatcaggagcgctgcgcacgtaacgcaggaagcgctcctcgtcgacgaagagcgcgaaggctatgtcgcagtccccgtcacggcgcctgctgtcgcaccggtgcctgcagaggctcccgctcctgctgccgctccagcagctacgccagcccctgtcccagctcccactgcagaaacgccaaccgtaccgcaggaaggcacaaaggctgctgcacctgccagacaggcagaggcagcgcatcccttcgggctcacggataccgagtacgaccttgccctggcactgctggatggcagggactacacagctatcgtgtccgctacgcccgctaccttggacatgctcatcgacagcatgaacgagaagctcttcgacctcgagggcgatgtatgcttcgagttctcggatgacggacccgtaccgatagaagactacgcagaagatctcagaaaggctcttgtgcatgagtgaccagaaccagacagccccgcgcgtgccgaagcgcattgccgctgtcatcatcaattccctcaaaggcggcgtctcggcttatctgaggattgcctgagggtgcttcagcatctctgcttgtggcctgcgagacatcgccgtgccagtgccgagcggggatccgcctcagcacaataaggagtcaagacgcaggaactggtcgttgatcaaggccttcaagggccctatgtagatgcagccgacagaggcaggagggtcttcccgactctgtgagtatcgggaagaaggctgcctcggtcttgccggaggcggtaaagcggtcaaagcacattctcgtcggtgtcgaagatggccttggcagcggctacctgcacagctctcagttcgtccagttcgactatagatgtagtgtcctggataagggtgcatagcgcgagaaagactccatggactagatctcgaattccgagaagcggtcatgctcttctgcaggcgctgcagaagaggcggcgtgcttcttcttcgcggcagctcgacaggagcatccaccggggccttcaggaagtcgccctggatgaggtcgtctgccttcatgccggggttctggcaggatatccaggagctcgatgaagtcgcgtgacctccgcgcgcgcgctcagatgggtgtctgcaccgacgcgctcgaactcggcagcaaggaactgcacgaggctctcctttgtgatggtcctcgtatagccgaagaggcctgctggatgtccgcgagcttctccacgagcacaaggagctcctcgtgggtgagcggctcgagatgatgaccggggccacatgtccgagaggccgccctgcgcgaagcgcccctgcgtgagcccgaacgcatgcctcgtatagaggcccgccctcctgtcctcgatcgtctggggtgtgccgcccatgatgatgccgagataatgggccttgccctgggagcgtgtcgttgtacatcgtgaggatctcctcgtatttgtactggcggctcacggcattcggatcttagaggttcacgagctcatcgatcaggatagtgaggccctcatatcctgcagccttcaagaacgtggcaaagaccttgaggtagtcataccagtcatcgtcgccgataacgatgttgacgccgagctcctggcgtgcctccgtcttcgtgcggtactcgccacggaaccacttcgtgacgagggccttcttctcgtcgtcgccctcgatgcttgcatgccaatacatggtgagaaggcgtgcaaagtcatagccatgcacgagctcctctctggcccatccactgccatgatccgcttctccatggcagcctcgaagccaggacgcatctggcgccagcccgtcttccatcgtgacctgtgtctggatgttcgagacccacgtcgagccgaggttcagcgctccgccatcggccttgtcttcgtcgagaggttgcggatgagctcctataggtagcaaggccctgaccgcccgttccctggaagcggcgctcagggagaggtcggcgcatcgcagacgacgaagttgttgcccattgcatggttcctgatggtctgcaagaggaagctcttgcccgagccatagcggcccacgaggaagcggaaggaggcgcctccctccttcacgagctccaggtcatggagcaatgcggcaatctcgcgttcgcggccgaccgtgatataggggaggccgacacgcgggac

SEQ ID NO: 80 - DNA, 11214 bp, Unknown
  Metagenome-assembled genome
aaaaataaaaattgcgttgctattaaaaagtgaccacctagcaactgctagttgatcactttaatttaactatccattgccacttcaagtgaaattaagcgcgctagaaagcgcgcttaattatcgattatctgcaatgaacctggcgctagctcccgcggacaacactgctgcactaaagttaattgctgcgccgacatcgctggggcgactaattcagtggctaacacgcgctgggcagtggtgccaacgttcaacagaaaaatactgtaatggtgggcatcagcataccgcaaataaccaaaacacgtattattgaaataaaacggttgaaacgcactagtcgccaaccaagggcgctcgtgccgcaactggatcgcatgccggtaaagctgcatcgtctgcggatcttcattttcccaagggaagaagcggcggttatccgggtcaacgtcgccggtaaggccggcttcatcgccataataaatgcagggtacgcctggcaatgttagtagtagttgcgtggctagtgccaggtgctggtaatcgccggccagtacggtcaatatacgcttggtatcgtgggtgcctagattattgaaattatattgaaaggtgctgcggggatagttttcttttaacgttaataatcggcgcacccaagtctgggcgtcgatcttgccttggagcacgtccaggatcagctggcgcaacggataattcattaccgcatgtaacatgccgccagccaaataatggcgccgctggttgtaggcgatcttgtgcgaggcgtcctcccaaacttcaccgatcaagactttttgcggatactggtctaggcgctgacggatgccatgaataaagaagtccggtaattcatcggcgacatccagccgccagccatccacgccacgctgcgtccactgctcgatcacgccggcgggaccatagatgaactgctgataatctgtattatttttatcgactgttggtagatcagtgacgccccaccagctcttgtatttagctggaaaatcggtaaagttgaaccaattgtagtagggactgtgtggcgactcactggcaccaaggccatcataggtgtgattaaggttgaaatagcggctatttgcccccacgtgattgaacacaccgtccaaaataaggtgcatcccccggcgatgcacttcctgcagcaaagcgtcaaaatcagctaaactgcctaacattggctctagctttaagtaatcgccggtatcgtaacgatgattgctcaccgcctcaaagatcgggcttaaaaatagcgcggtcacgcctaattcttgcaggtaatctagcttggtcatgattcccttcaagttaccgccataaaaatcccagcgcaaaacttccccgctggcatccttgacgtaaagcggccgatcttgcttggtcccataaataaagctattcggtttaggcgcattaacgtggccatccgcgttgccgttagcgaagcgatccacaaaaatatggtaaaaaatcgcctgctggtaccattgtggtggcgtttcaacagaatcaagcaccgtcagctggtacatttggacggcggcgcgcgcttgataaaccacgccggttccgccgtaaccaccgtcttgacagccgtaataaaaggtctgccctgcctgggtgatctgaaaataataaaaatataatcctgcctgggtgggggtaaattcgccacgataagtctgcgctgccaccgctgctaaagcgactttagtcggtgtttgccactgaccatccgcatagatcaccaaccaaacgccagtggctgctggcgctgccttaaattggaatgtgatcggtgtttgttgtaccaccgccccaaacggcgacttaaaatcaagtccaaacgaattatagtacacgactattgcccctttattaaaaagcaagcgggtgcagaatagcgctaacaccaccacttgctcgatttctacaaactataaccgatctatttcgtttctggtcggctttgatggggcacgtgccagatatcttcggcataacggttaaccgttttatccgcagaaaaacggccggcaaaggcaatattctctagggcccgctgttgccactggttctgatcctgataagcttgatcaatttgtgcctgtgcggctaaataagactctaagtcgcggacgacaaaatagtcatcgttgaagcgcaacaacgaatcgtaaatatcgcggccttcagtttggatacccgggatcgtgccatcaactaaagcgtccagaatacgacgaattcgtggtgactgatcgtacaaagtttgggcgcgatagttttgctgcgcataataagcgtaaacttcgtcaacagtcagcccaaataaaaatagattgtcggcgccaactgcatcccggatctcaatattggcaccatctaaggtcgctaacgccaaggcaccattggccattaatttcatgttactggttccggaagcttccttagaggcagtggagatctgctcaccaatgtcggcagcgggaatgattttttccgctaaggacacgctgtaattcggtagaaaaacaatttttagtcgatcgcgcatagccggatcgtggttcactaagtcggccaaggcgttgatcagcttaatgatctccttggcataatagtagctcggtgcggccttagcaccaaaaatatggacccgcgcttggtaatgttcatctggcgcggccttgattcgctgatacagatcaatgatgcctagcacgtgcaacaattgccgtttataggcgtgcaggcgcttgatctgtacgtcaaataatgctatcggatcaattttgatctgcagcgttgcggccacatagtccgccagtcgctgcttgttggttaatttaacttgggctaatttagccaagaaagccggatcattttggtaagctttgactgttttcaattcgctgggagcactgcgccagccgctgccgatctgctgatccaacaattcgcttagtggctcgttggctaattgtacccagcgacgcaaggtgatgccgttggttttattattgaagcgttcaggatagatcgcgtacagatcggccaaaacatcccgttgcaacagttcggtgtgcaacttggacaccccattggtactgtggctgccgatcaccgccaaataagccattcgcacttgaccatcgccaaagggggcactacgttggacccgctcggcaccgtagatcggcgtcatttctacccgaaaacggcggtcgatctcagcaatgatctggtagatccgcggtaactcacgggccaacatatcctgaggccatttctccaacgcttcttgcaagatcgtgtggttagtatagctcatcacttgagttgtgatcttccacgccaccgaccaatccagatgctcttcatctagcaaaatgcgcatcaattcagggatgaccaaggtgggatgggtatcattgatgtggatcgcgatctggcgaccaagatcaactaagctttgttggtgccgccgataatggcgaataatgctttgcacccccgctgaggaaaagaaatactcttgatgcaaacgtaatagttgcccgtcataattggaatcatcgggatataaaacttcagtgatccgtgcgactgcggccttatcggcttgcgtatagtaatgatcgtcggcctgcggtggtaattcggctgaccacaaacgcatcgtattgccgacatgattgtggtagcctaacatcgcggtatcataaggcaccgccaaaacgtcttgggtattttcgtaaaccggcactaattgcccgctagcttcatcacggcgcaaataaacgttgccgccgaaacgcacagtacaggctttgctttccttgcatacctcccacacgttaccattgcgcaaccaatcatctggcaattcaacttggtacccgttgataaaggcctgcttgaacaagccgtaacgataacgaataccgttaccattgccggcgatctgcattgatgccagtgaatccatgaagcaggacgccaaccgacctaacccaccgttacctaagccaggatcaggttcggccgcgactaactggtcaaaatccagccctagttctttgctcccggcccgcacagtatccaaaatacctaaattcaataaattagattccagtaagcggccaggtaaaaattcgatcgaaaaataatagacttgcttgcgctttgtgcggttatattcggcagtcgtttgttgccattgatccgctaaatattggcgcaccaaattacctaacactaaaaactgctcgctagtcgatagttcatcttgctcttcagcgtacaatgtttctaaaagtttgcgataatccgtcttaaattgtgccgtggttaatttcattttttctcacccaatcacttgttgatagagacgctggtaatcctgcgccgaatgccgccaatcaaaatcctgcgccattgcttgttgctgcaattgctgccaagccggtgcgtcttcgtggtagattcgataagcgtaagacatgatctcgcctagtaccaccgaactataattatcgaagccaaagccagtacccgcgccagtgtattgattatagggttgcacggagtcccgtagccccccgaccagatggaccaccggaatgctgccgtagcgcatggctatcatttgggataagccggatggttcaaaggctgacggcatcaaaaagtagtcgctgccagcatagatctgttgcgccagcgcttcattgaaagtgatgcgcactgcacattgtccgggatagcggacctgaaaatcacgtaattgttgctcaaaatcgggatcgccagtgcctaataccacgacctgggcgtcatggcggactaaaaagtcgtctagcgttgccactaatagttgggcacccttttggctggtcagccgcgagatcatggcaaaaagcggcacttctttgcgctggggtaggcctaagctagcttgcagggcttgcttatcggcggccttacctgtgcggtcagtggcggtgtagttcgctgctaaattagtatcggttgctgggtcgtatagttcattgtcgatgccatttaaaatgccgtggagcttgtatgcgttctggcgtaaggtgccatccaagccttcgccaaacgccggcgtctggatctcctgggcgtaactcgggctgacggtattgatcgcatcggcgtagttgatgccgcctttcaaaaagttgacttggtcgaaatatttagtgccattttcttgccacgttgccataccaatgccaaaaagatcactgagcaccactggatcaaaaacgccttggaagcgtaaattatggatcgtcaaaacggttttgatcgcgcggtaatcattgatccactgatatttatcccgcaacaaaaccggcacgaacgcggtatgccaatcgttgacgtgcaacacatcaggaataaaatcaaaccgcgccatcatttcgcacaaggctaattggaagaaggcgaaacgctccccatcatcggcgtagccatacaaaccgtcacggccaaaataataaagattatcgatgaaataatagcggactttacctagcaataaagttttgatgccacaatactgctggcgccaaccgacggccaccgtaaaattagtgacgtccgtcaactgttcagtataagcggcaggcatttttgttgggtaatagggaacgaccacgcggatgtcgttgccggcgcgctgcaacgccttaggcaaggcataggccacatcgcctaagccgccggttttataaaatggcgccgcctccgccgcagcaaataagattttcgtcattgcgtcaccacttccttttgctgatagacgtgctgccctttaccgatcaccaacggctgttcggcggttccaatcagcttaaggttaggcccgatcacaacacttttatctaaaatcgcatgctcgatcacggtaccagcgccgatccggctgccttgcatgatcacactatcactgatccgcgcccgccgattgatcaacacattccggaagatcactgaatgagtaacggtgccttcaatatagctcccggtccccactaggcaattttccacttgtgaatcgcgggagaaaaagctggggatctcgtttttaactttagtcaagatctgtcgctcgctgaagaaaagcgcctgataatttttctccagcaacatttgcatattagcggcgtaaaaatcctgaatgctgcgaatattagcctgaaagccggtatattcaaaggcactggtattattttgcatcacggcatgttttagcaccagatttaaaccgccggcttgaccttcacgattagcctcttgtaataattcgatcaaccgacgcacatcgatcatatggatcgccaaactttttggcaccatcgtcgctgccgctggaatattggcttctgctaacggtaaaatactggtggctttaccatattcagtcagcgtcactacctgatcatcagcggccacttgttctgccggtaagaatttataaacggtggtcatctcattgttccgttgttggtgataacgccacagtgcactaatatcaatattattcacattttgcgtccctaaaataaccacatattcggccccagatttacgcaaaaattgaatataattgtcataaaaatgatggcgggcctctgcttgttgctgggccgcgactaccgctagatcattgtatggaaaggtgaagacacccccgcgcagtgaatcaagatcccaatccttaccactacgcacatgatcgccgactgagcggccattgcgcggtaaaaatagtgctacagtattgatcccggcgttgctgatacaagaaagtggaaaatccagcaggcggtaacgaccagcaaagggcaaggttcccaatggccgctgttcagtcaacggcagtaacgcttcggcaggttcgatcaaattaataatggcgcacaatctattctttttcatgctgctcacctcctaaaacctcacgataaccagccaccgcgatctcctcattactgccgacgacccgcgcgccatccccaatgatcgcacgttcgccgatcaaggcatgatcaatgaccacatctttaccgatcacagcgttgggcatgaccatgctgtctttgaccactgaattctcgccgactttaacgttttgtgacaagatcgaatgcgtcacggtgcccgccacataacagccatccacgatcattgaatttttcaccttggcactttctgtcaacaacattgggggcaaggccagcgccttcgaatagattcgccagttacgatcgccaatgttcagcgtactattaggtgataaaaattccatgttcgactgccatagactgtagatcgtcccgacatcgcgccaataaccgtcaaaagcataggcaaacacggcctcattatgttccaaataagccgggattacgtcatgaccaaagtcctccaagctgccatccgtcgcgtaactgtcctgtaaatactttttcaacgtagcccaattgaaaatataaatgcccatcgacgctaaattacttttcggctgttcaggcttctcttcaaattgaatgatccgctcggtctcgtcggtattcataatgccgaagcgcttggcctcctcgttagtcaccggaatgacgcccaccgtcagcgacgcctttttcgcctgatgatacgccagcatcgcttcataatccattttgtagatatgatcacctgacaagatcagcacataagtcgggttcatccggtcgatatattctatattttgatagatcgcgtgggctgtccctttgaaccacttctccccgtcgctggccgagtatggctgcaaaaccgtcacgccaccattttgctcgcttagaccccaactagcaccattaccaatatgcgcatttaattccagtggcttatattgggtgataacgccaactgtatcgatccctgaattggcacaattactcaacgtaaaatcaatgatccggtaacggccaccaaaaggaaccgctggcttcgccgtcgacttagtcagcttacctaagcgggtcccctgaccaccggctaaaataatacctaacatatcatgtttcattattagcgaaaagcgctggacgcctctccttgccccctttttctaccgaacacgctgtggctgaatgatcaacgccccagcggccggtaagatgacttgaatgctataaggttgccccttatacggaactgcttcagcagtaaaagtcccttgcaacttcgtccacgtgccaccaaattccttggactccgtattcagtaactcgtgataagtccctgcataaggaaccccaacacgaaaatgttggcgttcttgtgggataaaattaaacacaccgactaaaaaatcatatttatgcttaccttgacgtaaaaagctcaatgcattactagctggatcatcggcgtcaatgatggtcaagccagctggctgatgatcttgttcccataatgaccgttgctgccgatacaattgattaagcgtttgtacaaattcttgcattttatgattcaacggatcagctagatcgacccactctaagccgctccaatgacgccattcaaggaactggccccattcgctgcccataaacgtcagtttttttccaggatgtaacatcaaataaaccatcaatgttcgcaagttggcgaattgattatagcgatcacctggcatcttgtgcatcagtgatttcttgccgtggaccacttcatcgtgggaaaacggcaagacaaattgctcatcaaacgtgtacataaatgaaaaggtcaataaattgaactgggcgtgtcgatacagcggatctaattcgaagaaccgtaacgtatcgttcatccagcccatgttccacttgtaattaaagcctaacccgccagtagccaccggatgactgacctgcggataagcgctagactcctcggccaccatcaaaatatcgggatgataacgaaagaccgtctggttcaattttttgataaaggcgattccctctagattggcgtttgtaccggctgcgttgaccgtgccttccttgccggcatcatagtccaaatacaacatattcgagaccgcatcgacccgcaagccatctaaatggcaaaaatccagccagtacagcgcactagagatcaaaaagctttgcacttgcgccttgcctagatcaaagttccacgatccccaacgatgattatccgcccgaaaagcatcctgatattcaaacgttggtgtcccatcatactgggccaacgcatcagcattgcgaataaaatgccccggcacccagtccacgatcaccccaatattagcttggtggcattgctcgataaaatctaaaaagtcagtcaagccaccgaaacggctagtcggcgcaaaataacccatcaactgataaccccacgaagcatccaacaaatgttccatgatcggcatcaattcaatatgggtgtagcccatttgcttaacataagggatcaaagtctgcgccaattcagtataagataaataactgtcatccgcatgccgccgccacgaacctaaatgcacctcgtaaatattgactggtcgctgataaggcagaaacttctttcgccgcgctaaccacagactatcacgccactttttttgcggtagcggcatgacgatcgctgcattgcccggttttttttcaaactgatgggcgtagggatcgattttcatcacccgttggccgccggcggtcacgatcaaaaatttgtacagatcaccaatttgtggttggctcgtttccactgaccaaataccggtatcactttgtgcaagcaacggtaagtcttcctgccactcattgaaactaccgactaaataaacggcctgcgcattgggcgcccaaacactgaaactaaatcgtgccgcggcgatctgctgacaacctaaccagaaataactccgatagtcagcgccggtattaaataaataagcctgacgcaaccgtgccgcatctatatttactgccattggtacctcacctcaccccttagcaatattaaacaaatatagcgttttcattaaaatgagaaccccatgttaattcgtttcaaaatacagcctaacaagtaagcactggtcacttgcttgtgactcaattatacaccaatagaaacacgattaaaacagtatattaagcgcttacaataacgtgacatacgtgcatatttcacaactattttaatgataatatgatacataaaatctgtatttatggtagaccgttttctgaaaactatataaataaaacgtgtcgcaacattaaacacgctgcgacacgttttattagatttattagaatagctccctaccttgcggctcatctttggtcacaaagtaatcaggccgactactggacacagtgtttatttagcttttacgccatagtggtaatctaattgacgccatcggtccacgaataagtgatcgttgcgtggtaatcacctggttggatattgttgccggctaactgcaactgaatatttttgaaaacataggacatgctggtttgtttgtcagcgtaatcgtaactgactaattgattggccggcccgccggcagtaaatatcgcactactcaaagcaggcgtgccaaagttgatcttagccgcttcgccagtgagtttgcgactaccagcggtgaaatcactcaactgcgcggtgattgtccacggtcctggcgttgcccgattgtcggtgaccaacagtgttttatcgccatcggtatttttatacgtccctggcgtggtcgtttgcgtgccgaattctaaattcgttggcggtgtgatttcgatcccaccagtggttgcggctggtagcaacgtcactttgttggtatcgaccacataggaactttggtccatcatcacgtcagttggcgtcaacccactagccggcaacgcggccgttgcttgaacttgataactgacaacaacttgacttcctttagcgatcgggccagcccaggcaatgttaaaatagccactcattggcaccacttgcgcggtcaccgccttaccatctacggttaccgttggtgtgccaacttgtttcaactgcgcggccaatggtaccacgacgatcggtgtg

SEQ ID NO: 81 - DNA, 26112 bp, Unknown
  Metagenome-assembled genome
aatgggaacttgggaaaacttttttttttgcaaaagaactgagcagtcttgatgaatcccaacttttcttaggatactgtatccatgctctatagccaacgatttttatttccgaaacatgcagattatggcgctgattttacagacccgattcgcttaatttctcttcatacatttcatcctgctctttcattttctgcatatatttctccaaggctccatttcagtcttcagaaatcggtccgtttggactcttctgcattttgcatatatcaacctattaactgcatattgcatgcatacatgcagatagagaaaaggggcctccccgatgggaaggccgcctctgtaaggacatttccggatgatctagagcttcgtcggaagcagggactctgccggaacgagcttgccgtcctgatagacaagacgcttagcgtgcgctcgatctgcgggtccgggatggggatggggagagcagcgcctgcgtatagggatctttcggatgcgtatagacatcctcggtctcgccgtattccacgatcttgccgaggtgcatgacagcgaccgtatcggagatgtggcggatgacgcgaggtcatgggcaacgaagagataggagatcttgagctctgcctgcaggtcctcgagcaggttgatgatgccggcctgaatcgagacgtcgagcgaggcaatcggctcgtcgaggagcaggatcttcggattcgtggcaagagcgcgggcgattgcgatacgctggcgctggccgcccgagaactgggatgggaaacggtcgacgtagtcgggattgatgcgacaaggtacatgagctcgccgatgcgcttgttgatcttcgcatcatcccagtgctgggccttgagcggctctgccaggacgtcgtagatcggcatcctcgggtcgagggagctcatgggatcctggaagatgacctgcagattcttcctgagctcgcgcctctcgcggttgttcctgatatcggcgatattcttgccgaggactgtagtcgagccgccctcgggctcctcatgagctccataatctgcgtcagcgtcgtcgatttgccggagccggatctccgacgagcgccatggtctcgccctcatgatcttgaacgacacatggtccactgccgtcatggttcccttgttcctgcggatgaggcccttgctctgaatcgggaaggtcttcacgaggtccttgacctcaagcacgatcggcctctgatcgcgcggcagtctgcccacttggcaggcagcggctcgagctccgggtacacatcctggtaggtcatgtgcttgtcgcggatctcagcaagcctatggcaggagacgaggtgtccctcctctgccgcaaacggctcgagcttcggctctattcgttggcacttctcctgtgccatcgggcactcggagagaacgggcagccggaagggatggcagcaagcgaaggcggattgcccttgatcgggacaagcctgtgctctgcggccacatgaggctgcggcacagcaccgagaagcccatcgtatacggctgtgccgggctcgcgaagagcgtacgaccgaggcacgctcgacagcagcgcctgcatacatgaccatgatgtcgtcggcaatgccggcaacgacgccgaggtcgtgggtgatgataacgacagcggcgcccgtctccttctgtgcgaccttgaggacatcgaggatttgcctggatcgtcacatcgagagccgtcgtcggctcgtcggcgatgatgatctcaggattgttcgcgattgcgatagcaatgacgacacgctggcgatgccacggaggaactcgtgcggatacgcatcgagacggtcctcaggatcggtgatgccgacaagcgtgaggagctcgacgcagcgcttgtgcacgtcctccttgctcatcttcgggttgtggatgagaagggcctctgcgagctggtcaccgatggagaacatcggcgtgagagcgtcagagggtcctggaacaccatggagatcctggagccacggagcttcgacatctcctcgtcggtcttgccgagcagctcctctcccttgagcttgaccgagccctcgacatgcgcattgtcgtcgagaaggccgatcagtgaaagtgccgtgacagacttgccggagccggactcgccgacgatgccgagtggtgcggccgcccagagatcgaagttcacgccgcggacggcgtcgacacggcctgcctcggtcgcgaacgacacgcgcaggtctctgaccgagagcacggggtctcctgtgggcgccaccttcgggcccttgctctcgagcatctcatggcaaggacctcgtccttgacctggttcttgttatcagtcataagacagctcctgctctagtgcagctcgatgtctgggcttcggcgtcggcgttctcccgctcgtccttcttctcgtcttcctggtcgccgacagagccagcagcgcgggagtaggggtcgaaggcatcgcggaggccatcgccgatgagctgcatgctcacgcacaggacaatcagcacggccgacggaatcaggacgatccagggagccgacagcatggcagaggagccctgggagagaaggtagcccagagaggtatccggagccttgatgccgaggccgaggaacgagtaggccgtctcggagttgatgccggagatgacgccgaggaccgtatcgatgatgaggatggagccgaggttcggaatcaagtggcgcacgatgatcttgaacgaaggaacgcccatgtacttggcagcacggacatagtcacgctcgcgcagcgacagtgccatggtcctgagcgtacgggcatagccgatccagccgaaggccgtgaggccaatgatgagcatgatccagccctgcgtgccagaagaggcgcgcacaatcattgcgacaaggaggaaggaaggaatgacgaggagcatgtcgaggagccacatgccgaccttctcgccccagccacgcatgtaggcgatggcggtaccgaccgtagcagcgatgaccgtcgtcaggagcgagtaggtgatgccgatgacaagcgagcggcccaggccatgcacgacgcaggcgaagaggtcgaaaccgccgccatccgtgccaaaccagtggcgcgcattcggtgcgacgttcagggccgtgaagtcaggctccgtgtagtcgaaggcacagatgaaggggccgaagatggcaatcaggatcatgatgatgaggatgatgaggccaatcacagccgagcgctggcggaagaagcgccttgcgatcaggcgcgaatacgtgatgcgcttgacctcggtcggaccctgggaatctgcctggagttcgagctgggcattggtgagcctgccctcttcctgaggagtgttgttctgctcttccattgccatctccttagctcatcttgatgcgcggatcgagggcagccgcaaagaggtctgccatcagagcgcccacgagggtgcaggcacccgagaaggcggcaacggcaaccgcgccattgatattgttgttgttgatgcagttgatgaagtattcaccgaggccatggatggcgaagatcttttccgtcatgacggcgccggtgaagatggaggcaatggagaaagcgacctggacggaggtcgggatcagagaagcgcgcagggcatgcttcctgatggcctgcttcttcgtgaggcccttggcacgtgccgtgcgcacatagtcggcgtgcatctcatccaagaggtacgtacgctggctcaggtggtagccgaccgccgagatgatcgtgaggacgattgtcggcagaagaatgtgctgcaggaaatcgatgaatgccaggaacatgttgtcgccggcatagctcgaaagacccgtgacatagaagacgcgggctcccgtctgctggttgatctcgattgcgaagaagacgacaagaatggccagaacgaccgtaggtatgaccatgaagacggaggcaagcccgctccagaatctatcctgccacaggtattgccgctgtgccgtgtagacgccgagcgagacgccgatagcgatggagagcaccgtcgcgagcgtcatgagctcaaccgaagcactgattctgcctgcaatctgggagttgacggaatcgccgtcaggagacatgccccaatcccactgggtgaggatgccgccgagccagcgctgatagcgctcgagcaccggcgtcttgtcgttcaggttcgtgcggtcgagcgacgcctcgatggagtcctgcggaggacgcggcgtcttcgactcgaagttcgagcgcggactcatgaacgcgcaggcgaggaaatacgtcagcgaagtcgcgacaaagatcatcacgatgtagctgaggatcctcttggtgatgtaccagatgaatcgtgccatggaccttctccttagccacctgtcctgagacaggctacggtatggcaagcctacaagatgtgcctctgccggacgcatggtcacgttccagcatcatgcaagcttacactgtatcacggagcagcacattccttgcatgtttcatgcaattgtccatggacggcgcataaattctgatgcagttggccaagcatccgtacatgccgcagcaaaaaaatgcccggcaccgaagtgccaggcatgaggaagggcttgctatgagagcttagatcgtgccgagcgggaacgtcagtgccatgatcagcacgcaggcaatgaagacaagagacgtgatgaccgtgagcctgtcgaggttcttctcccagatgccggaaccggcagaagcattgtacatggaagaagcgatgaggtcggagacacccgttcccttgccggaatgcatgaggatgaggatgcaggtcgcaatgccggacaggaacagaagcaccacgagaatgatgttgaggacgctcacggatatcgcctttcccacgtgccgccatgcagcacatcaatattcacaattgatgagtgtaacacagaagcgctcccccaccactggaaggcgagggagcgccagaaatgctacatgcagcagatgctacatcgcagccttcaccatagcggcgaaggagtcagccttgagggaagcgccaccgacaagtgcgccgtcgacatcctccttctcgaggaagccagccacgttgttcggctttgcggagccgccatacaggacgcggatgccgtctgccgtctcctggccgaagatttcggcgagggtcttgcggatagcgccgcagacttcctgggcgtcgtcagccgtagcggtctttccggtgccgatagcccagatcggctcgtacgcgacaacgtacttcgaaggatcggtaatctcgagaccctcggtgtccttcttgatctggtcgacgacgaactcgacgtgcttgccggcctcgcggacctcaagcggctcgccgcagcagctgatggggacgatgccgtgggccatgagagccttggccttcttgttgatctcctcatcggtctcgtggaagtagccacgacgctcggaatggccgatgatgcagtacgtcgcgccgacattcgtcagcatgtcgggagcggtctctccggtgtaggcgccggactcctcccaatagacattctgtgcaccgagtgcaaacggcgccttcttctgctcgatgacctcagagacacccttgagatcgactgccggcgggcagacgacgacgtcgacagagcccgtgccatccttgagctcggaagcgagaccctcggcgagctcgacgccctccgtataggtcttgttcatcttccagttgcccgcaatcatcctgttacgcatcgagaagagcctccactcccggaagagccttgccctcgacgagctccatggaggctccgccgcccgtggagatccagctcatcttgtcggccaggttgaacttgttgatagcagcaacggagtcgccgccgccgatgatggacgtgccgccgagcgccttgacctcagcaacggcacgggcgactgcctcggtgccatgtgcgaactggtcgaactcgaagacgcccatcgggccattccagaacaccgtcttggcgcccttgatggcatcggcgaagagcttctcggtcttcgggccgatgtccatgcccatgcggtcgtcggggatgttgtcggattcgacaacctcgccctttgcgtcctcgccgaagtgatcggcaacgacgttgtcgaccggaagcaggaccttgacgcccttcttctctgccttctcgagcatctccttggcgcggtcgacccagtcctcttccttgagggaggtgccgacggagtggccctgagccaggaagaacgtgtaggccatgccgccaccgatgatgagggtgtcagcagagtcgatcaggtgatcgaggacgccgatcttggaggaaaccttggagcctccgacgattgcgacgaacggacgctcaggctcagcgaagatcgaggtcagggtgtcgacctccttctcgagcaggaagcctgcgactgccgggatgtaggcagccgggcccacgacggagccctgtgcacggtgagccgtgccgaaagcgtcgagcacgaagatatcgccgtaggaagcgagcttctttgcgatctccggatcgttcttcttctcgcgcttgtcgaagcggacattctcgaggacgaggatgtcgcccggcttgacctcggagacggccttctcagccttctcgccgtaggtgtcgtcgacgaacttcacgtcgtagccagtgagctcagcgagcttctcggctgcaggcttgagggagagctcgggctcggggccatcgcccttggggcggccgagatggctcatgagcacgatgccggcaccgtgctccttcagatacttgatcgtcgggatagcggccttgatgcgggtgtcatccgtgacaacgccgtccttcaggggcacattgaagtcgacgcgcatgaggacgcgcttgccctcgacgtcgacgtcgcgaactgtcttcttggtgaaagccatgttcactcctcctaatggaaaacgtacctaaaaaagaggcgcggccgcggcccgaaagctgcaaccgcgcctccaaacttctgtgcgaaacgcgacttaggcgacgaacttctcgaagtacttgatggtgcggaccatctgggacgtgaaggagttctcgttgtcgtaccaagaggtgacctggacgaggctctggccgttgccgagcgggttgaccatggtctgcgttgcgtcgaagagggagccgtaggtcatgccgacgatatcgcgggacacgatctggtcctcgttgtagccgaaggtctccggaatctgctcagagtaagccttcattgcagcgttgacgccctcgaccgtgacctccttgttgacgacagcatagaggttggtgagggagccggtcggcgtcggaacgcgctgagcagcgccgatgagcttgccgttgagctcaggaagaacaaggccgattgcctttgcagcaccggtggtgttcgggacgatgttctctgcgccagcacgggaacgacggaagttgcccttgcgctgcgggccgtcgaggatcatctggtcgccggtgtaagcgtggatcgtcgtcatgatgccggagacgatcggagcgtagtcgttgaggccctttgccataggagcaaggcagttggtcgtgcaggaagcagcggagatgatatcgtcgtcagcggtcagcgtctcgtggttgacgttgtagacaatcgtcttgaggtcgttgcctgcaggagcggagatgacgaccttcttggcgccagcgttcaggtgagcctgagcctttgccttggaggtgtagaagccggtgcactcgaggacgacgtcgacgccgagctcgccccaaggcaggttgttggcgtcagcctccttgtagatcttgatggtcttgccgtcaaccgtgatggagtcctcgccagcggtcacctcatggttgcgggagtagttgccctgcgtggagtcatacttcagcaggtatgcaagcatctccggggaggtcagatcgttgattgcgacgatctcagagccctcgtgaccgaacatctggcggaatgccagacgaccgatacgaccaaagccgttgatagcaaccttaactgccatgctttctcctttcgcgaggtcgtgccggagcttctctccgccactgaccttcttccaattggaatgttaccgctaaatgtctgactctattcggattatcttgagaccgttcgaaaatcggattcgagacgactcaaatgtctacggatgcgtagacatacaagacctcctttccgtctcgctcaagacaaaaccgcaggtcagaagaattgtgtccattctttgaagacgcaatgcatcaagcagccaaaaatctaccccgcaatcggcgggcggcagctcagccgctataagcggctcttctcatccgtctcatcaggcacgtccccgcgggcttcctttacaagcgcctcgaggcgcagaagcctgtgatagagggccgatttcgaagccggaggcgtgcactgctgccctaaggccgaaagcgggagctcggggtaggcacgccgcacacggcagaactcgcggatagccggaggcaggtgccgaagtcctatgagctcttctgcctcgtcgatgagtgcaagctgctgcacagcggcatcggacgatctgttcgagttggcgatctccgcattcacgcggcggttcacatcattcttgaccgatttcatgcgccgaacggcctcgaccgcatgggccgagcgctgagcccccatggcctcgagcaggcgcacgatgtcctcgaagctcttgagatagattgcaaaggcgccgcggcggcggttgagcctcgctgccacgccgacggtctccatgagggagacgatgccttgggcaaggtcctctcctgtgacggcaatctcgagatggaagtcgcctctcggatctgcaatgaagcctcccgccatgaatgcccctctgaggaatgcattccggcagcactgccgcgtcaggagatggtcgggcaagccctgcgcaagcccctgccccggcacaaggatgcccaaggtcacgagatcgtctgcaagctctggctggtccggtatctcgatcaggtagttcctcgtcttgtggagcacggagtgacggaccgtaagcgacgtatcgaggtcgaggagcttgtgcgtgtacttcacgaccgtgcgagcgacggcaccggtctcggtcgagatgcggatcgcatatctcccctgcccggagaaggagaggctccccgagacgcggatcaaggctgcaagctcggcaaaggggcacatgtcgcacgtgccctcctggcgcgaaagctcgtctttgacctcagccgtgaatgacatggctacattcccttgttctgggcgacatctgcgcgcggcaggtcacggtgcgcgatcgtcaccttgtagccgatgctcttgaggtagttcgccgtcgcctctgcaagagcgaccgagcggtgctggccgcccgtgcagccgaccgcgatcgagagctgaggcttgccttcagccacatatcccggcatcacaacatccagaaggcggcaccatgccttcaggaactccttcgtcttcggattgtcgaggacgtagtccctgaccttggggtcaaggcccgtgagatggcgcatctcggggtcgtagaacgggttcggcaggaagcgcacgtcgatcatgaggtctgcctctgccggcatcccgtacttgaagccgaacgagaagaccgtgacgtccatgagctgctggtcggaaaggtcggagaacgcatgctggagctgcgagcgcagcaccgatgtcctcatgtgcgatgtgtcgatcacaagatcggccacatccttcgccttctcgagctgcttgcgctcgcactcgatagcatgctcgaggctctccccctcgaaggccagaggatgccttcttctgttctccttgtagcggcggatcagcacctcgtccgatgcctcgagaaagaccaccttgtacgtgagctcatgggcagaaagctgcgtcagcgcatccgagagctcctcgaagagaccctggctccgaaggtcgctcgtgaccgcaagatgccttccgacgccggagttgatgccgacaagctgggcaagctggaggatgaggcgcggcggcaggttgtcgaggcagtagtagcccatatcctcgaaggcatggagggcctgtgtgcgcccagatccgctcatgcccgtgatgatcacgatgtcaggcacgcgtgctgccgcttcggccgcacgcatctgctgccctgccttgtccatgcccttgtccttccttctggctagtccttcttttcctcttcagggtagacgacaccccatgcccttcttgtttccgtcatgatcttcatcacatcggacgcatagccaatgaggctctgagcctcttcgtcccctgccacggcgcgctcgaggtctgctgcctcgtagtccaaggcatagccttcaacacctgctgcgacctcctcgcgcctgccatcctcggtccagacgatctctgccttgtcagcgcgaggatagtccatgatctcgatgtagcagcggtcgaacgagagcacggcacgcttcggctgcttcgagtggagcgtgagcgagatgacgccgagctggccctcctggttcctgcagacgatgcctcccgcctcatcgacgcccgtctctgcaagatttccgagcgagacgacttctcgaggtgcgctctccatgaagagacgcatgatcgtgagcgcatagacgcctatatcgagcatcgcgccgcccgcaaggttcctgttccagaagcggttcttgaggtcgccgtattccttgtagctgccgaaggccacctgcgcgatattcatgcggccgaactcgccggcacgggcacgctgaagcagctctcgatagagcggcatatggagaatcgtcgtcgcatccatgagctggacctggtgctccttggccagcgcgcgggcctcttcgagctcctccgtgttgagcgtgatcgacttctcgcagagcacatgcttgccggcagcaagggcgcctctgagatagcggatgtgcgtgttgtgcggcgtcgtgatatagattgcctggatggcagggtctgcacagagctcctcgaatgcggggtagaccttctcgacgccgtacttctcggcgaaggcctcggccttgctctcggtcctgttccagacgccagcaagctttcttccggccagcgcaaacgactctgccatctggtgcgcaatcacgccgcagccgacgacagcccatctgagctcgggagccgtgaatatatcatccgggaatggctggttcctgacttcctcgaaggctgcatctgccgcctgcgccgcatcgagcgccttgtcactcttcacttcaggccgcctttccgatagcttttcctgccttcagtctagcggatacctgtcccagcatagggacagccccgcaactcacacgagctgcagggctgccaaggggagatatgccggatggaatcaggcctccatcgcggcacggaaccacttcgtgaggctcgtcgggtgcgtgatgccagtgccgacgactacggcccaggcgcctgcatcctttgcagcctttgcatcggccggtgtatggacatggccttcgcagacgatgggcaggcccgggaactcatgggtcgcctcctggagcagggcgatatccggtccttcatccatagtcgtctggatggccggcttgttgtgcgaaagcgtcgtcgagacgatgtcgcagccgacctcgacggcattcctgatgtcctcgatggtcatgcagtctgccatgacaagggtctcgcactgggcacgcaggtcgcggaccgtctctgcgaaggtccttccgtccgggcggggacggtcggtcgcatcgagtgcgacgatgtcggcgcccgcgttcacgcaggcaatggcatggcgcagcgtcggcgtgatgtagaccccctcatgcccttccttccagaggccgatgacggggatctcgaccctgcccttgatggcagcgatgtcggagagtccctggcagcggatggcagcgcatcctccctgctcgcaggcctctgccatctgtgccatggtctcgggatggcgaagaggctctccaggataggcctggaccgagacaatgagcttgcctttgagcgactgaaccaaaggcgcgatttccatttgagccctccttaggcaatctcgacgtaggcagactggagcacgttctgcgcagcaccgatcaagggtgcatcgtctccgagtgcaccgtcgacgacaggagtcttcgagaccggcggcatgacagtctcggaccagcccttctgcatggccttgtgccagacagggccagactttgcgacggagccagagaggatcacgcagtccggatcgaacatgttgaccatcgaggccaggacctcgccgatagcatgtcccgagcgctcctcggcagcgatggcagcctcgtctcccgactctgccgcctccgagatataggcaccatcgaccggcgcaccgtcgtcgagcgtgcggcgtccgccgagctcgaggtagcgctcgatgatgccaggacctgcggcgatgggctcgaggtgtcccgtcgctccgcaggagcaggggatgcctgcagcatccgtgcaggcgacatgtccgatgtgtcctgcctcggagtgtgcgccgagcatgatgtggccacgctcgacataggcgccgccgatgccggtgccgaccgcacagacaagcgtactcgtcttgccgaagcccgcgccccagaatgcctcgccgaaggcgtgggcatggacatcgttcatgaccttgacggggatgccgaagatggcatggagctcggctccgaggtgcgtgccgccccagcccggcatcatatcgtttgcataggtgacattgccggtcgcaggatcgatgacgccgccggacgagacgccgatgccgaagaccctgccatcagctgcgtcgatgacacggcgggcagactcgatggcatgctgcagcacgaccttgccgccacgcttcgcctcggtcggcaccttcccgtaaagcgatacttcaggacgctcgccctccttgaaggtcacgagagccgatgcaatcttcgtgccgccgatatcgagcgcgactacctgcctggtttctcccatggtgcatcctttcgaaaaagctagcctacagaagcccgttctcctcgagcaccttcttgatggcctcgcgattctcgcccttgagcgtacgaaccgggcgcggcatcgtgtcgtggtcgaagatgcccatgaggttcagcgccgtcttgaaggcgccgacaccgccagcatagcctacgacgccggtcgtgacatcgaagatatgcgagacctcgttgatctggttctggatctcgcggacacgctcccagtcgcctgcctggtaggcatcccactgcttcacatagggctcaggaatcacgttggcaaggcccggcaccgaaccgtcggcaccggagagataagcgccgtcgacgacgatctcgtgtcccgtgaggaggctcaaaggatgtcctgccttctcgttctcctggacaaggtagcggaagttcacgtcgtcgcccgaggagtccttgacgccggcaatgacgccgtcacggccgagcttgagcgccagcttccagggaatcttcgcatggacgcagaccgggatatcataggcgaagatcggaagcttgacctcgtcgtggatgatgcggaagtggtcctcgatctccgtgaggccgcccagggcatagaacggagccgtgacgacgatgccgtcagcgccgagcgcctcagcatgcttcgcatgctcgatcacgcggtcagtctccgtatcgatgcagccgacaagcaccggcacgcggccgtcgacgatgcggatgccctcgcgcacaatctgctcgcggtgctcgtcagacgagaaggcgacctcgcccgtggagccgaggaagaagaggccatggacgccggcatcgagcatgcggttgatgaggcgctcataggacggcacgtcgaccgtatggtcaggaagatcgggcgtcacgacaggaggcacgacaccgcgcagagcaaacttttcagacattgcgagacctttctcttgcattgctgcagaactgcttatcaggacatgagccagctggagacgaacgagaatgtggcatcctcgaacgcattcacccgctcatgcgcccatctaggatagacgttgcgtgtgacaggacctgagagcgcagaggcgaggacatcctgcgcctcaggaggggtgacgggatcgagccccgaggtcccgaagagcaccggagccccgatggcaggagcgcatgcttctgcctggacatacgagagcgtacggaagagatcgtctgacgtctttgccagagggtccttctcccggaagtagcgtgtgaggccggaggcgatgccttcgggcatccccttctcccagacacgcctcaaggcacagggcagagggttgaggatgcagaagagatctgctcccctgccctcaagcgctcctgctgcggcaacgcccagaccggcgcccaatccttcgccgtagacaatcagcggcacgctcggaaagagcctgcgtgcgagcagcatcgcctctgccgtatccttctcctggcggacgagagcaaggctcgctggcgctcccgccacatagccttcgcagacatcctcagaccagaacctgcgctccggcgagagcacggcgcatccgagcgcgagccagcgccccagatggtgccagccacgcacgggacgccctgcatcgtggaaggcacagacgacggcgagcggcgagatgcgtgcagactcgagcatgcgtgccttgagcacctgcccgtcctctgccttccagaaaactgtctgggcctttccggaagcagtcgagaaggcaggctctggctctgtcgacacgagctcaggcacagcccctgagagctgtcccttccagaaggaagcgatctcttcgaagctggcgtctgccatcagaggccctccttcccgaagaaggcgatgagcgcatcgtcgaaggcctgtatctcctcatgcccgaaggcaggatagaagagacgccgcttcggacactggaggcgctcgtagactgtatcctgcgtcgcaggcgggcagatctcatctgcgagcccggtgccgaagagcaccggacactgcacatacggagcaaacgaggccgtatcgatatagacaagcttcgagaaggcctcctctgctttggcgccgtctgcatcgaaccagcgggcccagtagcgcaggccttcataggcaacagcatcggcaccgagctccatcactttccggaaatccgagaggaagggatagaggatgcctgccgctgccacttcagggttcagggccgccgcggcaagacccactccccctccctgcgaatcgccgtagacgaaggcctgagcgtgggcaagccgaggctctgccgcaagcacccggaagaggatccggatgtcctgctgcaggcgcacatagtagaggtccttcggctcgccttcgagccccagcacgacatgtcctgcgaccgtcgtgcccggaaagcctcctatatcttccgagcgtcctccctggccggggttgtccatcgagacgaggatcatgccttctgctgcccaggaggcattctcgagccaggaacgggtgcgtcccggatacccatggaagcgcatgagcagcgaaagggggccgctcctagcaaaggcctcggtcggcaccaggacctttgcatagagctgggcgccacgcatgccacggaaccagaggtcatagggcaccgcgcagggagccggtgtcacctcggaagctggcacgagctcccaggaaagaggcacggcatctgcttcagccatgcgctctttccagaaggaggagaaatcctcgggctcccgaaagctttctatgggatagccggcatccatcgcatctattgcccgagcttcggatggagaagcgacggcgcagcaccgaggagcgtcttcgtatagggatcctgcgggtgctcgaagacctgcttggccggaccttcctccatgatctggccgtggttcatgacaatgatgcggtcagagatgtagcgcacggtctggatatcgtggctgatgaacatcatcgacagccccagatcgtgcttgaggtcggtgagcagattcaggatctgggcacgcacggagacatcgagggcgcttgtcggctcgtctgcaatgatggcagacgggttcagggacatggcacgggcgattgcgacacgctggcgctggccgccggagagctggcccggaagggcgcgcagggcgctcttgggaaggccgacaagcccgatgagctcgctgatgcgcttctcctgctctgcttccgtgccaacatgatgcacgagcagcgggtcgagcagctggtcatgcacgatcatgcgcggattcagagccgtggccggatcctggaagacgacagagacgacgcgtccgatctccttcctgagctcgggcgtcctcttcgtgacatcgcgtcccttgaagtagacatgtccctgcgtaggtgcctggaggccgcacatgacattggcagtcgtcgacttgccgcagcccgactcgccgacgatgccgatggtctcgccgggcatgagcttgatgctcacgttctgcacggcgtgcacgagattcggatggagcagcgtgccggtacgggtcttgaacgtgaccgatatgtcatcgaggaagatgatcggcgtgtccttgtcctgggacacggtcttggtatcttctgccatcgctacttcgcctccttggcgcctgcgagggttgcgaggtacggggtgagcccgttctcctcgagatagctgtcgggaagctcggagaacttgtggtgcttcgaggcatcaggcagctgcttgatgacgggatggacatcgaggccgagcgtcgggtggctcgagcgcggagcgaagcggtcgcccttcgggaagtcctctggagacgggaccgagcccggcacctggtggagcctcgtgccgtccttggcgccttcctcgatcgagaggaccgatcccagaaggccacgggtgtactcgtggatcgggttcgtcaggagctcgcgcgtcggcgcctgctcgacgacctggcctgcatacatgaccgtgatctcagaggcaacctctgccacgagtgccaggtcgtggctcacgaagatcattgcgaagccgagcttggcctgaagatcgttcaggagcttgatgacctgcttctggaccgtgacgtcgagagccgtggtcggctcgtcgcagatgacaagggacgggtcgcgcgtcagagccatagcgatgaggacgcgctgacgctggccgccggagagctcatgcggataggactcgagcgtgcgcttcgggtcgaggccgacgagctcgagaagctcctctgcagacctcgtgccgccgcgctccgtgagctgcttcatctgcgtcgagatgagcatggaggggttcaaggacgaaagggcgtcctggtagaccatggcaagctcggtgccgaggagctggcggtgctcttcgcgcgagagcttcaagaggtcctggcccttgtagagcacctcgcccgtgatggtctccttcgggtccgtgaggcccatgatgaccttcgtcgtgatcgacttgccgcagccagactcgcccacgagcgccatgcactggccggggcgcacatcgaaggacacattgtccacgacgtgcacagagccatgcgactcgaagctgatcgagaggttcttgacctggaggagcggctcgaccgagaagtcgggaacgtggcgatcggtacgcttgagctcgacttccttgagcgctgcaagacggcgacggagtgccggctcctgctccttgtaggcacgcacaggatcggaggcgaggatgtcgtccttgcgcctggactctgcgttgtctgcatcgatcggagcgccaggcgctgctgccatagcgtcagtcaggccctcggagaggatgttcaaggcaaggcaggtgatcatgatcgcaaggcccgggaatactgcctgccaccagcgtcctgcaaggacgccctggcgggcattggagaggatgttgccccaggtcggcgtcggctcggtgatgccggctccgatgaaggtgagcgatgcctcgaagatgattgcgtcagcgacgagcgtgaccgtgaagaccatgatcggagcgatgcagttcctgagcacgtggcgccagaggatccagggcgcacgggcaccggagacaatgacagcacggacatagtcctcgccgtactcggagacgacgttcgcacgcacgatgcgggcaatctgcggcgtatacatgaagccgatcgagaagatgatggccggcacggagttgccgaggatcgtcacgaagacagcggcaagcgcgatgcccgggatcgacatgatgatgtcgaggatgcgcatgatgacttcagataccgccttgcgcgacacagcggcaagcgcgccgatgatggagccgcacacaagtgccatgccggtggcaccgaagccgatgatcagcgagtagcggccaccgtagagcatgcgggagaggatgtctctgcccttgtcgtcggtgccgaagaggaacccatctcctggtgccatgcgggcattgaagatttcggtcgggttgtgcggggcaaggatgggcgccaggatcgaagctgccgccacgaggatgaggagtacgagcgagatcttcgaagaggtgcgcatcttcttccagccgccgaacttcttgttctgggccgcagcctcttcgagcttctttgtctgctcttcgcgaatcttctgcatgctacaccgtccttatgcgcgggttgatgaggaggtagagcatgtcaaccacgatgttgatgatgatgaaggagagggcgacgacaatgacgacaccttggacgagcatcgtctcattgccctggattccttcgaggatggccgtgcccatgcccggcaggttgaagatgacctcgatgacgacagcgccgcccatgaggtagccgatcttgaggccgagggtcgtgaccggcgtgatgagggcattgcgcaggacattgcgtccgacgacgacacgctcaggcaggccggcaccgcgagccgtcttgacatagtccttgtcaagctcctcgaccatggcggtacgcacgatacgcgtcatctggccggtgagcgggaaggcaagggcgatggccggcatcagcatgcgggcaagatagccgcccggatttgccgagaacgccggcagctggcccgatgccggaaggacgtgcagatacgacgagaagagaaggatgagaagcacggcgagccagaaggacggcgtcgcgatgcctgcaatcgaaatgacgcggatcagctggtcaggccacttgtccctatagagtgccgcaaggacacccagcagaaacgacacgatggcgccgatgatgaggccgatgaacgtgagctgcatcgtgaccggcagggcctgggagatgcgctcgccgacggagtagtttgcagcaccataggtaccgaggtctccatgcaggagatctcccatatagcggacatagcggactggccatggatcgtcgaggccgtgctcctcatggtactgggctacggcttcaggcgtggcagactcgcccaatgcattgtaggcagggtcgaccttcgagaacgacatcaggaagaatacgagaatcgtgacgccgaaggccatgatcggcaatgcgatgagccgccggccgataaggcgcagaagattgttcacgcgctcccctttctcttgctgcgtacatgaagtgaggcccggagaactggggtcctccgggcctcccggcggaggcatctaacggggcctccgagcttcgctggacaatcccaggcggactaggcagagacggtgacagcgtcgatgaacgacaggccggtcgtgccgatgcccttgaagttcttgatggcaacgccgttcggtgccttcgaggtgtcctgccaggagccggtgcaggtctggacctggagcaccggatagaggacgcagttgtcggcaatgagatcgaagcacttgttccaggtctcctgctgctcggagccgctctgcgtgagagcggtgctcatgagcgactggagctgcttccactcgtcggaggtgttccacgggcagcgcgtcttcatccaggtgttgtcgccgtaccaccagttcatgaggaggtcaggatcggcgccgaagcaggacggatcgcccggggcgagcaggaggtcataggagttgtcaccggtgtcgatggcggcataggtggccgcagacgtatcggtcgcgatcgtgacattgaagccgagggcgtcgaggtcttccttgacctgcgttgccattgccacgacctgctcgttgtccgtcgtgcggagctgcacgtcgcccggtgtgatgccagcttcggcgagcaggctcttggccttgtccgggtcgtgcgtatagacggtcgaagccttgtggtagttcgtgaagttctcgggcaggtagcacgtcggtgctgcggcaaggcccgcgaaggcattgttgatcatcttgtcgtagtcaagcgcatacatgacagcctgacggacacgcttgtcgttccacggcgccttcgcgacatcgaacatcatgaatctggtgccaaagccctggaccttgtcgatgttgcagccgaggttcgtgagcgtatcgaccgcgtcggccgtgaccatctccatgacgagggtggagccttcctgctctgccgtcaggcgtgccgtcgcatccttcaggacgtcgtagtgaatcttctcgtccttggcaggatggtcgccgttgtagttcgggttcgggacgagctcgagcgagctatcggagatcgtgtcatacatccagggacccgagccgatcggcttctttgtcatttcgtccttcgtcgagcttgacggcacgacgcggatgatggcgaggcgctccttgatgagcgagaagttcgggacgttcgtcttgattgtgagtgtcttgtcatccttcttctggatgtcggcgatgggggcaagcatcgaggtatagatgttgccgctccagtcggccgccttgccggacgagcgctggaaggactcgatgacgtcctcaggcgtcacggcgttgccgtcggagaactttgctccgtcgcgcagggtgacctcgaacgtcgtgtcgtcgaccttcttggggtcgtcggcagcaagctcgttgaacgtgctgtagtcatggaaatcgatgccatagaggccttcgacgacctgccagttcgtgccgcaggcaagagcggaggacgtgctcgacggatcgtagttctgcgtgctgtaggcggtgccggccgtgatcgtgccgccaccctcggtgccagcctgggagctggaagaagacgagctggagctgctcgagcccgagcctccgcatgcagcaaggcccagaacggctgcagaggcacccgtcaatccgatgaagttcctacgtgtgagattgttcatggttctcccctttcgcagtgcatggtgcttggaactgccgctccagacgcttcctgtcaagcgtctgaggccggccctgatggcacctatattgcactcttgcagaagctggaaccgttaccaattaggaaattggtagtaaccatcgcccaatggaaaactgcataatcccagtggtgcaatgctccaatcagacggtttgcacgttctttccacaaacaggagaacagcagcccagccttcctgcatcgctgagctgccgtttatctaaatcgctgatataaaagcttttccgttacagacaattgatgaattgttacttgagtttttcaggcttttgcccttcatcctcggcgagctcctgctttctggctgcattgtcctcgtcgaaggcccggagcgtctcgtataccgcctctgcgaccgccttcgggatgcccggcgtctcggcaagctcctcgacggaggcggccttgatcttcttgagcgacccaaagcgacgcatgagggcacgcttcctcgtcggccccaccccttcgatatcatcgagcacggattttgtcatagccttgtcgcggagctccctgtggaacgtgattgcgaagcggtgcgactcgtcgcggacgcgcttgatgaggtagagcgaaggcgagcctgaaggaaggacgatcggcgtctcgtcccaggggacgaagacttcctcgtcggacttggcaaggccgcagcacgggatatcgaggcccaaaatcttgagctgctctatggcagccgtgagctggggcttgccaccgtcgagcacgagcaggtccgggcgagatccgaacttcttgtctgccatcgtctttggcccatagcggcgcgagagcacctcgctcatggacacgaagtcatttgcctcggtgagcggcgtctggatcttgaagcggcggtactgcgacttgtcggggcgtccgttcgtgaagacgaccatcgaggctaccgtgaagtggccatggatcgtcgaaatatcgaagcactcgatgcgcatgggcggcgcctcgagcgcaagcgcgctttcgagctcgagcagtgcctggtttgtgcggtcatccgcgtatccggtccttaccatgtagcggttgagcgcatgatgggcattctgctctgccatcttgaggagattgctcttctcgcctctctgcggccgatgaaggcggcagatgtgcccccgcttctccgtgagccactgcgagatgttctccccgtcaggcagctctatcgcgacatcgacctcggaggggatatctgcagtctcgtcgtagtagcgcttgatgaaggactcggcaagctcggtctcggagacatcaaggcccttgtcgaggatgaattcgacggagcggatcgtcctgccttcgcgcacgacgaagacgcaggcgcatgagatcgtctcctcgcggtagaacccgacgaggtcgaggttcacatcggaggcgaacatgacctgctggcgtacattgagtgctgagagcgactcgagccggtgcttgagcctgcctgcccgctcgaagtcgaggtctgctgcggcttccttcatctggctcttgagctcgtcggtgatgccgctcctcttgccctgcaggaacctttccacctggtccacgttcttcgcgtagtccaccgtgtcgacggcgccgatgcagacgcccgggcccttgccgacgtggtagtcgaagcagggcctgccttcgcgggccagaagcaggttcgcgacgtctatatcgtcaggatgcgcttcgaggatgcgcttcgcgcgcttccactcgacgcagttcgcagagcagatcggcacgaccttgcgcagcgtatcgaccgtttcccgtgccgcatgggcatccgtataggggccgaagtagcgtgtccccttgcggtggcgctcgcgcgtgtatttgatggccggaaacgcatccgattccgtgatggcgatataggggtaggacttgtcgtccttgaagtcgacgttgtagtaggggtggtactgggcgatgagattgcgctcgagcacgagcgcctcgtgctcgttctcgacgacgatgtagtcgaacgagcgcacctcctgcatcatgagcgggatctttgcgcggtcatccgtcaggttgatgtactgccgcatgcggttgcggaggttctttgccttgccgacatagatgaccgtgccctgtctgccgtctccttcgggaactgcaattgaactcattgaggccgagcaagcgacggcagcgaacggagccgctgcccatcattacatacgactcagtgcctgtgtttcgcgaggtcgcagcactcgaagtagacaagctgtcccgtccatgctggcgcatgttactcattcaaggatgctccgtagagacgcacggcacgcttgacggaaatagtgacgatgaccagggagcgaccttgcgtcgaccatgcccgcgatagacgcggcagtgctcggcccgaggagacggtatcagcctccgtagcggagatcggtgccggcacaaagcatcgcgcttgctgtctcgaacatcacatcggagtagtcgcccgtgcggtgctcccaggaaggacttggtcgctgccctcgttcaatcagcgcacgtaccgcaggctctcgcgcaagagcctcctcacaatcgcgcggccacgcggcttcatgcgggagaggatagcgtcatctcgccgcaccagtggacatcgatgatccggtatgggtcttacggcacggtcagaaagggcagatgcgatctgcgatgtgtgcacgagggccagcggatgaagacctgcctgcggtcatgctttgggagatagtcgcaagggcctcagcaagctcctctttcctcatcctctgtcgggcctcatggaacagatgggcccagcacggcattgggtagtgatgccatgcgtctggaaatcgacggaaccgagcacaccgcggtcgtggatccgtccacaactcgccgcaagcgcgccccagggcgtgcgtccggaaacgttgcctgataacttcgcccagtagcggactgctcgattgggaggcaggacgtcatggtcttgatccttcttcgaggatgccgagcgagagatctcgcaggatattccatcgtgtaggggggctccagtatcgtgctttccgctgagcaacatttggcagcggaaagcagatacaggtgaggccccctacacgatggatatccgcgagatctcgctcggcagcctcgaagggaagtcaagagccagaacgtcctgctcccaatcgagcagtccgctatctgggcgaagtatcaggcaacgattccggacgacgccctggggcgcgcttgcgcggccgagtgtgggtggaggatccgagtagcggcgtgttttgcgtgctcctgttcctcgatttccaagagatggctatcactacctcaatgccgttcatggcccatctggttccatgagccgacagaggatgaggaagaggagcttgctgaggcccttgccgactactccacaagcatgaccgcaggcaggtcttcatcgcatggccctcgtgcacgaaatcgcagaatcgcatcgccctttcgaccgtgccgtatgaccataccgtgatcatcgatgtcacgggcgagggatgaacgcgatcctctccgcatgaagcgcgtggccgtcgcgatgtgaggaaggctctgcgcgagagcccggcggtctgcgctgatgagaccgaggcagcgaccaagtccttccaggactactacgatgtgatggtcgagaccggcaagcgcgatggctttgtgccggcaccgatctccgactacgaggacatgattccgtctcctcgggcccgagcactgccgcgtcgctgggcagggtcgacggcaaggtcgctacctggtccatcgtcacgatttccggcaagcggccgtgcgctaactacggagcatccttgaatgagtacatgcgccagcatgtgacggacaagcttgttctacttcgagtgctgcgacctcgcgaagaacaagggcatcgagtcgtatgacatgaggcatcgctccgatttcgcgccgtcgcgcttctcggcctcaatgagttcaagtgcaagttcacgaaggagacggcagaggtcgccccctcccgcgatatcccggtccgccgtggcttctatgcgctgctcgtggaaggcacgcgacgtcgttgtcgcccgccgcaagcgtgccgaggacgaggcggagcgcaagcacagggcagagctcgagaaggctcacgccgaaaaggcgaagcatgagtcggagagagctcgctgggcggatgccgagaacgctgagaagaagtcggaagagtccgggaaatagccatggcgcgcgcacctctgccctgggaccatcttcgcaatggggagccgtctctgagagaccaggtggaccaggtccccaccgagtctggctgctatctctggagaatgcccagggc

SEQ ID NO: 82 - DNA, 19603 bp, Unknown
  Metagenome-assembled genome
gctacatcttcgagcacaacaaggaacaggaagtgcctgggtcttctgcaaactcgcgcgaggagtgcgaggccgtgacgacgacgcttcgccagtactgcgaggcagcaggagagcccgaccgcttcctctccatcatggcaactctcgagctcattcaggagtccgccgaagacctatgcgcgacgaggagacaaagctcacgacctgcacgacgcaaccttggagctaggcatcgatatcggccgcctaggcgcgccttccagatcgatgcgccgttcacggtttcgagcttcctgcaggcatgggccggacaggcaggcgaggcgagccttccgagatgtggttcgtcatgcgcgaggagcagccagaagccagagccttgatgccgaaaaccatcctggaagctccttcagggcatagccttggtgcagctctatctagaggatcgctgggtcgagccgccgagacttgatggcctcccctatagccttctctatcatcagaccatggcggtgcttgcaagctcaggcgagatggcaccgcaggagctggcacgcgaggtgctgaccctgacgccgttccatagggtgtctctcgaggactaccaggtgctcctcaggcatcttctggatatcgaccagatagagcgcaccgagggcggcggcctcatcgtggcccgccgggagaacggcagatcaatgttccgcttctatgcggtctttgccacggatgaggagttcacggtcagaagcgagtcccaggagcttggcacgatcgtgcagccacctcctgtcggcgaggcgactcgccatgccggtgctgtctgggtcatcgaggagatcgactacaagcgccatctgatcgagtgcacaaggtcaagggcaaggtccctgcctatttcggcatggtcgcaggagacatcatacgcatatcatcgagcgcatgaagcatgtcctcgaggaggatacatctatccctacccagacgaatgccatcgcccgcatcaagcaggcacggcatgtcgcagcgaatgcccatgtatgcgacgagcccttgatcaacctcggtggccgcacgtgggtgctcttcccctggcttggcaccatgccttcctggcattggaacggttcctcaagatcaagtgcggggccagctcggcctcaagggcctcgactcctcacgtccctacttcatgcagtttgtcagaagtcctctgccgaggagttctaccaggtgcttgcagaagaagcctcgaagccggtgaccccatggagctcctctatcccggcgaggtcccctacttcgacaagtacgacgagttcgtgcctgaggagctcatacggaaaggctttgcagaaggcgtcctcgatgtggaaggcatgctcgagcgggtaacttcatggggagcaagatacgcgaagctgccgcacgaggaccatcaaacgctatcatagagaatcagaaagttaaccgcagttcaaagggaggccagcatgcaggacgcatattcggacaggcacacggcaaaggtcagctgccccgccaatagctgtgcctatcgccagaacatggcacctgcatggaccacatcgcctctttgccggccttccgactctgccaaggaagagcttgcagaccatgcaacgcacgaggaatggccgaagggcacgatcctcgtgcatgagggagacccgatcgagtctgtcctcatcgtccgcaaggggcgcatcaagacattccggagcgacgccgaaggcgaagagaccgtgctcgatgtgctgcatgacggacaggcgatatggcatgggatgttcctggaagaccatatctatcactactctgtaggctgcctcacgaaggtagagctctgccgcatccagaggacagacttcgaagcccttctggcagcacaccctgatgtagctatgagctgatacagatgcgtgaaccgagctcgacgatgcagaagagaagatcatgatgctcggcatcagggatccgagacgccgcttagagagtatcttctgcacagagatgagcgctgcatcaacagagagatcaacctcaaactcgaagacattgcagcatctgtgggtctgcgtccgaaaccgtatcccgcatcctctctgccttcgacgcgaggagttgtgaagcgctaggccgtggccgtcaaggtcatagacaggccggccttgagacgattggactcgagcagagctagggcttcctgcagacaacttattcctctttcagcatctgagtttgcgcccgcaaacaaaaggagccctacacatgctttctgtgggaacacgtaatagatgattgcgaaggtaatgccgacaatcgccgcaagacctcctaatccttcgaggtagggaatctccagacaatggttgtcaatcagattctcgatgatatccttcgcaaaatcagccagcacagccacaagcgcaagccacaggccaagccgtgaaatcgaatcgcccacgccagaattcatgacctcatagaggcttccaagctgctcattcagcgactcctgctcttcgccgatacgaagctgatcgctcagaagttgtataactcgatgcccggcgctggttcgatatctcgccgataagcatctgattctcgaaggctacaaattccctctgcaggcccgcaagctcacggtagctcctggcagagttcttatgcttatcttttcctcttggaacagctgaaatccgtcccgcacgctgcgaatagctcgcaaggcccattctctgcgcaagcacaagagatgcaatgtagatgtattggttcaggtagactcgggcaacagaggcattgagctctggattcgcatccatcaggcagacgaatgagtagtttgtcgcggcatagatggttccggcgtctgcccaacggggcatgattgcgtcgttcaagagcttgtgcacatctgggtatcttgacagcagcagtcacatccatatcgatgtagacatactcatatatgcttttctggaagtccacggtctctttattggtgggattgggctccatgaacgtatcccatctccggacttctcaatccagggaaagcttctgtcccggatgagctccataacgacatacggtcatcattgagaggctttgcgtggaactctccgctctcacccataagaatcggacggaagaaatcagttctctggaagcataggcttcttcttgttcttgacatcttccagagattgcactggatcgaagacacaatgtttagcccaatgttcagtattagcttggtcgcgttgacatggggagctctgtcgcagctgtctggaatatagggaatgcacgtgcgccttcctgcttccgtgatgcgcttcgtatcctttggctcattgaatgtgccatgggtcttgatccacaggacaccgcagccaaacgtatagcagtggagctccaggccctccaggacaagctcgtagctgaaggcttcacgctgttgtctctgcctttaatgatatagcgatcgcttggcccggcctccatggtatagatatggcagaagccctcgtcctcctttgagtggcctgccggatcagatcgccgaatatctgccgtgcatcattgccaagatactgccagacagcatagcggtcatgtagctgtggatatcagggactgccgattcgctgctgcggcggcaaagatcatctgcttttcctaggcgcttccatcccagcttttcagagactcctttgacagatagtcgctgatgtcctgactctgccgcaaaagaccaggcgaagtagaagtagctgttcggttctccttcagtcacacctgttctttctatcttgacctcatcgcaatccttctgcctgtcattattggcttcactggacatgcaactgctcccaaaatgcactgaaactgttttcaggataggctggacagtgcattgaaatgttgtgcacatctgtccatgtcagggcatgtccggttgcaggtcgtacaggcgccagactaaagatgccgagcaatagactcatcacatgccgccgctagccctgcgacaggcctcgctcatgaaagaaaactctgcagctgtccgagacacaatgcatgccatatcatgtacgattctcggggatagagagaaagctatatctcgtcaggcctgacggtatggcgagcagccccatcgcatttgagtatacaccatagccgctgagccgggcagagaggctggcaccgcatttcggacagcgtgcttgcgcaacgcagatgtagtgattgacgtcttcaggtgtgagatagtcaacatattcgcaggatgtgcatctgagaaagaaacttgccgctcttatgtccacgcgacagcatcatcggagccccgcattcagggcaccgcttgtgcttcttgatacagccggcaagtccatatgcttctgcaccatcatcagccggtcccttggtcccataacgctgaatcagagactgcgtctcttctccgtttctgcggattcccaggttcgtcaaagaccaaatcatatcgacagcatggaagccttcgattctgagaggtgtctcaagcaccgtctgcggagccactccgttctttacgggaggatggaaacgcgacggcggcatgccataccagcagatcttgccgtcgatcataacaagcgggaagatgcatcatcagactgccatgtgaacgtcttccaatcctctggcagttctccgtactcgctgcactttgcaaatacttcgacgcctctatcgcgcagatcatgcacgatgctatacgcctctgcagcaaagggctctcaagcttgcctccgggaatgagaagaccactctgatctcagccgccctgagatcggccagaaacctgtctttcgccttacttggatccagaagagcgatatttggccggcgaatcgcactccgagtgcaacagaatattacgaggcagccgcccaggcacgacctatgtgatgcttgcggagacatgcatcattggaggcaccatggacggctacagccatcttagcatcgcggagcgcgaggacatcatgatccgctggaagggccatgagggggtcagcacgatagcgagggagctcggcagggacaagtgaccatatcccgcgagatcaggcgcaacggatggcaggggccttccggacaacgctaccgtgcatcgaccgcacagaggcgcgcggacgcgaggaggctgcgctgcaggcgccccaggcatggacgatccggagaggcgcgcccggtcgtggagctcatgcgcgacgagcactggtccccggaggagatatcgggccgcatcgcgatggagcatccgagcctcgccgtgaggacgacagcatctaccgtgccgtggagtcggggtcctcgactgcgagcttccgggatgcaggaaggcatccaggctgctcaggcaccatggaaagcgcaggcagtgaagggcagccaggagcgcagggggaagttcccgatcacccatgaaatctccgagagggccggaggaggcctcctccaggagccgcatcggagactgggagggcgataccgtggcaggaagccagggagcgcctgcctcgtcacccaggtcgaccgcatgagcgggttccttgccggcgggaaggcagccaggaaggcgcatgccgaggtcaacgaggcgacgggaaggcgcttgccggcagggccgtgcatacggtcacgctcgacaggggcaagggttctccgatgccaaggggctgcaggaggcgttggggctcccgtctactttgccatccacaccatccctgggagcggggaccaacgagaacaccaacggccttctcaggggctggttcccgaagggcatgagctcgacgatgtcaccgacgacgaagtgcagagggtgtacgattcgctcaaccggagaccgcgcaaggtctggggtggaagtgcccctgggaggtcttccatatcagtcgtcacttgctctgaggtcgcccccgaaatcgaggctatggagcatatctgcaagtgtgcattgcgggcagagaggactctgccgaagtcgcgatcatatcggcagagggccctgaatgcattcctctcgcctgccgcttcgtatcccagaagttctcgtttgcaacggtgaagagcttgcctcttgcctcgttacagcgacattcacgagtctgtcgaccgaaccattcacgttcttgcccgtaaggatgcctggcttcatggcggatagctctcgaccgtatccagcacaatcacgtctcgctccgacccctgaaactgatggactgtcgagcatgccggtcagaaagatctgtcctgcctgcgtgcggcgctcctgatagtcctgcatcatggcacgcacaagccgtgcctgggctatatagggggtatgacaccgatgctctttgcacctgacttcgctgctgtgagcgccagaccgaacgagacagctgctccaagcacgttgagagggaatggtctgcattgctggcagtgacaatacgttcctctgaggtctagagcgtcatggcactcccagcacagggattcagtgcaacaatgctgctacgtgcctttctgacatcgggatggtctctcagaagcccctcgtagaaagcttcactcgagaaagcggagatttcaggatgcatgcgcctctgctcatgagcatacaagccagggatggaagtgggcctctggtctcgatgacgatgccaagatatgagaagacatcctggaaagaacgtctttggcaggatggagacgatgggcgctactggcgggaatccccgacgagtaccaacttccttgaagcatgcaggctgcacagacaatctgcggaacatatgccatgctcactcatcgaacaacaccaggtcatacttcctgtctgtgaagaacttgttcgataggcttcgagaccgttgttgcgaccatatgtgcatgcgcaactgctctcagttcatcttcattgagtcttgcgaatcttgttgatgcgctcctgtatgcccacaagctcgggaggtgcgcacacccgtcttcctgagatccgtacgtcttttcaagagaatcgagctcatccttgggtcaggattgcagctcagcgcatagcgatatgaaacaaggtcttcttctgcatccagcgcttcatccctgacgtggccaaagcgcatgaactctgcattgttgacaaccttgtcgaggccccgttcccgcagaagcttcgcaacctgaaggaccatgccatcaactgatacattgctgtgcgatacagcaagcactgtccgtcccgtcaggatatggttgattgcaatctcagccatggtataggtcttgccagttccaggaggtccccagatgagcgtgacgggattctcccttacatgcttcttggccatctcctgaccggtcacaacctcagtaatggacgctccgtggtaagagcaggtccctcctgcatgagctgtaccgccaaaggactgtttgcgaaatggctgagtacctccggcatagttaggctcctgaatgtaaacggcttaggcaagctcgcaggaagcttcggctggaccgtggccgtggctgcgatgcggagagcgggacatgcatgaggcacatctcgtggaggagctccatgcaggcatcggaggagctcctgtggctgtatctccagctgtaggagtccgcatatgactgcaggtgcttcttggagaggccgtggaaggcccctccacgtatgccttgaagttggagatgaccctgtggaccatgggagcgaggcatcgccgtcgagctgtcgtattccttctgctcgaggccgggaaggacgagagcccggcagctatgccgctccaggcatccgcccttatcctcgatgcatggcaagggtggtgtgcccgaactggcgccatgagtctcccgagcagtctgcgcgcaccggatgggcgcaggagcccctcttgccagcatcgaggaagggcggatgcatggagcggcatagctgccgggcctctgccttccgcggcctcgagcagaaggaatacgacagctcggacgggacggcgatgcctcgctccccatggtccacagggtcatctcccaacttcaaggcattacgtggagggagccttccacggccttctccaagaagcacctgcagtcatatgcggacttctacagctggagatacagccacaggagctcctcgatgcctgcatggagctcctccacgagatgcctcatgcatgtcccgctctccgcatcgcagcaacggcccggtccagccgaagcttcctgcgagctgcctagcgtttacagttcagggagcctaactatgccggaggtaccagacattgccgcaaacagtcctttggcggtacagctcatgcaggagggacctgctcttaccacggagcgtcccattactgatgttgtgaccggtcaggagatggcaagaagcatgtaagggagaatcccgtcacgctcatctggggacctcctggaactggcaagactataccatggctggattgcaatcaaccatatcctgacgggacggacagtgcttgctgtatcgcacagcaattgtatcagttgatggcatggtccttcagggtgaagcttctgcgggaacggggcctcgacaaggttgtcaacaatgcagaggtcatgcgctttggccacgtcagggaatgaagcgctggatgcagaagaagaccttgtttcatatcgctatgcgtgagctgcaatcctgacctcaaggatgagctcgattctcttgaaaaagagacgtacggatctcaggagacggggtgtgcgcacctccagcgagcttgtgggcatacaggagcgctcaacaagattcgcaagagcgtcaagaagatgaactgagagcttgcgcatgcacatatggtcgcaacaacggtctcgaagctctatgcgaacaagttcttcacagacaggaagtatgacctggtgttgttcgatgaggtgagcatggcatatgttccgcagattgtcgtgcagccgatgcatgcttcaaggaagtggtactcgtcggggatttccgcagcagcgccacatcgtctccagtcctgccaaagacgttctttccaaggatgtctctcatatcttggcatcgtcgatcgagacagagagcccacttccatcctggcgttgtatgctcaatggagcagaggcgcatgcatcctgaaatctccgctttatcgaagtgaagctttctacgaggggcttctgagagaccatcccgatgtcagaaaggcacgtagcagcattgtgcactgaatccctgtgctggggtgccatgacgctctagacctcagaggacgtatttgtccatctgccagcaatgcagaccatcccgcttcaacgtgcttggagcagcgtctcgtgtcggtcggggctcacagcagcgaagtcaggtgcaaaggcatcggtgtcatagccccctatatagcccaggcacggcttgtgcgtgcccatgatgcaggactatcaggagcgccgcacgaaggacatgacagactttctgagacggcatgctcgacagtccatcagtttcagggtcggagcgagacgtgattgtgctggtacggtcgagagctatccagccatgaagccaggcatccttacggcaagaacgtgaaggttcggtcgacagactcgtgaagtcgcgtaacgagagcaagaggcaagctcttcaccgttgacaacgagaacttctgggatacgaaggcggcaggcgagaggaatgcattcagggccctctgccgtatgatcggacttcggcagagtcctctctgcccgcaggtgcacacttgcattgatgtgctccatagcctcgatttcgggggcgaatcctcagagcaagtgcaacgactgattgatggtagacctccccaggggcacttccaccccagacgcttgcgcggtcacggttgagcgaatcgtacacctctgcacttcgttcgcggtgacatcgtcgaggctcatgcccttcgggaaccagccctgagaaggccgttggtgttctcgtggtcccccgtcccagggtgggtggatggagatcagaagtagacgggagccccaagcgcctctgcagccccttggcatcgggaaaatcctgccctgtcgagcgtgaccgttatgcacggccctgccggcaagcgccttctccgtcgcctcgtgaacctcggctgcgccttcctggctgccttcccgccgggcaaaggaaccgctcatgcggtcgacactgggtggacggaggcaggcgcctccctggcttccgcacacgtatcgccctcccagtctccgatgcggctcctggaggaggcctcctccggccgccggagatgtcatgggtgatcgggattcccctgcgtcctggtgcccttacgtgcctgcgattccatggtgcctgagcagctggatgccttcctgcatcccggaagctcgcagtcgagggacccccgactccacggcacggtagatgctgtcgtcactcacggcgaggctcggatgctccatcgcgatgcggcccgatatctcctccggggaccagtgctcgtcgcgcatgagctccacgaccagggcgcgccctccggatcgccatgagcctggggcgcctgcagcagagcctcctcgcgtccgcgagcctctgtgcggtcgatgcacggtagcgctgtccggaaggcccctgccatccgttgcgcctgatctcgcgggatatggtcgactgtccctgccgaggctccccgtatctggctgaccccctatggcccttccagcggatcatgatgtcctcgcgctccgcgatgctaagatggctgtagccgtccatggtgcctccaatgatgcatgtctccgcaaggcattcatcataggtcgtgcctgggcggctggctgctcgtaaattctgttgcatcggagtgcggattcgccggccaaatatcgctcttctggatccaagtaaggacgaaagacaggtttctggccgatctcagggggctgagatcagagtggtcttctcattcccggacggcaagcttgaagagccctttgctgcagaggcgtatagcatcgtgcatgatctgcgcgatagaggcgtcgaagtatttgcaaagtgcagcggagtaggagaactgccagaggatggaagacgttcaatggcagttgatgattgcaatcttcccgtgttatgatcgacggccaagatctgctggtatggcatgccgccgtcggtttccatcctcccctaaaagaacggagtggctccgcagacggtgttgagacacctctcagaatcgaaggcttccatgctgtcgatatgatttggtctttgacgaactgggaatccgcagaaacggagaagagacgcgagtctctgattcagcgttatgggaccaagggaccggctgatgatggtgcagaagcatatggactggccggctgtatcaagaagcacaagcgtgccctgaatgcggggctccgatgatgctgtcgcgtggatcataagagcggcaagttctttctcagatgcacatcctgcggaatatgttgacttatctcacactgaaagacgtcaatcaactacatctgcgttgcgcaagcacgctgtccgaaatgcgttgccagcctgtctgcccggctccagggctatggtgtatacatcaaatgcgatgggctgctcgccataccgtcaggcctgacgagatatagcttctctctatcccgagaatcgtacatgatatggcatgcattgtgtctcggacagctgcagagttttcttcatgagcgaggcctgtcgcaggctgagcggcggcattgtgatgagtctattgtcggcatctttaggtctggcgctgtacgacctgcaaccggacatgccctgacatggacagatgttgccaaacatttcaatgcactgtcccagcctctgaaaaacagtttcagtgcatatttgggacggcagtgcatgtccagtgaagccataatgacaggcagaaggattgcgatgaggtcaagatagaaagacaggacagggtgactgagagaggagaaaccgaacagctacttctacttcgcctggtcttttgcggcagagtaaggacatcagggcgactatctgtcaaaaggagttcttgaaaaggggatggaagcgcctaggaaaagcagatgatctttgccgccgcagcagcgaatcggcgagtccctgatatccacagctcatagaccgctatgcgtctggcagtatatcttggcaatgatgcacggcaggagtattcggcgatctgaatccggcaggccactcaaaggggacgagggctttctgccatatctataccatggaggccgggccaagcgtcgctatatcattaaaggcagagacaacaagcgtgaagccttcagctacgagcttgtcctggagggcctggagctccactgctatacgtttggctgcggtgtcctgtggatcaagacccatggcacattcaatgagccaaaggatacgaagcgcatcacggaagcaggaaggcgcacgtgcattccctatattccagacagctgcgacagagctccccatgtcaacgcgaccaagctaatactgaacattggcgataaacattgtgtcttcgatccagtgcaatctctggaagatgtcaagaacaagaagaagcctatgcttccagagaacattgatttcttccgtccgattcttatgggtgagagcggagagttccacgcaaagcctctcaatgatgaccgtatgttcgttatggagctcatccgggacagaaagctttccctggatctgagaagtccgggagatgggatacgttcatggagcgccaatcccaccaataaagagaccgtggacttccagaaaagcatatatgagtatgtctacatcgatatggatgatgactgctgctgtcaagatacccagatgtgcacagagctcttgaacgacgcaatcatgccccgttgggcagacgccggaaccatctatgccgcgacaaactactcattcgtctgcctgatggatgcgaatccagagctcaatgcctctgttgcccgagtctacctgaaccaatacatctacattgcatctcttgtgcttgcgcagagaatgggccttgcgagctattcgcagcgtgcgggacggatttcagctgttccaagaggaaaagataagcataagaactctgccaggagctaccgtgagcttgcgggcctgcagagggaatttgtagccttcgagaatcagatgcttatcggcgagatatcgaaccagcagccgggcatcgagttatacaagcttctgagcgatcagcttcgtatcggcgaagagcaggagtcgctgaatgagcagcttggaagcctctatgaggtcatgaattctggcgtgggcgattcgatttcacggcttggcctgtggcttgcgcttgtggctgtgctggctgattttgcgaaggatatcatcgagaatctgattgacaaccatgtctgggagattccctacctcgaaggattaggaggtcttgcggcgattgtcggcattaccttcgcaatcatctattacgttgttcccaacagaaagcatgtgtagggctccttttgtttgcgggcgcaaactcagatgctgaaagaggaatgaagttgtctgcagagaagccctagctctgctcgagtccaatcgtctcaaggcctggcctgtctatgaccttgagacggccacggcctaggcgcttcacaagctcctcgcgttcgaaggcagagaggatgcgggatacggtttcaggacgcagacccacagatgctgcaatgtcttcgagtttgaggttgatctctctgttgatgcagcgctcatctctgtgcagaagatactctgctaagcggcgtctcggatccctgatgccgagcatcatgatcttctcttctgcatcgtcgagctcggttccaagcatctgtatcaggctcatagctacatcagggtgtgctgccagaagggcttcgaagtctgtcctctggatgcggcagagctctaccttcgtgaggcagcctacagagtagtgatagatatggtcttccaggaacatcccatgccatatcgcctgtccgtcatgcagcacatcgagcacggtctcttcgccttcggcgtcgctccggaatgtcttgatgcgccccttgcggacgatgaggacagactcgatcgggtctccctcatgcacgaggatcgtgcccttcggccattcctcgtgcgttgcatggtctgcaagctcttccttggcagagtcgggaaggccggcaaagaggcggatgtggtccatgcaggtgctcatgttctggcgataggcacagctattggcggggcagctgacctttgccgtgtgcctgtccgaatatgcgtcctgcatgctggcctccctttgaactgcggttaactttctgattctctatgatagcgtgtgatggtcctcgtgcggcagcttcgcgtatcttgctccccatgaacgtacccgctcgagcatgccttccacatcgaggacgccttctgcaaagcctttccgtatgagctcctcaggcacgaactcgtcgtacttgtcgaagtaggggacctcgccgggatagaggagctccatggggtcaagcggcttcgaggcttcttctgcaagcacctggtagaactcctcggcagaggacttcatgacaaactgcatgaagtagggacgtgaggagtcgaggcccttgaggccgagctggcccgcgcacttgatcttgaggaaccgttccaatgccaggaaggcataggtgccaagccaggggaagagcacccacgtgcggccaccgaggttgatcaagggctcgtcgcatacatgggcattcgctgcgacatgccgtgcctgcttgatgcgggcgatggcattcgtctggaggtagggatagatcgtatcctcctcgaggacatgcttcatgcgctcgatgatatgcgtattgatgtctcctgcgaccatgccgaaataggcagggaccttgcccttgacctttgtgcactcgatcagatggcgcttgtagtcgatctcctcgatgacccagacagcaccggcaatggcgatgcgctcgccgacaggaggtggctgcacgatcgtgccaagctcctgggactcgcttctgaccgtgaactcctcatccgtggcaaagaccgcatagaagcggaagtcattgatctgccgttcgccggcgaggccaacgatgaggccgccgccctcggtgcgctctatctggtcgatatccagaagatgcctgaggagcacctggtagtcctcgagagacaccctatggaacggcgtcagggtcagcacctcgcgtgccagctcctgcggtgccatctcgcctgagcttgcaagcaccgccatggtctgatgatagagaaggctataggggaggccatcaagtctcggcggctcgacccagcgatcctctagatagagctgcaccaaggctatgccctgaaggagcttccaggggatggtttcaggcatcaaggctctggcttctggctgctcctcgcgcatgacgaaccacatctcggaaggctcgcctcgcctgcctgtcctgcccatgcgctgcaggaagctcgaaaccgtgaacggcgcatcgatctggaaggcgcgctcgaggcggccgatatcgatgcctagctccaaggttgcagtcgtgcaggtcgtgagctttgtctcctcgtcgcgcatgaggtcttcggcggactccctgaatgagctcgagaggttgccatgatggatgaggaagcggtcgggctctcctgctgcctcgcagtactggcgaagcgtcgtcgtcacggcctcgcactcctcgcgcgagttgcagaagaccaggcacttcctgttccttgtgtgctcgaagatgtagccgatgcctgggtctgcaaagactggcgccttgtctgagggtgcctctgcatccggaagctctggctcgggcgctgcgtcttccggcaggtcttccttggcagggatgtgctcaggcgctgccacgatctgaggcatttcgtaggcaggctcatcctcgtctttcgtgacgccgccgaggccgtcttcgccacgctctggtgcctgcggacctgagatgtagaagtgctccatggaaaggcgccagcgctccttggggccttcgaacttcgggatcacgcagtccctgcctgtccccatggacagataccttcccgtcgcgatagggtcgcctatcgtcgcagaaaggccaatccttctggggttcacatgggcgaggcggcttatgcgctcgatgcagcagagcgtctggtcacctctatctcctctgaggagcgagtgcacctcatcgatcaccacatagcggaggtctccgaagatatgggggatggcagagtgcctatgcaggagcatggcctccaaggactccggcgtgatctggaggatgcctgaggggtgcttcagcatcttctgcttgtgggactgcgagacatcgccgtgccagtgccagacggggatgccgccttcagcacataaggagtcaagacgcaggaactggtcgttgatcaaggccttcaagggccctatgtagatgcagccgacagaggcaggagggtcttcccagaactctgtgagtatcgggaagaaggctgcctcggtcttgccggaggcggtagaagcggtcaagagcacattctcgtcggtgtcgaagatggccttggcagcggctacctgcacagctctcaggttctgccagttcgagctatagatgtagtcctggatgaagggtgcatagcgcgagaagacatccatggactagatctcgaattccgagaagcggtcatgctcttctgcaggtgctgcagaagaggcagcgtgcttcttcttcgcggcagcctcgacaggagcatccaccggggccttcaggaagtcgccctggatgaggtcgtctgccttcatgccggggttctggcagaggatatccaggagctcgatgaagtcgcggatgacctcgcgcggcgtcagatgggtgtctgcaccgacgcgctcgaactcggcagcaaggaactgcacgaggctctcctgtgtgatggtcctcgtatagccgaagaggcctgcgtggatgtccgcgagcttctccacgagcacaaggagctcctcgtgggtgagcggctcgagatggatgaccggggccagcatgtccgagaggccgccctgcgcgaagcgcccctgcgtgagcctcgaacgcaatgcctcgtaggagtagaggccgcgcctcctgtcctcgatcgtctggggtgtgccgcccatgatgatgccgagataatgggccttgccctggagcgtgtcgttgtacatcgtgaggatcttctcgtagttgtactggcggctcacggcattcggaatcttgtagaggttcacgagctcatcgatcaggatgatgaggccctcatatcctgcagccttcaagaacgtggcaaagaccttgaggtagtcataccagtcatcgtcgccgataacgatgttgacgccgagctcctggcgtgcctccgtcttcgtgcggtactcgccacggaaccacttcgtgacgagggccttcttctcgtcgtcgccctcgatgcttgcatgccaatacatggtgagaaggcgtgcaaagtcatagccatgcacgagctcctggatctggcccatcactgccatgatccgcttctccatggcagcctcgaagccaggagcatctggcgccagcccgtcttccatcgtgacctgtgtctggatgttcgagacccagcggtcgagcacgaggttcagcgctccgccatcaggccttgtcttcgtcgagaggttgcggatgagctctctataggtagcaaggccctgaccgcccgttccctggaagcggcgctcaggggagaggtcggcatcgcagacgacgaagttgttgcccattgcatggttcctgatggtctgcaagaggaagctcttgcccgagccatagcggcccacgaggaagcggaaggaggcgcctccctccttcacgagctccaggtcatggagcaatgcggcaatctcgcgttcgcggccgaccgtgatataggggaggccgacacgcgggacgacgccgcctttgagggaattgatgatgacagcggcaatgcgcttcggcacgcgcggggctgtctggttctggtcactcatgcacaagagcctttctgagatcttctgcgtagtcttctatcggtacgggtccgtcatccgagaaccgaagcatacatcgccctcgaggtcgagagagcttctcgttcatgctgtcggatgcgatgtccaaggtagcgggcgtagcggacacgatgctgtgtagtccctgccatcccgcagtgccagggcaaggtcgtactcggtatccgtgagcccgaagggatgcgctgcctctgcctgtcgtggcaggtgcagcagcctttgtgccttcctgggtacggttggcgtttctgcagtgggagctgggacaggggctggcgtagctgctgagcgggcagaggagcgggagcctctggcaggcaccggtgcgacagcaggcgccgtgacggggactgcgacatagccttcgcgctcttcgtcgacgaggagcgcttcctgcgttacgtgcgcagcgccctgatggaggagagcttcgagaggtcgaccttgaagcgcctcttctctgccgcttcctttgccttggcagcgccctccttcttccttctgggctgctatcgcatcatcgatcatgcgcagcatgtacttcggaggttctgcggcttcagggcatggccaaagtcccaggcaatgcgcatctctcggtcaagctcgcggaagatgcgggcaagctcgcggctcttgtccgggtagctgcatggctcatgcacgacccaggtgccccgctcatagaaaagataggttccgggtgctgcatcgaagcgccttccctcggcaccaagatcctgccttatgggtgcgtggtagaaggggagcacgatcgagcggtaggggatgcctaccgtgccatcgatgaggttctgcttcctcctctttgcgcagtggagcacatacgcatcgaagagtctcttgtcacggctgctgcacgttcctggtttcgcttttggaagaacggggagcgggtgggtcgaaggtcgagatgccggcaaaggctcgaggagctctgcgtcagagggcggctctatgccatattccaggttgggagcctctcgcccctctctcatagaccgcattctgtgccctgcggagggtggccacatggctgaagaaggcaagcgcatcatccgagaagtaggacttggggtcgatgccagagatattgcatagtcatgcctcagagacctagcgcgtctcttgtcatgttccagatctctttgtcgctgaagacttcaggagctggtcaagctcagagaggatctcttccggtcccatatccgtggcaccgacgatgagctcaggcatagagaagggcgcagcagccaggggccctcccc

SEQ ID NO: 83 - DNA, 25154 bp, Unknown
  Metagenome-assembled genome
gcagccacggccacggtccagccgaagcttcctgcgagcttgcctaagccgtttacagttcagggagcctaactatgccggaggtactcagccatttagcgcatatgcgctagtggtttcagcgcgttagcgcgttttcaacgtatcgcgttatgtgggctagttaacctatcaggtcgtggcatggtttcgcaaagaaaaagagtggaaagactcttcaaggcgtctttccactcttcatcagatgtgccgtgttgtcctaagcgttcttctggcagccgcagcccttcttgccggcgtccttcggcaggatgccttcctgctgggcatggcggatagcatcctccatatggagaagcaccggtgccggctcatggccaagctcggtcgcgcagagggactcctgcgagaagtcggggtcgggcaggggattgccgttcctgtccacgccgaagagggctgcgatgagatcgggaagcggggagtcggctgcaccttcatcgtccttggggtcatagccctcgaccgtgtatccggaagcctcgagcgccattgcgatgatggggagaccgacgtcgagcctctttgcaagctgggggatggtctcggtagggtctttcacctcgatatcgagctcatgcaggtcttccttgagagaaggatgggtatccataagctcagagagcgggcgggtgaagtcgagcgtttctgccatgttctgggtgtcctttccgttgtggtggggccattgtactccggctcacgcattgcgtacgggacccttacaggaattggaaagagcgctgctaccctgaaaagcactgcgctgaataatgaacaaggagagatatggcagcaaagaagaagtcgaagaaggctgcggagaagaaggacgctctgaaggacaagctggtcgcggtccacacgagcgtagctacacacagggagcgtcctgaggaagagaaccctgatacgtcgtacatgaagggcccgattcttctgcgcggcaagatggtgccagcacatacgacatccggcaaccttctggcacccgaacacgataccaattggctccacgaggatccatggcgggtgctgaggatccaggcagagttcgtggacggctttggtgccttggcagagctggggcctgccattgcggtcttcggatctgcacgtacgccagaagacgacccgatgtaccagaaggcacaggagattggcaagggcatcgcgaaggcaggctttgccgtgatcaccggtggcggcccgggcatcatggaggctgcaaaccgcggtgcctatgaggcaggcggcacgtctgttggcctcggcatcgagcttcctcatgaagaggggctcaaccagtgggtcaatatcggcatggtcttccgctacttcttcgtgaggaagacgatgttcgtgaagtactcttcgggcgctatcgtctgcccgggaggattcggcacactcgatgagctcttcgagctcgtgaccttgatccagactcacaagacggactactccccgctcgtgcttctggggacagactactgggagggcctcatctcctggcttcgcacttctgtgctcgaagcaggaaacatctcgcccgaagaccttgaccgccttgtcgtcacggacgatgtggaagaggctgtgcgtgtcgcgacgggaggcaggaagtaggcctgtgccatagcatgaaccttcggatgccctttctgctgcaagcaggaagggcagctctgtccctgaggcttggcgaatcccttctctatccgcagaagacgggaaccttccatctgaagctcgtgcaggagctttgggagtcgggtgcggagagcgggacggcagcagctcttctcggcattgaaggctttgcgggacatccggtccgcacctattcgcagggcatgaagcggcagctccttctggcgatggcctatgcgtcgcaggcgagctatatccttctggacgagccgctcaatgcactcgacccggacaaggcggagcggggatgtgccgctctgttcaggatggcagaagaaagcgcatccatccttgtggcatcccaccagcctgaggacctgaaccgcatctgtgactcctacatggtcttcaagggaacgaagctcgtggtcgtgccgaagcggggcagctgcagggggctcttccatagatgctacgggaaagatgccgagaggcaaggctgaagaattggcagggctggcagcggggggatggcctggattctgccatgtgcagccacaagccgcaatgcgtcaatgcatacccagctcctgcagggcctgctcaggggaatggcatgttctgtcatcctgggcaagcgcctcgcgaagcgcagccagattctttgcgtcctcgactctctcgaggacatcatcgcgcatgaagtccgaggccgatctgccatcgtgctctgcacatctgtagatggcagccacctcatcgtcaggcaagttctgccttcatctctgccatcagctcctccttccggatggtgaagcgagcaggtcaatgatgaagcagcgcagagctgcgccctctggcaatctgggcaacgatccggggcggctgcagccggcctccttgtgcctttgggctccgtatcacatttcatataggtgaactgatgctgtcctatgggctgctggcactttactgtgctaaagtgttccgcacgggtcggcaggctgctgccgcatatgaaaggggagaccatgtccaccatgaaccgccgccagttccttggccttgcaggaagctgcgcttcgtttgcagcgctcgcatctcttgctgcctgcggaaacacctcttcgtcctcgtcttcttcgagctcttcttcgagctcgagctccagctcttcgagcttcacgggaccctttgtcctgggcttcgaccaggagttcccgccgtatggctacatcggcgacgacggcgcagcgaccggcttcgatatcgatcttgcccaggcagtctgcgatatggagggctgggagttcaagcccacgcccatcaactgggactccaaggacgcaatgctcaatgctggccagatcacctgcatctggaacggcttcacgatcgagggacgcgaggacgactacgccttcaccgatccctatatggagaaccgccaggtcgtggtcgttcgcgccgactccggcatcgagagccttgccgaccttgccggcaagaatgtcgcgacgcagaccgactctgctgcctactatctcctcgtcgacggcggcgaccaggcggacctcggcaagacgtttgcaaagctcgatacgatcggcgagtacaacacggccttcatgatgctccagcagggcacctatgatgcactggccgtcgactatccggtcgctgtctacaacatcggcgacgacacgagctacaagatcctcgacgaggcactgaactccgagcacttcgccgtgggcttcaagaaggacgatgccggcgctgcccttgccaagaccgtcgaggccgacctccggaagctcgatagcgaaggcaaggtcgaggaggtctgcgagaagtacgcagaccagggcgtctcctatacggcctggtgcctgccgaaggcataggcatatctgtttctgtcagctggtagccgcatgcagcatgcgctgcatgcggccttgtgtgcaaggtgatgatcttggatctctctacgatggtggggcttctggggacgggctatgtcacgtcgctcgagatatttgccctgacgcttctgggttccatccctcttggcatcattgtggccctgggcaggctctcccacataaagccgctctccttcatcgtgaagctctacatctcgctcatgcgcggcaccccgctcatgctccagatgtttgcggtcttcttcctgccctattacggcttcggcctctcgacgggcacggactacatgttcacggcctgcatgattgccttcatcgtgaactatgcggcctacttcgcagagatctaccgtgctggcatccagtccatcccgcgcgggcagtatgaggcggcagaggtcctgggctatacgcattcccagaccttcttccgcatcatcctgccgcagatgttcaagcgcatccttcctgccatgggcaacgaggtcgtcacgctcgtgaaggatacgtcccttgccttctccatcggcgtggcggagatgttcacgcagagccgtgccctcgtcgcgagccagcggagcatggtaccctttgccattgcggcactgttctactgggtcacctgcctgatcatcgagttcgtgatgcgccgcatcgagaagaagatggactactaccatgactagaagcgatatcgcagtgagcttctccggagcctgcaaggccttcggagacaaggaggtcctgcacggcgtcgatttcgagatcggccgtggcgaggtcgtgtcgctcatcggcccttccggtgccggcaagtccacgatgcttcgctgcctcacgctcttggagaccctcgatgcaggacgcatcgcctacggggacgccgtggtctgcgaaggagcggagaaggcggtctacaacaaggcagccatgcgtgaggcgcgcatgcgcttcggacttgtcttccaggactacaacctcttcccgcaccgcaccgtcctccagaacgtaatggatgcgccgctcgtcgtgcagcacagggatgaggatgaggtcaggaaggaagcggaagagcttctggaaaggctcggcctcgaaggcagggaaggtgccgtgccgtgcgagctttcggggggccagcagcagcgcgttgccattgcccgcgccctctgcatgaaccccgaggtcatgtacttcgatgaggcgacaagcgccctcgatccgaagctcacgaaggacatgcacgacctcatccgccagcttgcaaaagagggcatggcggtagggatcgtcacgcacgagatgggctttgccgagacggtctccgacaggatctgccttcttttcgatgggcagatcgtcgaggatggcacgccccacgaggtcatggagcatccgaaagatccccgcacgagggctttcctggaccttgcgtgcgactgatgggaagacgtcagaaacgctctttcgcaatgcgtgtccttgtgctcctgctcgtcctctgggcggcaggagcatttcttgcattcgtgcagctgatggaaagctatcccaaagcagcggatgcggagacgtggcttgccgaggcggaggttgcgacagatgtgctggcaaagccttgccttcttgcacttgccctcgtgctcctcgtctgggcggcagggaccgtgctcttccgcacgcgggcaaagcggaagataaagcggctctcgcggggtgccaaagccttgacgcctgagcagttcctccatatgcgcaatggcggaagcacgcggggcagaagcgatgtgctttcccatgactttgccggcatctacatcttcacgaacacggatgacgggagatgctatgtcgggcaggcccataacgtgatctcgcgcgtgaaccagcatctcacgggcaagggcaacggcgatgtctatgccgactatgtccacggggcgcatttcgagatcaggatgatcgccctcaagggctcgggctaccatacgctcgacgatctcgaacgcacggcaatcgaagccaccggtgcctatgagcggggctacaacaagacgcgcggcaaccgtccgtcgtgagagggtgccgttcaagggataggacctttcgtacagaagtgctgcggctacacttgatatgtcccgaaggggctgcctagctgcccttcatgcagccgagcgaaaggatagtccatggctgacgaagatgaggtcgagttcatcacgcttgactacgaagatggaacctccgaagagtgcgaggtcctgggcgtattcgagagtggcgacggcgagtatgtggcgctctctcccgagacgcaccctgaagatgtctacctctacgtctacaacgagacggacgacggagacttctatgtgacagagatcccggatgcggactacgaccaggtctcgagcgatttcgacaatctgtggttcgctgacgcggacgaagacgacgacttcgacgcagaggattccgagtaggaatcccgagcaggggagatatggggagacggggaccggaaggcttggctttccggtccccgtcgctatggcacgattcttttcacaagctcctcgagctcttgtaccgtgtgcacctcatgctctgccgggaactggtctgagggtgctcggcgcagcctgtggttgaaccagatgaccggcatatgcacggagtgggcgccgagcacatcgatcgggaaggcgtctcctatatagagcgagtgtgtggggtcggcacctgcatgtgcaagggccatctcgaagatctcaggcgaaggcttggccgtgcctgtagcgtcggagatgaagacgttgtcggatgagatccagcgggaaaggcccaagatctcgatcttctggcgctgcggcgcctcgcggccgttcgtgatgatgccaagagcgcatctgacatgggcggcacaccagtcgagcgtgcgctccatctcaggggcaagcttcatggcagccttgctctgtgtcccatagacatgctggagggcaagcgctgtcttctcgtcgatcgtgacaccgtaggtcgcaagcgtcctctgcatgcggcggatatacatctcgcgggtcgggtgccaatcgtttcggagtgccgagaagatctcctgggagtagcgcctgctcgtatcgaagaggtctgcagccgtggcatggggaatgggtcctacgacctttcctacggcatatgcgaagggctgcgcctggtcatagagcgtatcgtccaggtcgaagaacacggcatcgcgcttgcctgcggcctcttgtcccattgcgtcagctcctgctctgtggtattcaaactatagatggcatgataggtttcttgtatcggtcgctcaattgcgagcgtgctacattgagcctgtcctgcaacatgaatagtaccaattcgtgcagaatgtttctgtgcgtataatgactcggagccgctttctggtgcggatatgcagcttcgtggctatactatggtgcttgtagcaatgtctccggaagagccggagcgtgaaagagagggaacgcatgagcctcggacctttggaaatcatcgttattctggtcgttgccctgctcatcttcggacctaagaaccttccgaagcttggcagcgcccttggcaagaccgtcaagaatgtccgcgagggcatggagggcgacgaggacggcaaggatgagaaggcaaccgagacggaggcttccatcgaggatgccgacgctgacgcggatgcttccgacgagaacgtgaagttctgcccgaagtgcggtaccaagaacccggccgacagcgccttctgctccaagtgcggcgcaaagttcgagtagcgcagacggggccttcggttccttcggataagtcctgcaccaggtcgtgagaaagcagagcatggaaaacactatcaccttgacccctgagggccgccagaagctggttgacgagcttgcctaccgcgagggcgagaagcacgacgagattgtcgagcgcatcaaagttgctcgcgatttcggcgacctttccgagaactcggagttcgacgatgcaaaggaagaggaggcaaagaacgcctcccgcatcaacgagattcgtaccattcttgcaactgccaaggtgattgacgctgccaacggccttgaagtctccattggctgcacggtcgagctcacggatgccaagggcaagaagacgaccttcacgatcgtgggcacgacggagaccaactcgctcgagcacaagatctcgaacgagtcccctgcaggagctgccgtcattggccatgaggtgggagaccatgtctccttctcttcgccttccggcaaggtgcgcgagtacacgatcacgaacgtcacgcgctaaagcatgcacagataggattcgctgcgccccgaacccatgggacaccatggggccggggtgcttcatgttgaaggagatatacacaccatgcaggaagaagaggcacgcacgcaggacgcccaggcaccgcttctggacgagcgcgcacagagaagggcacgccgccaggagctgattgcagccggcatcaacccctacccgatcaagagccacgtcgatgcccatgcaaaggacatcgaggagaagtatgcaggcctcgctgcaggcgaggacacgacagacgtcgtgaccgtcgctggccgtatccgtgcgctcaggaaccagggcaagattgccttcatcgtgctcgaggatgtcacgggccagatccagctcttctgccgcgtgaacacgctcggcgagtcctggccgctcgtgggcgagctcgacctcggcgacatcgtcgaggcaacgggtgccgtcgtccgcacgaagaggggacagctctccgtcgcgccgacgaagctcacgctcctctccaagagcctgcgcccgcttcccgagaagttccatggcctcacggaccgcgaggtccgctaccgccagcgctatgtcgacctcatcatgaaccccgaggtccgcgaggtcttccgcaggcgttctgccatcatctccctcatccgccgctacatggaggcagatggctacctcgaggtcgagacgcctgtcatgcactcgattctgggcggtgcgaacgcaaagccgttcgtcacgcacttcaacgcgctcgaccgtgacttctacctgcgcatcgcgacggagctgccgctgaagcgcctcatcgtcggcggcatggagcgtgtcttcgagatcggacgccagttcaggaacgaaggcatggacctcacgcacaatcccgagttcacctccatggaggcctactgcgcctactccgacctcgagggcatgaaggagctcacgcagggcctcttcaagaccattgcccgcgagattctgggctgcgaagagggcaaggaggtcatcacctatcaggggcagaagatcgacatgtccggcacctggaaatccatcccgctggcagaggtggcctcctcggtcgtgggcgagcacatcgatatggatacgcccgtcgagcatctgcacgagatcctcgacgcccacagcatcgaatggcagaaagactggggcgccggcaagctcctgttcgagatctacgacgagctcggcgaggcgacgctcgtgaacccgaccttcgtctgcgactaccctgaagaggtgagcccgctctcgaagcgcaaggacgaggacaagcgcctgacggaccgcttcgagctcgttatctgcggccatgagtacgccaacgccttctccgagctcaatgacccggtcgaccaggcaggccgcttcgccgagcaggtcgctgccaaggacttcggcgacgacgaggccatgggctatgactacgactacgtgcgtgctctcgagtacggcatgcctcctgcaggcggcatcggctacggtatcgaccgcatgatcatgctgttctgcgaccagccggccatccgcgatgtcctcctcttcccgcagatgaagcccgagacgatcacgaaggaagacatcgcctcgcagctgcctgacaagacggacaacgctgccgcctctgtcgatgcccttgccaggaacgccgaggacggcgccacggcagaccgcaaggcagacgaggcagctcatgctgaggctcaggaaaaggcagaggaagcacctgcagaagagtccgcagaggagccggagggcctctctgaggccgccaaggctgccatcgcggccgatatgtccggcacgcttacggcgggcatcacgcgcgatgaggcgcacgaccttctgaagcgctacaacgacgacaccttccatatcgaacacggcgagacgcttgaggggctcatgcgccactttgccgagcagtacgacccggagaatgtggacttctggggcatcgtgggccttctccacgatcttgactgggagaagttcccgtctgtcaccaaccacacggtcaagacggctgagctcctggccgaagctggcgccacgccgcagcttgcgcatgcgatcatgacgcacaacgcagacaacaacgacgagctgccccagcctgagctcaagatggagcgcgtgctcttcgcgaccgacgagctctccggcctcatccaggctgctgccaagatgcgtccctccggctctgtcacagacatgccgctcaagtcgctcaagaagaagttcaaggacaagcgcttcgctgccggctgcgaccgtgctgccatggagcgcggcgccgagctcaacggcgaggacatgaatgcctgcatggagtccgtcctcgaggcgatgaaggccatcgcccctgtcggcgacatctatgcaaagcccgccgaggacactgaggcataggctctagggccatatgagaatggaagcgcggcaggtggctggctacctgccgcgcttttgtcttccgaggaggaaacgatggggaagatgcctgaggtggcgcctcgcgaggcagccgcatgcgaggaggtgctcctcgagcaggagcaggtgctccgctacaaggagagcttcgattcggctgctgccttggagcttggacgtgcgctggctgggctcgagaaggagttctcggagacctatgtcgtgcagatcgtgcgcgcagcggatgcggaggtcgtcttccagtggctgcccgacgacaaagggacaaggaacctcgatttcgcggcaggaaagattgcagagacgctcgccacgggacatgcaagctgcttccggcagatcgaggcgctgaaagaaggggagggcttggatgcgctctttgcagaggcgcctgagcgcctcatctcggcaggggccttcccgatctatgcggacggcgagctgactgccgtcatcggcgtgagcgggcttcaccagggtctcgaccatgaggcaatcgtgcgggccttggagcaggttctgggaaagagcgtgaggcgcttaccggtcgctctggcatagcttctccttccctctcctcataaatgccatatgcgggctaggaattttctgaggagaaggcatgcgcgattgagcattcgcgctcgtgggtacagaaaggacaatcaaacggcgccctgcaggagagagccttctgcagggccttatgcacaaggggtggttggacccaacatgttcgagaaattcaccgacaaggctcggaaggtgatgtcgcttgcccaggacgaggcaaagagcctcggccagatgtatgtcggcaccgagcatctgctccttgccctcatcaaggaaggtgacggcatagccgcgcaggcgctcgcgcagctcgatgtgagctacgaggagacgctcgagaccgtgaaggaaatcacgaaggatgactccgagcccatccctggcggccacatcccgttcacgccgcgtgcgaagcgcgtgctcgaggatgcctaccgcgagaccatgagccacggccagacgtatatcgatacgcagcacctgcttctcggcatcgtctccgaaggcaacggcgtcgcaatggaggcgctctcccgcatgggcatctcaggggatgccgtgaggaatgccgtggacgagctcatgaaggacgcagagccgcagtcgcagcagcctgcagaagctgcaggcgtacgcatcgggcctgagctcttcggaggaggcgcacagcagcaggaaggctcgcttctcaaggagtacggccgcaacctcacgcagcttgccgctgatggcaagctcgatcctgtcatcggccgcgaccgcgagatcgagcgcgtcatgcaggtccttgctcgccgccagaagaacaacccgatgatcctgggcgatccgggcgtcggcaagaccgctatcgtcgaaggcctggcacagctcatctgcgccggcaacgtgcctgatatcctgcgcaacaagcagatctggacgctcgatgtcgcagcgctcgtcgcaggctccaagtaccgtggcgagttcgaggaccgcctgaagaaggtcatcaacgaggtcgaggagtcgaagcaggacatcctcttcatcgacgagatccataccctcatcggcgccggctctgccgagggctccatcgatgctgcctcgatcctgaagccgccgctgtcccgtggcgagatccaggtcatcggcgccacgacggtcgacgagtaccgcaagcacatcgagaaggattccgccttcgagcgccgcttccagccggtcttcgtgggcgagccttcgcctgagaacacgttcaagatcttgaagggactgcagtcccgctacgagaagcaccaccacgtccactatacggacgaggcgctcgaggcagcggtgcagctctcgatccgctatgtccaggaccgctatcttccggacaaggcgatcgatgtgatcgacgaggcaggtgcgcgcacccgcgtgcacaagatggtgctgccgcctgaggtcgcgaaggtcgacgaggagcttgcccgcgtcaagcaggagaaggcgaaggctgccgcaacccaggagtacgaggaagcagcacgctaccgcgaccaggagaaggagctcacgcagaagcgcgacgagctcgaggagacctggcacaagcagctcgaagagcatgtcgtgaccgtcgaggcgaaggacatcgccgacgtggtctccgatatcacgggcgtccccgtctcgaacctcacggaggcagaggcctcgaagctcctgcgctgcgaggatgcgctccacgagcgtgtcatcggccaggatgaggcagtctctgctgttgcccgcgccatcaggaggagcaggagcccgctcaaggacccgaggcgccctggcggctcgttcatcttcctcggcccctccggcgtcggcaagaccgagcttgccaaggcgctcgccgagttcctgttcggctccgaggatgccctcatcagcttcgacatgtccgagttcatggagaagcatgaggtatcgaagcttgtcggtgcccctccaggatatgtgggctacgacgagggcggcgagctcacgaaggccgtgcgcaggcgtccgtactccgtcgtgctcttcgacgagatcgagaaggcgcatcccgatgtcttcaacatcctgctccagatcctcgatgaaggcaggctgacggatgggcagggccgcaaggtcgacttctcgaacaccgtgataatcatgacgtcaaacatcggcgccagggatatcgcgcagacgacgacgctcggcttcacgggagactccaatggcctttccgacaaggagatccactcccgcgtcatgggcgagctcaagaagctcttccgtcccgagttcctgaaccgtgtggacgagatcgtcgtcttcaagtcgctcacgaccccgcagctgcgtggcatcgtcgacctcatggtctctgacctcaggaaccgcctcatcgcgaacggcatgtcgatcgagctcaccgatgcagcgcgcgaccttgtggccaagcgcggtacggacaagatctacggcgcacgtcctctccgccgtgccatccagaccatgatcgaggatcctctcgcagaggagctcctcgaaggcaagtgggctgccggcgacatcgtgaaggtggatgctgcgggagatgagctcacattcacgaagacccagggagagattcctgcaccgacggagcgcgtccacatggacggcccgcaggcacgcgagagctggtctctgcccgagtcggctccgacagatgcagggagcggcctcgagacagcaggtgcataagagggccgctgtcctgaataaggcgcaaatgtttcgatgcggaccgaagctccgagttctgggggcttcggtccgcttcggtcatatacactgaagatgatgtagcggacgaaagagtcgggtccgcacttcaagcgaaggggtcgatgcaatggaagccgagggaaccgaaccaagccgtccggaggcccagccccagacaggcgcaaagagcatggatgagcgcatcaaggaggctgtgaaggccacagcccctggcacctccctgcgacttgctctcgatatgatcatcgccggcaatctcggcgccctcatctgcgtgggcgacacggatgccgtgcttgcagtaggaaacgatggcttcccgctcaatatctcgttcacggcaaaccgcgtgttcgagctcgcgaagatggatggcgccatcgtcgtcgacaaggggctcacgcagatctaccgcgcgaacttccatctcgaccccgatccgtcgcttccgacgtccgagaccggcatgcgccaccgcacggcggcacgcatgagcctgctcacgaaggctgtcgtgatttccgtctccgagcgcaggcatgtggtctccgtcttcgtgaacggctatcgcttccagctcaggaccgtgacagagatcatgagcacggtgaaccagctgctcgtgacgctccagaacacgcgccagcagctcgaccattcgctcctgcgtctcacgacgctcgagcttgacaactatgtgacgctcggcgacatcacggaggtcttctaccagttcgaggtgctcatgaccgctgcagggcagctgcagaagtgcatcgacgagcttggctccgaaggcaagaccgtcgacatgcagcgcgacgagttcgtgggcgacatggatgaggaatatgacctcatgatccgcgactatgcgctcgactcctccgaagagaacgcaaaggtgatccgtgccaagttccatgcgatgaacaacaaggacctgcgctcgccgaagcgcatcgcctcgatcttgggctacgacgaccgtggcgaggattcgatcatgacaccattgggactcaggaccctctcgcgcgtctctgtcgtgcatgaaggcatggcggacaagatcgtcgatgagttcggttctctccaggagctcatggacgatatcgaggaagacccctcgaggctcgacagcatcggcgtcaagaacccgacgatccttgcggacagcctctacaggatgtggggcaagcgcgcatgagcggccattgcttcgttctcgacacccaggtgggcacgaaggcgtccttcatcggcacggcggcagccggccatgactgcgcggccgtgatcgtggccgcaggctcgggcacccgcttcggcgcttcagagggcaagcagttcgtgaagctctgcggcctcccgcttgttgcctggtcggtccttgccttcgatgaggcgccttcctgcgcacagatcgtcgtcgtgtgcccgccaggcaggaaagacgagatggccgatgcaatcttgggcaaggtccatatcgcgacatccttgaagattgtcgagggcggtgccacccgccaggaatcgagcaggctcggcgtgcttgcacaggacccgaagcttgcctataccgcaatacatgacggtgcgcgccccctgatcacgggggcgacgattgagaatgcgcttgcgcatcttcggtgcgcacctgagcttgcaggcgtcgtctgcgcccatcctgcgaccgatacgctcaagatcgtggaccacgagatggtcatgagcacgcctgaccgctcgctcttctgggctgtgcagacgccccagatcttccgccgccagcgcatcatcatgtaccacgaggcggcagccaaggaaggatacgtcggcacagacgacgcaagcctggccgagcactatggcggagccatccgttgcgtcaagtcgccgcgctcgaacctcaaggtcacagtgccggaagacctctcgctcgcagaggccatcctcgaccagcgtctctgctcctggcaggacgagaggcggcagagttcctcgaagggggaagcctgatgcttcgcataggacacggatacgatgtgcaccgcttcaaggaaggcaggaagctcatcctgggtggcgtggacatcccgagcacacgtgggctcgatgggcattcggatgccgatgtgctcgtgcatgccctgatggacgccatcctcggtgccatgcgcgtaggcgatatcggccagctcttcccggactcagacccggcctatgagggagcagattcgctgaagcttctggagcgggtcgctcagctcatgcgcgacgagggcttcgagcttgtggatgccgacacgaccattgcagcgcaggcaccgaagcttgctccctacaaggacgagatgcgccgatgtatggcttctgccttgggcgtctcgcctgaccatgtcggcgtgaaggcgacgacgacggagcgcctcggctttgtcggccgcgaggaaggcgtggaagcctgggcggtcgtgctgctcgagggcagcgagaacgagcggccttgtacgcaggagtagccgcacctacaatatcctgacacgcaggaacctcggccaaggtgcatgaggagcctggatccagcagaggagaagcgcagatgcttatctataacagccagatgcacaagaagcaggagttcaagccgatcgagccgggcaaggtccgcatgtatgtctgcggccccacggtctacgaccagatccatatcggcaatgcacgcacgttcctctgcttcgacgtgatcaggcgctatctgacctacaagggttacgccgtgacgttcgcccagaacctgaccgacgtcgacgacaagatcatcaaccgtgccaatgagcagggcaggaccgctgccgaggtcgcagaggagtgctcccaggccttcatcgagcagatgcaccgcttcggcatcctggatcctgacatccgtccgcgtgccacgcgcgagatcgctgcgatgcaggagatgatccagggcttgatcgaccagggctatgcctacgccgtgccttcgggagacgtctacttcagcgtccgttccgacacgaactacggcatcgtctccggcaggaatgtcgacgagctcatgagcggcgcccgcatcgaggagaacgagcagaagagggatcccctcgacttcgcgctctggaaggcagcgaagccgggcgagccgagctggccgagcccctggggcaatggccgtcctggctggcacaccgagtgcgtcgctatgatccaccgctatctcggcgtccccatcgatatccacggcggcggctccgacctcatcttcccgcaccatgagaacgagacggcacagtgcatgtgcaactggcacacgccgcttgcaaacgtctggatgcataccggcatgctcacgatcgacggcgagaagatgtcgaagtcgcttggcaacttctacacgctcaaggaagtgctcgacaagtatcctgcagacgcgcttcgtctcctcatgctccagacccactaccgctcgcctctcgacttctcgttcgagcgtctcgagggctcggtcggcacgctcgaccgtcttaagagctgcgtcaagaacctcaggtgggctgccaaggcagcgccggaagacggcgagctcaatgatgcagaccacgagctgacgcgcgccgtgcgcgaggcacaggccgagttcacggcccagatggatgacgacttcaataccgcaggcggccttgctgccatcttcggcctcgtgaccgcagccaatacctacctcacgaaggcaggagaggacatctcgacggcagcgacgcttcgtgcagttgatgcgctcgaggagctctcgggcgtcctcggcatcaaccttgctgcagatgaggaggagggcctgccggcagagcttgtcgaccttgcaaagaaggaagcaggatatgcgggcacaagccccgaggaggctgctgacgccctgatcgaggcccgtgctgctgcccgcaaggcaaagaactgggccgtcgccgatgccatccgtgacggcatcacgtcgctcggcctcgttctcgaagacaccgcggcgggcacgcgcctgacaaagaaggactagcacatggcagacagaagataccagggctcctcttcccgtcgaggcgcaaagggccagggcggataccgaggacagggcggctatatcggaaagatgtcccaggacagaagccccaagagccgcaattcccgcggtgggcagaagggtggccgtggcagaggtgcaggaaggccgcagcgtccggctcctgtgcgctccgacatgctgatgatcgagggcaggcgcgctgtcgccgaggcgctcgataccggtgtcaagcttacgcgtgcctatgtgtctgcccctgacggcgatgcttcgctccaggagctcatgagcaggctcgaggcagccaatgtccccatcgaggaggtctcgcaccgcgagctcgatgcaaggtcgtcccatggggcgcaccagggaatcatggtgaagtgcgcaccgtttgcctatgcaagcgtccgtgacatcatcaatcgtgcaggcgagggaccggcgctcgtcgtcctcctcgaccacgtgacggacgaaggcaacttcggcgccatcgtccgctctgccgaggtcgcaggtgctgccggcgtgatcatcgccaatgcccgtgccgcccaggtcggcgtcggtgccatgaagacatcggcaggagccctgctccatattccggtcgctcaggtgccgaatctcgtccaggccatgcaagagctcaaggacgcagggttctggtgctgcgctgcgacagagcacgcggaagaggacgtgtggcatgccccgctcgagggccgcatctgccttgtcatgggatcggagggctctggcatctcccatctcgtgctctcgaaatgcgacttcgccgtgaggcttccccagaggggacatgtggagtcgctcaatgtcgcacaggcggcgaccgtgctctgctacgagtggctgcgccgcgatatggagcgcacggaagagccaggtggcaacgcgtgagctcccgttcccatcatgagctcctcatcgtcgatggctacaacgtgctcggggcaacccctcgctatgaagggctgatcgacgagcataccgatcctgagcactttgacaccgatcccttcgtgcgggcacgcgaggccctgatcacggatgtcgcagcctttgcccagggacgctatgacgcggtcgtcgtcttcgacggagcgcagaatcccgatcccacgaggaatgcgatgcatgaggcaggcatagagatcatgttctcccgcgcaggggagagcgccgataccgtgatagagcgcctcgtcaccgaggcgcgtgtcgcaggacgtccggtgagcctcgtcacctcggacaatacgatccgggcgaccgcaggattcggcccgggcgaggttacgcgcatctcatcggccttgcttgtgcatgagatcgagcgggtggaccgcgaggtagagacggtccgtggcgagctcaagccccagaagatgacggtagaggaccggatttctccggaaatgcgcgcgaagctctggaaaatgctgggccattaggggtaatatcattcccacgccggtatggctcaatggcagagcaacagttttgtaaactgtgggttgtgggttcgactccctctaccggctccacgataaagcagcaggccacgatatgaatacgtggcctgcttttttaatctctgaacgattggaagatgctgatccacgtaggctgttagcagttttgcagcaggatcccgccgaaatcgaagccggctctgcaagaacaggcgccagcaagaacaggcgccagcgccagagcgcgtgggcatactgccgattgcaagtttacaaatcttttgaaggaattctgcattgagaggccgttgccagagcaccgctgacggatttggcgagcggttctgtgtggccaatggaatgggtgccgtcagcagagaagagacgaaaagcataggccgctatgggcgtatcccgaaaaaacagcaggtcagatggggcggcaagcaacggcgcgtctgctctggaaaccactctgctcgtacaggaatctcttgcagttgtgcaggaatcgtgggggagttacgcccggctgggtggattatgttgacatgaatttggggacgtcgtactatcttttccgctgacggggagcacaggctcgcagcaacgcttgaaaacggtatggggatgtggcacagcggcaactgcggcggactgtaaatccgctctctctgagttccttggttcgagtccaagcatccccaccatgcccgtgtagctcagtcggtagagcacttcgttggtaacgaagaggtcaccggttcaaatccggtcgcgggctccagattcaggcatatggcggtgtagctcagctggttagagcacgcggctcatacccgcgatgtcaccggttcgaatccagtcaccgctaccagagcttccgcggcgcccttgggcgccgctaagcatataagagggtattatcaggtaagaccgaccaacaagtggtcgattttgaaggaggacggcaatggccaaggaaaagttcgagcgcactaagccccatgtaaacattggtaccatcggccacgttgaccatggtaagacgaccctgaccgcagcaatcaccaaggtcctttctgagaccccgggctgcacggcaaactacacggccttcgagaacatcgacaaggctcccgaggagcgtcagcgcggcattaccattaccgtcgctcacgtcgagtatgagaccgagaagcgtcactacgcacacgttgactgcccgggccacgctgactacgtcaagaacatgatctccggcgcagctcagatggacggcgcaatcctcgtcatcgctgcaaccgacggcccgatggctcagacgcgtgagcacatcctccttgctcgtcaggtcggcgtcaagtacatcgtcgtcttcctgaacaagtgcgacatggtcgacgatgaggagctcatcgacctcgtcgagatggagacccgtgaccttctctccgagtacgactaccccggagacgacattcctatcatccgtggctctgcactcggcgccctcaacggcgatccgaagtgggtcgagtccatccgcgagctcatgcgcaccatcgatgagtacatcccgacgccgcagcgcgacaacgagaagccgttcctcatggctatcgaggacgtcatgaccatctctggccgtggtaccgtcgcaaccggccgtgtcgagcgtggcgagctcaagctcaacgagccggtcgagatcgtcggcatcaagccgacccagaagtcgaccgcaaccggcatcgagatgttccgtaagaccatggacttctgcgaggctggcgacaacgtgggcatcctgctccgcggcatcaagcgcgaggacatcgagcgtggccaggttatctgcaagccgggctctgtccagccgcactccaagttctctgctgaggtctacgttctgaccaaggacgagggtggccgtcacacgccgttcttctccaactatcgtccgcagttctacttccgtacgaccgacatcacgggcaccatcacgctccccgagggcgtcgagatggctatgccgggtgaccacacgacgatcaacgtcgagctcatccaccacatcgcaatggaggagggcgaccgcttcgcagtccgcgagggtggccacaccgttgctgatggccgtgtcgttaagattgttgagtagatctaaccgacgaggctttctgacccggtgcccctcagggtgccgggtcttttcatgcaagcaccatcagacccagttatatgcacattctgtgcagcggtctgagagttcctatcgctagttgacagaatcgacctagggatggtaacgtagtccaccgcgtcatggtcgagggcgtctcggctatgacaagtattcaggaggatcaatgcgtactttggttacccttgcatgcactgagtgcaagcgtcgcaactacaccacgaagaagaacaagtcgaacaaccctgatcgacttgagatgaagaaatattgcccgtggtgccgcaagcacacgctgcacaaggaaacccgctaaaatagggttagtcataggccagtagctccaatggtagagcggcggtctccaaaaccgtttgttgagggttcgagtccttcctggcctgccagcaattacaccgactatcccttacggggtagtcggtttccatgtaataaggttcttttgatctgaagggttagcgcatggctaagaaggagcgccagaagaggtccgcacgccaggcccgtgcacagaagcgtgcagagcttgaggcggcgcacgccacatccgtcgcttccacaggcgatgcaaagaaggctgatgcttctgccaagtcgcaggagacgaagccggcaaaggctgcaaagaagccgggacgcgtccgttcctacttccaggcagtcaaggctgaaatgcatcgtgtcgtgtggccgtcccgcgaggagctcaagaactacactgtcgccgtcacggtcttcctgatcgtcttcggcttctgcatctggctcgtcgatacgggcgtcgtcgctctgatggtcggcttcacgggcctgagggggtagagatggcaaagcactggtatgtcgtgcatacctactcgggatatgagaacaaggtaaagaccgatctcgagcaccgtgtcgagaccttcggcatgacggacaggattacggatatccagattcctgtcgaggaagtcaccgaggtcaaggaaggcggcaagcgcgagaccaaggaatccaaggtcttcccgggctacgtcctcgtccgcatggagatggacgacaatacctggactgtcgtcaggaacacgccgggcgtaaccggcttcgtcggtcttgatggctccaagccggcacctcttcgccgctccgagtacaacaagatcatgcgccgcacgccgaacgcaccgaccgaaataatccccctcgaagcttttatacgccatcataagatctaaccgacgaggctttctgacccggtgcccctcagggtgccgggtcttttcatgcaagcaccatcagacccagttatatgcacattctgtgcagcggtctgagagttcctatcgctagttgacagaatcgacctagggatggtaacgtagtccaccgcgtcatggtcgaggcgtctcggctatgacaagtattcaggaggatcaatgcgtactttggttacccttgcatgcactgagtgcaagcgtcgcaactacaccacgaagaagacaacgtcgaacaaccctgatcgacttgagatgaagaaaattgcccgtggtgccgcaagcacacgctgcacaaggaaacccgctaaatagggttagtcaaggccagtagctccaatggtagagcggcggtctccaaaaccgtttgttgagggttcgagtccttcctggcctgccagcaattacaccctatcccttacggggtagtcggtttccatgtagtaaggttcttttgatctgaggggttagcgcatggctaagaaggagcgccagaagaggtccgcacgccaggcccgtgcacagaagcgtgcagagcttgaggcggcgcacgccgcatccgtcgcttccgcaggcgatccaaagaaggctgatgcttctgccaagtcgcaggagacaaagccggctaaggctgcaaagaagccgggaccgtccgttcctacttccaggctgtcaaggctgagatgcatcgtgtcgtgtggccgtcccacgaggagctcaagaactacactgtcgccgtcacggtcttcctgatcgttttcgcttctgcatctggctcgtcgatacgggcgtcgtcgctctgatggtcggcttcacgcctgaggggtaaagatggcaaagcactggtatgtcgtgcatacctactcgggatatgagaacaaggtaaagaccgatctcgagccaccgtgtcgagaccttcggcatgacggacaggattacgaatatccagattcctgtcgaggaagtcactgaggtcaaggaaggcggcaagcgcgagaccaaggaatccaaggtcttcccgggctatgtccttgtccgcatggagatggacgacaatgcctggactgtcgtcaggaacacgccgggcgtaaccggcttcgtcggtcttgatggctccaaccccggcacctcttcgccgctccgagtacacacaagatcatgcgccgcacgccgaacgcaccgaccgaggtcgttccgaagcgtgtagcctcgtccttcgaggtcggccattccgtcaaggtcatctccggtcctcttgcagacttcgatggccagatttccgagatcgatgcagaccgagcaaggtcaaggtcatgctcacgatcttcggtcgcgaaaccccgtggagctcacgctcgaccagattgcaagcatctaaggcatcgctgcgcggctccgttcgtgaggaagcttctcgcagctgcgttgtgaaaagcacgtatccgtttctgaatcaggactagcatggcgagaagcaagtcaagtccgcacttcatcaagctcaagttcctgctggcaagcaaacccctgctcctccgtagacccgctctgggtgcagcacaggtcaacatcatgcagttctgccaggcattcaatgctgccacgcaggacaagatgggtgacatcatcccgtcgtagatcgctcgagagctccttcttgaagacctttcgctctgcagagaagtcagaaggagcgatcccgtagaccggatctcgaccgggatgatgtcacccatcttgtctgcgtggcagcattgcaaatgctggcagactgcaatgagttacctgtgctgcacccagagcgggtcctactggcgagcagggttttgccttgccagcaggaatcttggaggcttgatgaagggctgtgacttgctctgtcgccatctaagtctccctgattcagaaacggatacgtggctatttcacaaacgcgctgccgagaagcttcctcaccgaacggagcccgcgcagcgatgccttagatcttggcaatctggtcgcgctgactccaccggggtttcgcgaccgaagatcgtgagcatgaccttgacctgctcgcgtctgcatcgagctcggaatctggccatcgaaggtctgcagaggaccggagatgaccttgcggactggccgtgacctgaatgacgaggctacacgttcggaacgacc

SEQ ID NO: 84 - DNA, 8345 bp, Unknown
  Metagenome-assembled genome
ggccggaagatgctccggtgatgagtgcgatgcgcatggaatcagcctttctgcgggggcaggatggtctctgctgcaagatgatctgggagcggtcggcaagcttcgggaagcccggtccgagccagatggaggactcgccgggacccagcacgagcggcatcctcggtgcaccggaccgacatcgccgttcggcgggcaggtcacgatcgagacttccccacctttcatgacagcagcaagaagaagatgcggtggccttccgacgtgaagcggacggcgacctttccgtcgggtgccggagagcccgctctgtccatgactcatagaaggcgcgtaccggcacaggcagcgccacgcgtgatggggccgacccacatgccgtagccctcctggagctgggaagcgcggtctcgatgcggtgttgaagacgcgtccctggcgcttcggctgcgtgcttgcaaagccccagatgagctcctgggccttggtgcgccgccacgctccttcacgaccgtggcaagcttcgttccgggtagacatccttcggcacgggattgtccttcgggatgcgggcgtgccccgtcgtggcatagaggtcgagcgccatctgcagctcgtccatctgtacgggcacgatcctgtggcacattgctcatccacctcctgcgcttctccttctgttctggactttgtacccactttccaataataggacatgcagcagagaggcaggacgccagaaatgcctgcagagacagaaaaatagccgccggaaggtgtgcccttccgcggccttggcatgttcttgcgggtgcttcctagatgagcttctccaggcagacgagcattatgggggatccattggttgcaggggacgatgctcacttccctgtagccaaggcgggcatagagcctgcgggcggaagcattgcgctcgttcgtgtcgatgcggcaggctgtgcagccgcgcttggctgcctcctcctcataaagccgacgaaggaagccgagcctttgcccttgtagcgcggatcgacgaccagggtgaagtacgagcacctggtcgtccggcgtatccccgtccagtgggcgagggcgtactccggcacctgcgtctggttgatgatccagaggcaacaagtctcgtctcgccttcgacgaagtcctccatcgcatagagtgctccctcatcgagggcacgccgggcagtctcggggaccggatagatgccgcgacccagccaatcgtcgtacgtcctgcctcttcctcatcgtggacgagctcatagacttgattatgccgggatatcctgcgggcctgcttttcggacatgcatggagcggggccttccctagtcgcgcttccagggaacgaggcaggcgtcgaggccggcaacaagggcatccttgtccatgtgcctgccgatgaagcacagcttcgtcatcctgctcgcgcgcactccggatcccagtcgtccatgagctcggggctctcctcgatcatcttctcttcttttcgtcctcaggggcagagtcgacgaagaggccgttctccgtgagggagacctgctggcctgcctgctcgaagatgtacacatgtcaggatcctgcgagcaccagaacatgcccttgcagcggatgatggacccggccaggtctggaggaactcgttaacttgtcgacgtcgaagggctgcctgcgctcgtaacaaggtcgtgacatcgtactcgaggacctcgggttctcatgctcctcggggtgatccattgcatcgatccaggcagcaagttgtaggccggctgaagtcgaagcgtccggtatgaggagctcgtccatcggcacgttgccgtggtcggcgacgacgatctttgcatcgcgctggaggctcctgacgagagccttgagctcggagagctggtcctccgtcacgaggtcgctcttgttcaggatgacggtggtgcagaactcgagctgctggatcagcagcgactcgatatcgtcttcctctcgatatcgtcgcgcagcaggtccttgccgccattgactcgtcgtacatgcgcttgcagtcgacgacagcgacgatgttgtcgagatcgagcggggcttcgccgccgtcttggactggtcgcagaagttcgagatcgtgtaggcgatggggatgggctcgcagatgccggaagcctcgatgatgatgtaatcgaagtccccggacttggcgatgtccgtcaagctggtttgcaaggtcgcctgcgagcgtgcgcagatgcaccatcgtgacgggatcaggagtcggtcttcgagaggccgccgccttgatgagggaggcgtcgacattgacctcgccgatatcgttcacgatgacagcagcgcggatgccctggtcattgttcaggaggtggttcagaagtcgtcttgccggcaccgagatagccggtgagcatgatgatcttgacttgctttgccatggattccttaatcctttctcttcggggcgcagctctgtgcagccatatttcggaggcttgtataccctgcagacgttctctgtttgcgaggcaggtgggcttgtgcgcgcaatctccttgttctcgccccattttaaggatgtgggcggctaccatgatagaagcccgcataactcttcagaaatgcatcggaagaaggcggcctgtgatcaagctcatcctcacggacctcgacgatacgctcatcccggttggcgctccctgcgcttccgcacgtgccaggaaagcgattcatgcactcctcgaccatggcatccacttcgggccggtatcgggacgcattccctctgccatggggtggatgtttgcagacgatgcggcctgctttgcgacaggcgccttctcgaatggccagatcctccatctcgatggacgcgaggtcggcgtgaaggagcttccttttgaggcgctcgtgcacacgcaggagatcctcagcgacggggcaccccgctcttgccatctacgatgtggagggtgatggaagggctacgctctattctggcgcgcccgatctgatcgggcaggacaggacgatcttcacggagtcctcaggcaggtcgagacgaagctcgaccctcatgcccgctacgtcaaggccaatgtccatgtatcggaagctacgaggagaggtgcgcgctcgagccgtctgaagcaggaagtgcctgctctcggcttcgtgctgccaagcctcaagcgccgctcatcgatatctctcctgccgctgggacaagggctcgagcgtgcatgcgctcgcgaagccctgggcgtggggctcgacgagtcgtctgcttcggcgattcggaaaacatctctcgatgatcaaagccgtgccgaatggcgtggctgttgccatgcctcctgaatcagggaggcagcacgctggcatatcggcccctcgaaggatgatgcagtcgcagcagcgctcgaagatatcgcgcgtgctgccgatgcaggcacgctcccttcttcatgcaggaatagactgaggcatgtcgacatttccccagatggatgagtgcctggagcggcgcatcttgaggagctagcgccggaacatgctcagcaccgatggcataacaacggtcttcggaaagccggcaatcagcagggagacctggacctgaggcgcttgccgatgccgcgcgccacagaagcgcctggtcgagcttgcctatgcaacgccgtggacaggggagtgctcctgtgctgcctggatcgaagaacatttgtgcgcctcgatatgggcatgtggacggagatgcgttcgagtctcgccggaagtacctgggctcgacgatcttgcagagctcaaggtgggcatggcagtaggggtggagcatcacccttacggcgctcaggggcttacctatgggcatatcggcctctacatcggagacgcgcagatcttggactgcgccgatgacaggttcagatgcgcaccgcttgccctctggctttccatctatggggccatggacgatccgcgctggggctggctcgaccatcttgcgctcacggggtgaagcctgagctctgaaacatacatatttgacactccccacggctaagctgggggattctcgctgtggagcggcgaagaccagcttcccgccgcagcggaggaaggctatcgcgtcaaagcgagaatccccccagctttagccgtgggagttgtcaatattgtatgtttcagagctcaggcttcacccggtcgagcgcaagatggtcgagccagccccagcgcggatcgtccatggccccatagatggaaagccagagggcaagcggtgcgcatctgaccctgtcatcggcgcagtccaagatcttgccgtctccgatgtagaggccgatatgcccataggtaagcccctgagcgccgtaagggtgatgctccacccctactgccatgcccaccttgagctctgcaagatcgtcgagccccaggtacttccggcagagctcgaacgcatctccgtccacatgcccatatccgaggcgcacaaatgcttcttcgatccaggcagcacaggagcactcccctgtccacggcgttgcataggcaagctcgaccaggcgcttctgtggcgctgcggcatcggcaagcgcctcaggtccaggctctccctgcctgattgccggctttccgaagaccgttgttatgccatcggtgctgagcatgttccggcgcttcagctcctcaaggatgcgccgctccaggcactcatccatctggggaaatgtcgacatgcctcagtctattcctgcatgaaggaaggaagcgtgcctgcatcggcagcacgcgcgatatcttcgagcgctgctgcgactgcatcatccttcgaggggccgatatgccagcgtgctgcctccctgatctcaggagctgcattggcaacagccacgccattcggcacggcttcgatcatcgagagatcgttttccgaatcgccgaagcagacgacctcgtcgagccccacgcccagggcttccgcgagcgcatgcacgctcgagcccttgtcccagccggcaggagagatatcgatgagcggcgccttgaggcttggcagcacgaagccgagctcaggcacttcctgcttcagacggtctctgagcgcgcacctctcctcgtagcttcccgatacatggacattggccttgacgtagcgggcatgagggtcgagcttcgtctcgaccctgcctgaggactccgtgaagatcgtcctgtcctgcccgatcagatcgggcgcgccagaatagagcgtagcccttccatcaccctccacatcgtagatggcaagagcggcgtgccccgtcgcatcgaggatctcctgcgtgtgcacgagcgcctcaaaaggaagctccttcacgccgacctcgcgtccatcgagatggaggatctggccattcgagaaggcgcctgtcgcaaagcaggccgcatcgtctgcaaacatccaccccatggcagagggaatgcgtcccgataccggcccgaagtggatgccatggtcgaggagtgcatgaatcgctttcctggcacgtgcggaagcgcagggagcgccaaccgggatgagcgtatcgtcgaggtccgtgaggatgagcttgatcacaggccgccttcttccgatgcatttctgaagagttatgcgggcttctatcatggtagccgcccacatccttaaaatggggcgagaacaaggagattgcgcgcacagcccacctgcctcgcaaacagagaacgtctgcagggtatacaagcctccgaaatatggctgcacagagctgcgccccgaagagaaaggattcaaggaatccatggcaaagcaagtcaagatcatcatgctcaccggctatctcggtgccggcaagacgacccttctgaaccacatcctgaacaatgaccagggcatccgcgctgctgtcatcgtgaacgatatcggcgaggtcaatgtcgacgcctccctcatcaaggacggcggcctctcgaagaccgactccctgatcccgctcacgaatggctgcatctgctgcacgctcgcaggcgaccttgcaaaccagcttgacggcatcgccaagtccggggacttcgattacatcatcatcgaggcttccggcatctgcgagcccatccccatcgcctacacgatctcgaacttctgcgaccagtccaagacggacggcgaggctccgctcgatctcgacaacatcgtcgctgtcgtcgactgcaagcgcatgtacgacgagttcaatggcggcaaggacctgctgcgcgacgatatcgaggaagacgatatcgagtcgctgctgatccagcagctcgagttctgcaccaccgtcatcctgaacaagagcgacctcgtgacggaggaccagctctccgagctcaaggctctcgtcaggagcctccagcgcgatgcaaagatcgtcgtcgccgaccacggcaacgtgccgatggacgagctcctcgataccggacgcttcgacttcagccgcgcctacaactctgctgcctggatcgatgcaatggatcaccccgaggagcatgagaaccccgaggtcctcgagtacgatgtcacgaccttcgtctacgagcgcaggcagcccttcgacgtcgacaagttcaacgagttcctccagacctggccggagtccatcatccgctgcaagggcatgttctggtgctcgcaggatcctgacatgtgctacatcttcgagcaggcaggccagcaggtctccctcacggagaacggcctcttcgtcgactctgcccctgaggacgaaaagaagaagatgatcgaggagagccccgagctcatggacgactgggatccggagtgcggcgacaggatgacgaagctgtgcttcatcggcaggcacatggacaaggatgccctcgttgccggcctcgacgcctgcctcgttccctggaagcgcgactaaggaaggccccgctccatgcatgtccgaaaagcaggcccgcaggatatcccggccataatcaagtcctatgagctcgtccacgacgaggaagaggcaggacgcacgacgatcggctgggtccgcagcatctatccggtccccgagactgcccggcgtgccctcgatgagggaacgctctatgcgatggaggacttcgtcgaaggcgagacgagacttgttgcctctggcatcatcaaccagacgcaggtgccggagtacgccctcgcccactggacggaggatacgccggacgaccaggtgctcgtactccataccctggtcgtcgatccgcgctacaagggcaaaggctacggctcttccttcgtcggcttctatgaggaggaggcagccaagcgcggctgcacagcctgccgcatcgacacgaacgagcgcaatgcttccgcccgcaggctctatgcccgccttggctacagggaagtgagcatcgtcccctgcaacttcaatggcatcccccatatccagctcgtctgcctggagaagctcatctaggaagcacccgcaagaacatgccaaggccgccggaagggcacaccttccggcggctatttttctgtctctgcaggcatttctggcgtcctgccctctctgctgcatgtccttattattggaagtgggtacaaagtccagaacagaaggagaagcgcaggaggtggatgagcaatgtgccacaggatcgtgcccgtacagatggacgagctgcagatggcgctcgacctctatgccacgacggggcacgcccgcatcccgaaggacaatcccgtgccgaaggatgtctaccccggaacgaagcttgccacggtcgtgaaggagcgtggcggcgcactcaaggcccaggagctcatctggggctttgcaagcacgcagccgaagcgccagggacgcgtcttcaacacccgcatcgagaccgcgctctcccagctccaggagggctacggcatgtgggtcggccccatcacgcgtggccgctgccttgtgccggtacgcgccttctatgagtcatggacagagccgggctctccggcacccgacggaaaggtcgccgtccgcttcacgtcggaaggccaccgcatcttccttcttgctgctgtcatgaaagggccggaagatgctccggtgatgagtgcaatgcgcatggaatcagcctttctgcgggggcaggatggtctctgctgcagatgaatctgggagcggtcggcaagcttcgggaagcccggtccgagccagatggaggactcgccgggacccagcacgagcggcatcctcgagtgcaccggaccgacatcgccgttcggcgggcaggtcacgatcgagacttccccac

SEQ ID NO: 85 - DNA, 25381 bp, Unknown
  Metagenome-assembled genome
gaatcattgcacggcctcaagctcgctggcgtcgattcgaccgcaaggtcctcgcgcagatcgcctacgacgatcccgaggccttcgcaaagctcgctgaggttgccaagaaggccctcgcgtgctgcctaagctgtctcgctaggtgaatgaatatgggcgtccctgcacagatgtgcggggggcgctttttgctgagcacgaaaggggagagcgcagtgccaggcatcatgcctgcatgtgtggggacacgcagcctgttcacccctgcaggatggcctgcatgccagacgctctcagagcgcgtataagctcatgtctgaagactcatggctccttgctcacatgcaatattggaagcgctgaggtcgatttggaggcgctggccagggactgccctgaggagcgatcgagacagcatctataaatatcaggcaaagcgacgctgcattgcataaaagattggagcctcgtcttccatagacgaaggctccttgtgcgtcttgatatgccagtctcagtgcaggtgatggtggctgtgatgctcgagctgtcctcttctgccttgaaggcagggtcgtccggcgtgatgagggtagtctcccgtgtctgggtcctggtggtgcagaagcaccggctcgaagaggtggagatggcggcagaaaagcgctgagatacgaagagcaggaagaagattgcgatgcggggccacagagtcacttgcgtcatgacgtacgagccgatgcagaggacgcttgccaggcataatgagaagcacggcctggcgctggtcgaagccttctgcaatgaggcggtgatggatgtggccgcggtcagcctgtccgatgctcacatggccacgcatgcgccggacgatggcagagagaggtatcgatgatggggatgccggcaatgacaagtgggacgatgatcgtcgtgaggccggcaatgcgcgtgacgttcagaagagagatcgtgcccagggcaaatcttgagcatcgatcccgagtcgccgaggaagattgatgctgggtggtggaagttgtacttaggaatccgaggcaggcgccggcaagggcaatggagagccctgcggcatcgaagcggccgccgcgaaggcgatgatgaacatcgtgaagcttgcgatgacggcaatgcctgaggcaaggccgtcgaggccatcgatcagattgaagatgttcacgtaggcaacgagatagatgacggtgatcgggtaggtccagatgccgagctcgatgaactcgcctgtaaagggctcacgatattgccgataacaagacccgagcaggcagcgaaggttgcggcgagcacctggccgaacagcttctggtggggcttcagggagaaattgtcatcgagaaggcctgtcacgaagatcgtgagcatagccaagcccagaagtggatagctgatggcgcggcttctgggcggcatgatgagaagggccagcccagatagcggtagccgaagatctggaggagcagcgtgacgaaaagacccaagaagactgcaatgccgcccatgcggggaatcggcgtcttgttgatgcggcgcttctccgggtagtcgatagcgccgaccttccaggcaatcttcgaagcgagaggcgtcgtcagaagcgtcgtgacgagtgcgctcagaaagagcaggatgtagggcacccagtgctcgatatgcacgccacacctcctgcttcggatcggctgtgagtgagatagaacctctcaatcataccggaaagagaaggcaaggaaaacagagcactcacgcctgccacaaagcaggcagaagtattagcttgctgcagccaacctcaagtatttcccgtttgcaagccacaagtcaagactgtgcaggcacgagacatttcctatcatgagtggtgccgtccccctgcagcacaaactgggtgaaccgacacgtatttacagggagtccatatctcgtttccagtacaggtatccttcgggttaaggaagctggaacagcgacgaggacacccaccttagcaaggtgggttcataaacgttctgcaggaggcggcatctgttgcatcgtgctgctgtgccttactatgtgcagccagaaattgggcattgacacgacctgctcgaattgcgagaatatctaacgcactgcccagacggggatgtagctcagctgggagagcgctgccttcgcaaggcagaggccgagggttcgaatcccttcatctccaccattcgtctatcggacccggatgcttctgcatccgggtcttcttgcatgaaggagacttaggatttcctctcagaggatgcattcgcttcctgcacgctctgccccaggcactgcggcggcacgcgcagccggcaaggcagggctctgcggcgccacggcagattcaggatcgcacgcgccgcactccatttctgggaggagccgccgatatcgggagaggcggggtgggtgccatcttcttcactggctgcctctgcgctgcatcttctgccagaaccacaacatctcgcaggaaggcttcggccacaagattacggtaaggcgcttggcaaagatcatgctcgagctccaggaccagggggccctgaacatcaatctcgtgacgcctttccactatgcacccatgtgcatgaggcgctcctgcttgcaaaggatgccggcctcacgctcccgattgtcgcgaacacgtcgggctacgagctgccagagctcgtcgatgcccttgcagacgatatcgatatctggcttacggactacaagtacgcatcagcagagcttgctggcaagctctctggggccaaggactacccggctgtggcccatgaagcgctcaggcatatgcatgatgcgctcatggcaaaaggcggaaggattgaggacgcagacggacggatgctccagggcatcatcgtccgacaccttgtactgccgtcgcacgccgatgactcctgccatgtgcttgaccgcgtctggagctctgcggcaacgatgtcgacatctctgtcatgaaccagtacacggcaaacgagcgctgccggaagatgggcggctctcttgcaggcgctgtcacggatgcggagtatgaaaaggtgcttgaccattcggacgagctcggcttcgagcgcctctggtggcagcagggcggcacggtctcggagagctttgtgcctgccttcgatgcaaccgggtggaaggcccggagctctgatggaagagcgccgttgagggaataagcacatcaaggcaatgcagatatctaccaatagattggtgaaggcaatggatgagaacaagggcacggagctcacagatgatgagaggcgcgagctcgaggagctgagggccgagaaggcaaagcgccaggaagctgccaaggcagcacaggagcgcgccgagctcgagcacctgaggtccgagaaggccgtggccgcaaaggagcaggaagagatcaggcacgagcaggcacagcgcgagcgcggacgcaagctcatggagcccgacgacgacctcaagatgccgctcggccagaagatcacgattgtagctgtcgtcggcctcgcgatcatctgtgagctccgtgcccttgttctcatccattgccttcaccaatctatggtagatatctgcattgccttgatgtgcttattccctcaacggcgctcttccatcagagctccgggccttccacgccggttgcatcgaaggcaggcacaaagctctccgagaccgtgccgccctgctgccaccagaggcgctcgaagccgagctcgtccgaatggtcaagcaccttttcatactccgcatccgtgacagcgcctgcaagagagcgcccccatcttccggcagcgctcgtttgccgtgttactgggtcatgacagagatgtcgacatcgttgccgcagagctcccagacgcggtcaagcacatggcaggagtcatcggcgtgcgacggcagtacaagggtgtcggacgatgatgccctggagcatccgtccgtctgcgtcctcaatccttccgctttgccatgagcgcatcatgcatatgcctgagcgcttcatgggccacagccgggtagtccttggccccagagagcttgccagcaagcttgctgatggcgtacttgtagtccgtaagccagatatcgatatcgtctgcaagggcatcgacgagctctggcagctcgtagcccgacgtgttcgcgacaatcagggagcggaggccggcatccttgcaagcaggagcgcctcatgcacatagggtgcatagtggaaaggcgtcacgagattgatgttcagggccccctggtcctggagctcgagcatgatctttgccaagcgccttaccgtaatcttgtggccgaagccttcctgcgagatgttgtggttctggcagaagatgcagcgcagagggcagccagtgaagaagatggcacccgaccccgcctctcccgatatcggcggctcctcccagaaatggagtgcggcgcgtgcgatcctgagatctgccgtggcgccgcagagccctgccttgccggctgcgcgtgcagcgccgcagtgcctggggcagagcgtgcaggaagcgaatgcatcctctgagaggaaatccataagtctccttcatgcaagaagacccggatgcagaagcatccgggtccgatagacgaatggtggagatgaagggattcgaaccctcggcctctgccttgcgaaggcagcgctctcccagctgagctacatccccgtctgggcagtgcgttagatattctcgcaattcgagcaggtcgtgtcaatgcccaatttctggctgcacatagtaaaggcagcagcagcacgatgcaacagatgccgcctcctgcagaacgtttatgaacccaccttgctaaggtgggtgtcctcgtcgcctgttccagcttccttaacaccgaaggatacctgtactgggaacgagatatggactccctgtaaatacgtgtcggttcacccagtttgtgctgcagggggacggcaccactcatgataggaaatgtctcgtgccttgcacagtcttgacttgtggcttgcaaacgggaaatacttgaggttggctgcagcaagctaatacttctgcctgctttgtggcaggcgtgagtgctctgttttccttgccttctctttccggtatgattgagaggttctatctcactcacagccgatccgaagcaggaggtgtggcgtgcatatcgagcactgggtgccctacatcctgctctttctgagcgcactcgtcacgacgcttctgacgacgcctctcgcttcgaagattgcctggaaggtcggcgctatcgactacccggagaagcgccgcatcaacaagacgccgattccccgcatgggcggcattgcagtcttcttgggtcttttcgtcacgctgctcctccagatcttcggctaccgctatctgggctggcccttctcgatcatgccgcccagaagccgcgccatcagctatccacttctgggcttggctatgctcacgatcttcgtgacaggccttctcgatgacaagttctccctgaagccccaccagaagctgttcggccaggtgctcgccgcaaccttcgctgcctgctcgggtcttgttatcggcaatatcgtgagcccctttacaggcgagttcatcgagctcggcatctggacctacccgatcaccgtcatctatctcgttgcctacgtgaacatcttcaatctgatcgatggcctcgacggccttgcctcaggcattgccgtcatcgcaagcttcacgatgttcatcatcgccttcggcggcggccgcttcgatgccgcagggctctccattgcccttgccggcgcctgcctcggattcctgaagtacaacttccacccagcatcaatcttcctcggcgactcgggatcgatgctcataggatttgccctgggcacgatctctcttctgaacgtcacgcgcattgccggcctcacgacgatcatcgtcccacttgtcattgccggcatccccatcatcgataccttctctgccatcgtccggcgcatgcgtggccatgtgagcatcggacaggctgaccgcggccacatccatcaccgcctcattgcagaaggcttcgaccagcgccaggccgtgcttctcatgtatgcctggacaagcgtcctctgcatcggctcgtacgtcatgacgcaagtgactctgtggccccgcatcgcaatcttcttcctgctcttcgtgatctcagcgcttttctgccgccatctccacctcttcgagccggtgcttctgcaccaccaggacccagacacgggagacgataccctcatcacgccggacgaccctgccttcaaggcagaagaggacaagctcgagcatcacagccaccatcacctgcactgagactggcatatcaagacgcacaaggagccttcgtctatggaagacgaggctccaatctttgtatgcaatgcagcgtcgctttgcctgatatttatagatgctgtctcgatcgctcctcagggcagtccctggccagcgcctccagaatcgacctcagcgcttccaatattgcatgtgagcaaggagccatgagtcttcagacatgagcttatacgcgctctgagagcgtctggcatgcaggccatcctgcaggggtgaacaggctgcgtgtccccacacatgcaggcatgatgcctggcactgcgctctcccctttcgtgctcagcaaaaagcgcccccgcacatctgtgcagggacgcccattcattcacctagcgagacagcttaggcagcagcgagggccttcttggcaacctcagcgagctttgcgaaggcctcgggatcgtcgtaggcgatctgcgcgaggaccttgcggtcgagatcgacgccagcgagcttgaggccgtgcatgaagttcgagtagttcagatcgttcatgcgggcagcagcattgatgcgctggatccagagagcgcggatgtcacgcttcttgttgcggcgatcgcggtactggtactggagggagtgggcaacctgctccttcatgccgcggaaggtgcgggaggatgtaccgtagtagcccttggaaagcttcttcagggtctggcgcttcttgcggccagtgactgcgcgcttgacacgtgccatatataatcaactcctattagctggatgcaatgcttacttgcccatgcgggcggaaatgaccttcacgtctgcaggagcgacggtggtctcctggcggaagccacggatgcgcttcggggacttcttggtcaggatgtggctcttgtaagccttggcacgcatgatcttgccggtacccgtacggcggaagcgctttgccgtacccttgtgcgtcttcatcttaggcatactcagttctccttctctgtctcgctatcttctcccgtgtccacgttgtcgaaggcacccttgatgggagaaagcagcatgtgcatgttacggccttccatcttcggctgcgaatcaaccgtagcgaaaggcttgagctcgtccgcaagcttctcgagaaccatgagaccctgctcggggtgcgccatctcgcggccgcggaacatgatcgtgaccttgacacgggcgcccttcttcaggaagcggagcacgtggttcttcttggtctcgtagtcgcccttgtcgatcttcgggcggaacttcatttccttgacttcgatcttggcctggttcttgcgggcctgcttggccttgcgggcctggtcgtacttgtacttgctgtagtccatgaccttgcagacgggaggctctgcgttgggggcaatctccacgaggtccatattctgttcctcggcaatgcgcagggcatcgcggacgccaaacagaccaagctgcgagccatccacaccaatcagacggcaagtacgagcagaaatctccccgttgatgcggggctcatcggacttagctatcgccgacaccttcctctctctggcagttgcctgccatataaaagaaaatctcccggcacgcgaagcagcagccagaagacatgggcccaaaagggtgaactcatattgtctgaccagacagctgctcaaggcgccgcaaggtggggacgcatgcgcatcccgcttcgttaacactaaaagacagtgtacgcctcagaccgcatgcatgcaagtcggagccgctcttcgctatctcttcacagcacatcatagcagaagggccctcagctcgtacgctgctttgtgggaaacgtttatccctgcaaacattcgctgcccagctgcctgccacttgctacactagtcgatgcacattcgcacggaccgaggagctgtacctcatgcaggaattcgaacttagcgtcaatggcctcaaggtcaaggccgcctatgactcggctacgatcgatggagtgctcacacctctcgtgaagcgctggtcgaacctcgcccgtggcctcggcaggcgcatgatcgtcttcatggcaggagcgccaggcaccggcaagtcatgctgcgcgcagacgcttgaagagctttcgctttcggtcgaaggggcactgcccttgacggccataagcctcgacggcttccactaccccaactcctatctgagatcgaatgtggccgacgtcgatggccgcgaagtgcgcctctccgacatcaagggagcacccgagaccttcgatctcaatgccttccgcgcaaagctcatcgagctcaagcgtggcaagcgcgtcctcatgcctgcctacagcaggaagacccacgaggtcgaggagaacgctattgccgtcgacacgaggattgtcctcatcgagggcaattacctgcttctcgacgaacggggctggagaggcctctgcgcctactgcaacgattccgtcttcatcgaggccacgccctccgagctcaaggcacgcctcattgagcgcaaggtcgagggcggcatgaagaaggcagaagccgaggcattctacgcgaagagcgacaggagaaacgtcgagcgcgttctggcgcaccgtgtcccctgtgccgttacgctcgagcagtcaggcatcaaccatctctccaggaagacagcaccttcaaacccagaggaccagctccgctagccgaaaacacatctcagcaagaaagaaggccggaagcgtgagcttccggcctcatccatatcgctggtgcccgaggtgggactcgaacccacacggcattgctgccaacggattttgagtccgtcacgtctaccaattccatcactcgggcatatgtgccttcatcaggctcccaaactataccagatgccaggcatccagaacagcccatttctctgtctctatatgaagagagcccctatccggggctctctggacactcgatggtgtcggaggcgggacttgaacccgcacgaccttttagtcagtcactagcacctcaagctagcgcgtctgccaattccgccactccgacatgcgttgtgcgcaagtggtactttacatacttcccaagccgtacagccgactttttttcgggagttctcggcgctgcacatttggcacagcctagtgcatgccatcagttgcatgctccccgtcctggagccaggggttgtgcgccagccctctgccatcgtcgtctcgggaccatggccgcagaagagcgtaggagcggggatgcagcgtttgagcttggcaagctctccatggctctgcatggctgccgccaggaaggtcggtcctgccgcaggaagatgaagagcgtatctcccacgaaggcaaagccttctcccagaagcaccatgccgcccggcgttggcccggtgcagctatagcctcgaaggaactcatcgagcttccatgtgtcccctcatgcagcagctcgtcggcgtcagggatctgctccccgtatgccatgcctgagccgtccaccttgccggagtgctcctttgcccacgcatagtccgcctcaggcacatgaacctggcaccggtagcctccttcagggcacgcacgcccgacacatggtcgttgtggccatgcgtgcagacgatgagtcgaccgtgacatctttgagctcctggcgatgcgtgcgccctggtctcctgtgatcgaaccaccatgcagtggccgttcgatatcacggcgtagcagttcgtctggaaggggcttaccacgaactgtctgagctctgccatctagagcctcctcttcatctggctcgacccttcgcccggcatgatgcggcgggcatcgaagaccgatggcacacggctcacgtttgcgagaagcggcatgagcaggctcgcgtcggagattgcaatgaggaagcgcaggcgtgccacgccctgggcagacgtctgggtcgcagcggacaggatattgccgccagaatcgttgattgcgatcgtggcatccttgagaagccccatgcggtccgatgcttcgacgacgatctcgacctggaactcggtagcacccgacgtatcccactcgacgtcgatcatgcgctcaggatgctccatgaggcccttcacgttcgggcagttcgcgcggtggaccgagacgccgcgtccacgtgtcacgaagcccacgatatcgtcgcctgcaacagggttgcagcagtgggcaaggtggaccatcaggtccgggtcgcccttcgcgatcacgccgcagctcgagcgcttctttctctcctcgcgggtcggcttcgacggcttgatgagcggccggtcctccatgatggcacggcgcatctcctcttcgcggtctgcctgggcctgtgcctgggcattggcttcaggagagccctcgagcatgacctcttcgaggcggttcgcgacgatcttcggcgtgtacttgccggcaccgatcgatgccatgaggtcgtctacggtgtgaacatcgaactgcggcaggaccttctcgcaggccttctgcacgcgcggcgtggagatgccgtagccgcgcttcctgagctcgtgggcaaggtcgttcctgccggtctccatatcgtcggcacgggtgacggaagcgaagtacttcctgatcttggctctggccgacggcgtcgcgacgatgttcacccagtcgcgtgacggcttggcattgttgttcgtcaggatctcgacgcggtcgcccatcttgaggcgataggtaagcggcacgacggcgccattgaccttggcaccgacgcagtggttgccgacctccgtgtgcacagcgtaggcaaagtcgagaggcgtcgagtcgcgccggaggctcatgacctcgcccttcggcgtgaagacgaagatctcgtcctcgaagaggtcgaccctcaggttgttcaggaactcatgggcatcgtcgatgtcgccctcggtcgtccactcgaggttcttcctgatgtagttgatggcagaatcgatgttcttgtcgtctgcgctcatgaggccctgggagttgccggccttcttgtagagccagtgtgctgcgataccatattctgcctgctcgtgcatctgcacggtgcgaatctggatctcgatcgggcgggcatcgggaccgatgacggtggtatggagagactggtagagatttgccttcggtgttgcgatgtagtccttgaagcgtcctggcagaggatgccagagcgagtgaacggcgcccaggacggagtagcactcgccaaccgtatgcacgatcacgcgaagtgctatgaggtcatagatgtcggagaactcgaggtccttcctgagcatcttctggtagatggaccacagatgcttcgggcgtcccgtgatctggaagttcttgatgccggcgcgcttgagctcgtcgtccaggacctttatggcctcatcggtatcctgctcgcgctgggcacgcgagtcctggaccatgcgggcgatcctctggtattcctcaggctcgaggtagtagaacgcaaggtcttcgagctcccacttgatggagctgatgccgagacgatctgccagcggcgcatagacatccatcgtctcatgcgccttgaagatgcgtcggtcgggcggcagtgccgcgagcgtcctcatgttgtgcaggcggtctgcaagcttgatgatgatgacacggatgtccttcgacatcgccaagaacatcttgcgcaggttcagggcctgcttctcgtccatcgactcgacctcgatcgaggtgagcttcgtgacgccgtccacgagctctgccaccgtctcgccgaagcgctcggagatgtcagagagcgtggcaggcgtgtcttcgaccgtgtcgtgcagaagcgcagcacagatcgaatcctcatccatatggagcttgtcggcgagaatcagcgcaacctcgaccggatggttgatgtagggctcgccagagcgccttttctggtccttgtggaactcggctgcaaagtgataggcctcgtgaatcttcgagaccgcctcttcgtccatgtagcgggagcaggtaacctcgaggaggcgccagttgtctgcattcggaatggccttttctgccatggttcactcctctccgtcgacggtacgtcccatatgcgggatgatgggcctgcagagtgcgcatgagagctcctgtgccgttgccgtgaggatccagtcccggaatcgggcgaaatcctcgcgtgcacgcatgccctcgagatagcggatggactgctcgaggtccatgcgggaaggagcgtctgccatgagtatacgacgctgggatccccagccgctcgtcgagaggaagccgagctcctggaatatctggatgccggcagagacagacccctcatcgatgtgcgctctgtcgtccatggagaggcaggcctcggcgatatcggcattcgccgcgtcgaagctgccatctccgccttctgcctttgcagctctgccaagctgcatgagcgtgcgatagagcacgacgaggtcagagcgtgcaggggcagcagaggcgatgatgcgctcatcgattctggcatccctgctgctgaagagcaggtgcacctgggcaggcttcccatcccttccggcacggccgcacatctggttgaactcaatctccgagaatggcatatggaagaggaccgcatgcctgatatcagggatatcgacaccctcgccgaaggcagaggtcgcaacgatgcaggaaaggtctccctcgcggaaggcacgctcgacgcgtgcacggtcgcggcgcgtgagacctgcgttatagaaggcgatgcgtcccgcctcatccggcacggcgtgcctgagcatcctcacgagcgccaccgactgctcgcgggagttcacgtagcagacgcacttctcccctgctgccacgatatgcacaagcgccgcctcgcggtcgcgcagctcgcgaagatcgtcgagcacaaggttcgtcctgctcgttctgtcgatgaggacattcgatttcggaatctggaaaagccggcagagctctcttgccaccggatcgggtgccgtcgcgctgactgcaaggcagaccggatgccccaaggcttccaagatcttcgggaagtcgctataggcgtctctctttgcaggccctgcctgccctgcatggtgggcttcgtcgacgacgacaaagcctatgcgtccgccctttgcgaagcggcgtgcatggactgcgaggaactcgggcgtcgtgagcacgacgtcgacctcccctgcagcaagcgcagcaaagatgtcctcccgctctccctggcctgtggcaccggtcaggacgcgcacggtcatgccgagagcgccgaaggcttcctcgagatggcatctctggtctgcaacaagggcgcggagcggatagacgaatatcgatgccttgtgctccgcgagcgccatgcgcgcggcgtggacatggaagatgaggctcttgccacgacccgtagccatcacgcagaagcaggatttgcccgcaccgaggagcgcgagcgcctcccgctgtgccggcagaaggtcgtggtcgccgatgaaaagatgcgagagacgctctgcaagcgcctcaggcgcaagccccgagagctcctggcgcagtgcctgcacgcccttggccttcgaagctgctgcctgcacctccttcggctgacgcatgacctggatatcgatggcggcatcctggctccttgtggtgcagacgaccttcagcacctcggcacgataggtcgcgccggcatcgatggcaggcacaagcgctgctgcgatatgatggcgcagatgccccaagactgcgccttccttcgtcacgagggcaagggagcacatctctgccgtgccgtcagagcagacggagagctcctcgccttccgaaagacgcgtggggtcggttccttccggcatcctcacgacacgggtcctgaatttgagcgcctctgctatgcctgcatgttcagggaccgagagcacctccgaggcgtgctcgaagagctcgtcggcaagcgtcggctccgccttcctgctgtcctcgtcaggagtcctgtagatgatgtccttgaccatgagcttcggcttcgtgcgcccctgccaggtctcgttcacagcctcgaagacgaggtccacggcaccgtcgtagcctgacgccttctcgatgtggggcgtccggaacatgatggcaggcacggcgtgcgtgccatcgcttgcgacgaagcgcagatggtcgccgttcgtgccgacacgcgccctgcccctcatcgtgacgccgcagacgccgaagagcggcttcttgttgcccataccgaaaggctggaggatctcaagcgaggagattgtcggacggtcgacctctgcgagggagacgatcgctgcgacctcgcctctgtcctcgaactgctctgcaggcagggcatccatgatggcttccatgcggtcgcggaaagcatcgagattggcggcatcgagcgtgacgccgactgctcctgcatggccgccaaagcggatcaggaggtccgagcactgctcgaccgcatggaagagatcgacagaacccacggagcggccagagcctctggcaacgccgtcagagatcgtgaagaggagggctggcacatggtatttgttcaccatgcgtgaggcgacgatgcccttgacgccctcatgccagccttcgccgccgacgacgatgacgcgaccgccctcgtagagtgcatcaaccattgccatcgcttcgtcggtaagcgctgcctcgatctcgcggcgctccgagttgatggcctcgagctggccggcaagacgggtcgcctcctgcttgtcatccgtgagcaggagctggaaggccacatcggtcgagcccatgcgtcctgcggcattgaggcgaggtatgagcgagaacggcaggctgtctgctgtgaccgtcgagaggtcggtgcccgagcttgcagccagagcgacgatgcccggacggtccgtcttcctcatgcgctcgaggccatcggtcacaagtgccctgttctcgccgcacaggtccatcatgtcggaaatcgtgccgagggtcgcgacctccgtgtagtgccgccagaggtcggggttcccaagcctctcgcccaggacctgcacaagcttcaaagccacaccggctccggcaaggtctctgctcgggcagtcttccgtcattttcggatcggtcaccggcacgccttcaggcacgaggtctcccggctcgtggtggtcggtcacgacgacgtcgatgccctcttccttgagccatgcgacttcgttcttcgctgctatgccgttgtctaccgtgacgatgaggtcgggcgatgccttctcctgcacacgcgcgagcgcctcgcgcgaaaggccatagccctcgccgaagcggtttggtatgaacggagcgaccttgcctccgagcgcccggagaccgagcgtcagaaggcaggtcgcactcatgccgtcgacatcgaaatcgccgaagaccgctatctgctcgccacgctcgagcgctgcctcgaccctgtccgctgcttccttcatgcctggaatcagcagagggtcctgccagtcacgatcgagcgagggcgtgaggaagcgcttcgcttcctccacgtcgcgtatgccgcgggcgcacatcacgcgtgccacaaggggcggcacgtcgagtgcattcgccagcttggaagcggcctcggcatctagaggaaggacatcccagcgtctgcttcccttgaggcctgccataaagatcaggcctcctgtgcgggcgttgccgtatcacggtacttggcggcaatctttgcccacttgggctccttgcccttccagacgcagaggatctgggaagcgaccgcgaagctcgaataggtgccgaggagctcgccaacgaacatggcaaaggcaaagtcgcgcagggtcgaaccgccaatagcaagcatgcagatgaccggcacgaccgacgtgatcgtcgtgttgatggtgcggacgatgacctcattgatcgagtagttcgcgatctcgtcgtaggtatggtgcttgccgtcagagagctgctttgcgttctcgtcgatgcggttgaactcgacgactgtgtcgtagagcgaatagcccatgatcgtcaggagcgctgccacgacattcggcgtgatcggcatctgcgtccaggcatagacaccgatggtgatgagcaggtcatgcacgagggcaatgacagcagagatcgacatcttgaattcgtagcggatcgagacatagacgatgatggcggcaattgcgacgaagaaggcaagaagcgaagagcgagtgacatctgctccccagtcagggccgatcgtcgtgacctgataggaggaatcctcgaggccgagcctgtctgcgacctggttggcatggtcggtggccgtctggggatccgtcgtgccagaacgcacgaggaagcccgtcgcgccgtcggtgacagaggtctggaccgtcgcttcgccctcgcctgcatcggcaagcgcatcgcgcatctgctcgatcgtgatctctcccgtatcgcggaagtcgatctcggtgccgccaatgaactcgatgccgaagacaaggccgcggacaaggatgccgacgatggaaagagcgatgaggacaccggagatgacgaagaagacacggcggtgcttcatgaactggatctcgcccttgaagtggctacgcatgggccacacctcccttcacgccccgctcgctgcgggcgcgttctgcctcttccagatcttcctcgatgccccagaactttgggtgcttctcgatctggtgctgggccagaaggcgaagtgccggtgccttgaagcagaacatcgtcacgatgtcgcaggcaacgccgagcgcaagcgtgaggccgaagcccttgaccgtgccagaggcgaaggcgaagagggcgatagcggagacgagcgtcacgatatcggcgtcaagcgaggtcttgatgccgtgcttcgtgccggagatcgaggcgttcttgacgctcctccccatcctgatctcctcgcggaagcgctcgagcacgagaatcgacgagtcggcagcagatcctgtcgtcaagaccatgccggcaagtcccggaagcgtcaggctgaagaggccattcttcgagaggatggcaagaaggccgagatacaggacagcgaagcaggcaagcgaacccagagtcaggatgcccatgccacggtagaagaagaagagatacacgacgacgatcgcgacaccggtcgcaatggcgaggatgccctgctggagggagtcctggccaagcgtcggtccgacgacgcgggactcggagtatgtgagcgtcacaggaagcgagccggagtccaggaccgtcttcaggctctttgcctcatcgagcgtgaaggagcccgatatggagacattgccatccgtgatggcggattgcactgctggcgcagacttcacgacgccgtcgagcacgatagcgatctggcccttcgtcggggcaagctcggtcgtgacatcgccgaagatccgggcaccttcgctgttgaacgagacattcacgacatactcgcccgtcgaggactgggcgacagaggtcttcgtgatataggagccatccatgaaggcggtgtaggagccatcagcaagctcgacatcctcctggccattcctgatcttcaggagcgcatcggcgtcgccgatatcgtcgaggcggacgaactcgatatgtccggtctggccgatggtctggacggcggcctctgcatccgtcgcacccggaatctggacgaggatggaatttgcgccctgctgctgcacggtcgcctcggaagcgccgagcgagttcacgcggttctggacaatcgatgtagcggtagccatatcatcagagctcggctgagagccatcagacttcgaggccgtcagaatgacggagacgccgcccttgatatcgagaccctgattgatggaggtgccaagcggcgtgaaggcaatcacgcaggcaacgcagaccgctgcgagaacgacgagcgtcgatacccagcggcgggcgtttgcgctcaggcgccgcttcgagcgtgatttcgggcgcttcggtgccgtagccgatgcgccttctgaggcattccagcgcgcgacacccgattcttggggtgcttgccccttcttgttcttagccatgtccctgcaactttctggaacctatggtccctcgtatctgcaacagaaccattatagggacatggccaagattgacaaaatgcggaaaagctgggcaatcagaagtcgcgcactgcttccgatgccatccactcgtcctcgaactgcttgtaggtgcccgcaaagatcgcagcgcgtgcctggcgcatgagctccaggaggaagtagatgttgtgcatggagaggaggatggcgccgaccatctcctgctgcttcacgagatgatggatgtaggcacgcgtgaagccgcctgtgcagacaggacacgtgcacttgtcatcgagcggtccgtggtcgtgcgtatacttcgcgttcttgaggttcatccttccctcatggctgaaggcggtgcccatgcgagccgtgcgggtcggaagcacgcagtcgaacatatcgacaccacagcccacctcatgcacaagcgtcgtcggattgccgacgcccatgaggtagcggggcttgtccttcggcatgtactcggagaccaagggatcgagcgtctcgcacatcgtctcgaagtcctcgcccaccgagtagccgccgatgccgtagccgggaaaatcggcgcattcctcaagatggtgcaaggaccgaaggcgcaggtccatgtgcatgccgccctggacgataccgaagagggcctgatcctcgcgggtatgagccgcaaagcagcgctctgcccaggcgctcgagagctcgaccgcacgctcgacgaaggagcgctctgccggatagggcgggcactggtcgagctgcatcacgatatcagcaccgagctgctctgcgatgtgcatgttgtcctcgggcgtccagtggatataggagccgtcgtagtcgaccgcacggaacgtcacgccctcatcggagagcttcgtgaactcgccgtgggagaagacctggaagccgcccgaatcggtaaggattggacggtgccactgcatgaactcgtgaaggccgcccatctcgtccacaaggtctgctcccggcctgtttgcgagatggtaggtgttcgcgaggatgatcttggcgccaagctcctcgagcgtggagggaaggatgcccttcacggttgccttcgtgccgaccggcatgaagatgggcgtcgggatgtcgccgtgctcggtatggatgaggccggcacgtgcatgggtcagaggatcttctgcctggaccgtgaacgtgaaattcggattgctggccatgttatgcctcctttgcaggtgcgtgcgcctcttcgagcgcagcccctatccagacggcgacgccgtcctcatcgatgcttgggcagatttcgtctgcaagcgccttcacatcgtccgatgcgttgcccatcgcgacgaaatggccgacatgcccgatgagcgggatatcgtttccgccgtcgccgaaagcgacaactgcccctttcgggatgcccagataggcagcaagcgcgtcggcgcccgtgccctttgtgacacccttcttcgtgatctcgatctgggtcttctccatctcggcgacttcccagatgccttcacgctcgaggattcgctctgccgccttcatgttctcgggtaccgggaaggagcagtcgagcttctctatcccatcctctgcactcttgagcttcggaagggctgacaggcagctgtgccatcctttgagacggaatatcggatgcgagacgaagcccttcagaatatcgagggctgacccgctcctgcgctccgtctgtcctgccatataggagatggcacctgcctcggcgtaggtatccataccgagatggacatgccaggcagcatggagcggcctgaacgcctggtagatcctgagcgcgtcatcacgctcgatggacctgcgcacaagcggtgcaagattcccgtcggcgatgcaggctccatttgctgtcacgtaataatccatgcactcagcatcggtggccggcccttcgatgaggccacgcgggcgcccactgcagacagccgtcgcgacaccgtggtcctggagcatcttgattgccgctacaacccgaggagagattccctgatgatgcgcaagaatcgttccatcgaggtcaaaaaggcacagcccgatgccctgagggcaccgggctgttccggtcaatccttgcttgagtgcagagggctgactacttctcgccaaagccgtcgtcaatcagagcaacgagggtgtcgagagcttcctgctcctggtcgccgtcgcaggcaacctcgaccttggtgccagcagcgaggccagcagcaagaatcatcatgatggactttgcgttgacaggagcggagcccttcgtgaggtccttgattgtcacattgcaggggaacttctttgcggcagcaacaaactgggaagcgggacgtgcgtgaagaccagtagcgttgacaatggtcgtctgcttggaaaccatctttttctcctttgacacgacaatggagcgcgcgggctgccccgcaatgcgcatttgccattactttaacaaaacttgtgtacttgtgacacactttctttgcactacgcagaatccagaatgttccagcatattccctccatctcgaagctctgcagctgtccgcgatggcatgaaatgacacccgctttcctatttctgggcagcggcgggcggaaatgcgccaaaatggtaaatgtacatgctgaagcaccaaggagcttggaaaccatgcaggacaacgcagaagagcgcagcgatacgaagaagccccgccatgagaggcgcaaggacaagaagcagcagaaggaccagaagacacagaagaagccgaagggctcctctggcttcacaggcggctttgctgccatgaggcaggtgcacgctgcctcgaaggagcactcgaatgcccgctccgagctcaagaaggcagcgtccgcactcgccgaggacaagaaggtgctcgaccacaggatcgatgtgacgagaagctacgcccagatcgtctccgagcagacgaaggccaggacggatgccgagaaggcgaaggctgcagcagagcgccgcatcgaggtcctgaaggaagagcatgacaagctggccggcgagctcgaagccatgcgctcggagcatgcagaagcgctcaagcctttccagaacgtcatggaatccacccgtgggcgcgctgacgatacggcaaagctcctctccgaagcgaagaaggccgccaaggctgcgcagaccgaggcaaacgatgcacaggcacgccgcgagcagaggatctctgccgcgaacaaggcctacgacaatgcccaggcacgtcttcgcaagctcaacgccgacttcgaggagctcaaaggcaggcctgataccgatgctggcgccatcgcccgcatggagcaggagatctctgccgagaaggcacacctcgagagcacgaaggcagacatccctctggttaccgacgaggcacagaagaatgtcgatgccgcccagcgccatctctggaaccagcggcaggcactcgattccgcgcagaaggcagcagaggaagcaagcactgaagccaagcgtcggaaggccgagtacgacgagcgctaccagagcttccagaccgaggaggcaacgctcgacaacgatgtcgtgcagcgcgagatggggatccgcgatgcctcgaaggaccgcgacacggctcaggcaaatatcgaggccgcccagaagctcctcgatgaggcagaggacatccatgcccaccccgaggtcacgaagaagctcgccgaatccgtggcagagaagcagcatctcgtcgatatccagaagcaggaagtgagctcgcttgcccgctccgaaaagcagctcaggagctccacgagaaagcagcgcatcaccttcatctccctcctcatcgtaatcgctgccgtcatcctcctcattatctggttcctgacgcactgatatgtagatccttctgtcaagaggcatgattgtcccatccccggattccgctccgggagatggggccattctctatatcgtccccggaagccctgcgccttcgtggcgtgtctgattcgaccacgactgcggtctgatatccgcgcgttgggtagcgcattccgatgcttccggctgggagttccgcgtgcctgggatcgcgcgtggcccgaaggctgcgcatagtgcgttcgcggattgccccacgcgccatcgagccaggcgcgggcttccggaaggacccatctgtcaggtcgggcccagggccgcagcggcatcaccccggccatcctggcgagcgcccagacaaccctgcgagctcgcgcgcgatggcggtgtttcacgacgctggcaggcttgccgcgccctctcaatgggcagcacggctgtggagcctgcggttcgcccgcgcggcagcctcggcgacatctgcaggcagccccgccgcatcgtccatggctgccgcagacgtcggcctcaggggccgtatgtgctgccatgccgcctccacgaggagggtcctcgcatggatattgcccgtccgttgatgcgccgccgagaacgctctccccgctcgatgactccgatggcacgagccccacgaagacatgaacgaccgtgcatccgggaagcgggagaagtccccgatctcggctgcgatggagaaggcggtcacggccggtatccccctgacgcacctcagggccgagacgccaggggccatgtcctccccggcagcgcgctcctctatggccctcgggccttgcgcgcctgagcccgggcgacctcacgctctcgagatattccccgaagacgagccgctcgcagggtccgcgaatccgggcctgccgagccattccctgtgggccttcgtccatgcggtctttccgggatacacatccccttcctgagcaggaacttcgagagcagatgcctcgcgcgcatcaggtcgtggcggcagtcctcgcgtgcccgcgccaggtcgcgtgcggcctccatcgcctcggtgggcatggccacctcgacgatgttgccacacggcgagcatgcgcgccaatgaaggtggcgtcgcgcctgtcggtcttcacacctgtcgccagagggcctgagcatctggagacggcgtccgaccacgcatgggacgcctgccttgccgggcttcctctccagccggagcccgtgggccggactcgtagacgcatctgcgggcggggcagtgcctctggcccattcggcgacctgcccgcgtcatacggaagggccttctggaatctatctcccggtctccgtgatgaaggccgtggcggcgatggaacgcgcgtgtacgtcgagcccatgctggtacgatagagcatggctgcggacctccctgcgaaatgtggcaagcgcgtcggacaaccgaagcctaacccactggccccacagaggcccttgtttcttgaatgaggttccagctgcctttctccatatcgtctaggacaaagcagccacaaggcagcacaaaggccggacctgcactgagcagatccggcttcttcttcgtagcttgatatgttgcagatagcctagtcgatgaacatggcatcaccgaagagagcatcctgaagcgtggtcgattgcatcctggtagcatccatgatcttccctcgtcgcgaaggcggagacaagcatcatgagagtcgagcgcggcacatgaagttcgtgatcagggcatcgaccacgtggtaggtcgagcggcatgagatagaggttcgtcgtggcgttcttgcgctccacgatatcgcccttgccccgtgcccttggcagaatcctgtgcatcctcgaagcggcgtgccgttaccaccggaggattggataccggtgcatctgcctcccaggcgctctcgagcgaccggacctcgtcgtgccgacggcaatcacgcgttgccccgctgccttcgttgcatgcacaacggcatccacgacatcctgcgacgtgatagcgctcggtatgcatgacatgcttcgtaggatcgtcctcctcgacgaggcggaaggtgtcgatgccgacctcgagctcccacggtcttccagccgatgccctgcttctcgaggcgctctgatgacgttccggctgtgaagtgaagtcctgctgtcggggctgctgcggagtgctccctcatgcatggcatagacggtctggtatttctcggggtccccctcatactgcgtgattagggggcagggggcacatgtcctgccttgtgcatggcttcgtcgagcgtagcccctctgccggcgtaaagcgcacgagcctgccgccacgcgaatcgtccacgtagtcgacgatctcgcccgtaaggacaaccggagcgtctccggtgcatgggcgccaccaggacgatactcgacgacattgcccggcttcaggcgctttcccgggtttcacgaggcactcccagacatgtcccagaggatccttgcctcgcgggcgcttcaggagcaatgtactcggagacgccgcctgtctggccttcctgccgacgagacgtgccggcatgacaacgggtcttgtttgcgacgaggcaggtctccgcgctcgaggtactcgccgatatcggtgaacgtgcggtctcgtggccaccgttctcgcggtgcaggcagcacgaagacggcagaatccctcgggtctgccggctcctgcgcgatgagctcatcacggatagtcgaaatcgtcagtgccatagagatatcctttttgttcttacgttatgccttgttatgatagcgcgctttgagcttt

SEQ ID NO: 86 - DNA, 16336 bp, Unknown
  Metagenome-assembled genome
ggcatgcatgccatcggctccgatgcacaggggcacgcagagatcgaccaggacaagtgcgttgcctgcggccagtgcccatcatcaactgcccgttcggcgctatcgccgacaagtcccagatcgtccaggtcgccatggccatcctggcaggccaggaggtcatcgcaatcgtcgcccctgccttcgtcggccagttcggcggcaagggcaatgtcggcaagtccgtgaggcattcaagctcactcggcttctccggcgtcgaggaggtcgcactcggtgccgacctgtgctccgtccaggaggcagaggacttcctcgaggaggtgcctgacaagctgccgttcatgggcacgtcgtgcgcccggcctgggagtcgatggcaaagaaggagttcccgagtatgccgactgcaatctcgatggcactgacgccgatgacattgacggcacgcatggtgcgctcccagcatccgaaggcaaggatcgtcttcgtgggaccgtgctccgcaaagaagctcgacggccatgcgccgctccgtgcgcccgagggtcgacttcgtctcacgttcgaggagaggccggcatgatggaagcacgtggcatcgactacctcgcacttgccgatgaaccaagtccgacttcgatgtcgcatccacggatggcaggaacttcgctgtcgcaggcggcgtcgcgaatgctgtcgtgaacgtgatcaagcgtggaccgtcctgatgcgaggtcaagacggccggctggcggcctcgaaggaatgcaggaagatgatgaaggacgccgtcaagggcaagtatcagggatacctgctcgagggcatggcatgcccgggcggctgcgtcgcaggcgccggtaccctcgtcgcgatcaacaagtcggcagcagccgtgcaccgctatgcggcccgctcgccgcacaagaacgcggtcgacaacgagttccgtggcctcatccacgacctcgagtacgcagatgacggcgtgcatccggaagatctgccgacggcaccgaaggccgagtagcacctgatgcttcgaagggcgccctccggaaggaaggcgccctttctcatgagacgatggcatgaaaaagcagggcctgccatctggcgggccctgctgcatgtcttgggtctggagtgtctactccttgtctcccttgatggaggcatagaacgtggcgccgtcgaagacgtccttgatcgtctttccgccgacgaacggaagtgccaggaactcgtccacagtgtcaacgagatcggagcagtcgatgtagtggcccttttcgttgcgctggctggtgtcctgtgcgcgccatgcttcgtagttcacgtcggtcaggtagtagaccttgctatcgatcttcatgtagacggagtgatggctgtggaggtagtcagccagctgatcgtaattgatatcgagtgcctcggatgctctctttcccatggcatgtcctttcgtcgaagggccagacccaacgtgcttgcactcactataccgttccttgaacaaactcatacatccgcttgggccagtgacggaaatagcgccctcaccgattgacactccccatggctaaagccaggggattctcgcttcacagcagatagccttcccccgcatgcgcgggggcgggtcttacgcctgctccacgagcgttcggggcgcttgcgcgcccccggttcccgcaagccctgcggtaccgtttccctccgccagcagcctcgcgccctcggcggcgatgttcttcgccgcgttgaggtctcggtcgtggcgggccccgcactcggggcatgtccagctctcgaccccaagcacgacgttcttgttcacgtagccgcagcacgagcacgtcttgctggacgggtagaacctccccaccttcacgaaggcacgcccgtaccaggcgcacttgtactggagctggcggatcatctctgacatgcttgcgtccgccacggccctggcaaggcggcggttcttctccatgccagccacgttcaggtcctcgacggcgatggcttggctctcgcgcaccgcttccgtcgtggccttgtggatggcgtccttcctctggttcgcaatcttctcatggatgcgggccacccggacccgctgcctggcccgcctcttcgaacccttcttcttcctggagagcctcctctgctcgcgggccaatctcttctctgacttggtgaggctcttggggctggcaaccacctcgccgtccgagcgggccatcaggcagcggatgccggcgtctatgcccatgacctcgacgtcaccctgcggcatatccggttctgggcagtccgtgcagcagacggccacgaaatattcgccggagggtaccttcttgacggttgcggagaggatccgcccccggacgggccgggtgattctcgccctgacgctccccagtttcggaagcttcacatggcgggcgtccacgatcgagatgctgttggtgcggtagctctgtcttgcacctgatttcgacttgaaccgggggaaccctacccttccagggcttctgaagaagttcttgtacgccttgtcgagatcgcgcagggattgctgcagggccatggagtccgcttcggcaagccaaggggcctcgtccttcttccagatgggtatctgcgtgatataggaattgatggatcgggtcttcttgtcccgctcgtattcctctttccgcatctggagcactcggttgtagacccaccggcagcatccgaaggtcctggcaagctgcacgcgttgggcagcgctcgggtagatcctgtattcaaacgtcatgtccatgatgggtcacacgttcttctggctctcgatgtaccgcctgacggccgcaagcggggcgccgcccacggtggagacgaagtagctgttcgtccagagcgagggcagcctcttcctgagccaggggaactcctccctcaggtcgtggctggtcctgcccttgaggcgcttcacggccctgtggatgccgagctgcgggtccacctcaaggagcatgtggacgtggtccggcatgacctccatctctatgatctcgaaggagagctcgtccgcgacctgccgcgctatctgcctgaagcgctcgtccacgccgtccacgagcacggggcggcggtacttcgggcagaagaccacgtggtacctgcagctgtagacgacgttgttgttgctcttgtagtccatggaaggattataccattgatccctatctaatatcgtctgcggcgatgcgccttatatccccatgcctaaagacaggggttttacggcgcttttgataatcgccaaaggcgctacgcgaaatgcaagagaatctgaatggatgcggccagatcaggcagcggccgtgccgtcgagcccttcgccggtgatgaggtgctcgagctgctccggcgtctcggcaagaacaggcgcccccttgtcctcgaggaattcgcggacgcggaagccccaggtcacggcgatgcagtcgcactgggcgtttgcggcggtctcgatatcgacctcggagtcgccgatgtagacgacatccttcttcttcatgccgaggacacgcatgacctcgttcacggtatcgggcgccggcttcttgcggatgccttctgcctcgcgctcgccgacgattgcatcgaactcgccggggaagaagtggtcgatgagtgtctggacggcggcatcagccttgttcgagacgacggcgcagcggatgccgcgcgtgcggagatgcctgaggacagcggctatgccggggtaggggcgggtcttgtccatcgagtgctcgcagtagtagctcttgaaggcgacgaagacctcctcgaaggtgccttcatctgcatccttcggaaggcaggtgcgcacgagattgcggatgccattgccgatggcccagcggacctcgtctgtgctcttgagcggcagctcatagaggccaagcgcatagttcaccgcgtcacagaggtcgtcgagcgtatcgaggagcgtcccatcgagatcgaatatcgctgctgcgtatgccatggactgcctccctggacctgtggcctcgtatggtctcagtccttatccacaagaaaatctacgcacctaggctagcattttccccactcatgcgcaaaaaggcaggcagacggtagtgtctggatgcatgagcgcatcctggtggagcagcttcctgaatgaatctcccagcttatgcatgagaggggagcgccggaggagcatcgggcagccatgcgctctctggaatttcgtggcaggctggtaacgttccgtgaggctcgccgcggccgccctgccttctggagtacaatggccgacgcgtgtgcggggacgctgtctacgcaccccgcgccatctgtcgggagccgtccgttacggcacgggacggcacagatgagaggatatctcatatggaccagcacagcatgcatacccgcacctgcggggagctgcgcaaatcagacatcggccaggaagtcacgcttgcaggatgggtgtggcacagaagggaccatggcggcctcatcttcgtcgacctgcgcgaccgcgagggcatgacgcaggtttcgttcgaccctgagcactccggcggcacggccttccatacggccgagaccatccgtaccgagtggccgatccttgtcacgggcaccgtgcgcgagcgtcctgagggcatggcaaacgagaagctcgcaacgggcgagatcgaggtgctcgtctccacgatcgaggtcctgaacacttcgaagacgaccccgttccagatcgaggaccacgtggatacagccgaggatgtgcgcctgcgctaccgctacctcgacctgcgccgtccgaagatgatgcacaacctgaagctgcgctccgacttcacgttcgcgatccgcgaggcactgcacaagcatgagttcatggaggtcgagacgccggccctcttcaagtccacgccggaaggcgcccgcgacttcctcgtgccgagccgcacgcagccgggccacttctatgccctgccgcagtctccgcagctcctgaagcagctcctcatggtcggcggcgtcgagcgctactgccaggtcgccaagtgcttccgcgacgaggaccttcgtgcagaccgccagcctgagttcacccaggtcgacgtcgagatgagcttcgtcacccaggacgatgtcatgggcgagctcgaagaggtactgaaggatgccttcggcgccatgggcgtcgagatgcagctgccgctgcgccgcatcgagtactgggatgccatggatacctacggcatcgacaagccggatacccgcttcggcatgacgctgcacgacgtgacgccgatcttcggccagtcgaagttcaagctcttcgcctctgctgcccagaccgaaggccagtatgtcaaggccatcaacgccaagggtgccggcaagtggccccgcgccaagatcgaccgcctcgccgatgtggccgcgacgttcggcgccaagggccttgcctacatcgcctttcgcgaggatggctccgtcacgagcccgatcgtgaagttcttctccgacgaggagatggcagcactccgcaaggagatggacgtcgagccgggcgacctcgtgatgttcgctgtggcagaccgtctccatgcagacgagatcctgggcggcatgcgcaaccacatggctgatgccctcgatatcaagcgcgaaggccatgacttcctctgggtcgtgaacttcccgctcttccactgggacgaggacaggaagtgcctcgactccgagcaccagccgttcacgcagccgaatgaggaccagatcgacctgctcgacaccgatcctcttgcaatcggctcgcacacctatgacttcgtcatggatggctacgaggctggcggcggtggcatgcgtatccacaacgcacagctccaggagaagatccttgagaagctcggcttcacgcctgagcgcgcgaaggcccagttcggcttcctgatggaggcactcacctatggtgcgcctcctatgggcggcttcgcactcggcctcgaccgtgtctgcatgctgctcacgggctctgactccatcagggaagtcatggcattcccgaagacgagctccggctccgacctcatgagcgatgctccgtccgaggtctccatggcacagctcaaggaagtctccctgcgcctcatgtaggagcaagacagaagatgtacgcaaagccggctgggacacctgtcctggctggctttttctgtgcaatgtgtcggccttgtcaggagtctgtggggtgcgtcacgaaataattctggaatgttctggtgatagaattttccgtgaacggcgtgaatctctatgtgggaggtagtacatgccccaatttgattcccattgggaagcgcaggcacagaggaacgcttcgaatgagcgtgctgctgccgcttccgccctgtccgaggtccgcattccccaggagctccgccacaacatggagctgttcctgcgtctgacgaggcgtgtcctcaaggagtacgatcccaagctctgcagcagcttcgatcttctgctcgagtacatggtccatgcaaatgacgaagacatctccgagacagacaaggacgaagcctatacgcaggctgtgcgcctcatcgacaagctgacgctcgaggaggagcagtatctgacgcgtgccttcgcgacgtatttccatctcgcgaatatcgctgaggaagactaccgcgtgagctcgctccgtcgccgcgagcgtgtcgtgccgacggactctgccgaagaccccgtgaacgagatcacggtttcctaccaccgcctgatcgaagaggtcggcaaggacaaggcagactccttcctgaaccgtctcgagttccacccggtcttcacggcgcacccgaccgaggcacgccgcaaggctgtgaccgcaaagatccgccgcatcgcagaccttcttgcagagaggccatctctgggcggcacggagcttgcggagaacgagcgccgcatgctccaggagattgactcgctcttccgcacgtctcccatcgctgcgaagaagccgacgccggtcgaagaggctgacaccatcatcgatatcttcgattcgacgctcttcgagatgatcccgaaggtctaccgccgcttcgatgactgggagcttggaagcaaggccggcaccgtgaagccggtctgcccagccttcttccgtctgggctcctggatcgggtctgaccgcgatggcaacccgaatgtcacagcaaaggtctcgcgcaaggtcgcagagaagttccgtgtgcatatgctcacgaagcttgccgacgcgacggaatatgtcggacgctcgctcacgatggaaggcggctcgacgaagccgtctgctgcccttcagaatctctggagccaccagctcgagatgaacgaagagctctgcaaccgcgtgatgctgatctctgtctcggagctccaccgtgctgtcatgcttgtcatggcagagcgcctgcgtgcaacgattgcccgcacggcagacctcatgtatgcagatgcagacgagttcctgggagacctgcgcgtcgtgcaggactcgcttgtcgaggcaggcgctgtccgtgaggcatatggccttctccagacgctcatctggcagaccgagaccttcggcttcaacatggtgcagatggagttccgccagcactcggtcgtgcactcccgcgcccttgccgacctcaaggagcatggccgcacaggccagctgcagccgatgacgcgcgaagtcgtggacacgttccgcgctatcggtgccatccagcgcaagaacggcgtcgaggctgcacgccgctacatcatctcgttcacgaagagcgcccagaacgtggcagatgtctatgagctggcacgcctctccttcgcccatgagaaggatgtcccgacgctcgatgtgattccgctcttcgagcaggtcgaggacctcgagaacgccgtcacgacgctctcccagatcatcgagctccccgacgtgaagaagcgccttgcccagacgaaccgccgtctcgaggtcatgctcggctactccgactcctcgaaggatgctggccccacctcggctaccctcgtgctccacaaggcacagaaggagattgccgactgggctcaggccaacaacatcgaccttgtcctcatgcatggccgtggcggtgctgtcggccgtggcggcggcccggcaaaccacgccgtgctcgcgcagccgagaggctctgtcaactgctgcttcaagctcacggagcagggcgaggtcatctttgcccgctacggcaacccggtgcttgcccgccgccatgtcgagtctgtcgcagcagcaacgctcatgcactcctcgcctgagatcggcaagatcaatacgatctacaccgagaagtaccacgatatggccgcagagctcgagaaggaatcgcgcgagacctacctcaagctcctgaaccaggatggctttgccgagtggttcagctgtgtcacgccgcttgccgagattggtcttctgcctatcggctcacgtcctgccaagcgtggcctcggcgcaaagtccttggacgacctgcgcacgattgaggcatagaaagtggcgccgtcgaagacgtcttgatagtctttccgccgacgaacggaagtgccaggaactcgtccacagtgtcaacggatcggagcagtcgatgtagtggcactttcgttgcgctggctggggtcctgtgcgcgccatgcttcgtagttcacgtcggtcaggtagtagacctgctatcgatcttcatgtagacggagtgatggctgtggagggtagtcagccagctgacgtaattgatatcgagtgcctcggatgctcttttcccatgggcatgtcctttcgtcgaagggccagacccaacgtgcttgcactcaactataccgttccttgaactaaatcatacatccgcttgggccagtgacggaaatagcgccctcaaccgattgacactcccatggctaaagcacgaggattctcgcttcacagcagatagccttcccccgcatgcgcgggggcgggtcttacgcctgctcacgagcgttcggggcgcttgcgcgcacccggttcccgcaagccctgctggtaccgtttccctccgccagcagcctcgcgcctcggcggcgattgtcttcgccgcgttgaggtctcggtcgtggcgggccccgcactcggggcatgtcagctctcgaccccaagcacgacgttcttgttcacgtagccgcagcacgagcacgtcttgctggacgggtagaacctccccacttcacgaaggcacgcccgtaccaggcgcacttgtactggagctggcggatcatctctgacatgcttgcgtccgccacggccctggcaaggcggcggttcttctccatgccagccacgttcaggtcctcgacggcgatggcttggctctcgcgcaccgcttccgtcgtggccttgtggatggcgtccttcctggtcgcaatttctcatggatgcgggccacccggacccgctgcctggcccgcctcttcgaacccttcttcttcctggagagcctcctctgctcgcgggccaatctcttctctgacttggtgaggctcttggggctggcaaccacctcgccgtccgagcgggccatcaggcagcggatgccggcgttatgcccatgacctcgacgttcaccctgcggcatatccggttctgggcagtcgtggcagcagacggccacgaaatattcgccggagggtacctctgacggttgcggagaggatccgcccccggacgggccgggtgattctgccctgacgctccccagttcggaagcttcacatggcgggcggtccacgatcgagatgctgtggtgcggtagctctgttctgcacctgatttcgacttgaacggggaaccctacccttccagggcttctgaagaagttcttgtacgcttgtcgagatcgcgcagggattgctgcagggccatggagtccgttcggcaagccaagggctcgtcttttccagagggtattgcgtgatataggaattgatggatcgggtcttcttgtcccgtctattcttttccgcatctggagcactcggttgtagacccaccggcagcatccgaaggtcctggcaagctgcacgcgttgggcagcgcgctcggtagatcctgtattcaaacgtcatgtccatgatgggtcacacgttcttctggctctcgatgtaccgcctgacggccgcaagcggggcgccgcccacggtggagacgaagtagctgttcgtccagagcgagggcagcctttcctgagccaggggaactcctccctcaggcgtggctggtcctgcccttgaggcgcttcacggccctgtggatgccgagctgcgggtccacctcaaggagatgtggacgtggtccggcatgacctcatctctatgatctcgaaggagagctcgtccgcgacctgccgcgctatctgcctgaagcgctcgtccacgccgtccacgagcacggggcggcggtacttcgggcagaagaccacgtggtacctgcagctgtagacgacgttgttgttgctcttgtagtccatggaaggattataccatgatccctatctaatatcgtctgcggcgatgcgccttatatccccatgcctaaagacagggttttacggcgcttttgataatcgccaaaggcgctacgcgaaatgcaagagaatctgaatggatgcggccagatcaggcagcggccgtgccgtgagcccctcgccggtgatgaggtgctcgagctgccggcgtctcggcaaagaacaggcgccccttgtcctcgaggaattcgcggacgcggaagccccaggtcacggcgatgcagtcgcactgggcgtttgcggcggtctcgatatcgactcggagtcgccgatgtagacgacatccttcttcttcagccgaggacacgcatgacctcgttcacggtatcgggcgccggcttcttgcggatgccttctgcctcgcgctcgccgacgattgcatcgaaatcgccggggaagaagtggtcgatgagtgtctggacggcggcatcagccttgttcgagacgacggcgcagcggatgccgcgcgtgcggagatgcctgaggacagcggctatgccggggtaggggggggtcttgtccatcgagtgctcgcagtagctcttgaaggcgacgaagacctcctcgaaggtgccttcatctgcatccttcggaaggcaggtgcgcacgagattgcggatgccattgccgatggcccagcggacctcgtctgtgccttgagcggcagctcatagaggccaagcgcatagttcaccgcgtcacagaggtcgtcgagcgtatcgagggcgtcccatcgagatcgaattcgctgctgcgtatgccatggactgcctccctggaccgtggcctcgtatggtctcagtccttatccacaagaaaatctacgcacctaggctagcattttcccactcatgcgcaaaaaggcaggcagacggtagtgtctggacgcatgagcgcatctggtggagcagcttcctgaatgaatctcccagcttatgcatgagggggagcgccggaggagcatcgggcagccatgcgctctctggagtttcgtggcaggctggaacgttccgtgaggctgtgcggccgccctgccttctggagtacaatggccgacgcgtgtgcggggacgctgtctacgcaccccgcgccatctgtcgggagccgtccgttacggcacgggacggcacagatgagaggatatctcatatggaccagcacagcatgctacccgcacctggggagctgcgcaaatcagacatcggccaggaagtcacgcttgcaggatgggtgtggcacagaagggacacatggcggcctcatcttcgtcgacctgcgcgaccgcgagggcatgacgcaggtttcgttcgaccctgagcactccggcggcacggccttcatacggccgagaccatccgtaacgagtggccgatccttgtcacgggcaccgtgcgcgagcgtcctgagggcatggcaaacgagaagctcgaacggggagatcgaggtgctcgtctccacgatcgaggtcctgaacacttcgaagacgaccccgttccagatcgaggaccacgtggatacagccgaggatgtgcgcctgcgctaccgctacctcgacctgcgccgtccgaagatgatgcacaacctgaagctgcgctccgacttcacgttcgcgatccgcgaggcactgcacaagcatgagtcatggaggtcgagacgggccctcttcaagtccacgccggaaggcgcccgcgacttctgtgccgagccgcacgcagccgggccacttctatgccctgccgcagtctccgcagctcctgaagcagctcctcatggtcggcggcgtcgagcgctactgccaggtcgccaagtgcttccgcgacgaggaccttcgtgcagaccgccagcctgagttcacccaggtcgacgtcgagatgagcttcgtcaccaggacgatgtcatgggcgagctcgaagaggtactgaaggatgccttcggcgcatgggcgtcgagatgcagctgccgctgcgccgcatcgagtactgggatgccatggatacctacggcatcgacaagccggatacccgcttcggcatgacgctgcacgacgtgacgccgatcttcggccagtcgaagttcaagctcttcgcctctgctgcccagaccgaaggccagtatgtcaaggccatcaacgccaagggtgccggcaagtggccccgcgccaagatcgaccgcctcgccgatgtggccgcgacgttcggcgccaagggcctgcctacatcgcctttcgcgaggatggctccgtcacgagcccgatcgtgaagttttctccgagggagatggcagcactccgcaaggagatggacgtcgagccgggcgacctcgtgatgttcgctgtggcagaccgtctccatgcagacgagatcctgggcggcatgcgcaaccacatggctgatgcctcgatatcaagcgcgaaggccatgacttcctctgggtcgtgaacttcccgcttccactgggacgaggacaggaagtgcctacctccgagcaccagccgttcacgcagccgaatgaggaccagatcgacctgctcgacaccgatcctcttgcaatcggctcgcacacctatgacttcgtcatggatgggtacgaggctggcggcggtggcatgcgtatccacaacgcacagctccaggagaagatccttgagaagctcggcttcacgcctgagcgcgcgaaggcccagttcggcttcctgatggaggcactcacctatggtgcgcctcctatgggcggcttcgcactcggcctcgaccgtgtctgcatgctgctcacgggctctgactccatcagggaagtcatggcattcccgaagacgagctccggctccgacctcatgagcgatgctcgtccgaggtcccatggcacagctcaaggaagtctccctgcgcctcatgtaggagcaagacagaagatgtacgcaaagccggctgggacacctgtcctggctggctttttctgtgcaatgtgtcggccttgtcaggagtctgtggggggcgtcacgaaataatttggaagttctggtgattgaattttccgtgaacggcgtgaatctctatgtgggaggtagtacatgccccaatttgattcccattgggaagcgcaggcacagaggaacgcttcgaatgagcgtgctgctgccgcttccgccctgtccgaggtccgcattccccaggagctccgccacaacatggagctgttcctgcgtctgacgaggggtgtcctcaaggagtacgatcccaagctctgcagcagcttcgatcttctctcgagtacatggtccatgcaaatgacgaagacatccgagacagacaaggacgaagcctatacgcaggctgtgcgcctcatcgacaagctgacgctcgaggaggagcagtatctgacgcgtgccttcgcgacgtatttccatctcgcgaatatcgctgaggaagactaccgcgtgagctcgctccgtcgccgcgagcgtgtcgtgccgacggactcgccgaagaccccgtgaacgagatcacggtttcctaccaccgcctgatcgaagaggtcggcaaggacaaggcagactccttcctgaacgtctcgagttccacccggtcttcacggcgcacccgaccgaggcacgccgcaaggctgtgaccgcaaagatcgccgcatcgcagaccttcttgcagagaggccatctctgggcggcacggagcttgcggagaacgagcgccgcatgctccaggagattgacgctcttccgcacgtctcccatcgctgcgaagaagccgacgccggtcgaagaggctgacaccatcatcgatatcttcgattcgacgctcttcgagatgatcccgaaggtctaccgccgcttcgatgactgggagctggaagcaaggccggcaccgtgaagccggtctgcccagccttcttcgtctgggctcctggatcgggtctgacgcgatggcaacccgaatgtcacagcaaaggtctcgcgcaaggtcgcagagaagtccgtgtgcatatgctcacgaagcttgccacgcgacggaatatgtggatcgctcacgatggaaggcggctcgacgaagccgtctgctgcccttcagaatctctgagccaccagctcgagatgaacgaagagctctgcaaccgcgtgatgctgatctctgtctcggagccaccgtgctgtcatgcttgtctggcagaggcctgcgtgcaacgattgcccgcacggcagacctcatgtatgcagatgcagacgagttcctgggagaactgcgcgtcgtgcaggactcgcttgtcgaggggcgctgtcgtgaggcatatggccttctccagacgctcatctggcagaccgagaccttcggcttcaacatggtgcagatggagttccgccagcactccggtgtgcactcccgcccttgccgacctcaaggagcatggccgcacaggccagctgcagccgatgacgcgcgaagtcgtggacacgttccgcgctatcggtgccatccagcgcaaaaaacgcggtcgaggctgcacgccgctacatcatctcgttcagaaaagcgcccagaacgtggcagatgtctatgagctggcacgcctctccttcgccatgagaaggatgtcccgacgctcgatgtgattccgctcttcgagcaggtcgaggacctcgagaacgccgtcacgacgctctcccagatcatcgagctccccgacgtgaagaaggccttgcccagacgaaccgccgtctcgaggtcatgctcggctactccgactcctcgaaggatgctggccccacctcggctaccctcgtgctccacaaggcacagaaggagattgccgactgggctcaggccaacaacatcgaccttcctcatgcatggccgtggcggtgctgtcggccgtggcggcggcccggcaaaccacgccgtgctcgcgagccgagaggctctgtcaactgtgcttcaagctcacggagcagggcgaggtcatctttgcccgctacggcaacccggtgcttgccgccgccatgtcgagtctcgcagcagcaacgctcatgcactcctcgcctgagatcggcaagatcaatacgatctacaacgagaagtaccacgatatggccgcagagcgagaaggaatcgcgcgagactacctcaagctcctgaaccaggatggctttgcgagtggttcagctgtgtcacgccgcttgccgagattggtcttctgcctatcggctcacgtctgccaagcgtggcctcggcgcaaagtccttggacgacctgcgcacgatccccggatcttcagctggagccaggcacgcatcaacctcgctgcctggtacggcctgggaagcgcctgcgaggccttcggggactcgatgcttccgccatgcctatgcggagtggccgctcttccagaccttcatcgacaacatcgagatgttcttgcgaagaccgcgagcgcattgcctggatgtacatgggcctcggcaaaaggcccgagctctcgagatggtcatggaaggtctggaagagcggccactccgcataggcatgggagagatcgaggtccccgaaggcctcgcaggcgcttcccaggccgtacagcgcagcgaggttgatgcgtgcctggctccagctgaaatccagggg

SEQ ID NO: 87 - DNA, 9718 bp, Unknown
  Metagenome-assembled genome
cgaaagtacatgcagcaagtcgcatggctagacgatacatggcttttccttcctgttgcatctgcatatgatatggggcgaaagtttgacccttcgccccatatcgaagccaaacgcctagaaaagctcaagcacgtctagcagatgcgataccagtaggagtcctgcttgttttcccaaggaaaatcggtcgggcacgcaacctacgaatacgagacctttccagcagcggtgtcgatgctggagttgtagacgccatcaagctcgcaagagcttccatgagccttggagccgtgatcgtagtcagagtggatatagaaaagccagttgccgtacgtccaagtaccgccctctgcagggtacctgaccgtctttggcgacgtgatgcgttgcgggccattggttggagccgccccggcggccattgctaccgtgggagataccatcgccaccgcaaggagtgctgagcataccccataaaagaaccgcttgaacatttcagctccaatctccgatcctgaccttacacttccagtagacaaggtattcttatctacttaaatcaatattaactgataatctacgtcatactttcatatatagcataaataggaaagagcgcggtgaacggtcgcacttgggccatagacgatccccgtctttagcttttagcaccacgattcttcaggacccgggacatggcccggaaccgcaaaagccagccctgagctggcttttttcatgcctgtatgcttgatccggaaatcgctccctgatagaatatatacatggtgctatggtgctttcccgtctttagcgtttagcaccacgattcttcaggacccagaacatggttcggaacccggaaagccagccctgagctggcttttttatactccgatgcttgatctgtggggaatttcctgacgtcatctatatacggtgctatggtgctttcgtctgacagggagtggcagatggcctacttcctcaagaggacgcgcaacaaagaaagggctctatctccagatatacgagagccactgggaccccaagcgaaggtataccgcgaacaggtcggtgaaggccctgggctacgaggacgagctgaaggagaagggcatagaggatcccgtctcgcatttcagggcagaggtggcccgcatgaatgccgagcgcaaggccggcatggagagggagagggtgcgggagatctccgatgtccccgccgcaaggcacctcggccacttcgccctgaaggcagaggacacggcgcttgtagctgcaggcgacatggccctgctccagaccccctcaggcttgcgcttctcgctgcatggcctgctcttctcgctcgtctatgcgagggccatggccccctgctcgaagctcaggaccttcaagggcgtgctgccccagatggagggcatggacgcatccttcaccctggaccagctctgagacgggctcgcctatctgggcgacgagtacgacaaggtcgtcgagatctacaatacccatgtggaggatgccttcggccacgacatgtccttggcctacttcgactgcacaaacttctacttcgagatagaccacaaggactccttctgaaggaaggggccctccaaggagcacaggccggagccgacagtcgcgatggggcttcttctcgatgcggactgcatcccggtggcgatgagcctgtttcccggcaacgagagcgagaagccgcagctggggagatgcatcgcccagatgaaggagaggggctccatatccggcaggaccgtgagggtcgccgacaaggggctgaactgcgcagccaacatcgcggaggcggtgcttgcaggggacggctacatattctcgaagtcggtgaaggcgctccctgccaaggagcgcacgtgggcgctctcgggagatggctggacggacgtcgccgacgggaagggcgagacatcgtttcgctacaagatggcggacggcgacttcgagtacacggtagagggagaggacggaaggaagaggaaggtcgagctcctagagaggcgcgtcgtcacgtacagcccctcgcttgccaggaagcagaaatacgagatagaccggcaggtggagaaggcgaggtcgcttaaggcggcagccgcgaaaaggtccgagtacggcgacagcgcgaagtatgtcacgttctcccccgtcgacggcgagggcgagctcaggaaggacgcgaaggtcgcggccatgctcaaccacgaggcgatcaggaaggccagggcccttgccggctacaacatgatcgtgacctcgaagaccaggatggacccccgcgccatatacagcacctaccacaggctctggaggatcgaggagagcttcagggtgatgaagtccgagctcgatgcgaggcctgtctaccttcagaggcagagcacgatcacgggccactttctcgtgtgctacatcgccgtgctgctcatgaggctcctgcagatgaaggtgctgggagatagcttctcctccaaggacatcatggggctctgccgcggcctcgatgtgtgccgcacctccgacaggaggtatgccaacatatccaggagaagccccatcatcgaggagctggcgtcaaggacagggctgccgctgcttcacttcaacctcaccgagggcgacgtgaaggcgatctcctcctgcacgctctccatgctccgcggcgaagggaaaggcccctctgccggcaggaagcgcggctgaggggcctcatagcaccatatcggggatcgaaaaaccaaagtccggtactatgcacaaggccgctaccggcgtctacgccgatatgcgccttgtatccgaaatgccagttcttccctttcttggactggtgcgctttaagggtcgcgcgtacggtctttgttcttcgttaagctttagagcccaggtgaaggtcgcatccaccatggagccaccccgccccgtggtccctgccttttcaagcttctaagtccaggcgcaaagcacaagccttgccgaactcctctcgctttaaggctatggcgcatcttcgcgctcgtcgttgcatctggcacctgcgcttgcatgaggtctacgtgcacagaagcgctaccaggagcggcaatccaggatagcatctttaagttccctcgtcttaagagagcaaacataacctaaagcaggatacatcctaaagctttgtctttgcagcacgcacatgcctgacaagagcctgtcagtggtagctggtatctaccagaacaatccagctatcccacacaacgattgcacccatccgctccaggtgtgcctctcgtctggtctttctccttttaccttagaatttaaggtcctaaaagctcatctggctgcctatatcttccttttggatatgctggaatgcgttgctgtaattataacatatccgcaggcagataggcatctatgtggatatggtcactgcgtggttcgagacattttgagccgatggtatacagcgtgtggccccagctacctcatcgaggcgaattaatcatcgtttccctagggggcttaaggacgaatgggaggtcacgggcgtctggtttaagaagcgcgagggagcgcaagataagctccatgtgagggtcgcgcacaggaggggcaggcgctcgagtgccccgtctgccacaggaagtgcggcacctgtgacacgcgcgagaggaccttgtggcatcttagcatctggcaatacgagacgatcgtgcactgcgcgctgcccagggccgactgccccaaagacggcgtgcatgccacaaggatgccctgaaaggtccgcccgaagacgcacttcacggcgctctttaaggcgcaggcgataagtgatggcgctctttggcatgaccgtctccgcgatagcgcatctggtgcacgagacagcccacgcgcatatggtgcctgctgggcaaggccgtcgacgaggcgagggatgccgccgactactcggatgtcgtgcgcgtgagcatagacgacaccgccaaaaggcgcggccagagctacatcagcatcatggcagaccttgaccaccagcgtgccatagccgtcacgcagggcagggacaagggggccttaggcaggctctgagacgagcttaaggagcacgcaggggacaggtcaaaggtccaggaggtcacgcgcgacatggccgaggcatactcgcttggcgtggcggcgcagatgccccaggccacacagagcgtggacaggttccatgtggtgcagcttctgatgagggcgacagaccctgtgaggtgcgcagagaggcgcgagtcagcggagaagcacaaggcagctcgcccagacgaagtacgtatggctcaagaggagggagagcctcacaaagcgccagctcgccaagagggaggagctcgatcctgcgaagacccatctcagggaggcacgcgcctgccagatggcagaggcgctgcaggacgtgtactcatgcgcagacagaaaatcggcggcagcagccccagagcgcctctgctcgtggatgatgcactctgccgtggccgagatgaagagcgtggcgaggaccttcaggaaggagcgggaggggatcctgaactggtggaagaggggctcgaccaactcgttcctggaagggctcaactccgtcgtccagtcagtccgcagcatcgtcaggggcttcaagagcatcgcctacttcaagacgatgatcttgctcaggctaggccgtttggacttcacagcccagaagaagctggcatgcgctacccactagaaacagcgaagagccccgaatctcccctcctacaatgcagccaagggcggcgtcaaccttatgacccagtctgccgcgctcgcgcttgccaagtacaatatccgcgtcaacaccgtgaatcccggctacatcgagaccggcatggtgaacgaggacgtaatgggcaaggaggccatcgaccacctcgtctcgctccatccgctgggacgcctcggacgtccggaagagattgcacatggtatcgtcttcctcgtcgagaacgaattcacgaccggcatccacctctacatcgatggcggctatacagcacagtagaaagcgcgacatccatcctttcgggcgggcagcagaaatgctgtccacccttttctgtaagctgcctgtcatcctccgacactctcgccgaaaagtgtctgactctgagcaatgaaccgctgcttctcaggaagaatccctctatacgcaaccaaagaagggatggcatatgcttctgcccaagacctacctcgtccgcatgaaggaacaggaacgctaccgctggtggaagccgatcgtctgcttccttctggctggcctcctcttcgtggtgttcatggcaatagcgatgttcgcgctcgggacctcgggcgtgctctcccccttcgaggtgctcatccaggatgcggacagcatcaccacagacgagctcatggaagaggccatgaacctcatgacaggaagcggtctgggcatcgcccctctcttgggctccatcatcctgcttctgcctgctctctggattgcaatgaaggcgacacgcctcggcggcctcaggaccctgagctcagtggaggggcatctccgctggaagaggatcggacggctgatcctgcccgtgctcctcgtctttgcgctaggcaatgctgcagagcttgcgatagcctcggtcctctcaagcgagattcccgccttctcgcttcccagcctctcctacctcctcacgatcttgatcctcgtgccggtgcagtcggcaacggaggaatatgccttccgcggctttctcatgcagaccttcggcagctggatccccatagccgtgataccgcttgtgctccagaccgtcatattcatggggtcgcacacctacaacatctggggacttctctccatcctggtcttcggcctcatcgcaggagtactggccctcaagacaggaggcctcgaagcctccatcgtcttccatgccacgaacaacatctgtgccttcctcatctcggcagcggtcggtgccaatgcgatggtagctgaggcaaccatcctcgatatggcgatttcgatcgcccttgacctcgccgtcttcctggttatcctccatgtcgcaaagaagcagggctggctcgtcgatgggacagaagaagagcatgtgccttcagcaccgcgacacatgaagagctagaaactgcatatatcttattattcatgggtaatatatgcttgtaataagcttatcaagcttaagataggatggccatgaaagaagattatgaatttgaatgggatagtgagaaggcaaagacgaattcccacaaacatggcatcagtttcccagaagctgaaactatctgggatgatccacaagctcttgaagtccaccttgtctccgatcccgaagaccgatgggccattatcggacgaaccgcgaaagactgttatctgaccgctatcttcacatggcgcgatagcagaatccgaatcatttcagcgcgcaaatcgaccaaaaaggagatagatagctatgaaaagtatcagtaacgatgaacttgaacagcgcttcgacgctggtgaagacataactccatacatggatttctcaactgcaaggcaccccaataaagaacgtgcagcacgccgcatcagcatggatataccagaagatatggtacgcggccttgatcatgcagctgctcgcatgggcgtaaacagacaggcggtaatcaaggtatggctctccgagcgtcttgatgaagaagcggaccgcgaagacagacgctacaggaacgcaccagcataatagctgcagcaatacgatattgctctctcttgattgtgttcgacctcgccgtcttcttcgttatcctccgtatcacgaagaagcagggctagctcgtcggtggaacagaagaagagcatgcgccttcttcaccgcagcacatgaagcacgaatagcctgtcccggcacagagacaaagaggaggcctcccgcatctgaactacctcccatttcctatgtccaggaaatgggaggcagttcacaaaggcagaagcacccttccttatcgtgaagcggcgcttctgccccttaaggaagcgctactaggggatagagaagatgcctgcacactcaagtctttctcgcccttgcaaaccttatccatgtgcatcttttgccggcaggctgcacctcccggctcccagagtcgctcgatccgtcttggagccttattgcggtgcatggggcagaacggatgtaaggatagcggctcctgtacatgctggatgagcatccttccctgcctttcccgcataccggcctagaaaagccgtgtggtcggtcccctctgacacgttatggggcattaatcatcgtttccctagctctttaaaagcacaggcatgctttctgcttctctgaagcagaaagcatgctgcctcatatgccaacgccaagatctccgcatggaaaggatggcacttttcatctgccattcgcgggtgtacctatctcagtgtcggagcaggagaaactggacctaatccgttctgcagcacagcacaggattaggcgtttgggcacaggtacagcattgtgctatggttaaccaagttttgaaccagcatccaaaggagatggatagcatggcagaggctggaagaagtcctgaggaactcaagggcgtcacccttctgggcaacaaaggcgtgaagtatccccatgactatgaccccacgcttctcgagaccttcgtgaacaagcaccagaaccgtgactacatggtcacgttcaagtgccctgagttcacgacgctctgccccaagacaggacagcctgacttcggctgcatctacatcaactacatccctgatgtgcgcatggtcgagtccaagtcgctcaagctctatctcttcagcttccgcgagcacggagacttccatgaggacgtcgtgaacgtaatcctggaagacctggcgcatctcatggagcccaagtacatcgaggtcttcggcaggttcaatccgcgtggcggcatctcgatctatccgtttgccaactgggcaaagcccgatgcaggctatgaggacatggtcacgcgcagacagttcgagcagctctcgatgcacgagcaggactaggaagggcgcgacatccatgaaggcaatcgtcctcaacagcggcggcgtggattccaccacctgtgtcggcatagcggtagaccgctatggtgcaaagaacgtcacgaccgtctctgcctactatggccagaagaacgacaaggagctctcctgtgcagagaagatcgccaagcactacggcgtcgcacaccgcgtgatcgattttgcctccacccacatcatggacggctccgtgtgcaccctgctccagggcggcaacgatatagctcacggcacctacgccgagcagatggcagaaggagacggcaaggtagcaacctacgtccccttcaggaatgggcttctccttgcagcagtagctgctgttgcccagtctgtctatccgcatgaggagtgcgagctctatatcggagcccatgcagatgatgcagcaggagatgcctatcctgactgttcgcccgagttcataaaggcaatgagcaaggctatagagcttggcacctacgggcttgtccatcttgtagctcccttcgtgaacctcgacaaggcaggcgttgttgcttggggactcaagctccatgtgccctatgagcttacctggagctgctatgagggcggagacgtacagtgcggcgtctctgtggcacctgcctcgatcgcaagaaggcatttgcagccaacggcgtgaaggaccccgtgccctaccgccagtaagggaatgtggctgtactaggaaaccagcctcaacaaaactaggagacatgcgtgaacataaagaagtaccatctgctgcagatactcacgtccctttcggtagcgacgctcatagcgtcaaatatcatcacgaacaagcagacagatctcttcggctttgccgtcacctgtggcaccttcaccattcctgtcgactacatcgtctcagatgtcttagccgaggtctttggctttgcagaagccaggcgtgttaccattacggccttcctctgcgaccttctgtgtgtcgtcctcttccagctgacgcttgtagcaccatccttctccaccttcacagcacaatctgccttcgaatccgtgctcggctctaccccacgcatcctggctgcaagctttacagcctatgtggtcggcagcctctccaatgccaagatcatggagctcatgcatgtgcatgacggagagaagagactggcatggcgatgcattgcatcgaccattgtgggagagacgctcgatatgacggtgttcacgctccttgccttcacaggcgtccttccctggcctgtcatcggccagatgatcgttgtcgccagcgccatcaaggtagctgtcgagtgcatctgctatccccttgtgacctcccatgtcattgcctgggcaaagacactggagtagtggagcaagtagactcatgtaagtgtcgcagaatcggacatgcagacggaaggcttaagtaaatgaagcggagcggcttaacagctccgcttcatcctctaatcttgaataggcaaatgcacaggaatcttatgccaccgttttgct

SEQ ID NO: 88 - DNA, 43885 bp, Unknown
  Metagenome-assembled genome
gggcgctcatggcagagccagaagtcatgcgtgccgctgcgcctgagctcgagcagcttgatgaggtctcgtatgcgcgcacggcagcatgccttgctgccgtggaggagctttcaggtggcgtagcagcctcgtctctcaggtgggcggcactcttttcggaggctggccccaaggcagcaaagcgtgcactcaagaggatggcaataggcgtcgatacggcccaggaggcagcggccatcctgaagctcggggcgcaagtgctggaggagatggagaaagagccttcctggacaaggcggcagagctacgggcttgcggtggcggcagagcgtgcctgcagccatcgcggcatagcactcgctctcgctgtggcgacctatatgcaggcccatcttctgactgaagcctcgctcaaagagctggatagatgccatgcgcatgagatgctgaaagcaatcgatggggtgcgaaacgatatcagggcacttgcacaggcaaaggcgccgctgcgcgtccaggagcttgcggttggtggctccgatcttatggatgagctcgagatgccggcaggacccgagctcggcaagattctgaaagcgctcttctctcatgtcgttgcaggcgatgttgccaatgagtgcgagacacttcttgccgaagcccgacgaattcgcatgcaagaatgcaaatagcataatctagattaagctaatcaagattatgcaaagatgaagctgcatgtttgtcggatgccagcatgagctcggtgagctcgagcggctctatgcctagagcggcttccagatggtcgtcctctatggcaggcgtcgtgtcggcaagactgccctcacgaaagagtttgccagagacaagcctgcacttgtcttcacagcaaagatacattgggatgctgcacttgcattcattgcccagcaggcgaaagacacgcatcttgtatacacgcatcttgtatttgtcttcgatgaattcccccatgccgcaaagcgcaatgcaagcctcatctccacgtttcagattgcttgcgaccggctctttccggagaccggcatcttccttatccttacaggctcgaatcagggcttcatggaagagaagatgcttggagagtcggatgaagatagcctcggggagaagaatccgcttttcggtcgccggactgcccagatccatctcggacctttcgggtatcgggatgctgcgctcatgctccccgggctctccagcactgagcttgtcgagttctatgcggtctttggcggcacgccgtactacctctcgatgattgatgcgtcagagagcctgaaggcaaatgcagagcggctgttcttcagaaaggaagggctgctctatgaggagccgatgatgcttcttcggcaggaattgcatgagccagccatctacagctccgtgcttgatgccatcgctgcaggtgccaacaagccacaggagattgcaggcaggatcggcgaagaccgaggccttgtcggcaggtacctgaagacgcttcagtccatgaggttcgtcgagaagaaggttccgtacggcgagccccgtgaaaagtcacgcaaaggcatctgctgcatctcggaacctgtcttctccttctggtatcggttcgtgcagccggctatggatgcaatcgagatggatgccggagagctcgaggcccgtgagcttttcgaaggaaatggcatccctacctatgtcgggcactggttcgagacaatctgccttgaatggacaatcgctcaagccaagaagggcgacctgtcagattcggaagctggtggggagcagaccctgccagaaaggggcagacaggcatcgatgtcgtggcaggcagcaagcgccgccgcgagctcttcgtcggagaatgcagggggggggaattcattcgatgcgggaaaagcaacgcaggagcttgtgcggagggcacagctcatatcgggctacgacacggttcgctacggcctgttcacgaaggaccagatttcagcgggctttgctgggacgcttggtccagagtggaccttcgtggatgcagagaggctctacgaagaatgagatggcatgccgcagattcaaatgggctaaggcgggaaatgggcgagtggcctgtattgaggacagagggaagaagacaaaaagaaaagcgctccggaaaccggagcgcatctcatttggtagcccgtagcagattcgaactgctggtctccgccttgagagggcggcgtcctaaaccgctagacgaacgggccatatgtaaggccagcaagtggccgaggaaaatctggtagcccgtagcagattcgaactgctgatctccgccttgagagggcggcgtcctaaaccgctagacgaacgggccagatggctgggatagagagaatcgaactcccattgacggaaccagaatccgctgtcctaccgttagacgatatcccaagaggtcgtgcgtgcgcttcatcggcgcgagaaagaactataccgcagagggtgggggtgtgcaacgacattctgcaaattgggcaaaaagtcgctctggacccccgctccaccacaatctcgccacaagttcgatagccatccaagattggctctgcctatggtgtctggctgctgactatctgcgtccagatcgattggacgtgtggcgggtatgatagtgtggcagcacaaagagagctgagcgagggaaggatatggatggccaaagttgatggcacgcatgcaggctcggccacgaagacatctgcttcccgtactggcaagccccatgtaagctccatgccgaagctcaaggtctcgacaggacatatccaggcagaaggaaacgaggaccagaaggcaagcgcacgcaagggtgcgctcttcctggctggtgtcgttgccctctatatcgtctatcttgtcttctcgggacagatggtgcagttcctcgatgcgctctcgacggtcgatacgcactgggtctggcttgcctgcctctgctatggcttctacttcgtcttcggcgtccttgcctacgtgattgctgtcttcatcgaccatgactctcccgtcggcatccgcgacctcatgagcgtcgaggcatcgggcgtcttcttcgggaacctcacgccgatgatggcaggatcggtcccgtcgcagatcgtgcgcctcacgaagacaggactcgatccgggcgaagcttctgctacccagttcacccgcttcatcatgttccagttcggtgtcgtgctctttgctgccatcatgcttgccgccaagctcgagttcttcttcgagacctacggcgatatcgtgatcttgaacctcattgtcttcggcgtgcacatgctcgagctcatcgcgctcttcgtgatctgcctctgcccccgcttcgttatgcgtgcgggcatggcagctatccgcttctgcaagcgcgtgggaatcctcaagaagcaggaggatgtcgaccactggaccgaggtcgtaaacattcaggtcatgcagttctccgatgccttcaagacggcagcaaaggactggtcctcgatgctcctcacgcttgccgtgaccatggcacagcttgccagcctctacatgattccgtggttcgtgctcaatgccttcggtgttcaagcggacttcctcgactgcctggctgctggctccatggtgcagatggtctcctcggctgtgccgcttccgggtggtaccggcggtgctgagggtggcttcttcatgttctatggaggcctcttcggttcgtctgcgacggcaggatacctgatctggcgcctcgtcacgttcatcgcgcccacgatcttggcagcaccgctcctgagcctcaagaccacgaacaggacaagaagcatctaccagcgctggcaggacctcacacatggcgggggcaggagcgccggcgtctcgatgtctggtaccacgatcaagcggcgcgttgcccaggagaagcgcagcacccagagaaagaagcgttagccagaaaggctttgtcatatggcattcggaaagagcagaaagacgcaggcggcgtcgcagcctggcaaggactctgccgagaacaagggccgtgccttcaagggcatgctgttcctcgcaggtgtcgtcctcttctatgtcctcgacctcatcgtcacagggcagatggagaccttcctgacgtcgctccatgagctcgagacaagctggatcgttgctgcggtcatctgctatgtcctctactacatcgcaggcgtcgcagcctatgcggtggcagtctggctcgaccgtgactctcctgtcggcatccgcgacctcatgagcgtcgaggcctctggtacgttcttcggaaacctcacgcctgccatgatcggatctgtgccggcgcagatcctgcgcctcacgaacgcgggcctcgatgccggagaagcaaccgcaacgcagctgacccgcggcatcacgcagcagattgcatccgtgagctattgtgctgtcatcctctttgtcggcttcgtcgccttccaggcttcctacggcaacctgatcttccttgcgctcatcgcctgggccatcgggctcttgaagatcctcggcgagcttgctgtctgctatttcccgaaccaggtcatgcacttcggcaatgctgccgtcaagtggatctcgaagcgcggctggctcaaggactatggccgtgcctatcattttgtcaacaacgaggtgggggagctctccgctgccttcaggcgtgccacgaacagccgccagggcatcctcgtcacgctcgtgatcaactacatccagctgacgctgctctacctgattccctggtttgtcgccaatgccttcggctgcgacctgaatcccattgcctcgattgagctctgcgctctcgtccagatggtcggcgctgccgtgccgcttccgggcggcacgggaggcgtcgatgtggcctggaacatcttcctggggccgaccttcggcacgctgacgaccgctggcttcatcatgtggcgtgccgtctcctatatcggcccgatcttcctttcaatccctcttctgaacctgcattcgggcaggaaggagcagtcgctctaccagaggtggaacgagattgcacacggtgccggcaagagccgcaggtactgaaaagcttggacatgaaaaaaaggaaggcgtctgcatgggcaggcgtcttccttgcatcttgtgcgcttctccctacgcacaggctccgcaggaagcgcatccccgcagggctgaaggctctgcggcaaggccgcccagagcggtctccctgagctctttgggtagggcatgaccgacttttgccattgcatccacgacctcatcgaagggaaggggtgccttgatgccggcatgtgcaagctgcgctgcgctcatggctgaggcaacaccgatcgcattcctgagctggcagggatactcgacgagtccctgcaccgggtcgcagacaaggccgaggaggtttccgattgcaatggaagctgctgcgagcgcctcttccggcgtgccaccgagaagctctgtgagcgctcctgccgccatagcgctcgcggtgccgacctctgcctggcagccgccttcggcgccggcgacgcttgcgttggcagcaatgagggcgccgatggcagaggaggtccagagtgcctgagatatctccttgtcatcctttccgagctcttctgctgcggctaggacagctccgggcacgacgcctgaggcacctgctgtcggtgctgcaacaatcacgcccatagcgctcgaccgttcaagcactgccatcgcataggcagttgcacgcgtgagggcacctcccagaagctcgggagaggaggcagccgcctttgctgcctggccgaagaggaagccgccgagcgagcgcacggggtgctcgatcgtgtcgtgcgtctcttctttcatggtggcaagcaccttctccatctctgcatcagctgcctcctggcttcccagaagctcagcctcgcgggcgcgcatgatatccgctatggatgcgctgcgggcggagcagagatcttgcagctcgcgcccggatgcgaaatcgagggcaagcgccgtatcgggggagaccgtgctcgctccggggatgctcaccgaggaggcaaagatgatgtcagggcgctcctggcaggtatccacaagctcttcgggcaccggctcgtccgtctcgaagaccgtgtaggcacggcctccgcgcgactggcgaaacgtgcgcatcgtcgcgatattgacggaggctgaggagagggcaccggtaagcgctgccaggacgcctggcctgtcatagtgcgagacgaaaagggtcgggtagtcgccggtgatttcgacatgcacgccgttgatcgaggagatgcggatgcggccgccgccgacggattctcccgttacctcgaaggtggagccgcttgcgcagagcatggagatggatgccgtgttcggatgcggcatcacgccgtcgggcccctcaacgatggagaccataaggttgcgatcgcgcgcaatctcgagggagtcgcggacgcggacatcgtcgggaagcatgcccagaaggcctgcgacaagcgcctggtcggtgccgtggcccttgtgcgtgcgggcaaacgagttgtagcagatgatgtcagcacgtacgaccggagagggtgccaaggagcgtgcgacgagcgcgatcctcagggcgcctgctgtatgggaggatgaagggccgaccatgatggggccaagtatctcgaaggcagaggtatgcacagatccattcctctcgaaacattctggaaataggcatgccccatcgtggctcattgagattgtcttggcaagacaggaacacaggaatcgtggatattggccggcattcagataagtttcctgcctgaaacagcagagcatcacaatggatgaggcatatcaaaaagagaaaggatgcagacatggacaggagcatctatacagggcgcagggaagagatcctgcgcaggatggcagaagacggcttcgatgccctcgtcattccggcaggcgcagacatctcataccttaccggcttcacgggcgaggcaggggtcgcggttgtcgtgctcgctcccgaaggttcgagctttgtcacggattcccgctatacgacgcaggtcgccgaggagacggaaggctatgagtgcgtgctctggcagaaggggacgcacagctactgcgagaatgcgggcatggtgcttgcaaagctggcacccaagaccgtcggcatctacggggcagaccttacttacaaggacttcctcggcatgcagagccgctacccgcaaggcgaatacaaggaggctcctgcctacctcaccgagatgcgtgcgaagaagacgcctcaggagctcgacacgatccgcgaggcctgccgcatctccatgctttcgttctatgccctgcttgactccatccgtccgggcgtgacggagaaggatgtcgcagacgagctcgagcaccagttccgcagccacggcggctccggcatgtgcttcgacacgattgtcgcttccggtcctgtcaatggcgcctgcccgcatgcaagcgtctccgaccgcgtgatccagaagggcgacttcgtaacgatcgacttcggcacgcgctaccacggctactgctccgacatcacgcgcacggtcgctgtcggcaagggcgccgacgccgagctctaccatatcttcgatgtggtgtgcgaggccaagaaggcgggccaggaagccctccatgcaggccttaccaggaaggagctccacgagacgatcgaggcgccgatcaaggcagcaggctatgtgacgcctcatggcttcggccactcattcggcctcgatatccacgagcttccgttcatcaatggaaacgacgagacgccgtatgaggcggggatgataacgactatcgagccgggcatctatgtgccgggacttggcggcgtgcgccaggaagatgactatctcatctgcgacggcggctacgagcgcctgaccttcatcacggaccatctgatcgagctgtaacgacaagcttttcagcgacagaaaagaccccgccggctcatccgacggggtctctgcgcttcatgctatgagctgtgcttactgcgcgagcggaagcgcatggtcgatgcgggcaagtgccatgtccttgcccatgagctcaagggactctccgagcggaggggagaccatgttgccgcagacagcgacgcggagggctccgtagaacttgcgcttgttcgtgccaagctgctcgggcagaggctcgagcgaagcgtcgattgcttcggccttccaggagtcgagggcggcaagggctgcacgggcaccctcgaggtaggacttcgtatccggcttcgcgatgttcttctggacgctcttctcgtcgagcggaagatcttctccctcatagaggaagcggctcttctccacgacatcaggcgtcacggtcgtcctcggtttcaggatcgaggcaagcagctcataccaggcctcgtcgtgagcaggggcatcgccctcgagccctgccttcttgagctcaggcaggagcacggtctttgcgaacttctcatccgacattgccataaggtacgtctggttgatggagtcgagcttcttcgggtcgaaagtagcggggttcttgcttacatgctcgagcgagaacgtcttggcaaggacatcgcgcggcacgattgtcgtctcgccgtcaggagaccagcccagaagcgccagatagttcacgaaggcatcggagaggtatcccgcatcgcggtactcctcgacagacgtcgcgccatggcgcttggagagcttcttgccgtcggggcccaagatcatggagatgtgggcgaaggtcggaacaggtgctcccagggcctcgtacaccatgatctggcgcggcgtgttcgacaggtggtcgtcgcctctgatgacatgggtgatgcccatcatggagtcatcgacgacggtcgcgaagttgtaggtcggcgtgccatcggagcggaagatgatgaagtcgtcgagctccttcgcatcgaacacgacatctccgtgcacggcgtcgtgcacgaccacgtctccgcggtcgagaggcaccttgatgcggatcgtgtggggctcgccggcatcgaccctggcctgtgcctctgcagggtcgatgttcctgcaggtgcgctggtatccctggaaggggtccttgcgctcctgtgccttgcgcttgtcctctgcgagcttctcgggcgtgcagaagcagtagtaggcattgccggacttcacgagatcctctgcggccttgcggtagagatccatgcggtcggtctgcttgtaggggccgaagtcgccgccgacctcgggaccctcgtcccagtcaagccccagccacttcatggcgcggaggatgatctgggtgttctcctcggtggagcgggtcggatcggtgtcgtcgatcctcaggatgaacgtgccatggttggcacgggcgaaggcccagttgaagattgcggtgcgggcgccgccgacatggagcttgccggtgggcgagggtgcgaagcgcacacggacaggacggtcttgatctgccacagaattgcctctcgacaggggcccgattgggtccatatgtacatggttagcgcattcagtatagacgctagagatgcgtctacatcaacttcgtgctttcgagcttctcctcgagccagtggttgagatggatcaccgggcgcctcaggatgaggcccaggaggagggcagggatgatgaagcagacaaggcgcagcatgcagaaccagtagtcgttctggtagatgccggctatgcaggcgcgcatcgcatcctcgccgtggacgaagggcaggaacggatagagcttctggaagacgcccgggagcatctccttcgggaaggtgccacccgaacctgcaacctggatgaccatgaggacaacggcgatggccttgccgacgtctccgaacgaggccgtgagtgcgtagatgatgttgatgaagatgaaggactcgagccagcccgtaaggaagaagagcacggggtgctggcactgcacgcccaaaaaccacaggtcgccggcaatcacaagggtcgactggaagaagccgatgatcaggaagaagatgatgcggccgatgtagcagtcggtcggacgggcatggatcttcttcaggaaccggtcggaaggcgctgtcttcacaagggcgcagagcacgacgccgccgatccagatggccagggtggaatagaacggtgccatgccggagccgttgtttgcaacggcgaagacggctgtgcggtccatggagaccggtgtcgagatgaagctcgcgaggtcttcggtgttggcggaaaggatggtcctcagctggtcgagatcgcccgaatcgagggcatcctggatctgcgtatggatatcgccgagcttggctgctgcgccgtcgagctggtctgcggcatcgagaagcgagccctgcacatcgcccatgctcttggaggcggtggctgccgtgtccttgagggaggagctcacattgtcgagctgcgtcttcattgcgtcagccttggaggcggcatcctgaagcgagctgttcatgtccgaaagcgacgagcgcagaccctgctcgtagtcggaggagatgtttgtgatgctcgtcttcgcctggtccacaagaccgtcgagcgtcgttctcgcgtcggaggcagaagactgggtgttctggatatcagagatggccttcccaagcccgtcgtcgagcttcttggcatcatccagagcctgcttgaccttcgcgatcagaccctcgtagctgttcacagtctcccactcggggctgccgatcaactggtcgcggtatttcttcgcgattgcgtcggtgccaaccatcgagtcatagaggtcctgaagctttgcaacgcgggagtcgactgtgccctttgcctgcgtaagggcatcgacaagctggtccgtgtgcccagctgcggcatcgaaggcctcatcgagtgcgctcttcacattgtcgaagtcggaggcggagtttgcgaacgagtcgttgatggaagacgtcgctccgtcgagtgcatcggagaggctttggacgccgtctgtgccagagcggagcatgcctgaagcatcgagtgccgaggagagggtgcccgagccatcggagtcgagctggtccagaagctgggaggctgagcctgagatggcagcataggagcggaggtttccggatgtatcgctcaggcgcttctgcgtctgtgccagggcagaatcgagctgcgttgccagcgtccggacatcgtccgaattgaggtagtttcctacctggtcgaggacgcctgcagctgcgcttgtgagcgagctggcaaatgactggttgatgtccttctgcacggcagcagatgccttgtccgtgacgatggcggcaatagcgttggccttctcgttctggtagaagtagacctccggcttgtctgtgctgtcggcgaagtaggtgagcatgcgctctgagaagtcggcaggaatgacgacagcagcatagtaggtgccgctcttcacgccttcgacagcctcgtcctctgagtcgacaatcgtgtagccgatgctcttcgaggctttgagctcgctttccgtgcgctcgccgagattcacatcgactgggatgagatcgcttgtgtagccttcgtcgaggttcacgacggcgaccttgaggttggccgtgttcttgtaggggtcccacgaaccccagatgttgaaccaggcatagaagctggggatgacgatcatgccgacacagacgacgagggagatcacgttcttgaacacgttatgcgcatcataggctgcgaccttcatgaacctaggcacggcgatcatctcccttcgtgtgcgaggagggcaggtgcatggtgatggtctgctcgacctcgattggcctttctgtgttcttggcggcatctgccttcctggctgcctctgcgcgttcatgcacgagcttcctgagcttcgctctcggcatgatcagcgtgtggctgcgctcgaggatgctcgtcttgtccgtatcgtctgcgacgccgcgttggacatcgaggccatgcgtgccgatgttgtgggagagcttcaggctctcgatcggcgagaacgtgaacatctcctgcttcaggttgtcgtcgaggagctggtagagctcttcgcttgacatgttcgcgatgcgggtcttctcggagacgcggctgtgcaggtactcgacgacgatgagataggtgcacacgacgatgagcgagatgatccagcaggtgatcgtgatcatgcggaagggcaggatgaacatgagggccagaaggacgagcggcacccagagcagcgcgaggaagccgcgcttgatataggtcgggtagcggagctcgaagttcgcgacacgctcgccgaagaccttgcggtattccttcgagttgccgagcgccttgatgatcgtggagaggcggaagtggacctcgggcaggccatcgcgctccgtgaccatgaggtcggtctcggcaagcttgcggtcgaagagggcgttgatgttgagaaggtggcgcctgagccccacgccgatgacaagggaggggatgacatagaggagaaggatgaagatgtcgtaggcgaagtatccgtcgtagaagccggctatggcttcgcgcatcgcattgatgccatacgtgaagggaagccaggggttgagggcctggaagaagccgggcatcatctggatcgggtaggtgcccgaagagccggggatctgcacgacgatgagaaggacgccgatggccttgccgatgtgcttgaaggcaatcgagagcgcatagatgatgctgacatagacgaaggattcgacgagtcctgcgaagacgaaggccacgggcgaaaggcactggatgccgaggcagaggtctcctatgcagcagcacagcgcctggacgatgccgagaaggttcagcaggagccagcggccgaagtagccctgccagggcttgaagtcaccgatcccctcatggtcgacctcgagcttgtagatggcaacgaggacgaagccgccgacccagagcgcgaggttcgtatagaacggcgtgacgccggatccgtagttcatgacagggtagatgggctcatcgacgatgttcacaggggagccgagatagtcgccgaggctttccgggtcgatgtccatgagcttcgagagctgctccacgatatcggcggaggcaatcgtgtcgatgtctcccgcaaggacgccgaggtcgctcttggccgtggcgacagagtccttcgtgctgtcgaggaccgaggtcgtctgatcaagcgtcgtctcgagctgctggagctgggcggttgtctggtcgacaatcggcgtcacggcgtcgagcgtcgaggcaagctggttgccgacatcggagaacgagtcgagcgcagagtcgagtgccggcatcgtctgggactggaggtctgagtcgaggttctggagccctatcgcggaatcctggatggcggtgttcacggatgaggagaggtccgttgcaatcaccgtgtcgttcttgatggagtcggagaggtcctggagcttctggatgcgggcggcctggtcgtcgacgagcgtctggagcttgtcgatctgggcatcgagctttgcgaggacctggtccctgatgtctgaggtcacgctgtcaggaagcgagagcgctgaaatcctgtcgcggatggacttcacgcggttcagcacggactgcgtctgggtgtttgcatcctcgaggacagagagcgcgttgtcgaccttgccctgcgcacgctcgatgccggctgcggcatcggcgatggagacattcgcattcgtcgagagggaagagatcgtgccggcaccattcaagagcgagtttccgagctgctggttcaaggtgcgggcctgagagcgggtatcggtcagggtgccgagtgcagatctcagagatgtggcggcatcggctgcgcccgagtcggcgtctgcgagcatggaggcggcagagtcgagcgcatccttcgaggtgtcgatcgtcgtctgggcatccgtcaggtcctggccgagcccgtcaagaagcccctgcgcatcgcggacgtcctgcgcgacggtatgggagccgtcgacgaccgtatccttcgcattgcctgcggcatcagcgatcttctctccgacgaccttgccgaccgtctcgacgaaggtcgcatcgatctgggtctcgatcgtcgaggcgccggtatcggtcaccttcggggcgaccgcattggccttctcgtttgcgtagtactggatgtgcgccttgtcggtctttccgtcaaggacacctgcgagcgtgctcgtgaagtctgaagggatgacgatggcagcatagtaggtgccggacttcacgccgtccatcgctgtgtcctcatcgacgaacttccagccgagctgggtgttctctctgagctcgtctacgaccatatctcctgcatcgatatggcccatgccggagatgtcggcgccggcatcctcattgacgatagcgattgcaatgtcgctcgtgttcttgtagggatcccagttggcgatgatgttgaaccatgcatagagcgaaggcagcacgcagacaccgagcgccacgatgacggcagcagggttatgaatgagccgcttgagatcacggaagaagatggcgaaaacggtcttcaagagggcctccagtgatttcggtacctcacttgcaggaaagattcaaaaatgtacacgctacactattgcacaaaagcgcctgttcctatcaccctttttgaaatacggtcaaaaatatccgtctatggtgctacactttacgcaaattgcatgcccgcctaagcgggaagaaaggaccttacgaatggcagaagcaggcgaacagtcgaagcatgatgcagtatctgctacggctacagcagcgatagaggtccacgaagcgatccagaagaagctgcagtcacagaagaagcagctgaagaccgcaggctcgcgcatgaagacacgcaagagcaccaggacgcgccaacgcatcatcgatgccgccaaggagatcatcgacgagaagggcacgacgaacttccagatgagcgaagtcgccgcgcgctgcaacatgtcgaagggcgccctctactattacttcaaggaccgctcgcagatcgtctccatcgtgaacgaagagatcggccagggcatcatctccgctgttgaagacatcagctcgcatgaatcgtctgccgtcgatgcgctgcaggacatctgcgagtccttcgcaatcgcgctctccggcaaccgtgcaggcttcggagcgcttctgggcgagttcatgcaccgtggctatgactccgtcaacggcctggacaatcggtacggcaagcttgcggcgctgaccgaatctctgatcgagcgtggcaagaaggaaggggcggtcgatcccgaggtcaatacatcgcttgtcgcgaacagcctgatcggcatgttcatgttcgccgccgcttcctatcttggccaggaggatctcatgggtacatctgagttctcgagccagctcatgggcatcgtgctcgaaggcatcggcaccaagcagggggtccagaacgcctgtcaggatctttgctgagattttttgaatttcattcaaaaaagaccgctctgactatttacagcactgcgaaagtggcatatcgtacatgccagctcgtcaagaggcattcgaaaggatgcacagagccgagggaccgagccctatgacgctccggcaacccgcccgcaagggaagggtgccaattctcggcaggctcaaaggcctggaagacgggggcatacgtgtcttgtgcacagagtccctgggtaaggtacaggggctctgttttttatgagcgcctgtgcgaagacgttcagagaaggttggttatgtctcacaagaactacctcttcacctcggaatcagtgaccgagggccatcctgacaagatgtgcgaccagatctccgacgcaatcgtcgatgccatcttcgcgaaggaggcaaagctccaggagcagggctacgtcgactccgacggccaggctgccaatgtcgacaacgtccgctgcgccatcgagaccttcacgacgaccggcaccatcgtcgtaatgggcgaggtccgcaccgaggcctacgtcgacgtgcagaagatcgtccgcgacacggtagccaagatcggctacacgcgcgccaagtatggctttgacgccgagacctgcggtgtcatgaacctcatccactcccagtcgcccgatatcgcccagggcgtcgatggcacgttcgcacgcgccaatgaccaggacgagatcgacaagatcggtgctggcgaccagggcatgatgttcggctacgcctctgacgagaccgacgtgctcatgccgatgccgatctaccttgcacagcgtctcgcagagaagcttgccgaggtcaggaaggccggctccctcacgtatctgcgcccggatggcaagacgcaggtgaccgtgcgctacgaggacgacaagccggtcgaggtcacggccatcgtcgtctccacgcagcatgccgctgacgtgaagctcgcacaggtccgcgaggacatgatcgagtacgtgattcgcccggtcctcgacgaggtcggcatcaagtgggaagctgccaagatctatgtgaacccgaccggacgcttcgtcgtcggcggacctatgggcgacaccggcctgaccggccgcaagatcatcgtcgacacctacggcggcatgggccgtcacggcggcggtgccttctctggcaaggaccccaccaaggtcgaccgttctgctgcctacgctgcacgctgggttgccaagaacatcgtcgctgcgggccttgcccacaagtgcgaaatccagcttgcctacgcaatcggcgttccccagccgctctccatcatggtcgatacgttcggcaccggctctgtggacgatgaggtcatcgagcacgctgtggagaaggttttcgaccttcgtccgggcgccatcatccgcgacctcaagctccgtcgtccaatctaccagaagaccgcagcctatggccacttcggccgcaaggatccggacttcacgtgggaggcaacgaaccgcacggacgagctcaaggcagctgtcgcagagcttgcatagcatcatctgaagcgtgccagaatgaaagaggccaggggagtgcatcccctggctcctttcttatgacgcgcatccagccgtgtgccttttgctgttctagctattcagcgatcgccataatgtgactgacattgagcgatttcaagatctatgccaacgattcgatatgcaagccggttcttgctgtcaatacggcgagaccaccatccagagagatctctgcgcagctgctctggcttgccgatcccttgtgcacatccgtttcgttcaatgtccttgacaagggcattgatgcgcttcagcgtcttcttgtcctgcgtttcccaggcaacgtagtcttcccaagcctctggtgcccagacctcattcagcttcatcgggctccttcaggtcatgtggctgaccgtggccagcatcgagcgatgcaatggaggccctgagatgggccatgttctcatccgaatagaacgggtctacagatacttcgaagggtatgcggtgctcccgcgcaaccttctttgcatagatcacgaatgctgttgtcatgctcatgccaagctctcggcaggtttcttccatgccgcgcttcgtttcggcatccatacggatgttaaccatcgtagaaccagccattatgtcctctttcactacagtgtatataatatgactatacaacagctatatatacccagagctttcatctccttggcgggatagggcagcagatctcgctctgcactccgggcaaacacctttgctgatgagggccaaaaagctgtcggaagggaaccttcctggcaaagtgcattgattgtctgcggagcaaagaagtcaggaaagcggagtgcatccgctggctccctcttcgctgagataagatggagcacaaaagggccatctagcttatacggtacgatgccttgaaggggagatatccatgagccttgcgattgcatgggtgggctatatgcttgtggctgccatcatcatcggtatcgttctagcaatcatcggcaaggccaaaaggccgcatcgtcccgtgccgcgaacgtccgtaaaggatccggatgcagacgagacgctccggcagatgatgctcgacgatatcgctgcgcatcgggaagggccagacggcgggaagagctagccttgcagaatgtgctggctccatgttccggcgtgctgcaagattgcctgctatgagacaatgaggctgagatgcgccggagacgtttgaaaggcagatatatccatgtggtttgctgatgtagcactcgatatcccgacaagggcactcgatggctgcttcagctatgccgtgccgcctgaggttgcggcctccttcggagaagatcctgatgcggtgagatcgggccttgtcggcatgactgtcctcgtcccgttctcgggcaggaaggccataggctacatcctgggtgcctctgaagaaccgccgcgtggccttgatgccggcaagctcaagatgttcgagcaggtgctggcgccttctgccttcgatgaggtgtcggcggggctcatccgctggatcaaggagggctatgcctcgaccctggccgatgccgtgcatccgttcctggcgccgggacaggccgtgcgcgtcaggaagaacgatcagacgggccattgggagcttgtccagcatgctgcagggccgcgcgatgtgcgctgggcagagcttgcaccggatgccgccgtcttcgtgccgcgtgccaatgcctcgaagcagaaaggggtcctgaaagccctctctgaaggtccctgccgtgtcgccgagctcgaggcgctcctgccgggagcctcttctgccatccgcacgcttgcctcaaaaggtgttgtccgcatcttccaggagcgtgagctcagagagcttgaggagacgacgctctcctctgcctcggccaagcggcccgagcatctgacagaagggcagaagaaagccctttctgccatcgcagcagcccaggccaaaggtgcaggagatgttgtcctcatcgacggcgtcacaggttcgggcaagaccgaggtctatctcgaggccatcgagaagacgctcgcagaggggcattctgccatcgtccttgtgcctgagatctcgctcacggcacagaccgtgggacgcttccgttcccgcttcggcgacaaggtggcagtcctccattcgcggctctcgcagggagagcgatacgaccagtgggaccttgcccggaaagggattgcacaggtcgttgtcggtgcccgctcagcgctcttcgccccagtccatgatctgggccttctcatcatcgacgaggagcacgaggcttcctacaagcaggattcggctccgcgctaccatgcccgcgaggtcgccgcagagcttgcaaagagaaggggagcggcgctcgtcctgggctctgccacgccttcgctcgagagcctctggcgctgccgggaaggaagcttccgcggagcccagtggacaagggtcgagatgccggagcgcccgggcatagcagaacttccggctgtccagatcgtcgatatggcaagccagttctcgcacggaaacaagtcgatcttctctgagcctctccaggaggcgctcgatcaggtcgtagagaagaagcagaaggcagtccttcttctgaatcgccgcggctttgcgaacttcctcatgtgccgcgagtgcggctgtgtgccggagtgtccgcactgcgcgacggcgcttacctaccacgagcggacgcattcgctcatgtgccacagctgcggcaggagctggcccatcaaggcctatcccgacccgacaacgcgctgcccgaactgcggatcgcgctatcttgcacagttcggtgtcgggacgcagcgtgtcgaagacgagctcagagcgcttcttccagacaatgtcaccgtcgtgcggatggatgccgacacgacgaaggccaaaggagcgcatgaggcgctcttggaggagttcgacaatgcggaatgtgccgtgcttgtgggaacccagatgattgcaaaggggctggacttccccgaggtcaccctcgctgctgtcatcaatgcggatacgaccctgaagctgccggacttccgtgccgccgagcgcacctatgacctccttgagcaggtggcaggacgtgctggcagaggcgaggatccaggaaaggtcatcatccagacctactgggcaacgcatcctgccatcgaggcagtgcgtacccacgacaaggagacctttgtcgagtgcgagctcgaggcacgttccgaggcccactatccgccattctcaaggctctcgaacatcgtgctctggggcaaggatgcccgccaggtgcgcgagctcagcatcgagtgcgccgaagcggtgaggaagaagatcggatctcgatcgggctgggaggtgctcggtcctgccgactgcgtgaaggcaaaggtcgaggaccgctaccgccgccatgtgctcgtgaagtcgccggtcgaggcagatgccggaaggcttcttgcagatgccgtagccagcttgcggaaaccgcatggagtcagccttgctatcgatatcgatgcctatgacctcctctgagagctgggtactatagaagattgtaaagacaagccggagcagcagctgctgctcccgaccataaggagaatcatggctagcaagaagcaagaggagctgcttgaagatatcgtgctctcgcccgacccaaggctcgaggaggagtgcgcaccgctcatggaagaggagatcgtgagccctgagacgaagaagcttgccgagcgcatgctcgacgacatgtacgctgcagatggctgcggccttgccggtccccagatcggcgtcatgaagcagatcgtcgtgatcgatgtcgactatgtcggcaagaagaggaacccctacgtccttctcaatcccaaggtcatcacggccgatggcccgatgaggagctacagcgaaggatgcctctccttcccgggcatctcggtcgatgtggagcgtccgtcccatgtgatcgtccatgcctacaacctcgacggcgagctcatgcagtacgaggcagaaggagaccttcttgccgtgtgcctgcagcatgagattgaccatgtccacggcatcacgatggtcgaccatctctcgccgatgaagaaggtcaaggcccttcgtgcctacaacgaggcactggccaatggcgcccgtccgggcgatgtggcggagtgaccggcatgcgcatcatcttcatgggcacccccgatttcgcggtgccatcgcttgcggccctcaatgaggcgttcgacgtcgtcgaggtcgtgacaaggcctgatgctgtgcgctcgcgcggcaagaagctggagccctctgccgtgaaggcagaggctgcaaagctcggccttccggtccttgaggccaagcggatgacagaagagaccattgagcacttcaggtccctttcccctgacatcatcgtcgtcgctgccttcggctgcatcctgccggatgcagtgctcacgcttgcacctctcggatgcatcaatgtacatgcctcccttctgccgcgctggcgtggcgctgccccgatccagcgtgcgatcctcgcaggagatgagcgtgccggcatctcgatcatgaagctcgtgcacgacctcgatgcaggcgactattgccgccaggcatccgtgcccgtgggcacgatgggtgacatggagctcacgcaggcccttggcgagcttggcgcgagagagctcgtgcctgccctcaaggagatcgaggcggggactgctcagtggacgaagcaggacgagagccttgtgacgttcgccccgaaggtcacgaaggcagagatgcgtctcgatccggcagactctgctgcccagaaccttcaccgcgtccaggcctcgagcgatgcagcgccggcacgtctcgcagtgtccggcaagggtctgcgcatcatgaaggcagagtcggcagatgctcctgtggctcagggcaaggtggagcttgccggcggcaaggtgctcctcggctgcgccgagggtgcctttgcagcgctctgcgtgaagcctgatggcaagcgcgagatggaagcctctgcctgggcacgtggccagcatgcagatgagctcacctgggagcatctctcgtgacaggaaggaagacgaagctctctcgtgcccgtgcagcagcgctctcgcttgtctctgagcagaggaggcgctctgcacgcctgcgcgacctcatgcgcacctctcctgtgctcgagaagctctcgcctgaggaccgggcgctcgcttcgaggctggcgcttggctgcgtccagacaagaggcgcgctcgatgctgccatctcttcgcatctctcctgcaaagggcatctcgagcccaaagtgaaagatgccctggcgctttctgccttcgagctcctgttcatgaagacgccggctgccgttgccgtgagccagggcgtcgagcttgtgcgctcccagagcccgaaggcagcaggccttgccaatgcggtcctccaccgcatcctcgaagaggatgtgccggcctgccatgaagcgcagacaaagcttgcggatgcaccggcggcagcaacggcagaagatctggcatgtgccacaggccagcctgtatggttctgcgaaaggatcgcttcctctcttggcatgcctcaggccatcttggcgctttcctctctcgcggagccggcaccggtctatgtagccgcaaatctcggcgtggccgatgcctctgcgcttgagcggaagctcacggaggcaggccttgccccggaggcacagggcctgccaggcgctttcgagctcaggcacccgcagaagctcttcgcttcgggccttgtcggtgcggtctcagccatgccggcagatctttccgcccaggaggtcgcgctcatcgcggcgccgcgtccaggcgagagcatgctcgagatcggacagggaaggggcacgaagacgctccttctgctctcggcgcagaagatgctggcagaacgcgagggcgtgaaggcagacaaggcgcgctacgttgcgctcgattccgaggagttcaagacgaagcttgcccaggaacgccttgccaagggcggctgggatggacgcgcgagctgtatcgcgttcgatgggacagaactcggcgaggaaaggaatctcccgcaggagctgtccggcacattcgacgcggtcttcgtcgatgcaccatgctcaggcaccggcaccctccgccgccatcccgagatctcctggtcgctcgagccttcagccgttgatgcggagagcgcagaagggctgccgcagctccagctcgcgcttcttgcggctgcggcagccaaggtcgcgccccacggcaggctcgtctatgcgacctgctcggtgctccgcgaggaggacgaggatatcgtctcgcgcttcctcagctgcgaggcaggtgcaggctttgcgatcgaggatgtgcgcaaggcaccggcattggtgctctggcccgaagcgcaggatgcgcttcccgtcaccgacgagggcttcttccgatcgagccctctgctcggagggcccgacgggcacttctgctgcgtcctcaggaggaagtagcaaagagcaaggaatcagacagatatgcctcccgcatccagcaatggaagcgggaggcatagacgcattgaggcaaagaaaaagcacggcatctgccgtgctccatctttatctatgacaggatcgaactacttcttgtctctctggtcggtgttgtagaagcctgagcctttgaagttgatgccgtacggctcgaagacctgctgtgcctcatggccgcacttcgggcagcttaccttcggatgggcggacatgggatgctccacctcgaacgtcgtgccgcatgccggacatttataatcatagcgagccatctgtatgcctccgtcgtattcagatataggatgcaggatgtgcctgcacacgagccagcaggattaactgtacccaatagctggcatttgtgccaccaagacacgtaatgcccaagactggacggatggcgggaaggatacgcgtgaaggcattgatcgtcggagggtcacccgaaccctcgagcacagagcttgtagcagagcttgcccatgaagcagactatgtgattgcagcagataagggcgcagagatgctctgcgcagcaggcattgcgcccgacctcttctgcggtgacgaggattctgtcggcaagggggcgctcgagacgatgcggagcctgcctctgcctgagaagcgctatccctggatgaaggatgacacggacttcggccttgcggtgaagcttgcacggcaggaagcaggagagcgcgaagagccgctcgaccttgtctgtacctgcgtctcgggagggcgtcctgaccatgcgctcggcgtcttcggtgtcatggcagaatctgcagagcccatctcgctggccggtggctcgctcgtgcttcatgaggacaggttcgtgtgccgcatgcttgtggcaggcacgtcctggaagcttggggccgaggccaagggccatacgttctcggcactctccctcgcagcgcgctctgtcgtgaccgagcgtggcatgctctggtgccccgaccactcggcgcttggcatcctcgacgaccgtggcgtctcgaaccagatcacggaagacgtgtcagagattgtctgccatgagggaacggtcgctgcgttcctgcttcaggagctcggacacacggactaggggagcggaggcactgcgttccacctgccataatcagacagagccgctacagaaaaggagccgaggcacgtgacctcggctcctctcaagcatgcagtgtgtgcgcagcctacgaacgggcaaccttgccggacttcaggcagccagtgcagacattcatcttctgcttgcggccgtcgacgacgacggtgacgtgctggatgttcggcttgaacttacggttgacggtacggtgcgagtggctgatggaacgcccagctacagcgtgcttaccgcagatctcacagaccttagacatttctttgacctcccatgggcggcgcaggtgcgcccggattggcatagctttctaaatataccacaggctattaagcccgcaagcttcatcgcgagttcttgggacatttatggagaaacccggaggtgcagcggagcagggcggaccatgggggcaactcgtttgcttgcagagatgtattgtagctccccagcagaaaaatgccagctcgtccataaaagatgccctgacattggcggagttgctcttggggttcacaaggagaccatataccatggagagtgtggcaagacccaagcatcgagggtgattctgcgcgcttggagtatactcagcttgatttgtctttggcccgtgtcccgcgcggggcacgtgagaggagatagatatggcaaagcccgttccaggaggactcagggtttcgaacgactgcatcgccgaccttgccggctatgccgcgatggagtgctatggcatcgtgggaatggcagagatcggaaaagaggatggggtcatccggctccttccgactgcacgcctgcgccgcggcatcggcgtgtcccatgaggatggccatgtcgctatcgatctccatgtcgtggtcgagcagggcgtgaatatcgcttcggtcacccagaaccttgcaagtggcgtcaagttcctgctcaagcagattgccgagctggacaatgtggacgtgcgcatccacgtcgaaggcatgcgcgtccactgacaagcagcctggcccatcggaagagcagaagagaaccaaggggttcaagaatgatttccaccgcagtacgcacatgcttccctgttgccgccaaggtgctggcagacaaggcagaggagatcaacaagctgaatgtgttcccggtacctgacggagataccggcacgaacatgtccctcacgctgaatacggttgtgaaggaggtcgaggcgctcccgagggatgcctcgatggaagagattgccaaggccatcacccatggttccctcatgggcgcccgtggcaactcgggcgtcatcacgagccagattctgcgtggcatcgctgaaggcctctgcgatgcaaagggcgagacggcgacgacgtccgatatcgcccatgccctgcgccgcggcgtgaaggtcgccttcaaggcagtccgcaagccggtcgagggcacgattctgaccgtcctcaaggatgtctctgcaaaggcagactcctgcgagctcaagcgcgtgagcccggacgagacgctcgacgcaatcgtcgtcgaggcctacgagtccgttgcccgcaccccggagctcctgccggtgctcaaggagaacggcgtcgtcgactcgggcgccttcggccttgccaccttcatcgagggcttcgtgaatgcgctcaaaggcaaggaaggccaggtctccgatttcaagacgaccgtcgagagcacggatgacgcgaagtcccatgtctcggatgtcgtggacatcgagctcaatgatgactgggagggctcgcagtaccgctactgcaccgagttcctcttcaaggcagacagccccgacttcgacgaggaaggcacgctcaagttcctctcctccatgggcgactgcgagcttctggtcggcacgaaccccgactacaagattcatgtccattcgaaccgtcctgaccaggtcctcggccacatgctcgagcttggccagatcttcaaggtcttcatccacaacatggacctcgaggcgcatgagcgcacggagaagattgcagctgacaagaaggcagcagccaagcctgagcgcaaggagctcggctttgtcgcagtcgcagctggctccggcgaggaagatatcctgaagtccctcggcgtcgatgtcgtggtctttggcggacagacgatgaacccctcgacggcagacatccttgctgccatcgaagaggtcaatgcgaagaacgttatcgtccttccggacaatggcaacatccgcatggcagcagaggctgccgccaatgcctgcgatacggccaaggtgacggttgtcccgacgaagaccgtccttcaggccttcgctgcgatgttcgcggtcgacacgggcctctctgcagaagagaacgccgaagagatgaccgatgctatcgccgctatccgcgacggcgaggtcacaacggccgtgcgcgactccgcagccgctgacggcacgccgatccatgcgaacgacgttatgggcatcgagggcggcgagatcgtcgtcgtcggcaaggatgtccaggatgtctgcgtccgcctcatcaacaagatgcaggaagacgaggaaggcgataccctcacgattctggccggcaaggacatgtccgacgaggacttcgagaagctcatctctgccatcgaggaggcacagccagacctcgagatcgattcccaccgtggcgagcagccgctctatccggtggtgttctccatcgagtagcccttggcagcgaatgattccatgagccgtccgagcatcggagcagcatcggagcgccttctgcgcacaagtgccctctccgatggtatcggacggctccgctatgtatcgggcacacgccaggaggcgctcgagcgtctcgggatacataccgtccaggacctcttcctggacctgccccgccactatatcgacctcacccgtgtgacaccgatcgcccttgccgatgtcggcacgcaggcgacggtcagaggcgttgctgacaaggtgaaggtcaagcagccacgtccccgcatgaagatcgtcgaggtctccgtcctcgacgatacaggcgtgcttgtcgtgtcgttcttcaagcagccctggatagcagaccagatccacgagggcgatgtgcttgtccttcagggcaagatctccttcagctatggcttcaaggagatgaagagccccttcttcgagaatctgggaccaaaggaccaagcaggcgcttctgcccggatacttccggtacatgccgtgggagaaggcatcacgcaggcctggatgaggcgtatcgagagctctgccgtggcagacttgggcgatgtctctgacttcatgccggcctcccttgtggcgctccatgggctcatgagcgaggccagagccatacggcaggtccagttcccgcatagcatggcagcagcagagcgcggaagaaggaggcttgcctacgacgagctcctgctcctgcagcttgcgctcctgacacgcacgcggctcgaatccgaggggcttgctcccgtgcagcatatcgtggacggacctcgtgtggcagcagtccgcacagcgcttccctttgcccttaccgatgagcaggatgctgccgtatccgagatcttctccgacatggcctctcctcacctgatgaaccgtctccttctgggagatgtcggcaccggcaagacggcggttgccgccgtggcgatcggcgctgtcgccgatacgggcacccaggctgctgtcatggcaccgacctcggtgctggcgcgccagtatgcagagaagatggggccggtgctcgatgaagcaggcatcaggtgggcgctcataaccggtgccacgcccgaagctgagcgcaggacggcaacggaaggcatccagtcgggagccatcacggccgtcttcggcacgacggcgatactctccgaagatgtcaacttctcccatctctcgcttgccgtgatcgacgagcagcaccgcttcggcgtggggcagagggcgcttcttcgcaacaagggtgcaggtgcagaccttctgaccatgacagcaacgccgattccgaggacgcttgcgctttctgtctacggcgacctctctgtctcgaggatcaggaagcgccctgtcaagggtgcagggataacgacaaaggtgctcgcgcctgagaatgccgatcttgcctatggggccatacgggaggctgtggcaaaagggcagcaggcctatgtcgtatgcccgctggtcgatgcgaaggatacgggagacgagctcgacgacgtgcccgatgcgatgaaggcaaagccgaaggagctccatgcggcaaccgtgacggcagagcggctttcccgcgatgtctttcccggcatgcgtgtcgcccttctccatggacgcatgtctgcccaggacaaggatgaggtgatggggcgctttgcagcaggcgagatcgatgtgctcgtctctacgaccgtcatcgaagtcggcgtcgacgtcccgaatgccaccgtcatgatcgtcttcgatgcagaccgcttcggactggccacgctccatcagctgagaggccgtgtcggcagaggcaagatctcggggcaggtgttcctcgttgcggcagccaggaaaggctctcctgcaagaaagcgcctctctgcactcgagaagagctcggatggcttcgagcttgcagagctcgacctctcgctcaggcatgaaggcgagcttctgggctataggcagtcgggaggcgtggcgcttcgcgtcgcagacctggccgaggataccgatcttgtgcagtatgcttacgtggatgcgcgcaatgtggcagaggaagacccggcactggaagagcctgagcatgtgcttctggcgcaggagatgagggcacgcttcggtgcctatttcgaggaggtagaacgggcgtgagagtggtcggcggcatatggaaggggcatcccctcgaagcgccccagggacgctctgtcacacgcccgacgacggatagggtgagggaagccctggcctccatgatggagagcgccttcgggctcgacctctcgggcaggcatgtgctcgatgccttcggcggctctggtgccttcggaatcgagatgctctcccgcggcatggaggaagcgaccttcatcgaccaggacaggaaggcagcagcccgcatcaagcgaaatcttgctgctgtcggggcaggacgcgagcaggcccatgtcatctcctctgccacggccacggcgattgctcggggctctcttccgggcgctcctttcgatgcggtctttctcgatcctccctacaagatgccggcagaagaggttgcgggccttgtcgatcaagccaggaagcaggggatgctcaaggagggctgccttgtgctctatgagcgctctgccacgggggatgcgcttccgcttgcaggggcagagctcttgaagtccaaacgctatggctccactgccgtggagctctggaagataaaggagtcatgaatggctgcatcatccaccatcacgcatctcgtcgtgccaggcacgttcgatccggtgacgtatggccatatcgacgtgatctcgcgcgcgctcaagatctgcccaagggtcacggtcggtgtcgcactctcccgcggcaagcacggcaatggcacgatgttcacgctccaggagcgtgtcgacctcgtgaagcaggcgctcgaagaggccaacgtgagagaaggcgtcgatgtgaagccgctcacgggcctgcttgtcgacttctgccatgaggtaggggctggcggcgttgtcaagggcctgcgcgcgattacggattttgaatatgaattgcagcaggcaagcttgaattcgcgccttgctccggatatagaaagtatatttgtcatgtcgagtccggaatatggctatgtgtcgtcttcgatcgtgcgcgagcttgcctcatttggttcggatgtggatctgctcgtgccgccgagcgtctcctgtgccttgaaagagcattttgcacaggcacgctgatacacgaaggccgcatgaagcggtattctggtacggaatatgaagtgatgccagaaggggcatgctgccccttgtgtgtcctgaaaggagccgagaatgcagccaggtgaggaaaccgaaagcctgctcgatgagcttgagcagcttgtcacggaggcgaagactccccttaccggtggtggcggccgcaagatcgtggatgcgaacgacatctacgagatcatcgacgatatccgccgtgtcttcccgacggagttccaggaggcacgccgcatcgtcaaggagcagcaggagaccatccagcgtgcgcagcagcaggcggattccatcatcgccgatgcccagcagcaggccatgatcctggcaggcgaccaggaggtcgtgaggattgcccagcagcaggctgactccatccgcgaccaggctgcccagtacgagcgcgatacccgctacaacgcggaagagtatgccgacacggtgcttgcacacctcgaggacaacctgaagtcgctcacgagcacggtgacgcgcacgcgccagacgctctccgagtactcgggcccgcgcaacaacacgaacgatgtgccttggtagcgtgattgcatgagcagagatttcaatatcacgattgcgctcgatgagcgcctggccaatcccggcgattccgtgccccaggtcgggcatgtggatatcgacggctatagcctgggcgaccatgacttcgagctgccgggcggcttcgactacgatgtcgtgctgacgaatgccggcgaaggcatacttctcacgggcatcttgaaggctcatgtcgtgggaacctgcgaccgctgcctcgagcctgccgagttcgatgttgcaggagaggtggacgagtactatctcttcaaggctccggacgatgcggccgagcaggtgagcgaggacgaggatggggaagaggcaggcgtcgactatgcgctcgtctctgacgattccacggtcgatatcaccgatgccctcatgggtgcgcttctgatggatacaccctacgtcgtgctctgcaagcctgactgcaagggcctctgcccgacgtgcggcgccaacctgaacgaaggcgactgcggctgcgcgaagaagcgcgaagaggaagagcttgcgcagaacccgttcgccgttctgaaagatctccatctggacaagtagcaccgaataggtccaagatgtagaattgctgttcgcgcgcatcgatagcatgtgcgtggtatagtgtcttattgtgtgtttctgaggcaagaccgccggtatgcactccggcgtcagaaggtcaaagagaggttaagatggcagtacctaagcagaaaaagggtcgcggcgccacgcacactcgtcgttcggccaacagcaagctcgccgctccggctcgttccatttgcccacagtgcggcgcacctaagcttccgcatcacgtgtgcccgaactgcggctactacaaggaccgcgaggtcgtcgtcaccgagtagttcgcgctatccaacagagacgtggcctgggaggccggcccttctggggccggcctccttccttatggggccaggcaagagatgggagcagacatgacagccatctgtgtcgatgtgatgggctcagacaaggggcccgaagtcgtcctcgaaggcgtagcgcaggcgctcgccgccgattccgacctgacggtccttgtggctggagcagacgagtatgtcacgccgttctgcgagaagcatgaaggagcaagtccgctggtgacgaccgaggtcatccatatggacgagcatcctgccaatgccatccgcaccaagaaggattcaagcatcgtgcgcgcatctgcagccgtgcatgcaggcgaggcagagggactctgctccttcggctccacgggcgccgtccttacggctgccaccttcggtatcggccgcatcaagggcatcaagcgctcggcgctcgcattgccgtgtcccggcgtcggcggccacaagaccgtgatgctcgacctcggcgcgaacgccgatgtgaagcctgaggtcatggtccagttcgcccatatgggacgtgcctatgcaaaggtggcgctcggcaccgacgatccgaaggtgggcctcctctcgaatggctccgaggatacgaagggctccgagatggcgctcgcataccatgcggcgcttgccgagggcaattgcggctttgtcggcaatgccgagggcacggatatcctgaacggcacgttcgatgtgatcgtcacggatggcttcacgggcaatgtggcgctcaagagcatcgagggcacggccaaattcctcgtcgcgcagatcaaggagcaggcaggctcttccaagaagacagccatcggtgccctcctcatgaagcccgccctcaaggctgtggcatcggagctttccggtgaccgctacggcggtgcggtccttctgggccttcgcgctcctgtcgtgaagggccatggctcctcgaatgcagcagctgtcaaggcagccacgcttgcctgcgcagaggtcgtgcgcgcccgtctgccgctcgagatccagcaatcctgcagcctcacgaatgaccgggtacaataggcctcgtatatccagacaagagaaaggcggagctcatgacccgcgatgagattcttgcaaaggtgaaggacatcgtcgccgacacgatcgacggcgccgatgcttcgaagatcacagaagccacgacgttcgaggacctcggtgcagattccttcgaccgtctcgagcttgtcacggccttcgaggaagagttcgacgcaacgcttcccgacgaggtgcttgcgagcatcgactccgtgaaggatgctgtcgacgcgattgagaaggtcctgtaggtgcaagagaacaattcagctgcatacgtagacgagcacgtcgctgctgcagagaagatgcttggctaccatttcgagaaccgtcagctcatcgtctctgccatcacgcatccatcggctgtggagaacgagcctatctgggcctcgtatgagcgcctcgagttccttggcgactccatcctcggcgcgatggttgcgaccgacctcttcgagaagttcccgaacatggacgagggacagctcacgcgcctcaagatctcgcttgtctcgggagcgacgctctccgaggtaggcgaggctctgggcatcggctctctcatcatcttcggcgagtcggagaaggggacgggtgcccgtggcatgcactcggcgctcgagaacgtctacgagtccatcgtcggcgccctctacctcgatgcagggtatgagcggacgcacatgttcgtgcgcgatacgctttcgccctacatggtggcagagcgtgcacagcgcccgctctctccgaagagcaggctccaggaggtcacgcagaaggacctcaagtgcgctccggtctacaagctcgagagcgaggaagggcctgcacacaatccgacctttacgagtgtcgtgcttgtgcagggcagccgcatcggacgtggatccggctcctcgaagaaggagtccgagacggcagcagcagaagatgcactgcgccgtctcaaagagaacttccgcaagccaatccagtagcagtccttttcctcccgcatccgaaaggctttcccacccgtgtacctcaagtcgctgaccctcaagggcttcaaatcatttgccgacaagaccagcatgacattcgacccaggcctgaatgtcgtggtgggaccgaatggcagcggcaagtcgaatgtctccgactcgatcctgtgggttctgggagagcagtctgccaagatgctccgtggccaggctatggaggatgtcatcttctccggctcctcggccagacagccggtgagcatggcagaagtcacgatcgtgctcgacaactcggaccatacactgccgatcgacttcgacgaggtggggatcacccgtcgcatgtataggtcgggcgagtccgagtatctgatcaacggagctccggcacgtcttctcgatatccaggacatcctccatgactcgggacttggcaaggacacccattcgatcatctctcagggaaagctcgattcggtcctcgcaagcaggccggaagatcgccgcgagctcatcgaggaagctgccggcatctcgaagcacaggaggcgcaaggagagaagcgagcgcaagctcaagagcatggaccagagcctgacccgtgccaaggatgtgcagcgcgagatcacgcgccagctccgcccgctcgagcgccaggtcacgaaggcacagaagagccatgagatccaggaccgtctctccgaagtcacgcagatcttggctgtggacgatcttcgccagctccaggcgcagcatggaatgctccagcagcgccagaaggaagctgatgccgcggtcgacctcggcaagtaccagctccagaagaagaccgacgagctcgaccatctccaggcattgctcgaggagaagggccttttcgtaggcgacctcggcgagcagcgccgccatatgcaggacatccagtcccatctcgactcagacatccgcatcctggaggagaagggcaagaacatggtctcccgcctctccgagatgaggtcgagcctctcgtccatggagaagcagaaggcagatgccgcacgcgagctctcggagatgcagggagatctctctgatgcccaggtgcagacaaacgagctcaagcgtcaggtacgtgagctcacgcctgaagtgcagaacgcagccaacaggcgccgcgagcttggaaaccgccagtcgaagctggtgggcgagcagcgcgcagcgcagcgggaatccgaccaggagaccgtcgcctatgcgcgtctcaaggaccagatctcgaatgccgaggtcgaggaccagatgtatgcaagcaggatctcaagcctcgaagagacgctctccgtctgcgaagagacgcttgcagagaggcgcggacgcaaggctgagctcgaagaggcgaggaccgctgcgcaggaacgtgcagatgcggcccatgagacgatccggaagagccaggacgaggcagcagatgcacggcgtaccctcgaggatgcacgccgcaagctctcgcaggccgaagcctcgctttcggcgcttcgctcggtcgatgcttcgcaggaaagtgcaagcccgctcgcaggcgctcttgccaagcgcggcgatgtgaaggagaggattgtctgccgcctgggcgatgcgctcgatgtgccgcctgagctcgatgacctcgtggagcgccttctgggcgacgatatggcagcccttgtcgtggaggatgctgaggatgctgcaacggtagcgtcgtctgccctcgggatccacggcgccaagggaacggcgacgatcgtctcgaagaaggcagcagccacagagctcccttcaacagacggcgtggcagggatggccctgatcgattctgtccatgcacagaagggtgcagagaagctgctctccgctcttctcggcgatgtgcgcatcgttgacactgcgcgtgcggcaatagaggcccatgagcagtggcctgcctataccttcgtcacgaaggacggcgtcacggtgcttccagacggacgctgcgtcgtcggctccggccgtggcgtcgagcagggcgcccttgagcgcaagcgccgcatccgtgccctcgaggacggcatgggagcgctcgaagcggcacagaaagaggcagagaccaaggagcgctcgctcgagaaggcgctgtccggtgcccgcgacagcgaggccaaggcaaagggcgagcttgctcagacccgtgccgagctcagctccgtgacctctgagataggacgccttgagcagcaggcacgccaggcagcatccgagaaggcaggcgtcgagaagcgccgcgaagaggcgaaatcgaaggtcgagaaggcacgctccgaggtggagctccatcacggcaaggcagacgaggcagctgcccgcgtgaagaagctcacagaggagctcgacgacctctcgagcaagcgcagcgaggcatcgcgcgaagagtccgatctcgagcgcaagctctccgacgcgaagctcaggctcgcgacggtcacggagcgtcttcgtcatctcgagacaaggacgaacgagctcgagaagagggacaagacgctcacagagcgcatcgatgccacaaagaaggcggcagaggcgctcgatgtgctgcgcgatcgcgtggacccgctccatcagcgctaccgtaccctcatcgaggcagcagacgagtggggacgtcgtctctccgatcaggcaagcctcgccgaggcagactctgaagacctcaagaagacgatccacgaagcgaaggcagcagtcgatgaggcctccgctgcgctcgaacgcgcaaagaccacgtcgcaggacctcaaggtcgaaggcggcaagctcgaggtgcaggtcgagaacgcgatcaatgcgattgcacagacaggcgccgtgctcgaggaagcgctcaatctcccggagcctgaggacaggggagcgctcgaggaggagcgtgactccctcaaagcgcagcttgccaagatcggcccggtgaacgaggtcgccatggatgagtacacgcagctcaaggagcgtgcagactacatccacgagcaggtggaggacctcgagagcgcacgggcctcgcttgcgaagatcacggctgccatagagcggaagatgaagaaccgcttccttgcggtcttcgaccaggtgaacacgaacttccaggacatctttgcgatgctcttcccgggagggcatgcccacatcgagatgacggacccggaccatctctccgagaccggcatcgaggtcgtggcgcagcctgtgggcaagaggattgcgaagatgacgctcatgagcggcggcgagaagtcgctgacggctcttgccctcctctttgcggtctacaagacccgtaccgtccccttctatgtcttcgacgaggtggaggcggcactcgacgaatcgaatctcgggaagctgctgatggcaatagatatcctgaaggaatcgacgcagctcatcgtcatttcccaccagcggcgtacgatggaacaggcagatgtcctgtatggtgtatccatgcaggcggatggtgtgagccatgtcgtgtcgcagcggctggatcatgctacaggaaaggtggtcgatgcctaagatgggactttttgacaggctgaagcatggcctctcccgctcgcgcgaggccatgaacgagctcttctacatgggcggcgaggtcgacgaggagttctgggagaacctcgaagacacccttgtcatgggcgacatgggagcagaggtcgccatgaaggtcacagatgacctgcgcgaggaagcggcaaagaaaaatctgaagacagcgccgcagctgagggaagccctcgccaagcgccttgcccaggagtttgcgcctgtggagcgcgaccccttcaccgatcttccgtccgtcgtcctctttgtcggcatcaatggcgccggcaagaccacgaccgtgggaaagcttgcgggagatgcccacaggcatggcaggagcgtcctcatcggcggcgccgatacgttccgtgctgctgccatcgagcagcttgaggtctggggcacaagggtcgatgtgcccgtcatcacacgcgagaggggagcagacccggcgtctgtctgctacgacgtcgtcgatgcggcagagaagatgggggcgcagcttgtcctcatcgataccgcaggacgtctccatacgagccccgagctcatgcgcgagcttgccaagatcgtgaacgtcacaaggaagcggagctcctatcctgtctcggtcgtcctcgtgatcgatgccacgacgggccagaatggccttctccaggccaaggaattcaacgatgccctcgatgtggacggcctcatcgtcacgaagctcgacggcacggcaaagggcggcatcgctgtcgccatctctcatcagctgaacctgcccatctaccgcatcggcgtcggcgagggagcggaggatttccagtccttcgatgccctgtcgttctgccgtgcgcttgtgggagagaacgaagggaatcgatagatgttcaacagcctttctgaccgcctgcaggacaccctcgacaagctgcgcggcaagggccgcctgaccgaggacgacatcaatgtcgccatgcgcgagatccgtatggccctgctcgaggcggatgtcaactaccgcgtcgtgaaggacttcgttgcctcctgcaaggagaagtgcctctcggccgaggtcctggactcgctcacgccgtcccagaacgtcgtgaagatcgtcctcgaccagctgacggagctcctcggcacgaccgagtcgaagctcacgcttgcccagaacaggacacccaatgtcatcatgctcgtcggcctccagggctccggcaagacgacggcggcatcgaagcttgcctatctcttgaagggccagggccacaagcccctgcttgccgcctgcgatacccaccgtcctgctgcagcagaccagttggagaccttgggcaaggagatcggcgtccctgtctaccgtggtgacggcaaggacgctgtcaaggtcgcgaaggagtccatcaaggctgctgtcgacggcatgaacgacatcgtgatcgtcgatacggcaggtcgtctccagattgacgaagagatgatgcaggaggctgtcgacatcaaggatgcggtcaagcccgaccagatcctcatggttgtcgatgccatgaccggccaggacatcgtgaacgtcgtctcgaccttcgccgagcgcgtcgacttcgacggtgtgatcatgtcgaagctcgacggcgatgcccgtggcggcggcgcactctcggtgcgtgccgtgaccggcaagcccatcaagttcgtgtccatgggcgagaagccggattctctcgaggtcttccatcctgaccgcatggcaaagaggattctcggcatgggcgatgtcgtgggcatcatcgagcaggcccagaagacggctgacgagcagtccattgcagatgccgagaggatgctgcgcgagggctttaccatggacgacatgctgacccagatgcagcagatccgcaagatgggcggcgtcaagaagatcatcgcatccctgcctggtggcgagcgcatgctcaagcaggcaggagacatcgaggacgagaagcagctcaagcgcatcgaggccatgatacggtcgatgacaaaagaggagagggcacggcccaagaccatcaatggccagaggaggaagcgcattgctgccggttccggcaggactgtccaggaagtgaatcagcttctcaagcagtggagcgagatgaacaagatgatgggcaagatgcgccagatgagccagcaggcttcgaagaacggcaagatctccaaccgccagcttcagcagatgatgaggcaggcacagggcatgggcggcatgcctggaatgggcggcatgcccggcatgggccgtggcggcaatcgtgcttccagaaggcgcggctggtagctcgtacctcatgctcaactgcatataaagcgtttggtcagagcctcccatgctgggaggctcttcctgttagattcccgacagcgcgaatacctatttctgtctggctcatggtttagagtgctgtatgaaagcgggactcctatcgatatgcctactgcagcgggtgatgaggatgtcggaagaagcaaaggtacagcatgtgctctccaaacaggcacgttccctctggggcaagacaggcgagcccaatgaagagggcgatccgacctggcttccactttctgtccatctgagcgatgcttctggcattgcaggcaagctttgggatcaatggctcccgaaattgacacgcaaagtcattgctggggcatttgatggagacgagcagcttgcgagggctttcgtcatcttcatctgcggggctcatgatgtcggaaaggcaactccgatcttcgaggcgaaaaccgatctgcggagcatgccggaagaggctggcctgcatgttcgagagaccttacgaaatgagaaagatccgacacaccctatagccggcgagattatccttgccgattacctcgaatccaaggtcttcggcgaagaagagcagcaggattcctggcactgcaagagacagatagacgccatcgcaagcatcatcggtgctcatcatggcaacttccccagcctttcccgcatcagcgatggagaaggcaagctggtggagcttggatggacagaaagcgccggcaattggaaggaagtccagaacgagctcatcgatcatgccctgagcatggcaggtatcgatgaagcgcatctccggagaattgcccatcaccatctgactgtggctacagagagcctggtagacggtttcctcatcatggcagactggctggcaagcaaccaggaccttttccctacctgctctgtctatgactcgattggcgatgaaaagctgaagggaagagttgatagagcctggcagaacgcatcgatacttccgtcatggaatgaagagcctcctgtcgtgcagccgttcgaagaatacttcgcatcgagattcaatcttcctgcaggggcgcatgcacggcctgtgcaggtcgctgctgcaaagattgcttgggagacgaaagatcccggactcctcatcatcgaagctcctatgggagagggaaagacggaggcagctcttgctgctgcagagcttatggcatatcgctgcggcatgggcggcgtctgcgtggctctgccgaccatggcaacgaccgatgcaatgtttagtcgtgtcgatgaatggcttgaccgtcttcctcaagcagaaggaggggatgagaaaagcatctatctggcacatggcaaatcgcggctgaacgagcaattccagggcatcatcagagaatcttggagagcgtcccgcaaggtccatacagacgatgatggcaaagcggatggtgtgacaatctctgaatggatgctgggacgcaagcgtggcatgctttcaaactttgtggtctgcacggtcgaccaggtactcatgggagctctctgcatgaggcatctgtcccttcgccagcttgccataacgaacaaggtcgtcatcatcgacgagtgccatgcctatgacctctatatgcgccagtatctcgaacggcttctggagtggcttggattctggcacgtgccagcaatactgctctcggccactttgcccaccggtcagcgagagagcatggtcagatcatatctttctggcagaagggcagctgaaggacctgcggaaaacaagcctgcgaaaccactgcctccatatctcaggaagaaattggcctctgctgtttctgatgaatcggccgctgcggatgaacctgcactcgatgcatatccgctcctgacctatacggagggactaaaagagaattggactgaagttccagcgtctggacgcagcgtcaccgtcagtgccgagtttatcggagacgatatcgagactcttgcagagacattgaagcagctcctcaaggatggaggctgcgcaggtgtcatctgcgatacggtcggtcgtgcgcaggcagcagagcgggcgctttctggatgcttcggacgggatgcagttgtgctggatcattcccgtttcatggatacagatcgttttgcaagagagaagagcctgagggatgaattgggcccagaggcaactgtcgagaatggcaagaggccaggacttcttatcgtcgtcggaacacaggtcctcgaacagtcgctcgatatcgatttcgatgtgcttataagcgatattgcaccaattgacctgttactgcagcgcttgggcagaacgcacaggcatgcaagaggagctgcagaatgcagtcgcccagagccgctgagatgggctcggtgcctcatcaggggcatttccgaatggaacgatgatggtccgaaattcgcatcgggggtagcaaatgtatatgaccaggcgacgctgcttgaaagcgttgcgatgctggggatggcagatgaaagggcagacacggaaatttctttgccacatgacataccgcggctggtcaggactgcatactccgatgcaggcatcctcaagggaacaagtccatatccgcctcccctcatcgcagagttatcgctttgctagctataaatataaactcaactgttatgtgaatgtaattctatccgcgaacggtagcaaaccgctatgaaggaatactccaagaccttgcattgagctcagtctgatactcgctattctcccctgatgcatgacaagaagaagctgtccggcgagcatggagactgctgccagcatgatacgtatggccacgatttgtcttctagccatggatacgttgtcgatgtccttgagcgggcagatagaaagaggcagtcttacggcgcactgcagcaagagcgatgccgctgcacgttccggctcgccagtcacagggaagctgcgctccctttggcacatccttgctgccaacccagggatgagggcgatgccgcaccctctgtctctctaaccagcagcattcgacagtttctgcgtatcgcggacagcacgttggcctttgtcggagtctcttggatcttcttccagcacctgctgagattcggcaagctcgatcaggctgccatcgttttttgcactttagcaacatcatgcgcaggtatgtctgcgccctttccgtctttccctcgttctttttcgatcttcttttgcaggctttctcatacctcgccatccagcatctgggaatgagcgccttca

SEQ ID NO: 89 - DNA, 13436 bp, Unknown
  Metagenome-assembled genome
gggggatagggaaaaaatgcacacaacggcgcaaacaaggggggggtaattgcaatgaaaactaccccggcaaaactagtgcacaaaagtcagaggacgtacagccatcaaggacgagactatacagtctggtaggggatgcactcggcgcaggcctttgcgatctctgcccagccggtgagcgttgtgacaccggtagcatgcccgtggcggcactgtcccaccagggagcaccgagaccggtgaaggcaggcacgaagtagctcctgtcgttcggattggcctcggagatgagcttttcaagctcgctcgggctctcgatcagatggacccggtccttcaccagcaggaacgacagcaccgttgtagttgaggtttccttcgagcacgtaggagagcctgccttcgaggttccaggcaatgctcgagacaaggccatggtctgtccggatgggatctctcctggacgcatgacggaagagccggtgccataggtcgccttgacttctcccggctggaggcagtcctgggctgcaacgctgcctgggatcaccgagcatgcatggagaggcacaggagccgcaagtgcgccattgaagtcagagacaccgaagagggcatcggacgcaagacttgaggcagggaagagcgggggatgccgaaaagggcgagaaggtcctcgtccacatcagccgtctcaagtcagaagctgggtcctgcaggcatttatggctctgtcacgaagggatggcctttgcagaggctgtaggcagccaggagtcgtttgtgccgaagcagagcgtgcctgtctttgcagcctcttggacttctgcacgttctggagcatccaggacatcttggcggcagagaagtagggagaaagggcgaggcctgagcgctcctggacaagctcctctgtaccaggatgtgtcgtcttgagctcttcgcagagcgcagcggcgcgtccgcactgccagacgattgcgtgtgtcaggggatgtcctgtcgtcctgtcccaggcgacgcaggtctcgcgctggttcgagatgccgagcggcgatatcttccgcgcgggcaccggactcctcatcagcgcttcgacgcaggagcagacgtttcccaagatctcttccgcatcatgctcgacccaccctgttgttcacatactgcgtgtggggcagggaggtctttgccaagggagccatcctctgaagaggagcgccttcgtgccctgtgtggactggtctattgcgaggatgagctttcccatcgctacttgctgcctttccgagaagcttctctgcagatgctgcatgccttctgcatcgaggccgtagtagctgaagacctccttcgaggtgccggtgacgaccggggcatcaggaagcgagaggttctcgacgagtcgcgggcagctggaagcgaccgtctgggcgacacggcaccgagcccgccatacggcgagtgctcctcgaccgtgtaggaccgcctttgcgttggtggcagccttcacgactgcctcttcatcgagcggctttacgcagtacatgtcaaggacggtggcagagatgcccttggcctcaagcagcatgctgcagcatcgagtggctggacggacgagctcgcctgtggcgacgattgcgatgtcgtggccctccttgagccaggttgccttgtccatctcgaagggcaggagtcctcggtgtagatatcctcgacggcgttcctgccgacacgcacataggcaggcttttcgtccttcagaagggcacggatgagcttggctgtctggagcggtcgctcgggagatagacgcgcatgttcggaatggcgcatggctgcgatatctgtgcggagtgatgggacatgcccaaggcaccataggagatgccgccggagatgccgatgagcttcacgttcgtatcggagtaggcgcagtcgacctttgcctgctcataggacctggtcgtgaggaagcttgccggcttgctgcaaacggcttcttgccgcaggagggagaccggcagcaatgccgacaaggtcctgctcggcgatgccgacctcgatggcctgctcaggatacttgtcgaagaaggccaaggagcagagcccctcgagtcggaacagaggacgcagacgtccttgtcagtgtggcagcctccatcagcacacgcagatggcctgcttgttcgcatcttgttaggcatggcactcctccttgtgtgctgcgaaatctgcggtgatctgggcgtactcttctgtattcggcaggtggtggtgccaggatgccttgttctccatgacaggggagccgaagccctttgtcgggttggcaatgatgacggtaggcttgcccttcgtctcttcggcaagcgagaaggcagcatcgagcgctcggatgtcattgcccggaaccgagaggacgttccgccgaaggcggcccagcgctcttcctggagtcctgcttcataacgtcttccgtggagccagagatctggagacggttcctgtccacgagggcacagaggttgtcgagctcgaagttgccgcccgacatggcacttcccagacagagccttctgcaagctcgccgtcgcccatgaagacataggtgcggtagttctgccatccatcttcgcggcaagcgccatgcccacagcgaccggaaggccatgtcccagggagccggagttcatctcgatgccgcaaagctgttgttcgggtgtccgatgtaggggctcttgaacttcgagaagcgtgccttcacatcgtcgaggtcgaggaagccctcgtggcagagcacggcgtagtaggcctccatggcatgtccttgagaggacgaagcggtcacggtcggggtcatccaccgtctccggcgtgatcctcagatggttctcgtagaggaccaaaggcatcgattacggacatgtcgcctccgatatgtccccgcctcctgccatgatgatatcgacgcatcctggcgcaggtcccagcgcagagctctcgacttatcgatttccacagctactccccctcagataggccttgatgtcatcttcgatcgggtcatacagatcgggcgtgatgcccagatacttgcaggcttcatagagcaccggcacgacgtcgtgctgccggcacagtggtggatgtgggtccctccgatctttgcctcgaggcgcttgatgttctgtacacacgaccaaataggggcccatgcccttcggtccgtcgatgccctgccgtgcccagcagcatcgagtactgtccgttgtccccatcgaagcgggccagcgtgaccgtgccgtgcttgcctcgtggcgtcgccctgcgtgagtcgtgtgtcgaaggcaagcagaggcgtcgtgatgaccggctttctctgtgccacgagcagggccacggtccgcagtgctgcaggagctcgcgttgggatcgtcaggatggcggatggtccagtcggcaaagaatgagcgcttgcggcccatgtcagcagcctcgatcatgagggaggtgatcgcgccgtggacatcggtctccgcgtgatgggcgtgccctcctcgttcaggatcgagttcgcggcacagggctgatgcccagctcgtgctggactcgttccagcactggatgcagccagccgtgcagtggtacttcctgagcagcggcgtatcgccacggccatggctgcaacgggtcgtacctgctcgttcggcagttcttctcgaagtgctcagagatccaggcaagctgcttctccacatcgaggtcccgtcgcccttgtcctctgcaagtgctgccttcacgccgcgggtgagctcgggcaggggcactggcacgcactcgatgccaaagcgctcgaggagctcgccctcgttgcccatcgtggagtagaactcatagggacgcggcccgatctggaggatgcgggcagagcggaaggtcttcacgacatgcagacggcaatgaagtcgcgcagtccccgttcgaagacggatcgtccaccctgcagtttgtcatgtacgtgaagggcacctggaagcggcgcagtaccttgcgggtcgcgagagtccgcactgggtgtcgcgcaggcgggtgccatcagcctcggggcgctcatcgacggtccccagaaggacgggcttgccaaggtccttggcaaggcgggcgcagatgaactcggtgccgaagttcagtgggggaggaacaggccatcgactcctgcatcctggaacttcttcaggaccttgaggcggtctcctcgtcgtagagcagccttcctcatgatatcgtcgatatcgacgaactccacgccgagctcacgcagcttgtcggcgatgatggcacggtacttccttgcatcgggcgcgctgaagatgcttcttgcggtcggtgcatagccaagaacgatcttgtccatgaggctcctctcctctgtctccgcatccgccattcagcggattggaagggcaggtttctttcctgagatagaggatatggatgaactcggctacacttaacgagtagacgctattactaaatatttagctctaaacaagttgaggagagcatatggcaggaaaggtcacggcacgcgatgttgcaaaggcagcaggagtctctccagcaacggtctcgctcgtgttccgggatcgccctggcgtcggtgcagagacaaggggccgtgtgcgcaaggtggcagaggagcttggcttcgaatatgacatgccgtccacacctcgcaagaccagtacgattcttcttgtcatctacaagcagcatggccgcgtcgtctcagatacccccttcttcgagtccctcatcaagggcgtctcagacatgacatacaagctcggataccaccggctctccgtctcctacttctattcgcaggagaacaaggcagaacagatggacagcctgcgctccatcaagtgtgccggcatcgtgcttctggccacggagatgcgggcaaccgatgtggcacagttcgagcatctgggcgtgcccatcgtccttctggacaactggtttccgacgaagaatctcgactccgtcgtgattgacaactcccgtggtgcctggacggctgtgcgctacctcaggaacatggggcataccgatatcggctatctccattcccgtacagagatcaggaacttcctcgagcgcaaggatggctacattcaggccatgcgctacttcaatacttccgatatagatccccgtcacacaatcatagaggtcggctccacgatggagagcgcctatgaggatatgaaccgctatcttgacgggaatccatatctgccgactgcctactttgcagacaacgacctcattgcgatgagctgtatccgtgcgctcaaggatcacggcatcagggtccccgaagacatctctgtcatcggcttcgacgacgtttcgacggctgccatagcagatccgccgctcacgaccatggcggtgcccaagacgaatatgggcggtctggctgtcaggcgtcttgtcgagcatgcgaaaggcgagacaggtggcgaggttgtgcgcatatcggtcctgccggagattgtccagcgcgaatcggtcatgaaggccgaggaagacgcttagatgaatgcagattgctactagcacaatccataaatctgtgcaagtaattgagctaaatattcctaaattctcgtaaacatgctactaaatccattgaagagtcaaggtacagtcccgcttctgtaatcttcatgtcagcaagtaattccgggtgcaggcaaggaggcctgcacagaggaaaagaagggggattcaatggcagtcgattatcagaagattgctgagggcgtgcttgccaatgtaggaggcaaggataacgtcgcttccgcgacgcactgcatgacaaggctgcgcctgaccttcaaggacaagtcgaaggtcaacagcgacgcaatcaagggcctcacgggtgtcctgggcatcaactgggcaggcgagcagctccaggtcatcatcggccaggctgtgccgaaggtctatgacgcggtgctcgcgatgggagttgccggcggcggctccatcgacgagaacctcgatgagaaccttacgaaggagaagctgacgccgaaggctgtcggcaacaagatcctcgactatctctccggctccatggtgcagatgatcccgctgatcatggcatccggcctgttccgcacccttgctgtcgttatgggtccccagatgttcaatctctgggctgccgattccggcatctacacattcttctacgcgacactctatgaggctggcttctacttcctgccgatctatcttggctactgcgcggcaaagaaggttggcgccaatccgctgctcggcctgctttccggcggcatcctgattgccccgagcatcatcacggcggcaacagctggcacgaccatcaatgtctatggcctcgatatcgcagctgcaaactatagccagtcggtgcttccgatcatcctcacgattccggtgcttgctgtcgtcgagaagttcatgaagaagcacgtgcctgaagtcctctcgacgctcttcacgccgttcttcacgatgatcgtcgtcgttcctatcgagctcatcgtccttgctcctatcggcaacctcatcggccagggcatcgctgctatcatcttcggccttgctgatctcggcggcatcggcgtcctcatcgttatggccatcctcggcgccttctggcagctcttcgttatcgccggcatgcacatgcctgtcatcctgcttgcccaggtcacgcttctccagactggcgtcgacccgttcctcttcgttgctacgaactgcgctatgaccgccgtctggggctgcgctatcggtgccttcctgcgcatacgcaacaaggaggagaagggcatggcagcaggatacgtcatctccgctctcctcggtggcgtgaccgagccggcactcttcggcatcctcatgcgtttccgccgcaccatgcttggcatgttcatcggcggcgctgtgggcgcagtcgtctccggtattctcggcgttcacctctatgtcggtgccatggcaacgaacttcctcgtcttcctcggctatctccagggcggcaccttcaataccgttgctgctgtcatcggtctcaccatctcctgcgttgttgctgccgtcgtcgtctacatgactggcttcacgaaggaagagctcgatgctctcgacaaggagaagcccggccagatgacggccgagtaagagctgctccatgcaccagatctgaagcagaacaaagcggacagtcgggtcagcgtgcctggctgtccgctttcatgaagggaggcgtatttaagctatggctgaagcggagaatctgcaccgcgaagcagagacctggcgcgaggtcgtgctgcactttgagtcggcccatccgttcagagatcccgtcagggactgctgcgtcgtcgcggacttcacagggcctgagggcatgcatatccagcgggaagcgttctgggatggcggatgccgcttttgcgtgagctttgctgcaccgaagccaggaacctggacctggaagctcgctgctcctcccgagagcgggcttgacgggaaatcgggcacgattgtggctgctccctattcggggaatcttcccatctaccagcatggctttctgcgctgtgccaaggcaggcgagctctatgagggtcagcctcttgcgaggaatatcctggtccatgcagatggcatgccgttcttctggctcggggatacgcactgggagttcgcgctgggggagagctgggacgcatcgaaccatgccggcatgagaagccagttcaggggcatggcggacaagcgtgcagagcaggggttcacggtctaccagacgaacctgaggagcgatttccatgagcacagccgcttctggctgacgagagaggacgcagagcatcccatccccaatcctgctgtctttgcagaagagatcgactgccgcatgcactatatcgccgaccttggcttcgtgaatgcgcttggctttgcctggggaagcagcatggaggcagagcctgatgccttcggagctgctacgacactggcggagcagaagacgcttgcacgctactgcgctgcccgctatggagcattgccacttgtctggaccattgctggcgaggcttctggctacgatccttctcgacacgacttccttgtctcctgctggagcgaggcagcacgtaccgtgcgcaggcatgatgcctaccggcagccctgcacagtgcactctgtaaatgagcggccgttctcggactgcttctacggagaggtctggtacgacttcacgctcaaccaggcagggcacggtgacttcgtcgtggctgagtccgactaccgcgacttcatggagcggcaccccgagaagcccttcgtggaaggggaggcgctctacgagggatgctcctcgctcgaggagaacgggagccgccgcatcgatgcctcgatgcttcgccgtgtggcctatatcaccatgcagctcggaggagcaggctatacgtatggcgctcagggcatctgggacaacatctggtcccaggtcgacctgtcgaagtctcctatggcccgcatgatgacagagatcttcaaccgttacggtgtcacctggacagaagccatagacttccccggtgccgatcagatgggcatcatgcgtcgcttcttcgaagagcagaagtggtggacgctcgagccttatgggaagggcggaagcgcgcttctgggcaggaaggcacctctggctgcaaagaacgcggacggcacgcatgccgtggcatactatgcggcaacgacgagaaagccgctcgagcttgctggcttgaaggatggctcctggctgctgcggtggttcgaccctgtgcggggcgtctatgcaggagaggaagtccggcagatatccggagggcgcatgcgcctgccagacaagccgacgatggacgactggctgcttgtcctcaatagggcagacggcctgtacaagatgaggatggagcagagcaaatgagcaaggtatcaatcgaaggaatgcatcttgtccgtgacggaaagccgttcttctggcttgcggatacgatctggactgccttcaccaatccgacagacgacgagtggatagcctatctcgaccagcgcgccgcacagggcttcaatgtgctccagatcaatgcgctggcccagtgggatcgtgcacaggcggctttcgaccgctatccctaccagacgccggaccacgggaagaccttcgacttcactcacgaagccggacgcttcctattggggagcacgcgcgctggcagcttgccgaggcggacgaagcgtggttcacgcccgccatcgtcgtccagtgggcaacagtccccaataactgggctcgaacatgatgcctgacaaacatcatccctgacgatctggtcgagccggtcgtgaagcagaccctcagagcttcaacgagttcgaccccatctatatcatctcgggcgacaccgatttcgaccacgaggagccgatcgagcgcatatgcatgtaaccgacctggtggagcgtatgcaccggatgccctcaagtgctatcacaaagggccgttacgacgggctgccggagtgcctggccgagcgtgcagatatctatctctatcatcgggacacaaacatctcggcgcaggcaggtgcctacgatcttgcacggagctttgacgggcaggccacagagaaagccgatacatcaattcggagcccgctatgagcagatgggctactgcatatggtctatggacgcttccgccgcgcaggactgccgccgggccctctggctctcgcttatgggcggggagcctcttgatgcgtgacctatggcgcgcacgcgtatggaacgggagaccggcgttctcgagggaggcttccttcggcgaaggcttcctcaaggccctgccgcatgagcagggaatccattttgcgggagcctgggatttctcatttgcccgccacggtcgcagagggctgggcctgctgagctcgagcctgcgcagggagatgcatggcaagccgcacggacgatgttttcgctgccaggaagcgggatggaacgacgctgtgcatctatgtgccgaccaatgcgaccctccgatcaagggagacctcacgcaggcgcatctcatggtcgagtggcagagcatgaaagccttccgcatcgctgcagaatatggcgcagagagggacgaggacgctgatacatcagagctctgcgatgagagtgcactctctagcaggagctctgagagatcgcgtccgtgcgctctgcgcctgcatgctagccggaaggctttcatgctctgccaagtcgagcgcatggagatgcgcctgcgtgagtctcccttgatgcggagggtcgcattggtcggcacatagatgcacagcgtgttcatccgtgtctggcagcgaaaacatcgtccgtgcggcttgccagcattcctgcgcaggctcgagctccagaaggcccagccgctctgcgacgtgcgggccaaggagaatcccaggctcccgcaaaatggattccctgctcatgcggcagggccttgaggaagccttcgccgaaggcaaagcctccctcgagaacgccggtctcccagttccatacgccgtggcgccataggtcacgccagcagaggctcgcccataagcgagagccagagggcccggcggcagtctgccggcggaggaagcgtccatagaccatatgcgagtagcccatctgctcatagcagggctccgattgatgatcggcttctctgtggcctgcccgcaaagctccgtgcagatacgtaggcacctgcctgcgccgagatgttgtgtcccggatgatagagatagatatctgcacgctcggccaggcacccggcagcccgtcgtaacggcccttgatgtgatagcatgagggcatccggtgcatagcgctcaccaggtcggttacatgcatatagcgctcgatcggctcctcgtggtcgaatcggtgtcgcccgagatgatatagatggggtcgaactcgttgaagtctgaagggttgcttcacgacggctcgaccagatcgtcagggatgatgttgtcaggcatcatgttcgaggcccaggtattggggacgtagtgcaccactggacgacgatggcgggcgtgaagccacgcttcgtcgcctcggcaagctgccagcgcgcgtgctcccaataggaagcgtccggcttcgtgaagtcgaaggtcttcccgtggtccggcgttggtagggatagcggtcgaaagccgcctgtgcacgatcccactgggccagcgcattgatctggagcacattgaagcctgtgcggcgcgctggtcgagataggctatccactcgtcgtctgtcggattggtgaaggcagtccagatcgtacccaagccagaagaacggctttccgtcacggacaagatgcattccttcgattgataccttgctcatgctctgctccatcctcatcttgtacaggccgtctgccctattgaggacaagcagccagtcgtccatcgtcggcttgtggcaggcgcatgcgccctccggatatctgccggacttcctctcgcatagacgccccgacagggtcgaacaccgcagcagccaggagccatccttcaagccagcaagctcgagcggcttctcgtcgttgccgcatagtatgccacggcatgcgtgccgtccgcgttctttgcagccagaggtgccttcctgcccagaagcgcgcttccgcttccataaggctcgagcgtccaccacttctgctcttgaagaagcgacgcatgatgcccatctgatcggcaccggggaagtctatggcttctgtcaggtgaaaccgtaacggttgaagatctctgtatcatgcgggccataggagacttcgacaggtcgacctgggaccagatgttgtcccagatgccctgagcgccataagtatagcctgctctccgagctgcatggtgatataggccacacggcgaagcatcgaggcatcgatgcggcggctcccgttctcctcgagcagaggagcatccctcgtagagcgcctccccttccacgaagggctttcgggggccgctccatgaagtcgcggtagtcggactcagcccagacgaagtcaccggtgcctgctggttgagcgtgaagtcgtaccagacctctcgtagaagcagtccgagaacggccgctcatttacagagtgcactgtgcagggctgccggtaggcatcatgcctgcgcacggtacgtgctgcctcgctccagcaggagacaaggaagtcgtgtcgagaaggatcgtagccagaagcctcgccagcaatggtccagacaagtggcaatgtccataggggcagcgcagtagcgtgcaagcgtcttctgctccgccagtgtcgtagcagctccgaaggcatcaggctctgcctccatgctgcttccccaggcaaagcccagcgcattcacgaagccaaggtcgcggcgatatagcatgcggcagtcgatctcttctgcaaagacagcaggatggggatgggatgctctgcgtcctctctcgtcagccagaagcggtgtgctcatggaaatcgctcctcaggttcgtctggtagaccgtgaacccctgctctgcacgcttgtccgccatggcctgaactggcttctcatgccggcatggttcgatgcgtcccagctctcccccagcgcgaactcccagtgcgtatcccgagccagaagaacggcatgccatgcatggaccaggatattcctcgcaagaggctgaccatagagctgctgccttggcacagcgcagaaagccatgcggtagatgggaagattccccgaatagggagcagccacaatcgtgcccgatttccgtcaaggcgcttgggaggagcagcgagcttcaggtccaggttcctggcttcggtgcagcaaagctcacgcaaaagcggcatccgccatcccagaacgcttccgctggatatgcatgccctcaggccctgtgaagtccgcgacgacgcagcagtccctgacgggatctctgaacggatgggccgactcaaagtgcagcacgacctcgcgccaggtctctgctgcggtgcagattctccgcttcagccaagcttaaatacgcctcccttctgaaagcggacagccaggcacgctgacccgactgtccgctttgttctgcttcagatctggtgcatggagcagctcttactcggccgtcatctggccgggcttctccttgtcgagagcatcgagctccttcgtgaagcagtcatgtagacgacgacgcgcagcaacaacgcaggagatggtgagaccgatgacagcagcaacggtcttgacggg

SEQ ID NO: 90 - DNA, 65549 bp, Unknown
  Metagenome-assembled genome
tctgcgatactctgagcattcgaacagaatagcgcctctgtctcattcgtcttccactacataatccgtgttcatgcatcggcatagcgccggtgtccgcaagcttcgatgcagtcttcgattgttttatgccttctcaatgcttatccatgcagactggctctgcgaattaaaggtgctgcagcttccgatgtactagaaggcgatcgggaaggccagcgtttacgatattgagatccaaggctcaggctgccatccgtacttgaaggggtagcacgctataggccgtaggtgcaaaaacataaacctgccaccagaaagatcgcttgcgccgtccgatggcaggcagccaaagcgaaacacgaggtatgacgtccaagcactggtaggcgtgagatagccagtataggggcttagttttgtcgagcgtcgcgccaaattgaagtccgcttcgccatcgctctgcatccttgtgacagcaaatttcctgagagacggcaatctatcccctgggtgagtgcacctcaggaacgcaaaggtagtgccatcagcaagaaaaggcgagaatacttcccaagaccgatgattacggcggtctatcctatagctgctcacaaaaaccggtcccataatcgaatcatccgtcgctgtccaatccggatgtgcatctgcatagcacacgattagccagctgtagtccgagggcccacagactctgcgaaggagtaagagctgcatctccatcagactcatacgttctctccatgctgctccccctcgctccgcattgccaggccgcgtttcttctttgcttagataattgttctcatagacagctgaggaaaagctgtctgcatccttccatcgatatcggtaaggctccatcctgaacagaaccgttatgacagcaaatgaatgccgcagcggcagcgattgcgacaggagccgatacctatgctaatgatgcgatgcaatcttcattgtgctccttcccgacaatccttcagtcttgcagatggacatgaagtcaacaggcttcaagctgtggatggttgtggcaggaaaacgagcagcgtcaccgcctggacgcatgatcttcggaacaatgtccgctcaccagctttatcacatccgtatcaaggcattggtaggctcatcctgatagagctcggctcttcactgatggcttgcgcgggattggcctctgttcatgcagaggctgtatgcagaaccggagcctcactcatcggctttcagtccgactagctcgagcgtccctgcaattctcttggggcatcagctctgatatggcaagaaagaatctcgagattgtctttccagaacggtttcccagaaccctgtgccacagccatgtagacaagacgcacagggtggtttcatgcggtccagcagctgacaccgacaagtatcatgccttcattgatgcggacaagtccggccaacagctcggaaacagcatcgattgcccgatccgttgacgcgggaaagccgcgacggagccccgtcgggaatatcgagcgctatatcgtaaagccacccgcccgttctatgtctcttcttcgggacatggtaaatcttacatcagccagggccctccaatcagacctctacgcgttgacggaacagcaggaacacggcggtagcagcgagacaccaagatgctcagggccaggagggccaaaagcaatggggcgggggtttcactagaaagccggcaataagggccgtcgcgctgaagtccagcccgcaggaatcaattctgcagaggagcgaatcgcttggcagcgacgcgacagccatgccaggaacgatatagcggattgcggcaagcaggaagcgaaaacggcttggttatcccttgcaggacgcgatcctatcatgctgtatacagctgcggacattgcatgacagcaaatgacgagaaagcgattgaaggctatgaatgagctttttttcagccatcatcaaggcgcctccagcaggatcctgccaagagctagacagctgctgaggccagcagatgaaacattcagcaatacgaagactagtagcaccctgtaccagcatgccgcggggatgcttcatgcggattctgagagagggccatggcgaaaagaaggatctgtcgccaccatctgacacaagaagatgttgagagcagctggtgcttatgctgccgaactgccagagaattgcattgcttctatcttgccgcgaaacgctttgctaaggccaacatctcagtcatcaggttattccgatgaacttgcggaggagcgagcgcacacaggagtgctacgctggcacagatcatgcagcgtattgtcctggtcttcaaggatgggactagcctctcatctgtattccgccccctgatggcacgtcgcacaatccgccattcaatctgatagatgcgaagattgcaatgcagagcccccatgacacttgcgcaggagcacaggacaggaatctccgatgccatctgctgtcctgcgataatcatccatccaaagcgcaagcatatagattgatcgcagcggcgagcgccgagaaaatagccgaagaagccataacctagaacagcggatgcactgcagctctctcgccagctgccaagaaaacagtgacaagcagcaatgcgcagtgaaaaaatatgagcagaccgccaatatcagagaagccagaacggccatattgccgcaccaatgcacccaagcaaaggtcgcatcaagatcaatcccaccccgagacagtaaatcctgccgcaagcgccagaagaagacagtccggcagcgtgcgcctcaagtgagcggcgaagccgttttgaacttttcacctcactatcagatagaagatgttgattatcggtaagcgagcacaacaggacaatgcaagatggtaagctggtgtatagaagagagcgttcagaagctcgggaatatgtcccatagagcttcataagggactgggacgataagtgcctgctgagaggggcttccatacatgacaagcatcaagaagatggatgctctatcgcgagcatgcttgctagccatcgcttgattctggcttcctggccgactggtgcattttcattgcaggtcaccctttgagcagaaattcggatacaaacagccagcattattctgcttgcaagtgccagttatggtaagagaacatccagcaaggagaggtcttctgcccgaagagagtgacagggtccgatggacgagaggatacatcagcaggagcactgcgtcgagacaatcccgaatgccatcggaaacgccaaagcaccagaagcgggcttcggtaaacacagcgaaaaggctgccaggcaaacacgaccagccagtgccgaagatgagaatgcgcggctgccagataagcccgatttaagcaggtaggacttatggatgccagcgcacaaaaaggaagctgtgccgcgtagtcaggtatttcagatcgaagccgcattgtgccgaatcccgtctgaaaggcatctatgctcgccttcaaaggggaatacgagcagctccacgatctgtgaaaaccgcaatcatgacagctacatatagaaaaaatccaatgaaacgctgcaaaaaaaaaggaagcaagataggttcgcctgcccattccttttgccgcatgcctatctcccggaacgaagatcgcggaagaaggaatctcctgcagccatgcagccaagcgttgggataacgaaaccaagcatatagacccagagatacgaatatatctttgtaattggccatcccacccgatgcggccgaaggcagggatccgaacacgctcccagatctgcgaagccttatgcaaaaaccactgcaatgccgcgagctgccaagtggtgacggcagcaagaaactgaggtgattcgacgatgtttcctgagctggaaaaacgctagccgtaagcatcctcatgaaggatccctcccctgccgcagcaaaaaacaatagaggggaatttacaaagccacctccagagcgaaaatgctagccgttcagattttgccagccttttacgttgtcacaattggtccatagccaagctccgtccgtataggttgcatagccgctgtagcttctgccctatttggtaggctccccaagcatgttctccgcgattaagatcgattgcggatccaatataagtgccgtttttccggcattggcattagaacccagaatgatcacggctgagaatcacttgccacttcaacgtaatacgaatgagatgacctgtaacttcgttccggatggctatccaagtttttccttgccatgccgctaggttcgcttcaaaaaatgccacccgcggcaggaagcagcaaccgccagcaccatgatactgcaacgatactgccagtccgaaaactaccgtcctgctgattgatattcgtcctctctgggcattttaacttcacagcgctatcgaagactctgatttgtccaaccaacaaatatcggtcatttcatttgatgtgctgggtgaacaatcgtccttttagtttggtgttgcagtcggatccgttctcatcaccgacacttccaatattcgatatctattattataatttcagtttatcttagatcctctagcagtcaagtaaagagggcttagctgggccaagcggatggtcaggacctagatggtacgattatcatatgcccaaactcctcctgtcaagtggcaatgctatcgcggaacagggcacccccaaggcttctgaaactgcagggatgagagatagagcgatatcggcgaatactgcgtggacgagtccggcaacatggagaccttgaccgggcatccctgcccattctcattatcctaatagcgtgaatatgaccggccccaacatcgatgttccaaacatcggcggctaagggacagtctagggaaacgatgattattccctcgatgaggccagtggagccacacgctgttgctcggctcaaaatgtctcgaaccacgcatgcccatacccacatagatgcctatctgtccttctggatatggtatagctacatccacatccgcatatccaaaaggatatggacagatgatgagcttttagaccttaaatcctaaggtaaggagaaagacagcgagaggcaccctggagcgagatggatcatcgttgtgtgggatagctggattgttctggtagataccagcaccactgacaggctcttgtcaggcatgtgcgcgctgcaaagacgatgcttaggatgtatctgttgcaggtaatgtttgctctttaagacgagagaacctaagatgctatcctggattgtcggtcctatctacgcgctcttgcacgagacctcatgaggcaggtacagatgcgacgacacttgcgaagatgcgccatagcctaagcggggggatcggcaagcttgcttttcgaaagaacttagaaaattaagaaggcagggatcacggagcggggtggctccattggctccatagtggatgaccttcactcgggcccctaagcttaacgaagaaccagaccacgcgcgtacctttaagccgcccagtccaagaaagactaactattaaaagtcaatcaggaaagtacgattcttcgaatgaaacgcaaacacggagacgtgttttagatagatcagtgccttgaaaactgcatgacgaacagagtctcgggaatagggctctaagaaaaggctatgggttgtaagatttacgctgcctggtattcgctatgggtcagctccatccggtagatggttctgactagcttctttgccacgtgcgacagggcgacatagtagtgcttgccttcagcacgctttctggccagatacaggccaaaccgctcgtcccacttggagacgtatatagcggcgttgaagagggcgaagcggaggtatttggagcctcgtttctccatatgggcataggtggatgtcaactgcccggactggtaggtagatggcgacatgcctgcataggcaaggatctggtccgcattgtcaaagcggttgaaatcgccaatctcggccaggatcatggctcccatccggtagttgatgccaggaatcgtcatgatcggagagctgctcttgtccataatctttcgaatggaagcttctactttttcgatgtcggcagtcagggcatcgatctggcggatcgtctgcttgagttctatggattttacagacatctctgatccgacagaggatctggccgcattccggatctcgatcgccttctctcggccataccggccacgggaggcatcacagagcagggacttcagatgtgtgaggttggcatcggcaacacatgacgcaccgggcatttcttcaagcaggcgctagacggtgttcatgtgaagcgttgggacgaggccttccagtttggggaatacgatgttcaccagcctggtgatggatgtcttcagcttcgctctcctctggatgagatcaaagcggtatctggtcaatgacttcagctcttcgctggggtacgatgtatccgtgtagggcctgagggtcttatcagtcacaagcatttcggcaatggagcgggcatcgactttatccgttttcgtctttctaaggcgctgaccttttctgtaaagatttgtgtgaagcgggttgattacaaaggtgcggtagcctcgatcaagaagcgagcccaagatgttgtaggaatagtggccggtagcctcgagccctacttttatctgggacaggtcttttgaggccgtctcgattcttctgaacagctcatcatagccttcgcgattgttccggatggtaaagaccgggaacagttcttcagcgtccggaccaagaatacagcagtcgtgcttgtccttggcgacatcgattccaacgtagatcatctttaagatcaaagaagcggttgattctgatgctgtcgtcagaccacagggctttctgccaatcgtatcctcgttctacataaaccgtcatgcggtatctaactgatcaacaatgcagcaaagaggctgtggctggagcccctctaaaaccgtcgagcggtaggggagcaagaccactccacagcatctgatgacaatgtagccgtttaccaggaacaggtaaaggaaagctaccacttaataatacgagggggagcctggcgtatcggatacaaggtgatattggcgtggacgtcgcaggtggccttgtgcatggtgtggagacgatcgcctagaatgtatctgacatatcctgtggcacatgcactcgtaagggaagatgacaggttctgctgcgcagactttaggctatataggtatagcgaagcgcccttaaggacgcataaagacccacacctctcatctatgcgctaaagcgttgtaaggaagccttcgactagagaggaccttgcctgtgcactcttgtccgagaaaggcatcgagtccaggaaggcatctatccgctcaaaggcagaagcacccttccttatcgtgaagcggcgcttctgccccttaaggaagcgctacagggggatagagaagaactcctgtatgctcgagtctgcctcacccttgcaaaccttacccatgtgcatcttttgccggcaggctgcacctcccggctcccagagtcgcttgatctgtcttgaagccttattgcggtgcatgcggcaggacaaatgtaaggatagcggctcctgcacgtgctggatgagcaaccttttctgcctttcccgcataccggcctagaaaagtcgtgtggtcggtcccctctaacacgttatggggcattaatcatcgtttccctaggctactggctctatgctctatgggcttaagagaaacgatgtgaggctctcctgcagccgcttagggcacctgctgcgatagtgtcgtagagaggtctttctttgccactcttaaaggcgagatgtactagcgagaaggctttgcaacaagaaaggatgccatacatgcgcaagttgaattcatcgagggctactacaacagaaaacgtccctactcaacgatcaacaacaaaattctagcgaaggtagtagatgctttctttgaaagaacgaaacctatatcagaagaggaccagatatcaccatccaatgcagcagcgaatcctcagagcaagtgcaacgactggcgatgatagacctcccagggacacttccactccagacgcttgcggggtctttggttgagtcctttcctctattgctgtgagtcatacccagctgctgccatgcgagaaagtacgttgtctgcactcagggcggggtttacggtggagtaggactccgtgcaaatggcagctgctgccactcctgctgcacaggtgttggcaagggattcaccgcgggtttgcgcccaggtgatggctgccatcatagtgtcaccggctccagtcgtgcttacaatgtttgaggcaaagctggggatgcggaccacattgttgcgatcagctgcataggctcctcgtgctccaagggagatgacaacccgtttcaccccttgatcgaggagcttttttgccgcgagcttcatgcttctgtcatcggtaatatggacaccggtgagggtttctacctcgagctgattcggtttaatagtgtcaagtttgccaattaagcccttcaccttcagtgccttggaggtagagaccgtatcacaatacaggggtactctgacgtggtctgcgagataggctaagcactcaatagagatattggtatcgactacacatacctgtgcgtggttgatcacacctagacgtgactcgagggcttctggagtgagctgatcgaggatcttcatatctgagattgcgagggtcatatcaccttgttcgtccatgataaacaaatgcgtagaggtgattccaccggggatggtgatcgagttgtcgatatcgatattcaacttacgacagtcattgacaagctcggttgctctaatgtcatccccaaagacagtgataagcttcacatcacagccaagcagcgctaggttgtgagcgatgtttctggcagtcccaccagcggagacggtaacagtacctggcattgtgtcgtgggctcttggagtgtaggcagggtgtcctgcgaggtccatattggttcctcccaccacggcaatataaggcttatcagccaatacgtagcgacgccccaagattgcacctttcttcgtgagattggagatgtggacagctaccgaggagcgtgagatatgagcacgctcagcaatctctttttgtgtaatggaaggattgatacggatccaatttaagatctgttgttctctgtcggtgagcatcgtggagcgctccttcggtgtcgagcatgctctatgcgtctttgatagagctatttgcatgccctttcaatacctgtgaccattgaaaaatgcggtgattagctccagtataagcatatgtttatttacgataagcaaaagccgctcggcgataaaacagcaccgatgggcatagtcattctactgttacagttatatttccatgatactaagtttaagccgttttccgtttcaatacagcacccgtagagatgggtacccctcatgagtagacgtatatttctcattgttctcgacagttttggtattggcgctgaaccagatgccgctgagtggggcgacgaaggaagtaacaccctgtgtgcctgcgcatcaactggtgaactcgacgtgccgaatatgactaagttgggattgttgaatattgagggcgcactgaagtctccctacactacaacgcttgccccgatcaacaaacctgaaggtgtttttgcgcggttacgggaagcttctgccggcaaagatacgaccgtgggtcactgggagatggcaggtgtcatctcaccgcatcgtttcccaacgtatcccaatggatttcccaaagagatcattgaggagtttgagaagcagaccggacgtggagtcctgtgcaataagccctattctggtacgcaagtgattcacgactatggtcaagagcaactcaagaccggtgagctgattgtctacacttcagcagacagtgtcttccagatcgctgcacatgaagatctgattccgcctaagcagctgtacgaatactgtcggatcgctcgtaagatcctaactggcaaaaacggtgtagcccgcgtcattgcccgtccgtacatcggtcagtatccgaacttcgagcgtacgagcaatcgtcacgatttctcactggaacctacgggcacaacgatgctcgatgtgctcaagaagcagggtaaagatgttctctcaatcggaaagatttacgatatctttgcgcatcgtggaatcactgactttgtatacaccaagaacaatgcagacggtattgatcgcacgatagaggcaacggagaaggacttcgacggcctgtgctacacaaacctcgttgatttcgatatggtctatggtcaccgtaacaacgccgttggatatgcacatgcactgaactatttcgatcagaaactccctgagattatggcaggattgcatcctgacgatctcttgatgatcaccgcagaccatggctgtgaccccgtcacaccgtctactgaccattcccgtgagtatgtgccgtggttagtctgtggtccgcaggctcgtaagggtatcgatctcggtactcgtccgacctttgctgatgtttcagcaacggttcttgattacttgggagctccctcacttgaagcaggggtttcccacgtcaaagagattttggaaggatagcgactatgccaaatgttccaacaccccacaacgaagcacgtgaaggtgaaatcgcgccgttcgtcttgatgccaggggatccgctgcgtgcagagaagcttgccgataactatctctctgatgtgaagcgcttcaacacggtacgcaacatgtttggctataccggcacctataagggagagcgtatctccgttatgggatccggcatgggcatcccatccatcggtatctactcctatgagctgtatcacttttacaacgttgagacgatcgtacgtatcggcactgccggcgctctgtctcctgatgtagatgtccgcgatattgtgcttggggaaggtgcgtgcacggactctaactatgcgcagcagttccgcgctccagggaccttagcgccgattgcagattttggtctgctccgcaaggcagcagatgcagcagattgtttaggctacccggttcgtgttggcaacgtggtctcctctgatgtcttctacaacgacgatgagacggttaacgatcgctgggctcgcatgggagttcttgcagtggagatggagtcagctgcactctacctcaatgcgatgcgtgctcgtaagaaggcactgacgattcttacgatctcagacaagcctgcaaccggagagtctctctctgcacaggagcgtcaggagagtctgacgcgcatgatggaagtagcactgacgctcgctactgatggataggttgtgaaccggtgagtgtgatcttactggttaaataatggatcgtttgtatcgtttcacgtacaaggtgtgcaaacagacgaaaggggatctcaaatgggtgcgtctggtaatgtttcacggcgtgggttcttacggggagccgcaggtataggcgcttttggcgccgctgctttcctggcaggttgtggcgaatcttccagctccaacaattcttcaaattctaatagttcctcagatgctggcaagaaatataaggttgagatggtcaccgataccggaggtgtcaacgaccagtcattcaactccagctcctggcagggactgcagaagctccaggacgaggaaggctgggatgtcagctatctcgagtccaagcaggaatctgattacgcaaccaacctcgataaggcagtcgacgatgaggcgaacctgatctggggtattggttttgcgatggcagatgcagttggcaatgctgctaaagcaaatcctgatgttcagtttgcaataatcgataatgtaaacccaactggtggtagcaacatcaccggtgtgaccttccgcgcacaagagtcctgttttatgtgcggctatattgcggcccgcttcagcaagagcgcaatggtcggctttatcggcggtatcacctccgatgttattgatcagtttgagtacggctacagagccggcatcgactatgcaaacaaagagcagggactcaacgtacagtgcgaagttcagtatgctgattccttctctgactctgcaaaaggtaagtcaatcgcaaacaagatgttctccgatggttgcgacgttgtaatccatgcagctggtggtgtcggtgtcggcgttatcgatgctgcaaaggatgctggtaaatatgctatcggcgctgacctcgaccaggggcacttggctcctgaaaacgttttgacttctgctctgaagaagtgcaacgtcgcagtcgacgacgtctcaaaacgtctgctcaccggcgatctcgagggtggcagcagcatcgaccttggtctctctgatgatgcagtcggcattcctgagaaccacgacattatgggcgacgagatttacaacgccgctattgaggtcggcgacaagatcaagagtggcgacattgtacctcctgcaaataaggagcagtacgaccagtacaccgccagtctgtagtggcatatatgagagcgtcacagctgagcacatgaggcgccctcaggttttccaaggggagggtgagagaaaaccctccctttttattcatggaggaggtgggcagtggaggtcagttctgactatgccgtacagatgcacggcatagtgaaaacatttggtacgtttagagcactagatggtgttgatctcgatgttcataaacagtctatccatgcaatcctcggtgaaaatggtgccggcaaatcgacgcttatgaatgtgttgtatggccttttaaatgccgatgaaggtgaagtgtatttaaacggtgagcgcgtcgatattcaaaatccgcaggatgctatcaagcacggtatcggtatggtgcaccagcactttatgctcgtagagaactttacagtcaccgaaaacattgtattgggagaagagatctgcagcactgccggtgtgttggatatggccggcgctcgcaaagaagtcgaacggattatcgacgagtacgggcttgaagttgatcctgacgcaaagattgaagacatcagcgtcggtatgcaacagcgtgttgaaatcttgaaggcgctctatcgtggctgcgatacgctgattctggatgagccaacctcagtgttgacgcctcaggaaatcattcagctcatcaagattatgagagagcttgttgaaaagggcaagacgatcattatcatcacgcacaagctgaaagagatcatggaatctgcagataagtgcaccattattcgccgtggtaagtacatgggcactgtcgatgtttccaagagctcagaagaagagctcgcttcaaagatggtcggtcgtcacgtcgacttgtcagtcgataagactcctgcaaagccgggaaaagttgtcctctctgttaaagacttacacgtaaaggacgcccgtggtatcgagcaagtctgtgggctcaacctcgatgtgcatgcaggtgagattgtgggtcttgccggtatcgacggcaatggtcagaatgagtttatagaggcactctgtggtcttacaaagagtgagtcaggaactgtcaccgtcaacgatgaggagatccagaataagactccgcgtgagatcatcgatcacaaggtctctacgatccctgctgaccgccagcgttttggcttagtcttgccctttacggtggcagaaaatacggtcctcgagcgccacaacgagaataagtttggtgcaggtattacccttgattacacgagagtgcgtgagtttgcaaactccttgatcaaagagtttgatatacgtcctgaggactgtacggatcacccagtggggggcctttctggtggcaaccagcagaaggttatcattgctcgtcaggtgtccagcgaccccgatctgctgatcgctgtacagccgacgcgtggtctggatgtcggtgctatcgagtttgtacacaataccttgatccgtgagcgcgataaggggatggccattcttttgatctctctggaactggatgaggtcatggatgtcgcagataccatcgacgttattcaccgcggtcaaatcgtcggttccttcaagcaacatacggtgagcggagagaaagttggtcttttgatggcaggaggtggcaagcatgaatagtacagtcgctaagattctcaagaagccgattacctccgcaatcctcgctattgttatcggttttgctgtcgcggctatcatcctgttgttagcaggctacgatcctggtggatcctttgcagccctgtttgcaggtgcgctatccaagccaaagtatatttcgaacgttatcatcaaagcgaccccgctgcttttgtgtggtatctctgtcgcctttgcatttagagttggtctgttcaatatcggtgctgagggccaatacattgtcggtacaatcgcagcaactatcgtcggtattctggttgatctgccagctcctttagagatcccgctcgtgatctgtgtaggcacccttgctggtgcaggcctcggcgccctgatcgggtggctgaaggcaaagttcgggatccacgaggttatcacctcaatcatgttcaactggattgcactgtacctgtgcaactatgtggtatctctcgatatctttcaccagccgaattccacgggatcctatccaatccacgaaagtggctttacgatgatcctgccgaattggaagacctccgatgagggtatggcggcactgtccaacatcccttggttgcgcgaggtgatggtgaaaaccgacgttaatatcggtatcattgttgcaatcgctgctgctatctttatcaattggcttctcaagcgtaccaagaggggctatgagatgcgggcggtcggtctgaatgctgacgcttcccgcttctccggcatcaatgttcagaagaacttagttctgtgcatgctgatctccggtgccctgagtggtcttgccggtgtactcaatatcaccggtatttctcctcacggaatcgcgacgatcgcagcctttgaaaactatggcttcaacggtttgtcggttgccttcatcgccggatgctctccgcttggctgtatccctgcatcccttctgttcgctggtctcatctacggtggtcagaccttacagcaggtcatgggtaccccctctgagatcatcaacattatgatcggcaccatcgtgttctgcatggcattgggtaacgttatccctatgctgatcaatcgttctgaacataagcgtgccacaaaaatgcttgctcaagaaagtgtgagagggggagacacccatgttagctaatctgcttttgtgcctctcaattaccctcatgtactcgacaccgcttctctttggtgctctgggtggtgtgttatctgaacgctccggtgttaccaacatcggtatcgagggcatgatgaacattggcgctatggccggtgtagcaggcagctttatcacgggaaacccctggatgggttttctgtgggctggtatcgccggtggacttgtagccgtgttgcacgcaatcgcttcagtgcgctttgcaggcgatcagacgatctccggtgtagcgatcaacctgattgctccgggcctggcactcttctggtgccgtcgactctttgacggagctgcaatgtccaaaccgattacgaccttaccgaaagtcttcgataccacgcagtttggtgattcagcgctcgcgagtctcgatatcgatatcaccgttatcttagggttgatcgccaccctcgtcctgtggttcgtgctgtatcgcaccaagctcggtctgcacatccgtgcagtcggtgagcacccagaggcggctgagacgctcggtatcaacgtatttcacatccgctacagttgcgttattgcctccggtgttttagctggattgggaggtgcttctgtcaccctcgcaatcatctctcagtacacacagaccgcaatcagtggccagggcttcatagctcttgctgctgtgatctttggcaaatggaccccgcagggtgcctacggcgcgtgcttgctctttggcttcacccaggcgctcgcaattatgcttgggggtggcaattccatcgtaccgagccagatcctggcaatgcttccgtacattatgaccatcattgtcctggtgctctttgtgggacgctctgttgcccctaaggcagacggcgtgccgtatgtagaaagcaaataagtagagttaggaggcatggggtatgagcgtttcagatgaagagcttgtgcatctggcaattgaagctcgtgaccatgcatatgttccgtattctcacttctcggtcggggctgcacttcttacgagtggtggcactgtgtatcaggggtgcaacatagagaatgcagcctacactccttcgaactgtgcagagcgcactgcctttttcaaagcggtgtatgagggagagcggagcttttccgcgatcgccgttgtcggaggggctgaaggacaggctatctctgattggtgtgctccctgcggtgtgtgccggcaggtgatgcgtgagttttgtgatccggatcacttctgtattattcttgctcgctcagagcatgagtatcgctccacgttattgcgtgagattttaccggagagttttgggccagatactttggagcgtgcggagactactaccacgcactcaggtgaagaaggttaatgcgaatgaggatgtatgacattatcgagtccaaacgtgatgggcatgagctgagtgatgctcagatagatttttttgtccagggctacactgagggctctattccggactaccaagtctcggcactgtgcatggcaattttctatgaggggatgagcgagcatgagactgctcgccttacccttgatatggcgcgctcaggggatatagttgatctttccgtgattccgggggtcaaggtcgataaacattccaccggaggcgtaggagacaagaccaccttgatcgtcgctccgactgtcgcctcacttggagtacacgtcgcaaagataagcggaagaggactgggccacacaggtggcaccctcgataagctggaatctattccaggactcaccacttcgatgtcgcgtgagcagttcttcgatatcgtacgcacggtgggatgtgccgtcgtcggacagaccgataacttagtgcctgctgacaaaaagctgtatgccttgcgtgatgtgactgccactgtcgattcactgcccctgatcgcttcgagcatcatgagcaagaaaatcgcagcgggctccgataagattttgctggatgttaagtgtggcagcggtgcgttcatgaagacgactgacgacgcaattgctctggcacgtgagatggtcgcaatcggtgagcacgtgggtcgtaccactacagctctgattaccgatatggatcaacccttgggccagtgtgtgggtaatgcccttgaggtacaagaagctgcatgcacgctccaggggaacggtcccgatgatctcgttgctgtatgtattgaacttgcggctaatatgctcgagcttgctggaaaaggtagtgtcgaggagtgtcgagcgatggtgaaagaacagctgagcaatggagaagcacttcagaagtttgcacagatggttaaagcccaaggaggtgatgagcactacgtgctcgagccagagcgctttggacatgacacctgtagcgttgagctcaaagcttcatgtgatggctggattcaccatatgaataccgaacaggtggggctagcctctaccgcacttggagccggacgtgctaccaaagacgaccttatcgatcctctagcaggtatcgtacttgcaaagaagacgggcgagaaagtacagaaaggcgaggtcttggcaaccctgtacgctcagaatggggccaaacttactgaaggtaaaaacgagctcagtggcgcctatacgattggcagtgaaaaaccggtccatgagcctttgatctacgctcgcgtcacacgcagtggtgttgaaaagctcgtttaaactgtagccaatacgcgttgagccatcgcattggtgtgagccttccatcctttgtatgcaagaggaggatgtattttttgggctcttcgctacttatgatgggtagcactcctgcatccccttaagtacgtggtgcctggacagcagggttttggtgacggaaggctttggtcctaaggtgcgatatggatgcttaaggcaggtatgctggcaagacgcttcaagaggccccatagggcttagggacgaatggaaggtctaagccccatcaatataagggacagcaagatcccagatctctatgcggcctgcgtggccgccagatcggatggaagggccctctcgaagcgctcgaagacctcctgtctggccggtaccacttgcccttgagtgtctcgagaagcgattctgcttgcgcactgtcgtggcagcttccggtgtaccttacaggagtgcctcacgccgtgcacggccgcctgggagacaagcttaagcgcttatgtattggctgtcctgctcgctgtgggatatggccccacaggcgatatatccccacacacgcgaataggccatctttaagggcggcagattgtcaagctgagtgcaacatctccctaaagacctcgttggctgtcctgtatttcagtaccttcctcggccttagagacgctcctgctgtcgtggtggcatcttctcgcggcaagcagcctgaatgccctgtcggcaagcacaagcaggcacataggtcccgctgccacgagcgtgtcgtctgcccactctccgaggcgagacctcgcatcggccttttgggcctctcctttacgctgtgtaagatctcgatcttgcctttggtcttaggcctcttgctgcgcaggtggcgccgcacctggccttgcgggccggatcccggcaagtcgagggcggcggctatggacctcacggtagaatagtcggcaggctcaacgacgcacctgccgccaccctcgagcctgagatgtcgtctatctgctccagggaccagtgtctgtccatgatgagtaagcgcaccttctgcgtaagcgcagggtctgaaagctgccttttcgccctgcatcccctgcggcgctcatccgccctccttttgggcagcgcatgccctaaagcgtccgtggcgtgcgttcctcgcgatcttgtggcagatgctggagctgtccctgccgatctctcccgcgatataggcaattgaccttcccttgtgcatgcagcgtggctatacagtccctctcctgtaggcttacgatgcttgtagtggcacattccttttagctttcgacgttgattgagacaaccaacatcgtagccttccggagtgtgccatgcttgcattcagcgggtcatcctgttgcactcagaatgctaatccgccatctgaaagcattcgatactcagctctcaaatgcaacaactaaaagataggagtttacatgacaaacgaagagcttgcttcctatattgaccataccgacctcaagcagaatgctactcaggcagatctcgcaaagctttgtgacgaagcggcacagtatcactttgctaccgtatcgatcaattcctgctggactaaatttgcggcagagcaccttgctggtactgatgtaggagtaaccacttgtattggttttcctctcggtgcctgcagtacacaggcaaaggttgctgaggcaacacaagcaatcgccgatggtacccgtgaagttgacatggttatcaacgtgggtaagctcctcgacgacgatgatgaatacgtgaagcacgatatcgcttccgtcgttaatgcagtacaaggacacacgcttaaggtgatactagagtgctgcttacttactgacgagcagaaagtacatgcctgcaaactttgcgtagaagctggcgcatcctttgtaaagacaagtactggttttagcaccggtggcgctacagttcacgatgttgagcttatgcgtaagacagtaggggatgcttgcaagattaaggcagcaggtggaatccatacccgtgaagaagctttaaccatgattaaagctggtgctgatcgactgggttgctctgctagtgtagcggttgtaaatggctagaacgagcctcaaagataatctgagtgtaagaaagcgggttgacattcccgtaaactgaagtttacgggattccagtgtgacccatgtcttaatcggtatggatccgctgtggtgttgtcaaaacacctgtacatagttgccgatctgccggtttctgcttacgtgtgatgttcgcggtagcgttgatgtctgcgctcaccaagacgccttccttggttcggtacagtccgcgtttgatgctcttaccggagaaaccatgcgtcgtcttgtcatcaggcttgtattcggggggctgtgtccccatccaagtaggatgctttggaagtgtaggcctcctcctgctccatgtatcggatagtatgcttccagcacaggtagctgagttggcgtttgagcatcccgtaggggatctgcacaaacgtctgattgttccttctgccgtgattgactccttggtttcatcccatgttggagccgacgatcaacgtggccgtgttttcccgtatgcacaggttgatgatggtgcgcgcagctttgagcatgtagtcatgtatgcgccagctccgtttgtcgctcaacgtttggattcgacggctggttttcaaagcgtccccatccttgtccagtcggcttttcaggtacgccaaccgcttgttgtagtactggttgattgatttgagtcgtcgcctaccaaccaagtatccatggtcgggggtggcgcatgtggcgagattatcgactcccaagtccattcccgcgacacggtttacatccaaatcgagggggctgttgctgtgtttcgaacacgtattggattttgaagcagcttccatcccgttcgggaaggatgcagatgcccttgatatggtgcccgttcaaacgatcgagcacaaggatacgtatgtttgacatgtccggatgggcttgcatgaatcgtctgctcacgggcagtttgaacagtccgttcgtggagagtatcagtgggaccatgccccctttgtccggtaatgtgggattaccacttgagaatacctgtagtctcagttcttgcattttttaataatgcaagggaaggctctcaagctaggggcgacaactttcatcgtttgcttggctacttaggcttgcagcatcttgtagatgtcgttggttttgcacagatgatagttggtttcgtatgagaggagcccgccttcgttgaaggcaggctgtcttgtctgatacagggccttgctgtagaggttgtttgagtactggcagaggagcttcggagcgcggtagtggttggcgctgagatggcggatgtagttggtttgcgtcgcgtactgcatttttttgtttcacctccctcctactcatgtcttgttatatgtaatacataagcaatatccgataggtggtgagatcaacatgaacaatcgctatgaacatgggaaccattcgaaatacctgttacgctaccacctcatccttgccaccaaataccgaaggaaaacactcaccgacccaacgatgatcacggatgtcaaacagctttcaaccgagatcgtcacacggggccacgtctcaatcccatacatgaagaccgacaaaggccacattcattacatgatctaaactccaccaaccatccgtctaagcgacttcgtgcgcactttgaaagcgttcaccacattccacatatgggaaacccacgcatcatatctacgtcacatctactggcatgagcacacattctggtcggatggatattccatcgccaccacaggcgaagtcagcgccgaaaccctcaaacactaatattgaaaaacaaggcaaacgcgattggacggcgtttcatcccgcgaactaaagttcacgggttttcacaccaccgattcctataaagcacttctatgaaaactccagtgcctcttccaatgaatgataagaatgccaccatgatctgttcacaggtcatggtggcagaattgagggaatacatattttggattgattcttgaagttagcgcaatatctagcagctagaaagtgtattcgcactcagcgcaagacttctcgacaacagatctttgatggaaacagtcggttctcagtatttgcgcaggaacctatcgtccttttcggtgttgcgataagtcttgaaaccaactcatctaacccgttgtagcgaggatccacattcagcgcaatggggcgaatctgtacaactctgtggtcttgacttaggctctagcctaaggcatcaccccttttctgacgacagagtgtgatggcctctggtttgtggagaaggtcactgcaggcgatcttctgtgtgtgcgtcgcctgaagcattttgtctgccacatcccccaagccagaatctctcagctggtctcttatagcaacgcgatgggtggagccctgagctgacctcaaagcacattggctgtatgtcttcaggtgctaatgtgtcgaagctaacagagcctttgggcaagatctttcctatcttctcgtggttcttctcacaggcccctttttcttggccttatctaaggccgcagcagtagagcctgattgcttgagcctctccttcgaaaaggtgtcctggcaccttttcatctgagaactcggctctctgacaaattcaaagagcgcctcaagtgttcgctttgtattgtcgcagtctttgtgtcccatcaaagacatgagctgaaacttcgatagtctgtacaaaggtgtaaggatacattcactgtcagattgaagaccttctgctgtatttatctcccaggcaccaacacaggctctcctaaggacagaaacgactataagcgctcggacgggtggttatacggggtacaaaggcgtgttgttaggacctatagcccacagatcgccttaaagtccacggcagacataatagctataccgtctgtgaacccagcgatagatagtgaaggcagatactggagcaggagaggtagttgctatctgctgaggggaaagctcacaagcgagcttatcttgtatgtgggcaactgtgtgcgctgtatcctcttcgctcatatcgatgccgcatttcatctgcaagcttttgtgcgtatttcaccatataggctacatggatgcggtagtggcatacctctgtttgtgtatctcatacacccgaagcaacactgcggtggctaccacaagcgtttccttgacagacagtctctgtcttttgttggctctctgggctctcccttaggcactatgtagaccacgtggtgtctaacctctctcttcactgtagagggtactctctcaaagtcttttgcgatgaaacagatagagtgtttttgaatctagcccatgctcaatggagcttcttttcgcaaggctcaatctgtcgtatcgcttgtgcttttcgtgcttgtcagccataaggtctcaaccgtgtctttacagctacagctgtgaagataccttagttgacgcaagactcagtgcaatatagtgcgatgagtcagaatagccgggctctatggtagtgtacgagggatagaaatctaccgctttctcttccctacacgggcaggaggaactaccgcacacagaataatgcctaccgttcagttgatacatttcttatagtctggttagcaaacagaaagttagtaagaaacacttatagtttgtttgttatacggtcagaggttgtacgcagacggcctcatacataaggagagaggatccgcatgagcaataagaatgcgcagatggaagcgatggacgaagatactcgccaattgttcttgtacgaaggaaagccatctgccaggctctatgttcctatggcaatacagcacgttattgccgcaattgtcggtattattactccggctatgatcgtcggctctgcatgcaatctgccgcccgatgagcgtgcgttgatgattcaatccgcaatgctgttctctggcatcgtaacccttctgcaggcacgcccgctgttcagcgtgatcggctcaggtctccctgttatcacgggcgcctcattcgcgttcgtccctgttctgaacagcatcggtggcacctctggcatcgccgcgatcatcggagcccaattcatcggtggcttcatcgcgatgctctttgcgatgttcttgaagcagatcaagaaactcttcccacccgtcgtaactggcacggtcgtcttctgcatcggcctttctctatattctgttgcagttggatatatggccggtggcactggcgctcctgacttcggcagcgcccagaactggattatcgctctgatcactatggctgcctgcatcttctttgccaacttcaccaagggtgtcaccaagcttggttccatcctgttcggcatgatcgttggctacatcattgctctcttcgcgggcaaggttgatttctccggcgttggccccgctaattggttctcactcccgcagttcctgccctttggtatcgagttccaaccggatgcaatcgtctctttgggcgcgatgttcatcatcgctgctgtcgagatgatcggtgacttctccgctgtgacgaacggcgctatggaccgtgagccgaagctgaaagagatccgtggcggcattctctgcgagggcatcgcttctacggttggcgctcttttcggtggccttccgaccgcaaccttcgcacagaatgtcggcattgcaaccaccaccaaggttgttaaccgtcgtgtctttaccaccgctgcacttatccttgtcatcgcaggcctcgttcctaagttcgccgctgtcctcgatacgatcccgatgtgcgttatcggcggcgcaacgatctccgtcttcggctccatcacgatgaccggtattcgcatcttgaccaagggtggccttaccaaccgtcgtgctaccatcgccggccttgcagttgctttgggtatgggcatctccactgtctctggttcccttgcaggccctggcatcccgaactggatcaccagcatcttcggtggctccgcagttgttgtgaccgcgctcgtcgctatcatcctgaacctggttctccctgatccgaatggtgagaagaagcaggatgaggaggaagaggaagaagagctaggcgaggctcctgcgagcaagtaattcttctgaaatcgggaagtatagatatgagatgcagttcacctgtgagctgcatcttttttagttgttgtttaaacatggggacactagtttgtcgagatgatgaccatttctgcgctatactaaggccttgaaaaaaggataaaggctttatctagtgttggatggagtcgtactatgtatcagcgtgcatctctgtttgggcggagacgttaaagtatttttattcccaaaactttaattataaatcaaaatttaccaaataaatgaggaaacttaccgttcaacgaaaaaaatcacctgttttgattctgtaacctatgatggaaattagccggcttgttttattcaaactcttcttacaggggatggtggcttagtttaagcgcctgggtctctgtacggttttgagaaggatgattatagatggggtacaagctaaaggatagctacggtctgtatatcgacggtaagttcgttcccgcttcagacggttctatgttcgtaacgaccaacccagcaaatggtgagaagctcgctacttgcgctgaggctacgaaagacgatgttcagaaggccgttgacgctgcttggagagcctatccaaaatggaaggcaatggatccaactgcgcgtgtcaacatcttgaaccagatcgctgacattatcgaggaaaacaaagaagacttggccaagatcgagaccatggacaacggcaagcctatccgtgagaccatgaacatcgatatccctgttggcgaatcgcacttccgttactatgcaagcctgatcgagacggagacaggccaggcgaaaatcttggataacggcatcattagccttgtcctccgtgagccgatcggtgtcgtgggccagatcgttccttggaatttcccgttcctgatggcaatgtggaagatcgccccggcactggcagcaggcgactgcatcgttatgaagccttcttcgagcaccccgctctccgtccttgtcctggcggatctgctcaccgacgtgctcccgaagggcgtcttcaacgttattaccggcagaggctccaagtccggtcagtacatgctggacaacccgggctttacgaaactcgcgttcaccggctccaccgcaatcggccacaacgtggcagacgctgccgcatcccacctcattccggcaaccctggagctcggcggcaagtccgcaaacatcttcttcgatgattgcgactttgacatggcaatcgatggtgtccaggtgggcatcctcttcaaccagggccaggtttgctgcgcaggctcccgtgtcttcatccaggaaggcatctacgacaagatggttggtgcccttgttgaccagttcaacaaggtaaccatcggcgatcctatggatccgaacacccagctcggcgcacagatcaaccagaagcagcaggataaggtcatgggctggattgagaacgctaagaagcagggcgcaacgattgcctgcggcggtgagccttacagtgagggcgactgcgcaaagggtatcttcttcaaaccgacgctgatcaccgacgcaaccaacgatatggactgcgctcagaacgagatctttgggcctgtcgctgtcgtgatcaagtttaaggacggggacgacgttatccgtatggctaatgactccaagtacggcttgggtggcgctgtctggacgaaggatatcaaccgtgcgctgagagttgcacgtgctgttgagaccggccgtatgtgggtcaacacctacaacgcgattcctgtcggtgcaccgttcggtggctacaaggagtccggctatggccgtgagaacgatatgcgtatcctggatgcttactctgagaccaagaacatcatgatcaacacgaatgagaatgtgagcgggttctatcctcacaaatagtcgataggtgacataggggcttacggtaagcaggagtagggagttttcctctgctcctgtttcgccataaaaatcatcctttgcagaatgtgcagtttggcgccctataatcggactaaccacatatcgacccgcgagaatggcggggcgggtggcggcgctcttgcgatgtggtagtcctaggcgccgcctcccacccggccagctaggactaccaccacaagcggagagaagcggcgctatgccgagacggcagtcatgcagagccacaggagcatgtacaagtaccggtactcgccgctctctgccaagcaggaggtcgccttcttcagcgtctatacgcagggaccgctgccccttctgcggctcggcgcgcatcggaggatgcggcacggacggcaacagagtccacagatggcgctgccatggctgcggcaggacgttcacgcccatggatggcaccatattccagggacacaggctgccggtgtccgagcggtgcgaattcctgctccagaccttctcgttcgagagcatgaacggcctgatgagggaggagtgcagaccaaagaccacgctgccctactggatcgccaagctgttctaagtcctggacgggatccaggatggcgccgtgctgtccgtcgacgtgcagatcgacgagaagtactacccgtgagcccgcaccgacgaggagcaggaagcgcggcctctccaggaacaagctttgcgtggctgcgacagggagggcaggtcagtcttcatcccgtgcggcaggagaaagccgagcagggccagggcctggaaggcatacggaagccacatcgtggaaggctccacactctcccatgacaaggagaggtcgtactcggtgttggttgagaggctgtcttgggagagcgtcgagtacgacgcaggggagatatcgcgcatgcccgacagggacaatttgctgaggagcgtcaaccacctgtacttcctgctggagaccttcctcaactcccattccggattcgacaggcatgacctccctggctggctcgagctgttccatgccatgatggatggccctgcggacaagatagagaaggccgcgatggtgctgggatgcgcaatgcgcgtcccaaagacgctgtcagacagggagttcttcggcataaagcccagctcgaagggctggcgattcagaagcatctgtacattgcgcaaaggatgattttttccgaatatcccttatccatcagttcaggaagccttgtgggtgccagcttcgcgatagcattgccacttgataggggttcgagtcatatgaggaatcgggtctaaattatccaccgcagtcccctgttaaacatctcgtttttctgctcatattgctaggtatcatgagagtgcgactcgtatcttactgcgtgcagtatgctgaatatgctccagtttcgtctgccatcaggcagcttaggagcatagtctatgctcaacaggaagaataggccacactagaagctctctataatccggaggacaatatatatgggcgacagggtgaagaaactatccattatcattcccgtctacaacgcggagaagtggctgccatcgtgcgtcgacagtatcattgctgcaacggatgacaccgcagagatcctcctggtcaatgatggaagcaaggatggctcgaagaagctcattgagagctatcaggatcgctatcccaatcgtgtcattgccatctccaagccgaacagcggatctggagagacgcgtaatctgggccttgcgaaagctacaggcaagtatgtcacgttcatcgatagcgacgactatgtagaccgtgactacttcgagaagtttgtcgatgctatcgagcgtacaggtgccgacgtggttgttggcggctacaagcgtatcgtggacggcaaggagcagttcgaagtcgttccgaaggacgtgccgtgggcacgataccaaatccttgctccctgggccaagatcttcaatcttgatttcatccgcaggaacaacctcaagtttgttccactcgtgctcggtgacgacgaccactttgtgacagttgcctattcctatgcaaacaaggttgcggttctttcgtatgctggctacaacttcatttgcaatagggagagcatcacgaatacgaagcacaagggactgcgcagggacatcgagcttaccgagctgcttgacaggatcgacgctgatgttaataagcgcgatgagctgctgaacctgcactatctgaagttgggcgtctactacatgctccgctcgggtcgtctggcaacgaaagagcgttttatggaagagcatgtgaagcttatggattggtatcgagagcacaatgtgcccctgaacttccctgtaaccagtatcaccacatccgaccctttgcaggttcgtcttgctgtcaagatctatctcatgctggcaaaggcccatctcatcggtgtctttgcaagcgtctactgcaagggtgttgtgaaagagtaggtcctatcggctcggatctgtatgtgatgccgctctccagacctaagcaatctggagggcggcatactttgtgcagtttttaagctgcaagcttcttattgtgggaaaggcggaagagcgacaagacagcgcctgcgagtgacgcgatgatcacgacatagttgatgccctgcatgtcaaaggtagcttccagtggaatcatggtcgcaagtgtgatggcgagagccgctgcggcgctgatgagcgcacccttgatgtcgcggcagatgacaaggacatcagtgaggtagtaaaggacagcaagcgcgctcgtgctgatgaggacattcgtgaagaggtaggtatagccttcgactttctgtccgtacacgagattcagaagtattggtccagcccatgcaaggactgcgacgcccacgacgatgaaagtgagcatgatgaggagcgtcttcttgaagaaggggaggaaggactccttgggagagtcattccatttctccgaaagaggcacgagtgccggtgcatagaggtagcgggcagcggcctgtatgaggacggcaggagtggccacggcggcatagatgccaagacgctcgctgccataggcattggcgtagtactgtcgggcaacagagacgatcatgccaaggaagagaatctccaagacgatggggaggcattcgacaagcagatttttcgcctgctcagccttgatgctgggacggatgtcgtcgatgcggtgtgcgtgcggaatgtcgtaggagattgtcacgatgagtcctgcggggaacatggcaaggatcgcaaggacgatgttctgcgagaggtagagaccgagcgagaaagcaaggacggcaaggacgccacggatgaactgggagatgccgatatagtccatgcgctcgccacgctggtcaacgccgtagagcacatcgcagaacgattcgtcgatcttgaagagcagataggcaaagacagcgatgagggtgaggctgtctggagagacggccacagaatagatgccgataacgatgagaccgatgagcagagtgatgagcctgaaggcaacgtagttcctctgggagtacttgcccttgatatccgacacctggtacgtcctcatgctgtaggtgcctactgccgtgaacatgttgcctatggtcatcgcaaatgataggatgccggaatcgctgtagccatccgacaggatgaccacgaggacggtagtgatccatagacagccttgataggtcaggctgcctatggtgttgtagagcatattctttttgatatcgagaggctctggctggttttccactaagggctcctaacggtagcgtgctaccacttgatatcgatgccgaaatggttgatgacggcgctgtaaaccgagaggaaggctggtaggagtcccagcttgtagaacctggagaccgtcagtagcctcttgaaggtcttgccgtgtgtccttgcatactgtccattgatgtagggagaatcatgccaggtggggaagttcttgttcaggaactctgtgcacatctggatagttgccttgaggtcgcagtcgggagaggcggcgaggcggtagttgaatgagatgccgaggtgcaggaaggcggcagcgtcgagtgcctcctgcttgcccttcgaagcatcgtgcgcggcgtagcgctccttgacctccttgaaagcctcgtaggtcggctcgatctgctggggtttcacggtctggatgatggagtcggagcggaccatgtagttgacgagagattccggtacaaagacgacttcgccattcatctcgaggtaggcaagccagtggaagaggaggtcatcgagtacaggtggctccgttggcagatctacgagggacttaatcacgcttgcacggaagatcttgttccagggagcgccattgagctcgaggagacgtcccggatccttgctgattgtgaaggggctgcgctggtcgcacatctcgcgggagaggaccttgccagttgcaagatcggtcctcgagaagccgcagacagcgatatctgcatctgcagcctttgccgtatcatagaggtcctgcaggaagttcggctctgcatagtcatcgctatcgaggaagccgatgtactcgcccctggcctttgcgatgccgtcccagcggccgcgccagacaccttcattcttcttgtcgataatgacgatacggtcaggatagcgggactgccactcttgcagaatatcgatgcagtggtcgggagagccatcgttgatgaagatgagttcatagctgtcgagcgtctgtcccacgagcgaagcgatacatttcggcagatacttctccaccttgtagcaggggatgatgacgctgacttttgggcttcgattaggcatgacaattactccttaacagcgaagatagggatcgaaagatagcaacaatatagtatcgggacgctctgggaaaagaaacgcaggagtgaaacaactatagaagacatgctgttggcagggatgcagactgcttggcgcagagctctccgatggccctacggatgcttggctgcttgaatgtcacattcagagcatatgcttcgccgttcgatataatatccgtaattatcagtcctgcatttcagacaataagaagccagctgcttcgattggaacaagaagatgtatataggttttctgcttgcgatagtatttctgttcttgcctggctttgctctcgtaagggcatttagtatccgagtgcctctgcctctctccgtttctatggctcctgtggtaagtgcagcatattacggtgtgcttggcattctatattcatacatcggtataacatcttctccgcttaccatgctggttcctgctgctgcattgctgattatcgaactcattctgcatatcagaaagggcaggtgccatatcctgtcggattggggtactgttggagcgatagcgctgtatgcagcggtcggcacatgcataggctggtatgtattcgttcgctccttgccgagctatagtgggatggtcgaacagtatgatgctatcttccatgccaatcttgtccaaagatttattgcaactggtgatttctcctgtatgggaatagatacaggaacattagattcctctttctatggaagcagtactactggtttctatcctgtcgcgtggcatgaagtcgtggctctggtaacaatgtctggcaacatatcgtctactatggccatgaatgcagtcaactgggcttactgcagtgttgtgtttcctgttggcatacttggcctgttcatggtgcttttcaaagacgacagacagacaatcctcatcggctcgatagtgccggtggcattcactgcctttccttggagagacttactttggggaccgatattcccaaacctggcatctttctgcagcgccccagctgtggcccttgctttcttggtactcttctcacccatggccgaggtaaaagacagagggaaacttcttgctgcggggattatgggaattatagggcttggaatgctgcagccgaacgctgtatttgcagtggcagtcttcgtagtcttctacattatgcatgtcatgaacagcccagagggctatcgctgtctgccacagcattctaaggatagacaatattctgcttccggccgccgtctgcagtctctgctgcttcttgtcgcatgcattgctgtatggacgttgctgtatagaagctcctttatgcagggggttgtatcctactccgcttgggtttcctatacaacagcagctcagtccttcatcaatatccttgcccaagcatacatgaaaggaatgaactattacacgtttcctcagctatgtctggcggcaattgtgctgctcggcattgctgctgcgctccttcgcagagagacccgatggcttatcgtgccatatggtttcttctgtatcgcgttcataatcaatgtatcaacggatggtttcctcaaacggtacctcacgggcttctggtattccgatccgaatcggattgcagccatctgtgcaatcatggcaatgccgcttgcggcaattgggctttctgttatttgcacgtgggtgcatgcggttatcgccaggcattccgacctgccagagaagcttcatggtcccttgcccgctcttctgacagctgcggtctttctgcttatgaatttctatccaaactatattgatccggagaacagcgctgcggtgaccacagctttcgacgaaattcgcagtcagtatgcaaccgcatatgcaaagacagctccatattccgaagctgaggaagctttcgtccaggaatgtctgagcatccttcctccggatgccctcgtcataaatgatccgagcgatggaagcgttgctgcctatggatttgatgggctgaacgttgtttacaatcagattgagacaggactgagagcatccgactcagaagattcccctgagagccaacttattcgtacgtctctggtcaatataggtagtgatgctgcagtgcagaaggcagttgctgataccggcgccagatatgtcattctgctttctaaagatgatggtaacacatcggtgacagagcattttgtctctgagcagtggagcggcatctctggaataggcgatgaaaccccagggttcaagctgctgctggcggatggggatatgcgcctgtatgagatagaggaataaggccatatctggaaaagactcatctggcagtccgttcagcattgattttcggcaactagttgtatgcatcaatcctggagatattgaactagtggccgcttgtgacatagaatacgctgagattgggttttcgcggtctctagcgggtagcgcatgcaagctgactctgggccgtgaagttgagtttcccagtctgaggaagatcatcgtcctgaagtagaccgtgttcctgaagcccctggcagcgctttccgctgactggacgagggagttgagcccttcgagaaacgaattggtggagcccttcctctgccagttgaggattccctcctgttccttcctgggggtcttggctaccctcttcatctcgactgagctgtaagcctttggtggacaggaggacgccagcaactggtggcaagtatcctttgcccagatgctcacccaacaccacctatagatttaagccatgagatgtcagtgagtgcaagtaaggcagaagaaggcaaagtcgaagtcgaagcttcccaggcagtatatagatgagtagcgcttaaaggctaccagtgctgcagcaaagccaggcaggtagacctaaagagaagcatcagggcgtacaccaaagagcttgaggtcagtgacaagaccttagatgagtgggttatcaaatacgaaaagatcagggaagctcacctgagccagggccgaagagcaaaagaagccagatgaggcgttaagacgcatcagggagtttgcaggcggcaaggatctgtgtggggcctctcataaaggccctcttaggcgatataggacaaggacgaagaggcactttagcttttttttaagctcttaggggatctaaagcagagcgactctagtgccacaaccctctatagcgtctacagatacatatttgagcttttaaggacaggtggcatctgctacagagctttcaagaggtgctggctttggacagggatacccctgtacaccctaaccttgtcaggtcacaagcctttgttgcgaccataaagcttataggcaacatagctatctttaaggaccacaaaaagctttatctagcttagcgtcgcaatgaagctgtgagcaccttatagccctcggctaaagcatgtagggacacctttaagcaagccttgttggctttgtccttaaaagatggcttatttgtgtgtggggatatatcgcctgtggggccatatcccacagcgagcagaacagccaatacataagcgtttaagcttgcctcccaggcggccttgcacgacgtgaggcacaccggggactgccacgacagtgcacaagcagaatcgcttctcgaaacactcaagggcaagtggtaccaccacaagcgcctacatcccaccacaaagcacaaggaccatcgggctcaatcgagtcgtaactacaaccgcttttgtccgcacgactccataggtaggtgcgtatctgcaaaaaggtcagacaggagctcttcgagcgcttcgagagggcccttccatccgatctggcggccacgcagactgcatagagatctgggacccctctgtcccttatattgatggggcccacctttcggggaggcgggcacaggatcttctggatcgacggtgcggctggatgttatctgaggaacccggctgctgtatcaaagccaagccgagtccgcgcatgagaatccatgccggagcagcgcagagcgacccgctccgacaacaaagcggactctctgaaggtacctcaggatctccggtggagctttctggctatcccgtgcagggcgatgagcagaagcagaagcgctacacccagaaggacgatggtgccgcctggcttgaggccgaaggcataggagacagtgaggcccaaagctgtgatgaggagcccgacggcgcatgaagcaatgaccgtctggcgccagcctcgggcgaactggagggcgcaggctacagggacgaccatcatggacgagacgatgagggcgccgaccgtccgcgcaccgacagagaccgcaaacgccgtcatgaggacgaatatcgcattgacaagcctcacattgacgcccgagacgcgtgctgcccgctcgtcgagggtgacaaggaagagctctttcctcagcaggatgcagagtactaagacgccagtacctacggcagcgacagcggcaagttcatcgtcgctgacagcgacgatcgatccgaacaggaagctcgagaagcttgcagcgttgggcacgaagcccgagaggacgcctgcaagtccgatgccgcaggacatgacaacggcaatcgcaagctctgcgtggccttcaaaacggcggcgcgccgcttccactgctccagcagcgcccaggcaggcaattgtcgctccaaggaccgggtcgattccgccgatgagtccagctgcgacgccagccaacgaagcatgcgagagggcatctcccatcatggagagacgcttgaagaccaccacgacgccgacgcagggaattgcaacgcctatgatgatgccggcaaggaaggcacgctgcatgaaagcatattcgaacatctgaagctagcctttcctgaggtcgaaaagcttgccgtcgcgcagctcgacgatacggctatagagatggggcagacgcgcaaggtcatgtgtcaccatcagcgctgcggtgcccgtctcctgggaggcctgggcaacggaaccaacaagcgtgcgggtgctctgctcgtcgaggctgctggtaggctcatcgagtatgagcagctccggtctgcagacaagtgcgcgtgcaagcagtgcgcgctggaactgtccgcccgaaagctcgcctgccagatgcttctcgaagcccctcagccctgcagactctattgcttgagctgcacgcttcctgtgcccggacctgtaggggagcagaggatgcgaagaggcatagagccctgacaggacaagttcccagactgtcacaggaaaccggcgtaggtcttcaggagcctgctgcggaacgtagccgatgcttccatcgaagtgcccgtgcgagggagtgcggcctagtactttcacagatccctcctgaggctcgagctcacccagcatgagtctcagcaaagttgacttcccggccccatttgccccttcgagcacgcagaagcagccaggctccaggaggaagtctgcacagtcgagaactttggttgtcccataggagaagctcaggccctcaagctccaccgcagccggagcagacgtcacgaaagggctttcacgagcttgccgaggttttccctcatgacagagaaataatccttgcctgctgcgagatcgtcatcgctcaggccttcgagaggattgagctcttcgcatgcagctccggtctcgtctgcgatggtctgcgcaaccttcgggcttactagctcttccgagaagatcgtcttcacattgttctgcttgacaaaatcggcaatcgtagccatggtcttcgcatcgggttcagagtcggcatcgattccctcgattgccagttggttcaggccataggcatcgcagaggtagccgaatgcctgatgggagacgacgatgttctttgaagtggtcttggcaagctggtctttgtactcctggtcgagcgcatcgagctctgaggcatacttctcgtagttttctcggtagacggattctccatcgggatctgccttgatgaggccgtcgcggatattggccatctctgtcttggcattcatgggagacagccatacatgggggtcgtactggctgctttcgtgctcctcctcgccctcttccccctcatgttcgtctttggctgcagcacgcagcgtgattcctttggatgcttcgacctggacgaggctgtcgttgccaatgctggacagggtgttatcgacccatttctccatgccagccccattgtatatgaagagcttggcggagctcagggtcttcatatcattggtcgagggctcccagtcatggggctcggtgccggctggcacgagattcatcacctggacacggtcgccgccaatcttttttgcgaagtctgccatggggtagaaagaggcgactacctgtaccttgctgtccgcattctcggcattcgccgtactttgcgtgctctggccggagcatccggcaaggcaggcgagtcctactgcagctgccaatacggctgtgagtatcttcttcacgatttcatcctccggaatcgtactgtttggatatgacatgctgatagtgcatacgggcatggctgcttgtcagccggcagcgaaagggcctggcattcttgcttcgaatctttccattgtccacagatgcactttgggacgctatacgctgtttgccttccggtagcagtcgggacacaggccatagaacacggtgcgccctgcatccaccgcaaagccatgctcgctgagcatatgctcctcgagtctggtcacctcatggcagttgatgtggatgagttttccgcattgctcgcatttgaggtgatagcagtggcccttgcagcattcgctggtatcgagcagctgaaagcaggcactcttctcgccttcgggggtgaaccgtacgaccagaccctcactgacaagcttgtcaagctgccgatatacggttgcgagcgagacagcagcccccagatctttaagccggctatgtagctcagaggcagtaaaatgtgtctgtgggcttgcgccgaggcattccagtatctccgttcttccgtgtgtgtcatatgtgctgcgcattggctgccatcctccaatctgcgaatgcttcgcaatatactagtggacagagaagctgtgtcaagcaaaattgcaaattattctcagattggctggatcgctgtagctgacggtaaagcttctgcagggtgcggtagaggacgtccggagtggttccgagtctcttgagcaatcgtcaggtgtaaatcggcagcgggatcaggtattccggcagtatcgccaggagccatctgcaggattgggaatgcgcaggatgggcatcgctgcagtctcgaagctggaaggtgctcacgtatcattcggggctcttcgctacttatggtgggtagcatatctgcatccccttgagggcgtggcctttaaacggtaggattttctccgacaggaggctgcgttctggaggtgcgatatggatgcttaaggcagggatgctggcaaggctcttcgagaggtcgatggggcttagggacgaatgggagctctgcgatgtctggtttaaggagcgcgagggagcgcaggacgagctccatgtgagggtggcccacaggaaagggcaggtggtggtgagccccgtatgccacaggaagtgcggcacctgtgacacgcgcgagaggaccttgtggcatcttagcatctggcagtgcgatacgatcgtgcactgcgcgctgctaagggccgactgtcccaaagacggcgtgcatgccacaaggatgccctgaaaggtacggccgaagacgcacttcacagcgctctttaaggcgcaggcgataagtgatggccctctttggcatgagcgtgacgccggtcgcgcagcagctgcacgagaccgacacgtgcatattgaggctgctgggcaaggccgtgaccgaggcaagggatgccgccgactactcggatgtcgtgcgcgtagggatagacgacaccgccaaaaggcgcaaccaaagctacatcagcatcatagccaacctcgactgtcagcgtgccgtggccgtcacgtaaggcagggacaagggggccttaggcaggctctgagacgagcttaaggagcacgcaggggacaggaagaaggtcttagaggtcacgcgcgacatggcttaaggcatactcgctggggggcggcgccaagatgccccaggccacacagagcgtgggacagcttccatgtggtgcagctcctgatgagggcgacagaccctgtgaggtgccaagagaggcgcgagtccgcctcgaagcgccggcaaagcgccggcagctcgcagggacgaagtacgtatggctcaagaagaaggagtcgctcacaaagctccagctcgccaagagggaggagctcgaccccgcgaagacccatctcaggacggcacgcgcctgccagatgggagaggcgctgcaggacgtctactcatgcgctgacagaaaatcggcggcagaggccccagagcgcctctgctcgtggatgatgcactctgccgtggccgagatgaagagcgtggcgagaaccctcaggaaggagcgggaggggatcttgaactggtggaagaggggatctaccaactcgttcctcgaaggcctcaactccgtcgtccagtccgcccgcagcatcgccaggggcttcaggagcatcacctacttcaggacgatgatcttcctcaggctgggccgtctggacttcacagcccagaagaagctggcatgcgctacccactagaaacagcgaagagccggaatctcgacgaccatatgcccacatgtacgcttgatagcgaaagcgatgtggttggcaagcgtgacaggaaggttcggcgagatcgtgcgggcagggtctgcgagctgtgccgcaaacttaagcacgtcttctgaaagctcgctcaccagtcccaaagacttaggatcgataccatagaacatgcgcttgatgtcggagaacggaatctcgcgcggtatcgtgccgaagccgaagctagtgccaagcgcgatgagctcgtgctctttgccgtcggtgtagatggcagcattgttgtggatgctcttgatgacgcgcatggagcttctcggtctgacaacgatggctcctgcattgtagcgaaggcccttgcgtgcggagggagagcattctgctgatggtaggcacagaacagacgccctccctcagagttgtttgcagagagggcactgacgtggacgtatatacaggctatcaggagagctcggcgcggaccttgtgcgcagcagccacgaggttcctgaggcttgccaccgtctcctttgtgcctctcgtcttgaggccgcagtcggggttcacccagagcttctctttcgggatgtgcttgagcatgcggtggagagcatcgacgatctcttccttggagggcacacgcggcgagtggatgtcgtagacgccggggccgacttcggtcctgaagcctgcttctgtgaggctcttgaggatcgagaggttcgaccgcgatgcctcgaacgtgatcacgtcggcatccatctcgtcgatctcatggatgatgtcagagaactcgctgtagcacatgtgggtgtggatctgtgtctcaggcttcacgccgctatggacgaggcggaaggcgggaatagcccagtcaaggtattccctgtgccaatcgctcctacgtagcggcagcttctcgcgcagggctgcctcgtcgatttggatgatgcggatgcctgcacgctcgaggtcgaggacctcgtcgcggatagcaagggcgatctggagcgcactctcgcggcgcgggatgtcctcgcgtgagaaggaccagttcaggatcgtgacgggtccggtcagcatgcctttcacgggcttgtccgtgaggctctgcgcataggtgctccagccgaccgtaatgggatggctgcgccagatgtctccccagatgatgggaggcttcacgcagcgcgtgccgtaggactggacccagccgttgtttgtgaagagaaagccttcgagattgtcgccgaagtactcgaccatatcgttgcgctcgtactcgccgtgcacgaggacatcgagactgagctcttcctgcagcttgatacagtcggcaatcttgcccttgatgaactcgtcgtactgctcctcggagatctcgccttttcttttggccctgcggcttgcgcgcacatcgctcgtctgggggaaggaaccaatcgtcgtggtcgggagaagcggcagtcccagctctcggtgctggattttctcgcgctcggcgaaggcgggtgtgcggtggaagctctcctcggtgagggcggcaaggcgctcgcgcacagccttgttcggtgctgcgtgcccttcatggaagagtgcatcgttagcagcgagggcagggtcagatgccggactgctgagcagcccttttacgctcgtgccgttgcctgccgcacggtccaggatgacgtggagctcattcagctctgcaagcttttcctcggcgaaagcgagatgcttcaagcagtcaggttcgagctgggtttcggcagatgtggtgtagggcacatgcagaagcgagcagcttgtggagagcacaaccttgctgtcaggtgcaaggctcttcagatgcgagagggcttgacggtagttcgtgcgccagatgttcttgccgttcacgatgccggcgaagaggacggtatcttttgggaagccggacgagacgagctcgtcggtcttcgtgccttcgacgaagtcgagaccgatgccgtcgaagccgagcttcgtgacagtcccatagacatcgcggatgtcgccgaaataggtctgaagcaggatcttgcagctgtgcttttggttcaagagggtgcgggcgatcttcacgaagagcatctcatcctctttgctgatgtcatgtacgagccagggctcgtcgagctcgagccaggcaccttctggtacgagcgccagaagcttcgcatagacagaagcaatcttttttgcccatacgttctcgtcggcaccctcgggtagctgggcgagtttcaggaacgtgaaagggcccgtgacggagatcttgagctgttctgctgcaagccccgcagcacgtgcttccccgatctggccacgcaggatatccggcacgaggtgaagctccatgctttcttcgagttcgggtacgagatagtgatagttcgtgttgaaccacttcttcattgcgagggcatgcacatcgccgcgcgtgccctggtagccatgagccatagcgaaataggtatcgagggcatcgaggccgagcttttggtagcgctccggtacggcgccgagcatcatggcagcatcgaggacgttgtcgtagagcgagaagtcgcctaccggtacaaggtcgagcccgcactcgagctgcacggtgcggttctcggctctgagcttggctgcctctgcggcaagtttgtccttgctgagctgccccttgaagtaggcttcttccgcacgcttgagttcgcggttttgtccgatacggggatatccgactatggtcgtcttcatgagctgcctttcacccgatagcttttcttcgcatcagagtataagcatgcaggtatcgtctgaataatatctattatctattcgctgcctcaagatatagcgtgagactatggatggaggctgtattgtcaggatgacaagaggcacgttccgctgtctgcaacgcctgtatcctcatcgttgccgaacgagaacatgacgtcgccgattgcattgccgaggacagggccaatcggaacaagagcgcagaggcccacggggaccatcacgaacatcgtgaggaagggcacaaaggccgtggaaagcatgtcggggatgacacgcttgaagaacttttcgacctgccggagcaccggcatgcagagaagaatcggaagcacggtagaggagtaggtgttgagcatcgcggggatgccatagaccgacgtgaaggtctggccggtctcggctgctgccgtgacgatgttcacgaagtcaggagcgatcaggacgccgcccatcatcatgccgagcatcttcgggcagccgagctgctgtgctgccgagtatttcagatatattggcatgaagtagtagcctgcgtcgtagatccagttgtagaagaggttgtagatatcagaatctgctgctcagagattgagcatgccgggaccagcgatgacagcaattgtgcggaacatggcagcgcccatcatgacagggatagcagcgaccatggtcttggaaagatagttaaggattgcctggccgacgcgcttggcgctccaaggcttcttcggcagattggtgtcgaggttctcgtctattgcgccgccggcagagacgccgagcttcacgatcgcatcgtagaccttcgggacgttctggccgatgatgacctggtactggccgccggaccactggcagccgagggcgcccttgattgccttgatcttgtcgtcgtcggggaccgattcatccttgaggttgattctcagccttgtcatgcagtgcgccgatgcttgtgacgttgtccttgccgccgattgcggcgaggacccctttcgcgattctctcgttgcctgccatctttgcctcccatatcagagcgttgcttcccctgctgctctgattattccgaggaggtgccatccttggaagccgtagctccaagaggtcgatgcctaacaaaaatgccccccgagccataccagagcagccgggaacacagaatctgtgcgtcccagccttggtaatgtctcgtagagcgaagtccagtgcgtagcacccaatgcaggaaagagattagggcgggaagacggctggaccgaagcaggtaggggcgaacggtcggatatcctctgcgaacggcagatggctaagcctggcctgaggtttcccgctcgaaggcacggttcacatggagggtcagataggcccgctcctcctcgtcgagcttcgcatccaggctcttctccaggaagtctgccacagcattcccgcaggcagagacatatggatagccctcttcgagcacaggcaggagcgctgcggcacctgacgagacatactcacccacgataagcctgccgatgagatagcgcatgtgggttgcaaagcgggcgtagtcgaaagaattgcgcccgaccgtgatatggagcttttcctctacgatcttcgtgttgtcctcgatgagacgctctgtcgtcttctggcgctctgcgtcgtgtgcgcttgcaaagatggcgcagctcacgatcgagagggcgatgccgactgcctcagtcttgggaaggcgtacattgaacgtgcgggagataccgtgcacggccatctctttgatgcgatattcggcaaggtagctctgctgcacatcgtaggtaaggggtatctcgacgaccatatgcccacgtgtacgcttgatagcgaaagcgatgtagtcggcaagcgtgacaggaaggttcggcgagagctcgtaggagaggctcgtgcaggcaaggtctgcgagctgtgccgcaaacttaagcacgtcttctgaaagctcgctcactagtcccaaagacttaggatcgataccgtagaacgtgtgcttgatgtcggagaacggaatctcgcgcggtatcgtgccgaagccgaagctagtgccaagcgcgatgagctcgtaccctttgccgtcggtgtagatggcagcattgttgtggatgctcttgatgacgcacatggagtttctcggtctgacaacgatggctcctgcattgtagcgaaggcccttgcgtgcggagggagagcattctgctgatggcatcaggactctgctggagccttgatgccggactgtgtctgatgcaaacgggcggggattttaccgaaagcttcccgctctctctgcctacctaccacatgtgggccggctcgtgcagaagatatccttcaggctttctgcatccttgaagggcacccagccattgccctgggcccatttcccgagattgactccatcgctcgtgatcatgttgcccgaagccaaagcatcgaggaatttctcgtagccaccgaggccaccgacatcttcgggaggtgtttcgccttgggcgttcacgatgtaggggagcttcgaggcatcttcgagcctcaagtttgaagcggtgagagcaagggcccagccatcgccgtagtcgtagtggtagacgaggccaggacctgaaagctcgatagcggagaggtcttctggagagcagctctttgctttggcgagcttcctcatggtctcatcgcccataaaatagcagccaagcattgtttgctccggcagggtggcattcgggcaatcgataaggtcgggatcaggatcgtcgaatagccccaggaagtcgtgatagagccagcgggggctcaggtggcaggtcttctcgaaggcagccgctcctccctcgtagaatcgctccggattgccgccccattcctttatgcggtctatgccaagagggagctcggggaagaaggcccagaaggcatcttcaagcgcgctctgagctgtcctgtcgaggagctggaaattatggaggtggtagtcgtaccagcgcatggtgcgctgcagggcatgatggagccagaagaggcttgctgtggcaggaacggcaatatcgcggaagaaggcaccatcgcgccaaggctttcctgtgtactcgtcgagaagcgtcgcgtgcagcgtaagcgtcggcaccatgagaccggcaacctcgctctgtgccttcgcatgtgtcacctcgagtggtatgacatagccgcccttggcagtcttgtcgctcaccagataggaggcaatcacccaggagtcatggtaatcgacgagctcgttcgtgcggtcaaggatcctgtccacctgaaggcacgcaagatgttcacgcgccatattgagggcggacgtcgccttcctgttgccgttggggacaaggatgacagatgagccagcagagccgtcaagggcttcatagccgagcttcaggtccttgcgcatctggtacatggtctcgaaacagcgcttgagatggaggtcgatagcctcgggcacgatgctgagctcgccccacattccgcggatgaaggagccgaaggtcttgtccagatcgaggaagtcctgcggcgccagcccttgtgctatcactatcgatctcatcgctgcgttgtagagataggccgtgcggtaggtattcgtcagtgcgggcttgccggcatggagcggcaaggaatccatatcgaggttccagagatagggcacacgctcggggtgctcgtcgcaccaggcccgaacgcgcttgatatcttccttgctatcgacgatggcagggaagaagcgatccttgccgatctcctgagcaagggcttccttgataagcgtcagggatctggcagagcagaaaacgatcatgggtgctccttcggctgtagttatccgtcccttcagtatatcttctcatggtgaatggcgcagcatgaagggaggagccttcgatgggaaagagcgaaagagttgtccatatccagtatgggcgcactgcgacctatcttctggaaggcgcagaaggctccgcgcttgtagatacagactgggctggagcgcttggctccttcttcaaggctctgaagactcaggtacttgcggttgaagacatcgggtacgtgctctgcacacactggcatccggaccacaagggcatcgtcggcggccttgaacgcctcggcgttgtctctgtcgtcttcgatgtgcagctgccctatctccacacgtctgacgcggtctttgcaacggatgcaaagcatcgcttcactcctgtggaggatacggacatcaaggtcatgccgctctctcagagccgtgcgttctttgcctctttgggcatcgccggagaggccgtctctacgccgaatcattctttggacagcatctctgttctgcttgattccgggaccttctgcgtcggtgacctcgcaacgcccgatatggtggcagcctatggagaaagcacaccagagcagcttcttgctgactgggagcctctgcgttcccgccatccccatcgcgcctgctttgcgcatgcaggagagcttgcttgctgaggttagattctcttgctgaagagccggacaaggaaagggagcggaaccatatggctccgctcccgtgcatccaggtgtctgcctaaagcctgaactgggcgctcttccagcgcgctgcttcgcgctcgtcgatgtctactcttgccatgcagaagtcggcatgtctcgcttcggcgctgctgccttcgggtatgctgttgccgtctggatcgatgccttccactgccgtggggctacaggtctcgctcgaggcgccgggcacgcggaaggtgttcacatccagaggctcgatgcttgtctcttctggcttctcgagctgcggcacccaggagtaggggatgcggtaggcgcggtagaccatgttcgtcgagaagccaggcgcgaattccctcgtatagggattgatgaattcccagacgatctcatggttcggcgtgacctcgatgatgcggccatcggagccttcggtgatgagggcattgccgttctcgaggcgctgggcgcttgagatataggaggaatagaatttcgagccgtcggagaagggcatgaaccctgctttgaccggcgtgtattcccatacgacgtcgaaggtcacggggtcgaattcgaggacacgcgaatagtctcgcctcaccgcgctcacgccgtcgggagacatcgcgttgggtgcatcgtagccggccgtgccgccattgtcgaagacgaggagattgccggcaccgggaagtccctcaggaatcatgtgcaggtggtgctggccgatgatgcagccgagcttctttgcgccttcgctggcattcggtccagcgtagtcggggccgacctgccagacaatctttccagtcttcttcgagatgatcgcaaggatattggcattgcgggaatcgaagatgatgttctttgggtcgaagcgctcgtcccctgcatcgaagaagcggttcggtccgaggtaggagatgctgttcacgtgcagccagtcgccacctgccgtgcccctcatggcaggattggcacgcagtgccttcttggcagcctcggagaatccaaattcctcgaagtggtctgcgcagcgccactcccagaggatcttgccgtcctagctgacctcgacgatcttgtcgtcgatcaggagcttgtccgagatctcgggcttcagcgtgttctcgtgggtcaggatgagagtcctgtcgttgaaagcgcttggctcctggccaggtgcatagtagccgacaggcgacccttcgagctggaagtcatggtgctgccgtgccatccatctcggctctgtgccctcatcctccacgagctcggtatggtcccgcttccagacgatcttcccatgccagtcgacttcgataaggtcgagctagtcctggtaggcagcctctcctgtgtgcctgcccgagctgccgaagacatagccgcctggtgccatctttgctgggaagccctggaggcctgcccagcagtggacctcgcgcccgttcatatcgatgaggaggacacccttggaggtggggaagagcgtgtagccgctccaggcacggtccttatcgaagatggtgacgccggtcggatagatggatgggtatcccatggctgctcctgttctctgcatgtattggggggggatgctcagcctggctgccctgaaagcagaaacctgctgaatgtcattgtcggcattctatatccagaacaatcaattcagttgtccaagatatagataactgaccatcggaaagaggtaaaaagggaagcttcctgctgagcctagactgaatcctatgctcgaacagagagccggatagcagtatttcagtcttgccgacggaaggagagaagatgctgggacgcaatgtgcatacggcacagcggacattcacgcgcagagaggccctcgagggcatgggagcctgtgccatgatgctggctctctccggatgtggcaccggtgcacttgccgaagcggcatcctttggcagcagtgcctccgcctcctcctctgcaggcgagaccgtcaggattggctttccttcgagcggacagagcttcgatgcggcaacgccgcttggcatagcggaaagcaaaggacactttgcgacctacctcgaacctctgggctatacagtcgagacgtcgagcttcgtgggggcagctcctgcgcttcatgaggcactgatttcgggggacctcgacctggtggactatgccggctttgccggcatcctcggcaagtcgaagggcatcgatacgacagctatcgccgtcacgcagtggggctcgggctagtcgcttgccgcggctccggatatcgcctccatcgcagacctcaaaggaaagaaggttgcctatcagcgcggagcgacaccacagatgttccccatcaaggtcctcgcagaaggcagcctcacgtttgacgatgtggaggccgtgaatgcgaccgggcctgatggactctcgtcgctttcggccggtgctgtcgcggcgaccgtctgctcgtcgggacaggagcagagccttgtctcccagggccttgccaagacgcttttccgtggcagggatggaaatccttccatctacttcgagccgttcacgctcgtggccaggaccctgtggctgaaggagaacgcagacgctgccgttgcggtgctcaaggcctatctcgccgccaaggcagagatagtggcagaccctgatgccttcatctgagctgtaatcttttggtggacagtaggattcagggactggcaacagatatgctctgtccagatacccacccagcacagtcaacagattgaagagatgagatgtcggtgagcgcaagcgagatagagaaggcaaagtcccgcacgaagccggaaacacccaaacactacactgaagaagtattgccttgaggccatcgactactacaggaaggcacgtaaggccaacccgaagaagagtatcagggagtgcgccgcagagcttggaatcaacgacaagaccttaaacgactggatcatcaagcactcaaagaccaaaagggtgacccaggaaaggatagacgagcacaagcagctcgacgcagtgaacaggcgcatgcacgagcttgaaagcgagaataagttcctaaaaaagaggcagccttcttcgccggaagcctctgacgaaggacaggttttagctcatgctggagaagagggcaacctacagcgtctcgatgatggagcgcgtactggaggtgagcagggctcacttctacagatggctcaaggccaaaggtggtgaggacctatggggtcctatcaaggaagccatctgcgcgatatgggaggaaagcgacaggcgctttagctcctgcaaggtctgatccaagctcacaggagatccgaagttacgcaaaatttacaggcacgacccgctaccgtgtgcgcaggtgcatggctaagcttgggcatctgcggcatctgatccaatgcctccaagaggacgatactgcccgcacctgatacccccgagcgccccgacctcacccggcgcgacttttcgtgtcctgtgtcgacagccaagctcgtgggtgatacaacctatcgcaggaccacggcaggcttcatatatctcgccgtcgcgcacgatctgtgcacacacatggtggtgggctgaagcatacaggacaacatgagggcagggcttgtcgtctttgccctgaagatggcatattcgcgcggatacgtggctggaggggccatattctaagcagtccaggcagccagtacataagctcaaagttcgccgcctgctcagccgcacacgacgtgaggctctccgtggggagaaccggaagctgccacgacaacgcgctcgccgaatcgcttttcgccacgctcaagaacgagtggtactaccataagcgcctcttagacgcatccacgaccaagcacaaggcacacgagtttaatcgagtcgtactacaaccgcttccgcccgcataagtccatagaagatcgcgtgcccgcagaggtgatgcaggagttcttcgagcgcttcgagagaggccttgcatacgatccaaaggtgatgcagaccgcataaaaaatctgagatttctctgtccattatattgacagggctcaatctcctacgctgccgtacagtcgggacagagcgaggatatggtcaggtcctggcaggacttcgacgacttcggcgcgaactatccgctgagcttcgatggcacctatctcgatgcgctctcgagcatccaggacttcgaagtggaaaacgacatcatcgccgaggagatcgacatcgcttcctggacagattcctcctacctcgagcgtgcccagcaggaatttggaaatggggactagctgtgaaaaagaaggtccttcatttcctcgagatgctgattctgcctgccctgatcctcgtgctgtggcagtgggcaactgtctcgggggccgtgcctgcaatcgtgttgccgactcctgctgccgtcgtatcctccatcgtctcgcagcttgccttgggcaggctcgagaacgatgttgcaatcagcgtctcgcgcatcctcaaaggctatgcgcttgcggtcgtcttcggtcttgccttcggtgtcacgatgggcatgagcgagcacgtaaaccgcttctttggaggcctcttcaaggcaatccgccagatcccgatgattgcctgggtgcctcttcttgtcatgtggttcggcatcggcgaggagtcgaaggtggctgtgatctttatcgctgccttcttccagattctgctcaatacgatcagcggtatccagcgcacggacaagaagctcgtcgaagttggaaagatgtaccagctctcgaaatggtgtctgttccgcgagatctatctgccaagtgcgcttccttcgattttcgtcggccttaagcttggcctttctgtctcgtggatggctgtcgtcggcgcagagatgatcgcagcgagctccggcatcggcttccgcatcaacgacgcgagagcgctgctcgactatccggtcgtcttctccggcatgatcgcgattgccgtcgccggtgtcctcatgggcctgattctttctgccatcgcaaagggctgcatgccctgggaaaggggcgagaagcatgcctcataagctgagcatccgaggtgtgagcaagtcgtttgctgcctcgtcgggcacgcttccgtgctcgaggatatcgacctttccgtggcagacggtgagctcctcgtgatcgtcggccacagcggctgcggcaagtcgacgcttctgaagaacatcactggcctcgaggaaccgacgaaaggcgagatcctgctcgacgggaagaagatcgcaggccccagccctgacaggactatgatcttccaggagcacaggctcttcccgtgggtgacgatagaggagaacgtcgcgtttgggctccatgaccgtccgagggcagagcgcagggaccttgttcggagctacctttcgctcgtacagctcgaaggcttcgagcatgcctatccccatgagctctcgggcggcatgagccagcacgctgcgatcgcacgggcacttgcaacgaagcctgaggtgctgttgctcgacgagccgttcggcgccctcgatgcgctcacgaagatggacctccaggacgagctcctttccatccgcgaccgcgagaagacgaccatggtcatggtcacacacgatatcgaggaggcggtctatctcgctgatcgcatcgtcgtaatgaccgagcgtccgggaaagatcgcggagatcgtgctgattgagctcgggcgtccgcgcgaccgtggcagcgccgacttcgcctggtaccagaagcggattctttcccacttcgtgaagccgaaggagaagcagatcgactacgtgatctaggagcacatcatgaagtgggatgcatcttcgggccggaggctccagtcctcctctctgtcggcccatctcttgccgctgacctcatggcgcccgccatggcggcggcatatggagcatgcatgctattgcatccgatctgcatctgttccttccgatgggggttgctgaccatcagccttctatataggaaacgatgaattcagcaatctgtcgaagcgatagccaagcataggaaagaggtagtagaggcagtcccttcaggcgcatatactgaactttatgaccagctctgggttggagaggagcaaggacatggcaaagatcgacaatgccgcgctcaagaagggcggcttcatggcacagaagcagaaggggctctactcgctgcgcctccatatcacggcagggcatctgacgtcgcgtcagcttatcggcatctccaaggtggcagacacctttggccacggctacgtccatctgacaagccgtcaggccatcgagattcccttcatcaaggtcgaggacgcagacgccgtgaaggcgatgctggctgagtacggcgtcgagccaggctgctgcggtgcccgtgtgcgtacggtcacaggctgtcagggatcggctgtctgcccctcgggcaacatcgactcctatcgggtagccacgatgctcgacgagcgctacttcggacgcgaccttcccggcaagttcaagttcggtgtcacgggctgccagaacaactgcctgaaggccgaagagaacgacttcggcatcaagggcgggcgcaaggtccaatggaagcctgatgcctgcatacactgcggcatctgctcgaagatctgtaagccccaggctatcacggatgacggggagaagatcgtcgtcgactatgcgaaatgtgtctcctgcggcaagtgctcgcagaagtgcccggtcaattcctgggactaccagacggtctacaacctcacgttcggcggcctctttggcaaccacatcacgaagggcaggaagatcctgccgccggtcgagtcggacgagcagctgctcgctgtcgccgatgcgacgatccagtggtatgacgaccacgcaatcgcaggcgaccgcttcaagttctgcctcgaccgcgaagggtgggagagtttcgttcccgtggtcaggaaggcctacgacgaggcggcgcccgagggctgccccaaggcaaattcggtagaagtcgagccggcagcgccggtggcgcagcagtaaggagaacaagatggcacaggagccctatgaggtcacagataccgtcgatatcacgaatctcgtatgcccgatgacgttcgtgacggcgaaggcagctttggcggagcttgagatcggcgaggtgctgagggtgcatctggcggcgggcgagccgatggaaaacgtgccgaggagctttgctgacgacgggcagaaggtgcttgccctgaaggaagcagacgatggcgcctacgatctcgatgtgaagaagctcgaagacgaatagcgcatatcggtaccttggataggcaggaaggatagccatgaacatcacagtgggcggagagaagaggagcgtgcccgaaggggagaccataggtgcgctcatcaaggacgagaaggtggagaacgcggactatgtgaccgtagccgtgaatgaggtcttcatcgaccacaaggacttcgcagcgaccaagctctccgaaggcgatacggtcgagttcctctatttcatgggtggaggccgctgagatggcattctcacctgacgagctcgagcgctattcccgccacattatcttgaaggaggttggcgtcaagggccagaagaagctctgtgctgccaaggtcctcatcatcggtgctggcggcctcggcgctccggctgcactctatctggctgcagcaggcgtcggcaccctgggcatcgtcgatgcagacgaggtcgagctctcgaacctccagcgccagatcatccacggcacctcggatatcggcaagccgaaggtggaaagcgccgcagagaccctgcacgatatcaaccccggcgtgaatgtcgtgacgtaccgcgagttcgtcgactcctcgaacatcgccgacctcatcgccgactatgacttcgtgatcgacggcgtcgacaacttcccgacgaagtttctgatcaacgatgcctgcgtgatgggcagaaagccgttcgtgcatgcgggcatcatccgcttcaagggccagctcatgacctacgcgccgggagagggcccgtgctatcgctgcgtgttccgcgatatgcctcctgcggatgccgtgccgacctgcaagcaggccggcgtcatcggcgctcttgctggcgtcataggctgcctcgaggcgcttgaggccataaaatatatctgcggcataggcgagcttctgacgggaaggctccttacgttcgatgcgctcaagggagacttccacacgatcaagctgccaccacgagattcgaactgcccggtctgcggcgaccatccgaccgtgaccgagctcatcgactacgagcagccgtcctgcgtgcttgcgcagcatggcacggcgctcacctgagaggagaggcatgctccatctgagcggagacgatttccacaagatggcagagtgggcacgagagcatatgcccgaggaagcctgcggccttctggccggctatcgcgacgaggaaggagatgccttcgtcgagcgtgtcttcatctgcgagaatgccgaccacacctcagagcacttcacgatttcgcccaaggagcagctgagggccctgaaggaagctcgcagctccggcatggagatcttgggcaactggcattcgcatccggagactccggcacgtccttctgcggaagacctgaggcttgcccaggacccttctgccctctactgcatcctctcgctcgaagatcctgcctggccggcactcgtcgcctatcgcaaggatgcggacggaaatgttgcaagggtgctggtgagccatgacgcgtgagggactcgtctttgcaagctacgggacgctcgtagatgaggcgaggcagagcgacattgccccggtcgccgaagcgctgaagggcgcctttccggaggatgcctttgccgaggtctatacaagcgcctgggtaagggggcatctcgcgaagcgcggcattgcctccacaagcctcggtgaggcgcttgtctctcttgctgatgaaggcgtcatgcatgccacggtccagccagggctcatcgtctgcggcgatgcgtgggacaagcttgcagcggaggcagcagcgctcgctgtacgctttccggaagggctttttctcggacgtccgcttctggcagatgatagagaccagaaagaggtcgctttcgtcatcgccgaggcattccctgcacgtccttcccatgcattcgtgcttgtaggacatgggacaagagaggcggcagatgccgcctacacaggcgtcgtctgggcgctccacgaggcaggacgcaccgactttgcccttggcctcatggagggcgcgcccgatccggacgaggcagcgaataagctcgtacgcaatgacacgcattcggttacaattgtcccgctcatgctcacggcaggaagccatgtgcgccgccggcttgcgggagagggcgcggcaagctggacatcgcgcctgagcgcggccggcattgccacagattgcacgctggcgggccttggctccctgccgggtgtgagtgccatctttgtccgccatgcacgggaagccgaagctatccgctgagacagacagcctgcatttcatagacatcgatatcgacagaaaagagagcattcccatgctgaatgacagccgtcttgtgcgtcctgctgcggtggcagccacgcttctgctcgcctcgagccttgtggcgcttcctgcctgcagccagaccacgtcttccacatcctcgacggacactgcctcgtcgagtgcatccacggcagaggccgacagcgtcacgttcacggacgacctgggacgcgaagtcacggtctcgaatccgcagcgcgtcgttgcctgcatgggttcctttgccggagcctggcagcttgcaggcggcacgctcgtcggcgcttccgatgatgcctttgcgcactacggcgtcgattcctcggccgtttctggtgtcggcaagtcgaccgcgctcaatcttgagtccatcctcgacctcgatcccgattttgtcatcatgaccggcatctctgacggcaagcactcgacgggcgtctcgcaggaggacatggagtcctcgctcgacgaggcaggtgtgccgcttgccttcttcaaggtcacgacgtttgccgactacgagcgcatgatggggatcttctgccagatcacgggcagggacgacctctaccagaagaacgtggccgatgtgaagagccagatcgacgaggacatcaagacctactctgttgccgacaaggcaccgaccgtgctcgtcgtgagcgcctactcgaagggccttgttgtgcagaattctacgggcatgacaggagcgatcgtgaaggatcttggcggcgtgaatatcgcagacgagaatccgagccttctttctgacttcagcctcgaggcagcggtcgaggcggaccctgactacatccttgtgcttgccgcatccgacgacgaagcgacagcgcagaagtactatgaggatgcggtcggctccgattctgcctgggcagacatgaccgccgtgaaggaagggcgtgtcacgatgctcgatgcagcgcacttcctctacaagccgctcgacaaatgggccgagtcctatgagatcgtgggccaggcgctcagcaagtagggatggctgtgggcataacgcatcagcatgagaagaaggcagcaggggcaagaagcatgcgcttcggtgcccttgctgccatctcttttgccgttctccttcttgccatgcttctgggccttgtcttcggtgcttccggcgtcggtgtgggtgacgtctggacgcttgtagcaggaggagacccacctgcgaaggcgagaaacatcctcgtctcgatccgcattccccgcgtactggcaggtgtcctggcaggcgctgccttcgcggtatccggtgccctcatccaggaggtgctcgataacccgcttgcaagcccgaacatcattggtgcgaactcgggcgcaggactcgccgtgctcaccgtgagtgcgctggcaacggtcggcatcacggtgccgctgccgcttccggcggcagcctttctgggtgcccttcttgcgtcggcgctgatccttcttgtttcggcccgtaccggagtctcgcggctcacggtcgtccttgccggcgtcgccgtgaatgcggtcttcggggctggcatgaatgcggtcttgatcatcgcaccgaatgcctatgtcggctcctcatcctatctcgtgggcggactttccggcatcgtgctttccgatctcgggcttcctgccctcttcatcgcgctcggccttgctttggccctcatcctggcgccccggctcaacgtgcttgcccttggcagccagacggcgcatgcgctcggcgtgcccgtgcggctcctgcgggtagcaggcctgaccgttgcctcgcttctggcgggtgctgccgtgagcttctcgggcctcatcggcttcatcggcctcatggtaccccatgtggcaagacgctttgtcgggcgtgacctgaagcgcgtcattccgatctctgctgtctggggtgcggcattcacggtgctctccgaccttctggcacgcacgctctttgcgccttatgagctgccggtggggatactcatggcgcttgtcggcgggcccttcttcgtcttcctgctcatgaagggaaagggataccgcgatgagtgaaaacgtgctcgcgttcagggacatctcgttcggctacggggagcggaagctcttcgagggcttctctcttgccattcccgaaggcggcatcacggccgtgctcggcccgaatggctgcggcaagtcgacgctcctttccctggcagaggggatgctgaagccctcttgcggcacagtcctgctctcgggtaccgatacgcatgcgctctctccgaaggagcgggcgggactcatcgcgatgctgccgcaggtgcacagaaccccgtccatgaaggtaagagacctggtagcctgcggccgctatgtgcacatgggacctttcggccagctcgataaggctgactgggacaaggtcgacgaggccatctacttgatgggcctggactctctggcagagaggaatgcgagaaagctctcgggcggcgagcgccagcgggcgtttcttgcaatgacggtcgctcagggagcgcgcacgcttctgctcgacgaaccgacgacctatctcgatgtgagggcagcgcacgacctcatggcgctcgtgagaaagctggctggggataagggcatcaccgtcatctgcgtgatccacgatgtggatctggctctgcgcttctcggatagtatcgtcgttctgggaagcgagcggccgacccgccttctttccacagggataccggatgcaattgcagaaagcacggtacttgcttcttctctcggtgtgcgggctcagcgcttcagcaatggcggggagacagcctatggcatatttcctgccaacagggcataaaggcattttgacctgctgattcttcaatctgtaaggacttcatcaggctgagatcccaggcattgacctaagatcaatgtgatatcacaatgcaaccagattcagagggcaggctaccaggcaggcaggctctctgagagaaaggatgctcagccatgagtgtcgagaagaaggcccatgccgcaagcggattgggggtggctaagctcattgtttttgtgttcttgcaatgttcgtgctctctgtcgcactcttcatcttcgatatcacggctctcgtaggagcagatgaagcaatgcgtcccgagcgccttcggcatgccctcatgatcatctttcgtagctgcttgtttccctcgaacagcttcttcttgctccagtcgggacaggcccgtgtctgcgtgctcctttggcaagtacgtcggcacccgtgaacgattgaaggactgagggggccaatcccgatctacgcaagaatctggcctcgttgaggaggactcgacagcgagaagccggagcatgccgccattgcctccaagagcgtgcgtggctctgttcatctcgatgcgtcttggaccttgaacggtgggcgctcaaggtcaatgaataagatggggcaaccgatcgagatcgagccacacggtgtctcctggcgtgtcgccgatacggccaaggctattttcgagtgtcgactatgagtcctatgtctccatgcagaccgagacccgccttcgccatgtcgcctactgtctaggctatgaccacatggaggatgagtctacctcctcgatcagcgctgcgctccaatatcgaagaggtgagcgatgccatgaaggcagatgccgacagaaggtttgcgccggcaggcgtcgctgtcgaggatgcccgcctcacgcacttgctatgtactgagattgcccaggcaatgcttcgccgccagcaagccgacgctatccttgcagcacgcaagaagatgtcgaagggcgctgtctccatagtggagatggcggcccgatcgtcttgccgaaggcggttgctatcgagctcgacgacgagcgcaaggcagctatggcacagaaacctcatggtcgtgctcgcggcgaatccgatgcacaagctagtgctcaatgtaggaagcctctatgcaataagggaaagagggtctaaggtgtaagccgcaaagcagtatccgctccgcatcgatccggacatctgggatgccatacagaggtgggcagccgatgacatgaagagtgtaaacggacaggtcggatatcttctgcgtgatgccctgaagcgggcaggatggctgccgaagaagagcagcccgaaggacaggagaggagagcagtagcagcagggtacctcccagggcgtctcgctgcttcactatcagaagagaggaagagcttttcccaagaggaaatcttcgacagaaagagcggcggatcctacgataagtgtcctggcatgcggataggcaagtgagaaggctgtaagtccgtgcgtattcttgatgcgtccgctctttacctcgatgccgatggaatctgtgccatagcttaagacgaagtcgacctcgtctttgccatctctccaccagttgagcgtgtaatcatattgctcgcagagcgcaatgagataggcaccgattgcgctttccacgaggtggccatagcggtcggaatctttcagcagataatcgcgatagcggccgtaggttgcagtcatgagggcggtattgtgcaccagaagccgtggcgaagagcttttttcgcgcagcaggtcgggatcatatttcttgagtccggaaagcattccagcggtatcaagcagctcgagataatgcgcaatggtggctgcgttgcccttgtcatccaactgccccaggagctttcgataggatatttcctgtgctgaatagggggctcccacatagaagagacgccttagtaatgcgggattgcgcactgtttcgagcgccagaatatctttgtctatggtgggctcgatgatggcatctcggatgtatcgctgccagcgatctgtatccttgatgaggcgcgcagcgcctggatagccgccaaagaagagaaaatcatcgagcgagaatccgaatgcttcgcggcactcctgcaaagtccagtgggtgcagcgaatgatttcgaaacgacctgcaagcgactcatccatgccgcttctcagcaatgtcgcggaagaaccagtcagcactacgcgcagatcgagatcattgaaggagtcttcatcccatagtgccttgactgcatctgaccagccagtggcatactgcacctcatcgattaccaagattgctgaaggcactgtgggggaaagcaggttccgcgcttgctgccattgagcacgaatccagtcgggtgaagccccgtgctctggaacctctgcatagtgatggggtatgtcaatccgcttgaaggcctgcttcacagcggtagactttcccgtctgtcggggcccaagcagaatctggatgaaatgtctaggttcattcatgcggtcgaccagcactgagacgatatcacgctcgaaggtcgcgctcatcttctcctccttgtggtgcatctttgtagagccttcctgtttcgatattatcctatctcttagcctatctcacaaaattgtgagataggcttctaaatttatgagatagactcacaaatttgtgaggtagacgcctaaattttgtgagataggctcacaagtctacggacttgcgtgcaggcacggttccatcagacatgcagcgcagagagaactatatgtcagccggcactgtcattggactttatgggggactatttccaagcaggaatagcacgtatgcggccggagtgctcaggatttccgcatcctccctgagtgtcatgtcggtcgtgacctgtatcgggagatagggctctaccgcaagcgaatctcctatcaggaaattgactttccctgttgtgggcactgtgtaggatgtggccatatccggtcttgtgcctcttgtgcgacgcataagctcgatatagacaacggtttcgagtctcttcccaaggtcttgctggcttgcacgcgagacggaatacaccatgccctgatcgcacgcataaaccttgggaacggcagtggtcttctctgcaagtgcgacagagtattcttgaagcatgctgatgagagcatatgcactccttcattgacggtctcccaggaagtgcggtagtcgaccttgcgaagcatttcgagaagtcggttgaccgataactcgcaggcggtatccctcaagacaaagagggtcatctgggtcgctatcgtcacatcgagacggctactgcgttccacgatatcgcgtgcaatcacatcgcgcacgtaggattgaagcatcaaggtgcgggtcggagcattgagcagctgcacgcccgggaaagcctccctgaatgagatagcggtcataagcagattcgagagatgttttcatcttgggagagaccgaacctgcattctcgagctgcccgtcttctggaagttcgatgctgtggaatctgcagcattcggcaaacgagagtgggaacatatggcattcaagggaacgcctacggaatgtgctggcaatctggtctgaagacagcttcgaagatgagcctgtgataacgagagtgatcttctcgcgctcggcaatgcgctggcaaaagacctaccatccatctgcttcctgtacttcgtcgaagaagagataggcaccttcttggcgggcctcgggcacctgccgccaatattaattgagcacgtcgttcagaagggtagctggagctggcctcagacggtcatctgcgaagttgaagtagaagatgcgatcgcgtggcatgcctgcagcaagaaggcactgtatgagctggaactcgtagaatgtcttgtccgaccggcgcactcccgtgatgatatggaccagattgaagggagcaggctcaggcaggcccgagatgatgtcctggcgtggtctcacttcaggggaggggattcgagcgactcgcgaatgagcgctccgtaatcaggcgctgtttccatgatctctcacatgccgttacttatttctctgtttcatgctgcggctgcacaggaagtccgtagaacttctcatcttcaatgagaagtttagtacgtaacttctcgccaatgatgataggttacgacaaaaacttctcactataggtgagaagtttgggaaacagttctgaagcggtatggagtttacaagcagggaagcgctgtgagggctcttccccgctctgcgcggtggcactagattgacaccaaacttcacgccttgtgcgccttcacagcgagcatggtcgggatattgaactcatgaagcctgccctcgccgttcgtgtcatcagacacatcgtcgatcacgaggccggcatggagcatgccgcccaggatctctt

SEQ ID NO: 91 - DNA, 75895 bp, Unknown
  Metagenome-assembled genome
ttctgtgccgcgccgtttgtgtaggtacggtggaggcggcgcccgccggcccccgcggggggccgcggggcgtatagtgttccctcgcgccgcgggagccccgcggcggcgaaccttgaaaaccggataccgcgatcgagagatcggtcagacgaagcacagcagagtaggtaaggcatcaagatgcagcggagccccgagaggggcccatggatccgacattgccggcgcggtccggacgggccggactcgaagaggattttcaggaactgcggggccctcgggccccggacggagagttcgatcctggctcaggatgaacgctggcggcgcgcctaacacatgcaagtcgaacggccgaggcgcccccgggcgccgaggcagtggcgaacggctgagtaacacgtgggcaacctgcccctcgcaccgggacagcctcgggaaaccgggggtaataccggacgccccgcccccgccgcatggcgggggcgggaaagcccagacggcgagggatgggcccgcggcctgttagcttgttggcggggcaacggcccaccaaggcgattatgggtagccgggttgagagaccgaccggccagattgggactgagacacggcccagactcctacgggaggcagcagtggggaatcttgcacaatgggcgcaagcctgatgcagcgacgccgcgtgcgggaaggaggccctcgggtcgtaaaccgctttcagcagggacgaggcgagagtgacggtacctgcagaagaagccccggctaactacgtgccagcagccgcggtaatacgtagggggcgagcgttatccggattcattgggcgtaaagcgcgcgcaggcggcccgcggggtcgggagtcaaatgcgggggctcaacccccgcccgctcccgataccggcgggcttgagtctggcaggggaaggcggaattccgagtgtagcggtggaatgcgcagatattcggaagaacaccggtggcgaaggcggccttctgggccacgactgacgctgaggcgcgaaagctaggggagcgaacaggattagataccctggtagtcctagccgtaaacgatggacactaggtgtggggggccatccccccgtgccgcagccaacgcactaagtgtcccgcctggggagtacggccgcaaggctaaaactcaaaggaattgacgggggcccgcacaagcagcggagcatgtggcttaattcgaagcaacgcgaagaaccttaccagggcttgacacctgggtgaagcggcggagacgccgtggccggaaggagcccagacaggtggtgcatggctgtcgtcagctcgtgtcgtgagatgttgggttaagtcccgcaacgagcgcaacccccgtcgcatgttgccagcggttcggccgggcacccgtgcgagaccgccggcgccaagccggaggagggcggggacgacgtcaagtcatcatgcccctcatgccctgggccgcacacgtgctacaatggccggcacagcgggctgccagcgcgcgagcgcgagcgaatccccaaagccggccccagttcggactggaggctgaaacccgcctccacgaagccggagttgctagtaatcgcggatcagcacgccgcggtgaatgcgttcccgggccttgtacacaccgcccgtcacaccacccgagtcgtctgcacccgaagtcgtcggcccaaccgagaggggggaggcgccgaaggtgtggagggtgaggggggtgaagtcgtaacaaggtagccgtacgggaacgtgcggctggatcacctcctttctagggagcggccccagggccgcgcccggcagtggccccgccgaaggcggtgccgtctggccgcgcccccaggggcgcgcggcgtccggtctcgagggctcgccccccggcgtaccttgagagccgcatagcgtgacagaaagactatttctcctaaaagtggaagcgagatcgcatcagacgatcggacatgcgctatcagcgcacccatagcatcgagaagcgagaagcgaaggtgttacgggcgcacggtggatgccttggcacaggaagccgaagaaggacgtggcaagctgcgataatccgcggtcaggggcacgcacccgacacgagccgcgggtctccgaacgggacaacccggaggggccagagcccctccgccgcccggccgaacacatgggccgggcgggggcaacccggggaactgaaacatctaagtacccggaggaagagaaatcaaacgagactccccgagtagcggcgagcgaaaggggaccaggccaaaccggcggccgcgcgagcgccgccggggtcgtgggcgcggggcacatggggcccggcgagggggagcggaacggcctgggatggccggcgagacagggctagagccccgtacgcgaaccccgagccggcccgccccgcggcccgagtaccgccggacacgtgaaacccggtgggaagcaggggggaccaccctccaagcctaagcactctcctgtgaccgacagcggaccagtaccgtgagggaaaggtgaaaagcaccccgggaggggagtgaaacagcgcctgaaaccgtgcgcccacgagcagccggggcggggggagacccccgtgacggcgtgccttttgtagaatgagccagcgagtcacggagcgcggcgaggccaagcctcgagcgagccgcagcgacagcgagtcccaaccgggcgtcagtcgcgcgccgtggacgcgaagccgggtgatctatccttgggcaggctgaagcgggggtaagaccccgtggagggccgaacccacctaggttgaaaactggggggatgacctgtggataggagtgaaaggctaatcaaacccggagatatctcgttctccccgaaatagctttagggctagccccgggcgctcgcccgcggaggtagagcaccggacggtcgcgggggcctcaccgcctgccaagaccgaccgaactccgaatgccgcgggcccaggagcccgggagtcagagcgcgcgggctaagccgcgcgctcgagagggaaacagcccagaccgcccgccaaggcccccaagtccgtgccgagtggcaaaggatgtgcgtccgcccagacaaccaggatgttggctcagaagcagccacccattcaaagagtgcgtaacagctcactggtcgagtggacatgcgccgacaatacacggggctaagcacggcgccgaagcggcgggccgggacccaagggtcccggcggtaggggagctttccgtcgggggcgaagccgcggggcgacccggggtggacccgccggaagtgagaatgctggcatgagtaacgagagcggcgtggaaaacgccgccgccgcgaacccaaggtttcctgggcgaggctaatcctcccagggtcagtcgggggctaaggcgaggccggagggcgtagccgaagcgcagcaggcggacattcctgcacccccgcaggggcgctcgaccgatggggcgacggaggagggtagctcggcggggttctggacgtccccgtgatgccgcgtagggcggcgggcagcgaagcgcgcccgccacggcgcccgaggcggcggacgaagcctagagcgaagcgagcgagcccatgctcccgagaaaaccccctagggagccccgaggggcccgtaccgcaaaccgacacaggtgggtgggtagagcataccgaggcgatcgggagaaccatggttaaggaactcggcaaaaccgccccgtaacttcgggagaaggggcgccggcctgggtggaggggcgagccccccgagcccgggccggcctcaggcgaccggtccaaacgactgtttaccaaaaacacaggactctgctgaagtcgcaagacgacgcatagggtctgacgcctgcccggtgccggaaggtcacgaggagccgtcagcttcggcgaagcggcgaatccaagccccggtaaacggcggccgtaactataacggtcctaaggtagcgaaattccttgtcgggtaagttccgacctgcacgaaaggcgtaacgatttggacgctgtctcaaccatgggcccggtgaaattgcactagtcgtgaagatgcgacttacccgcggaaggacggaaagaccccgtgaacctttactgcagctagacattggctgccggggcgccgcgtagaggataggtgggaggcttcgatcccggggcgccagccccgggggagccgtccttggaataccacccccggcgccttggcaccctaacccctcgccgtgacccgggagggggaccgtgtctggtgggtagtttgactggggcggtcgcctcccaaagagtaacggaggcgcgcgcaaggtccgctcggggcggtcggcaaccgccctcatgagtgcaagagcgcaagcgggcttgactgcgaggcggacgtgccgagcaggtgggaaaccaggctctagtgatccggcggcacagcgtgggatggccgtcgctcaacggataaaaggtactccggggataacaggctgatcttccccaagagtccacatcgacgggaaggtttggcacctcgatgtcggctcatcgcatcctggggctggagcaggtcccaagggtatggctgttcgccattcaaagcggtacgcgagctgggttcagaacgtcggtgagacagttcggtccctatcctccgtgggcgcaggaagactgagggaggctgccctatagacgagaggaccggggtggacggacctccggtgtgcgggtgtggccaacggcactgcccggtagctgagtcggtcgggataaccgctgaaagcatctaagcgggaagcccatcccgagatgagtcttccttctggtaaggccccatgcagaccacatggtagataggcagcaggtgcaagcgccgcgaggcgctcagccgagctgcactaatcggccgagctcttcacctccgatgcccggagcgtgaggatgctggacatggagattgccgagcgctgtgcggcccccacgggcacggatggacatatgaatgccctgtgcggccagcggccatggcaggggaggcaccactggtcccattccgaacccagaagttaagcccccgagcgccgatggtactgcggagagagtccgtgggagagcaggacgccgctggccagcagagggcattcgtgccggagagggaggggagcgcatccgcgctcccctcccttgccatatatatgcgcagcccggcagaagggcccctgcatcatgcgggggcccttctgctatctgccggcacttcctgtgctggtaacagccatgcaactctacacggctatgctgtgttccggcaaacttcaagaaggagaagcatatgtctgtcgaagcagtcaggaactatctcaagccgtatggcatagcggaccacatcatcgagttcgctgcatcgtcagctaccgtagaagaggcagccgaagatctgggatgcaagccggctctgattgcaaagaccatggcatgcatggtgggagagaaggcggtgcttgtcgtctgtgcgggcgatgcaaagctctggagctctgccttcaagaaggagttcggcacgaagccgaagttcgttcctgccgatgagctcacagatatcgtcggccaccctatgggcggcgtctgccccttcgcggtgaaggacggcgtcgagacctatctcgactgctcgctcaagcgctttgatacgatattccctgctgctggcagtgcgaactctgcggtggagatcacgctttctgagcttgaggagtgttcgcaggctgaaggctgggtcgatgtgtgcaagggctggcgcgacgaagctgctgaatagaagacaagcatgaatgggggacgcaatgcgtcccccatttcatatgcacaggagatgcatctatcagggaagctgccttcctgctgccatgtagagctcataccattccctgcgtgtgagctcgatatcggcacccttcgccaggtcggcaagatgctgctcatttgtcgtgccgacgatggcctgcatcttgccgggatagcggaggttccaggcaatggctatggcggcaggcgtcacgccgtgctcctcggcaatgcgcttcaggaccttattgagctctgggaacttcggattgtccaggaacgtgccttcgaagtagccatactggaggctcgaccaggtctggatgacctggtcgtgggcgagggcgtattcgaagatgccgccgtcacgcatggtggcatcattgcactccatgttcgcattgaggacggtctcgaaggcaggggcaaaagcgatagagagctgtacctggttggcggcaagcgggaaggggcaggcagcctgcaggcgcttcatggtggccgggttctcgttcgagacgccggagtccttcacgagcccttccttgcgaagctctgagagggcttctgagacctcgttggcatccatcaggatatcgggacgatggagaagaagagcgtccacctgattgactcccaggcgcttcagagaggcatgcgtggcatccaggagatactgcttcgagaagtcatagtaggtaaggccgttgtccctatggatgccgaccttcgtctgcaggaacagcttgtcgcgaaggcctggctcctttgcaaagaccattcccagaaggcgctctgagtcgcctcctgcatagatgtctgcggtatcgattgcattgattccaagttcgagggcggtgtggaggagatgggagagagcctttgcatccatcttgtccacacgcatgaggccaagcatgacagaggagaccttcgttttgtctggtccgaattccgtatagcgcataggtttcctttcaaggcggaattgcttccatcaagcatagtggatttgggctcgagagaagaagacgcagcagcaagcggcggacatcgcctttcaataagagaggaaccagaaagcttctgccatctggttcctcagacattctttgtatctattgcctattcgaaggcgatattgccaaactcggagagcttcagggtcttgttgttctcttcggcccagttcaggttccactggctcgtgaagagcaggagcctgccgccgcgcatgtcttcgacgcggcaggtgtcgcgcgtgaggttcagggtcttgaggtcgagctcgtcaggcgagttctggatccaccggatgatcgagtagggaagaggggtcctgcgcacggcgacatggtattcgctctggagacgctgctccaggacatcgaactggaggacgccgacggcaccgacgatcacggactccatgccggagccgatctcgcggaagatctggatggcgccttcctgggcaagctcctccatgcccttcacgaactgcttgcgcttgagcgtatcgacctgcgtgatgcgggcgaagtgctcgggagcgaatgtcgggataggcggatacttgacaggtgtcttgccagcgcagaccgtgtcgccgatcgagaagatgcccggatcgaagaggccgacgatatcgcctgcataggcctcgtccacggttgcgcggtcgtctgccatcattgcggtgccggtcgcgagcttgatatggcggtcgccctgcacatgataggcatccatgccgcgctcgaacttgccggagcagatgcgcacgaaggcgatgcggtcgcggtgcctcgggtccatgtttgcctggatcttgaagatgaatccgctgaacggattcgtggcaggatcgatggtctcgccggagatcgtgtccttgtaggcaagaggggcaggggcaaggcgcagaaagtccttgaggaacggctcgacgccgaagttcgtgagggcgctgccgaagaagactggcgtgagcttgccgtggcgcacggcatcgaggtcgaactcgttgtcggctccgtcgaggagctcgatatcatcgatcagattcttgtggttctctttgccgatgagatcgtcgagcgccggatcgccgagctccgcctcgatctctccgaccttcttcgtcgcattggcgcggccgtcgccctcgaaggcaatgacatggcgggaattgcggtcgaagacgcccttgaagttcctgcccgatccgattggccatgtcatcggataggtccctatcccaagcacatcctcgatttcctccatgaggtcgaaggggtcgcgggtgtcgtggtcgagcttgttcacgaacgtgaagatcgggatatggcggagggtgcagaccttgaagagcttgatcgtctgcgcctcgacgcccttggcgccgtcgatgaccatgacagcagcatcggcagccatgagggtacggtaggtatcctcggagaagtcctggtggcccggggtatcgaggatgttgatgcagtggccctcatacgtgaactggaggacggaggacgtgacggagatgccgcgctccttctcgatgtccatccagtcggatacggcatgcttcgagctcgacttgcccttgacggaaccggcagtctggatggagccggtatagaggaggagcttctcggtcagggtcgtcttgcccgcatccgggtgggaaatgatcgcgaaggtgcggcgcttcgagatctcgtcagacacattgctcatgctttgcctttgggtatgccgatgcagaggcatcggaactagattcttgaacccatacattctaaaggcgcggggggcctgcaggggcaactgcacaagaagagcaggtgattgggctagatgaggcctacaaggaagaggcctaaaagggccgcagcacagacggcaagcgctgcccaatccttctgctccatatggagcgggtgccactgcgtgcggcccgctccgccctcatagcagcgggcatcgagggcgcgtcccacattgtgggcatggcggacagagcttgcaaggagggctatgacaacagggccgatgccgtggatgcgccgggagatggagcccgagtcccagccgccgccacgagcacgctgcgcatcgatgatggcagaggcctcatcagcaatcgtcgggatgaagcggagcatgagggaaaagaccatcgcaagctcatgccccggaaggccaaagcggctcaggggcgcgagcacgccgtcgaaggcatcggtaagctccgtcggtgttgtcgtcatgagcagaagcgctcctgcgaggatcgcgaccgtgaagcgcagggggtagagcacggcgtcccagaggccggccgaggtgatctcgatgggtccgagcgcgaagacaggcgtgcctgtacgcacgaagaacaggttgaagatgccgaggaagacaaggatgaggacaagcggctttatggactcggcaatcttcttcgcggggatcctgcttgcagcgatgagggcgcctgcaagcacatagacatagaggagctggagcggcgtctggatgaagaagatgacaagcatgaccgcaagggcgcagcctgccttcacgcgggggtcgagcctgtggaggaaggaggggtgcggatagtactggccaatgcctattctcattgtcatgctattcccctccttccgagagcattgaaaggatggcctcagcaagggcatcgatcgtgagcgggtttcctgccgaggaagctatgcagccgtcttggccgaggcgctcttcgagtgcgagcgcgaacgtcagggcagaaggaaggccgagtccccgctcgtgcaggagctgggcattctgtccgcagaagatatcttcgggcgtgccggacatgaggagctcagactcgtcgagcacaaagatatggtcggcacgtgcggcatcgtccatcgagtgcgtgatctcgatggtcgcagtaccttctgcatgcacggcatcgaggatatgtgtgagctcatgcctgcctgaggggtcgaggccggctgtcggctcgtcgagtacgaggatctcaggtcccattgcgatgacgccggccagggcgcacttccttttctggccgccggaaagctcgaacggggagacatccctcttctcttcgaggccgacgagggcaagggcatgttcgacgcggcgggagacttccgtatcggagagccccaggttcttcggtccataggcgacatcctctgcgaccgtctgggcaaagagctggcgctcgggatgctgcatcacgtagccgatctttccatggagaaggcgccggccgcgcctttttgccgtcgagatgccgaggacggagatctccccttcatccggcacgccgagggcacagatgaggcgggccagggtcgacttgcccgatccggtctggccgacgatcgcgcaggactcgcctgccgagacagcaaggctcacgtccttgagggcgggcgccgtctgagcggaagagtccgtgtagcgaaaggtcacatgggagacggaaagtgcgggtgcaccatttgcggggatgtctgcacgcttctgtggcaggggacagatgcctttcgaagatgccgggatgcgcgccgccagctcgtccaggagctccgcctcggacggggtccagacgataccggatccgcttgcgcgcagacggcggctgagccttccggcaaaaggctcttcgaggcccagcgccgctatctcatcctcgtgggagaagacctcggcaggtgtgccgtcgagcgcgattctgccgcgggagaggacgatgacgcggtctgctgcgagggcctcttccatgaaatgggtgatatggatcacggtcctgccggtatccctgagggcagagatgaccttcatgatggagcgtcggccgcggacatcgagaagcgctcctggctcgtcgaagacgaagagctcggggtccatagcaagggtggcggcaatcgcgacacgctgctgctgtccgccggacatgcgggtagggtcgcgctttgcatagtcttcgagcgcgaccttgtggagcgagcgcttcacgcgccggccgatctcatcgggtgcaagtcccaggttctcgggaccgaaggcgacatcgtcctcgacgaccgtcgtcacgatctggtcgccgggattctggaagacaaggccacacttccgcctggcttcgcggtaggcttcgaaatcggccgttccgtcctcgaagacacgcttgcctgcaatctcgaccgtgccctcatcgggcgcaagaaggccggagatgacggcagcaagggtcgacttgcccgaaccgttcgcgccgaggatgcagagatgctggcctaagggaacatcgagcgagagatcatcgagtgcctgtatgccatgctcgaatctgagcgtgacgccgtcgaggcgaatttcggaagtgcggctttcctgcatcgctactcgctatctgcgagcgccttcgtgacgggcttgtagatgaggccgcacacgacgcagttgatgaggacctttgcagcattgaagggaagaagggcaggaacgatgagcgctgccacctgctctgtcgtcatgcctgcatagatcggcgtgacgatcaggttgccgacgatgcagcagaggacagagacgatggcacctacgaccattcctgcgatggcacccttcatcgtcgtgtgcttctggtagatgaggctggcgggcatcacgagcgagaaggttgcaagcattgccatgaccatgccccagaagccagaggccgtcgcgatgtgcggcaggtaggagatgatggagaccgtggcgccgacggcagggccgaaggcaaagccggcgacgagcgcgacgatgccggaagggtcgtactggagccagggcacacccggcaggagaggaatctcgatgaagagggtgcagactgcagcaagcgcgcagaagagtgccgtgacggctatcctcttcgtgctccagcctccctgggctgtcgtcgaatgcgtgtcatggtgagaagtggctttggccataataggccctccgtttcttccatccggactgtaaccgttggtcctggattctcaccagatcagccgctcttttcttcgcggcgcgcggacttgggagcacgcatgctccgtcaccaccagtggggaattgcaccccgccctgaaactgacactcgaacagtagcactccaaggaagaaaagggaaacatatcttcgctgagagccattcccgtcatgcaatcgttacaggaaggccctcctggcagcctggcgtgccaggagggcctgatgtgcagatctctgcctgcccttatgcatgctcctcgatgacgcgctcctcgtgcgtctcgcgggagggacggatgccatcgaatccccagacagccacagtgacccagacggcagcgcctgccgcagcctcgaggccatacatgagaggtccatggtaggggacgaggaaagcaagcagcagccctgctcctgcaggaggaagccagcacctgaggccgttccagatgaggatgaggcccacgaaggcaagggcgagggcaagctcgagcggaagcgctcctgcctcgacggcagcacgggcaagcgagcctgtcatggcagcgcccgcaagggcgcaccagcccttccaggggcgcaggcgcagcgtgaagtcaggacgtgtgagctccgtgtaggcaacgagcaggggcggcacggcgaagaatggctggttcaggaaataggcaggggcagagattgcggcaaagacagcgaggcgcttcatccagctcgtgaatgcctggtccttcggaagccggaagggatggtagtcaagaggctccctgagccctgcgtgctcgagcgctatctggcccaggcagaccagcgagacgagcacgaccacggcgacaggatagacccactccctcgtgccgaggagcacgggcaggattgcagccgagagcatcggcgtcatgtccgctgccacgatgttcatcatgagggcacagaaggcatagccgaggacggcacgcacccatatcggtcccggcacgaagaggttcaggagcactccgaagacagcacccgatcccatgaggaggagcatgcggggacggtcgatgttccaggcctggtgaggctggatccaggcgccgcagacgatagcggtgatctccgggaagaggatctccgagcaggaggtgatgtcggagacggctgccattgcgacgacgaagatgccgctcagaagaatcggaagccatctctgcctcagtgtcatgcttgccatgctctatcttgccttcctgccggtagtctgcgcaaagagacattctaggccgtatggggcgcatcttggcgggtgaaagcgcaggaaaagacaggcattgcagagaccgttgcatgaaaggcaggatgtggcggtaaatactggggtgcattccgcccatgcgggatgcgcccctgcaaacccgaaggtttttcatccaggcacatgcgccagcctggtgcatatgccgaatgcgtgcttcacagcaaggctatctgctgctgggaggcgctccgttatactcgggaatgataaacagtgacgcatcaggcttccgccggagcgggagggagaccatatgggacagaacagcgatgcacaggagctggcagaagagctcaagtcggtggtgggaaagggcaatatcctcacggacgagccgatgagcgagcatacgaccttcaagatcggcggtcctgccgatctcttcgtgctgccaggaaacgccgatgaggtgaagaagacgcttgaggtcctgaagacggctggcatgtcgtacttcattctgggcaaaggctccgatctcctcgtcgacgatgcggggtaccgtggcgccatcgtctcgctcgagcgcttctgcgaaattcatgtcgaggggacgaagctcgtcgcaggtgccggagcgaccctgaaggatgtctgcgccgctgcgcaggcagcaggcctttcgggcctcgagttcgcctgcggcatcccgggctctgtcggcggtgctgccttcatgaatgcaggagcctatgacggggtgacggccgatgtgctcgagtcgcttgcggcactcgatgcagacggcaatatgcgtacctaccagaacgctgagctcgacttcggctaccgcaggagccgcgtccgcacggaaggcctcatcgtgctcgaggtcacctatgcgctcaagcagggtgacaaggcagagatccaggcgaagatggacgatctcacgcgcaggcgcgaagagaagcagccgctcgagtatggcagcgcaggctccacgttcaagcgccctgaaggcttctttgccggcaagctcatcaccgatgccggcctcaagggctaccgtgtcggcgatgcagccgtctccatgaagcatgccggctttgtcgtgaacctggggcatgcgacagcgaaagatgtccatgcggtcatcgggcatgtgcaggatgaggtcctgaggcagttcggcgtcttcctcgagccggaggtgcgcttcctctagagcaggcagtacaaagacaagaaaagagcgggcagaagctgtcttctgtccgctcttctgctggagaggctctgtctcagagggcttcgaactcggcgttggggctcggggtgatggcctcggtatcgcgctcgccagtcctgatgcgtattgcatggtcaatgtcataccagaagaccttgccgtcgcctggctcgccggtgtgtgccgccttcacgatcgcattgacggtcttctctgcccagtcctcgttcgagacgacgatctcgaacttcgccttcggcagcatgttcatagcgaccttgctgccacggaccatgtgggtgtagccgagctgggtgccgcagcccatgacctgggagaccgtgatgccacgaacatctatggcacgcagggcttccttcacgtcctcgaggcgctcttcgcgcacgattgcttctaccttgatcatattgctgcctcctggctaatcgtcgagaccggtgaaggacggataggcacgctcgccgtgctgcgtgaggtcgaggccgatgtgctcctcgtgctctgtgacacgcagagatccgcagattgccttcgtgagggcaatgcagatgagcgagcccacgatagcaagcgctatcgtcaccagtatggcaatgatctgggcgcagatgaggcccgtatcgccgaagaagaggccattccattgaagcgctgggttcacggccttgcttgcaaagaggcctgttgcaatgcctccccagatgcctccgatgccatggcacccgaaggcatcgagtgcatcgtcgtagccgaaatgcgccttcatgcgggagcaggtgaagtagcagatgacagcaccgatgaagccgataggaagcgccgcagcaagaggcacgaagccgcagcccggcgtgattgccacaaggccgatcacgaggccggtgcaggcgccgacaagcgtcggcttgcggtcgaagagcacatccatgagcatccagccgagctccgctacagctgcagagagcgccgtcgtcgcgaaggcatggacagcgaggccgtcagcagcaagggcagatcctgcattgaagccgaaccagccaaagaggaggatcgtcgcgccgattgcgacaagcgggatgttgtggacgcggtagttcacatccgaatagccgctcctcttgccgagcgcgaggcagagcacgagcgccgagatgccggagctgatatggacgacattgccgccggcaaagtcgactgagccgattgaggcaagaaggccgccctggccccagaccatgtgggcgatggggtagtagacgacgaaggaccagagcaggatgaagacgaagagcgccttgaagcgcatgcgccctgcaaccgagcccgtgatgagggcaggggtgatgacagagaacatcatctggaagagcgcataggcaaggaatggaatcgtcgctgcataggggcctgccgcatcggcagagacgccctgcatcatgaggtagtcgaagccgccgatgatgcctgcgtggtcggacccgaacgagagcgagaagccgacgcagatccacaggacgatctcgaggccgatcgtgaagagcgatgccaggatgttgttcacgacattcttcctgcgccctagcccgccatagaagaaggcgagccctggtgtcatgaagagcaccagcgcggcacagagcagcacgaaggctgtatccgcattgtccatatgaaagctccttccctgaagcatgcacgctgaagacggtacggggcgtctgttgcggggccgtgacagggcgatttcaggagcgcagtattggtattacgatatgcggaccacaagaccagaggatactatcgaaccagaggcagacagctgcgaacagatgcatgatttcattcagacgcggctcagtgcggtctcagggacaggcaagctccataaaggctgttcaaggcttcttaagggagcggctgtttctgtggagtgtcgatgagtccttctgttaggcgtatagtgttaaatgcgctatctatactcacttgcagttattgcaaaacgtagcatgccccgtaaggagtgaacgtgacacctatagatcagaataccgacgagacgaggcgcacgccctccctctcacgccgcagcgcattgaagatgatgctgagcgctgctggcgcccttgccgtgcttggcagcccgcttcgcgcttttgcagacgatgtggccgatgcaacggctgccgccaatgatgcagcgaaccagcttgcagagacgcagtcccagctcgatgctgcccagtctgaatacgattcgatctcagcccagcttacgcagatccagaacgactatgaggaccttgcaaagcagcaggcagacaccctctcccagattgaggatgtccagaagcagatcgatgcgacgcaggaggacatcgacgagaagcaggccgatctcgaccagaagcgccaggtgcttggtgcacgcatggcatcgtcgtacaaggcaggaaacgacaacctgatctcgatcgtcctgaattccgattcgttcgaggacctgttccagaacgtctactacctcgacaagatcacggcagcagacaatgcgatgatccaggaggtcaaggccgcgaaggatgagctcgatgcgcagaaggctgcgctcgaggaccagaagtcccagctcgatgccctgaaccagcagcagaccgagcagatgaaccagatggcccagaagcagcaggaggttgccgaccttcttgcgaatgcagactctgccgtccagcagcttcttgcccagaaggatgccgacctcgttgcctacaacaacgccgagcaggcacgccagcaggcagaggcggcagcagaggccgagcgccagcgccaggcagcagctgcagcagctgctgcagcagcgtcgtcaggctcttactcgggctcctatgccgcttccggcgcgggtgccatcagcacgggcggcggcaacggctcgctctcgtcggtgctttctgcctgcagcagcacgccgtcaccgggctatggctactgtgcggcctgggtcacgaacgtgttccagaatgccggtgtcggctactttggcggcaatgcctgcgacatgtatgcctcctggtgcggcagctccaacagaggcgatctccagccgggcatgatcatcgctgtctcctcgcacaacctcgatgcggcaggcaggatctacggccatgtcggcatctatgtcggcaatggcaccgtgatggacaacatcggctatatcaggagcacgagcgtcgattcctggatctccacgttctcgggcgtcgtcccggcacgctggggctggctcggcggtgtcgtgctggcataggcacagacattcagaagggcactgccaagcgggaccggatcttgaattcggtcccgcttttttcagagcgagcgtgcctgattgacggacagagaaattaaaaatcagatcttgatcttttccgaaagctgagagatcatctgaccagcgctccggacggagcgctgggtattcggggtcggatgatctcaggcatatatcagagcagggagagactggtctgatctgtctgggccgagcaatcggcttttcttttctctcgggaagccacctgcccccgtattccaacatcggattatgtttgggggacgctatggcaacagatgcaatcatcatcaggctcaagcaatcgaatgagcaggaggtcggcgatataacacgcgtcgtcggtctcatgccggcacgccacatggctgacatcatcaatgtgctcgaccttgaggcaaatcctcgcaattcccgtctgggaagcgtgacggacgatatcgagaggtccatagagaacgacgagaatggtacgggccagaagcttttcccgctgaagtcgaagggcgtcttgattgcaacttccagattcacgagactggacaggggccgctacaagctctcgtttggggatctgagcgtcgagggaatactcgacggaggacataatacgcttgccatcggccgctacattctcgaccaggcggagacgtttgcaggaaaacccaagccacggaagagagatgtgtctctctgggcagacttcaagaaggtgtggaacagtgagcgctccgatatcgctacgtatcttgatgccatttcggatagcagagatgctctgaagagcgagggcataggaacgctcaacttcgatgtgcccgtcgagctccttcttcccttgaagccggaagatccggagtgcctggagacgttccactcctcgcttctcgagatctgcgatgcgcgcaacaacaacgcccagctcactgcgggcacgaaaggcaacaaggaaggactcttcgactcgttcaaggcgttgttcgaagaaaaggatcctgtgtttgcgaagaagatcagctggaagacgaacgacggaggaaccatcgattcgcgtagccttgttgcgcttgcctggatacccctatcgcttacgacgtgggttgaaggctccgataaaatcgtcgagctgccgaagccgatgagcatctatagcgggaaaggctcctgcctcgagaggtatctcgatctcatgcgcgatccgcatatctcgtcagccaataccaatggaaacgagaaagagctgcatgacctgcaggtgctgagtgcgctgaaagtggctgtggatcttccaaagctcttcgatctcatctacataaacttcccggactattacaacaaagacggatcgtacggcaagataactgccgtgaagggcatgcaacacaaggacaaagataagaagaatgccaagccgtattacacgccgtattatggcatgacatgcaatcagccggtgccggacggcttcatctatcctctggtctatgggcttcgtgcctgcatgaagcggaacaagaacgacaggatcgaatgggcgctcgaccccttcgacttcatcgagagcgacgaattcagcagtgcggctgcagattactgcggcgtcattcggcagagcgactacgatccgcagaaagtaggcaagggaagcttcagctatagcgctgccttgaccggtctcaagcttgctgccatcgactatcgtgctgactgcgagcagtaggaagggcctgctgcatcttggatgcatcaaaacgagcggccggactccaggaggaaaccggccgctctgctgctttgcgatgggctcaggactagttcttgagggaattgagcggtgccgggaagcggccgccacggtgggcaaagaccttgccggcatacttgttgacgggcatgacaggggcagatccgaagaggccgccgaactcgagcatgtcgccttcttcctttccgatggcagggatgaggcgcacggccgtcgtcttcgtgttgatgacgccgatggccatctcgtctgcgatgatgcctgccatggtctcgatggaggtatcgcccggaatggcaatcatgtcgaggccgaccgagcatacgcttgtcatggcctcgagcttctcgatcgaaagggcgcccttctcggcagcttcgatcatgccggcatcctcggagaccggaatgaaggcgccggagaggcctcccacggagcttgatgccatgaccccgcccttcttgacgcagtcattgagaagcgcgagggcgcaggtcgtgccagggccgccacaggtgccgacaccgatgatctccaagatctttgcgacggagtcgccggctgcaggcgtcggtgccagcgagaggtcgacgatgcccttctcgacgccgagcctacgtgatgcctcgcggctcatgagctcgccggcacgggtgatcttgaaggcggtctgcttgatcttctctgcgacggtcatgaggtctgcattgtcggggagctgcgaaagcgctgctgccatgacgccagggccagagacgccgacattgatcacggcatctgcctcgccgacgccgtgcacggctcctgccatgaacggggagtcttcgaccatgttcgcgaagcagacgaacttggctgcaccgtagcagtcgatatcggtcgttgcctgggcgcaggcacgtatcgtctctgcggcacgcaggactgcatccatgttgatgccggcacgggtcgaggcaacgttcagggacgagcagacacgctcggtcgtggagagggcatcagggatggagttgatgaggcgctggtcggcgcttcccatgcccttctgcacgagggcagagaagccgcccatgaagtcgatgcccagagtctcggcagccctgtccatcgtgcgtgcgatcggggagaagtcctcatcggcgcatcctgctgcgaccatagcaatcggcgtgacagagacgcgcttgttcgcgatggggatgccgtattcgcgctcgaggtcttcggcggtctcgacgaggtgctcggcctgcgtcacgatcctgtcgtagatcttgccgcacatgcggtccatatcctcgtctgcgcatccgagaagcgatattcccatcgtgatcgtgcgcaggtcgagattctgctctgataccatcgccagggtctctgcgacctcattcggagtgatgtccatgctgccccttatcgtcagttctggttggttcccagtatggcagagaagggacgcatgtacgtcccttctctgctgtagatgcatcaattgttacttttctgcagccttcgtgccgtcctgctctgccttcttctcggccatggccttgaggccctcctttgccatgtcctcgagcatgccggtatagatcttggccttcgtctgctggccgcggttgccatactgaagtgctatgagggagaggagctgggccttgcgctcgcccttggcatccgggagctcctcgagcatatcgtcgaggtagacagagctcctgttcgcgatgatctcatacatctggcggcaggacttctcgtaggcttcatcctcgtcgcgtgcctcgatgagcttcagcatcttcttggcatccttgtacttgccggcatcgagatagagcgtgaatgccttgtcctcggcggcagcgcgctgcttcttgttgaggcgggcattgagcagacggtcgcagacctcgagggcatgctcgtcgtcgccctttgcgatatatgcgttcatgcgcacgaagtcgcggttgaagggatgcaggtacatcttcgcaatgaacgaatccatgtacttcaggagctcgtcgtaggagccctgagcgaagtagcgcgtgatgcggtcggaagcgacgcggcgcatgatgaagtcgatgaggatgaggacgataaccaggatgagggttatctgcatgggcgtgctcatgatcaaatcctttctgggcttgaggcccagtgtctgcgtacctgttgcgtccttgggggaggggcgcatgtagctaccagtatacggattgggagcgctcgggcgccataaggatggcaaatggcgcaggcccctggaggaacctgcgccttggaagtgcttatggctgccttctgctgttatgcgaagtaggcgacgccgccctcgagcagcggctggaagcggttgcccgggatgttctggtagcagcccttgctcacgcgctctgagtggcccatcttgccgaggacgcggccatcggggctcgtgatgccctcgactgccatgagggagccattcgggttgaaggcaaggtccatcgaaggcgtgccttcgtcgtccacatactgcgtggcgacctggccctttgcgatgaggtccttgaggacttcgtcagaggcgacgaagcggccctcgccgtggctgatcgcgatgcggtgcaggtctccgacctcgcacttggagagccagggggagaggttcgaggcaacgctcgtcgtgacgatgcgggactggtggcgtccgatcgtgttgaaggtcagggtcgggcttgcagcggtcgtgtcgacgatatcgccgtagggcacgaggccgagcttgatgagggcctggaagccattgcagatgccgagcatgaggccatcgcgcttctggagaaggtcgcgcaccgcctccgtgatctgcgggttcctgaagaaggcattgatgaactttgcggagccatcaggctcgtcgccaccggagaagccgcccggcagcatcacgatctgggattcgttgatcgcctttgccatggcctcgacagactctgcaaccgcctcgggcgagaggttgttgaggacgagggagcgcggagcggcacctgcacgcctccaggcacgctcggagtcatactcgcagttcgtgcccgggaagaccgggatgatgacacggggcttgccgaaatcgacaccgcctgcaggggctgcgaagtgcacgggctcgtagtcgtgctcctctgccttccaggcaagcttctcgagagcgggcccttcagcgacgccgcggtacggatagacgccctcgatgccgtgctcccaggcttcctggagcgtggcgccggccagggtctcgccgcaggcacggatatggtagtcagcggccgtctcgcccaagggagcgacagagacattctcgggtacctttggcacgatgcagccgtctgcaagctcgacgatataggagccataggcaggcgtgaagaggctctcgaccgtataggtatcagcaacatcgacgccgatctggttgcccaggcacatcttgaagagggcttcggccacgcagccatagcccggcgtcgagacagcgacggcgtccttgtcggcaatgagcttctccacgaaggaggaggcagcaaggaaggagtctgcctcgggcacaaggccatcctcgtggtaggcagggacgacagcgatgacgcgagagcctgcgtgcttgaactcgggagagacgattgtatcgatcgtgcccaagcctgtcgcgaaggagacaagggtaggcggcacgtcgaggtcctcgaaggagccagacatcgagtccttgccgccgatcgaggcaaggcccagatccatctgcgccatgagcgagccgagaagggctgctgtcggcttgccccagcgctcaggcacgtcgcggagcttctcgaagtattcctggaatgtcaggtagaggtccttgtgggcaaagcctgtggacaccatctttgcgacagactcgacgacggagagataggcgccgcggaactggtctgcgctcatgaggtaggggttgaagccccatgccatgcccgagcaggtcgtcgtctcgcccatgacggggagctttgcgaccatggcctcggcaggcgtgagctgggtcttgccgccgaacggcatgagcacggtcgaggcgccgatcgtggagtcgaagcgctcggaaaggcccttgttcgaggcaacattgaggtcgcggacaagggagtccatcttctggccgaacgtcgtgccctcccagtcatgggagtagggcttctgggcctccacatgcaccttctggtgcttcggggcgccgttcgagctcaggaactcgcgggagacgtcgacgatggtctcgccgtcccagaccatgcgcaggcgcttctcttcggtcacgcgtgcaacgaccgtggcctcgaggttttcctcgtgggcaatcttcaggaactcgtcgacatcttcaggcgccagggcaacagccatgcgctcctgggactcggagatggcaagctcggtgccgtccaagccctcatacttcttcgggacgcggttgaggtcgatgaagagcccatctgcaagctcgccgatagcgacagagacgccgcctgcgccgaagtcgttgcagcgcttgatgaggcggcaggcgtccttcctgcggaagagacgctggagcttgcgctcgacaggagcattgcccttctggacctctgctccgtcctgggcgagggattccacattgtgggccttggaggagccggtggcaccgccgatgccgtctcgtcccgtacggccgccgagaagcacgatcttgtctcctggagccgggcactcgcggcggacatggtcagcgggcgtggcaccgacgacagcgccgatctccatgcgctttgccacatagcctggatggtagagctcggagacctggccggttgcaaggccgatctggttgccgtaggaggaatagcctgctgcagccgtgcggcagatcttgcgctgcggaagcttgccctcgagcgtctcggataccggctgcgtcgggtcgcctgcgccggtcacgcgcatggcctgatagacataggaacggccggaaagcgggtctctgatggcgccgccgatgcaggtggctgcaccgccgaacggctcgatctccgtcgggtggttgtgcgtctcattcttgaagaggaagagccagtcctcgggcttgccgtccacatcgaccgtgcacttgacggtgcaggcattgatctcttcggactcatcgagggtcgtaagtattcccttgtgcttcagatacttggcaccgatcgtgcccatgtccatgaggcagagcggcttcttgtcgcggccaagctcgtggcggacgtcaaggtagcgctggaaggcctgcttcacgacctcgtcgtcgatctccatatcgtcgaggttcgtgccgaatgtcgtgtggcggcagtggtcggaccagtaggtgtcgatcatcttgatctcggtgatggtcggcacgcggccttcgcttgcaaagtagcgctggcagaacttgatgtcggcgaggtccatggcaaggccacgctcgtcgatgaaggcctgaagacccttctcgtcgaggtcgaggaagccttcgagcttctccaccatcttcggcttcggatacgcggtcttgagcgtcgccttcttctcgagcgatgcctcgcgggcctcgaccgggttgatcacatagctcttgatctgggcgatatcgtcgtctgtgagcgtgccctcgagcacatagaccttggcagagcggacaagggggcgctcgcccttcgagatgagctgcacgcactcgcttgcagagtctgcacgctggtcgaactggccggggagcgactcgacggcgaagacataggagccttctgcgactggaggcatctcctcgaggctggtgtcgtccacctgcggctcgctgaagacggtcgggatgcactcgtggaagagttcgtccgtgatgccttcgacgtcgtagcggttgatgatgcggagcttttcgaggccggcaatgccgagcatgtgcctcagctcatgggaaaggtcttttgcctctccgttgtagccgtccttcttctccacgtagatgcgctggaccatggtcctaccttcccgggggtgtggtggcacgtacagctcaattctacgtctcggccaggggagaagagcccacctgtttgcctgctgctaacactccctgcaaataccgcatacggaagggatgggtgtccagagcaggagcgggtcaggcagcggcgttctgtttccacccgctttccggaagcagggaaagggcctcaagaggggccgtctgcaggcggctgctgtgaattgaacctacttcctggaaagttcaacgattggtgcatacaggctgtgctatgctgccacttgcattgaacatacggcagcagatgaattgaacttctcataaaattgaacttgttgcgcatgcaggaaaggagcgcgcatggaaagcaggactgcagcggagtcccaggcctttgcccggcgcctggaagatgcgatgcaggagcgccacctcaagcaggtcgacctcatccatatggcagaggatgccggcgtgaagctcggcaagagcaagctcagccagtacgtgggcggaaagacctatccgcgccccgagatgctcgatttccttgccaaagcacttgatgtgccgtctgcatggcttggaggaacggaagcctccgattctgcagcagcacagaaggcacctgaacccagcacagaccagaagagcacgacaattccggaaggacgtccgatgcgcgtattcacgaagtcccacaagctcgacaatgtcctctacgacgtgcgtggccccgtggtcgacgaagccaaccgcatggaggaggcgggcacccatgtcctgaagctcaacatcggcaaccctgctcccttcggcttccgcacgccggacgaggtcgtctacgatatgagccgccagctcacggaatgcgagggatattctgccagccgcggcctcttcagcgcccgcaaggccatcatgcagtatgaccagctcaaaggcctgccgaatgtcgagatgaacgacatctataccggcaacggcgtctccgagctcatcaacctcacgatgcaggcgctgctcgatgacggggacgagatcttgatcccgagcccggactatccgctctggacggcatgcgccacgcttgcaggcgggcatgtcgtgcactatctctgcgacgagaaggcccattggtatcctgacatcgaggacatcaggaagaaggtcacgccgcgcacgaaggccattgtcatcatcaatccgaacaaccccaccggcgtcctctatccgaaggaggtcctggaagagattgtcgaggtcgcacgcgagcatcagctcatgatcctctccgacgagatctatgaccgccttgtcatggacggcaagacacacgtttccatcgcaagcctggcgccggacctgttctgcatcacctactccggcctctcgaagtcccacatgattgccgggtatcgtattggatggatgacgatgtcgggcaacaaggactgcgcacgcgacttcatgatgggcatcaacatgctctcgaacatgcgcctgtgctccaatgtgccggcacagtccattgtccagacggctctgggcgggcaccagtcggtgaacgactacatcgtgccgggcggccgtgtctatgagcagaggaacttcgtctacgacgccctcaagagcatcgacggcgtcgaggccgtgaagccggacgctgccttctacatcttcccgaagctcgatccgaagaagttccatatcacggacgacgagaagttcgctctcgacctgctgcgccagaagaaggtgctgatcgtccacggcaagggcttcaactgggagacgccgggctacttccgcatcgtctacctgccgcgcatagagaccctgcgcgaggccatgaacaagcttgcagacttcctgagctactaccaccagtaggccaattcggttggaccgaatgaaaagcagagagtgccgtgcttccaaaaggagcgcggcactcgtcgtatatggatttgacatcatgtggctgcaggagaacgtatggggctgtcgctagcccagctgctccggtatcgctggagcaatacgaatccgcgcagagcctgggcagagcagaggcatctgagaaaagctgcctgagctggccataatgttcccaaggctaacgaatctggacatggctccggcttcctgtcatcagcatgcgaatgtatcagctccgatttgcgccactgctgctctccatcatgccaatctctgtgatgccgccaattatctgggggtattgcaaaaaatggctgaggacctccggcataaccgcaggaattcctgtcgccgctccgctgcatcatatggatgaacggctgatgcatccggaagagcggaggaagcaatggcgaagggccatgcaggcggactgagcaggaaggaatgcgagagcaggggcacgctcctggagttcctggagagatatcctgacgagagtcgtgcgagaggaggctcctcgaggagaagcatcccggaggcttcgtctgccccgcatgcggaaaccgcacctgctccaaggtgcacgggcatgcccacaaggcagtgaccaggtgctcccaccagttcagcgtcaccgcaggcacgatgatggaagggacccacctcgagctcaggaagtggttctggcgatctggctcatgtcgagccaaagcaggcatcagcgcatgctccctgcagcgccagataggctgcagctacaaacggcagggcgcgtccttgcgcgcatccgctgcgcgatggccagatcggagtgccttcaacgtcctcgctgctgactgcatcgaggcggacgacttctatataggcgcgagggccggaggcacgaggggaaggggcacggacagcagccgatgcttgccgccgtcgacagggcccctgccgggaggggctcctgcgccatccggtgcgcgcaggactgctcgggagactcatggcgccagttcgggcacaccacctctgccatgcatcgagataagcggatgcctggagcggcatagctgccgggctctcgtctccgcgcctcgacgaaaggaatacgacagctcggacggcgatgcccgctccccatgtccacagggtatctccaacttcaaggcatacgtggagggagccttccacggcctctccaagaagcacctgcagtcatatgcggactcctacagctggagatacagccacaggagctcctccgatgcctgcatggagctcctccacgagatgtggtcctcatgcatgtcccgctctccggcatcgcagccacggccacggtccagccgaagcttcctgcgagcttgcctaagccgtttacagttcagggagcctaactatgccggaggtactcagccatttctcggaaatctgtttgcgtcaatctgatgggtcattccgactggcatagtctttccataccatgctgcggcgactctttcggtctgaagcgaatgcgatcatcgaagctgcagagggcagacgggcggatttcgagataagggccagcgagcggaacttcaggaagagacagcacgtctgaggcgtctgcggcttctcgtcatatgacagaggagctcgatgcgtggcgctagcaggtctttaaaatagaggcaggcgggcatatcttcgagtgctgcaaaatcgatcaagtaatgaaacataccctcattatgtgaaaatcaccctttctacatgcacttctatagcttgatgacagaagctgcgatagaatttaccgcggctagttgaatgcataaggcaactgagtaatgtaagagagccaatcacatgacacttcttgagcttttccgtctgctgaaaaagcatctgcagattgtggtgctgcttcctgtagtatgcgccctggtcgtagggctgtattcagccatcttcgtacggaaccagtacaccgccacttcgagcatgtacgttctggcacagaatgacagctcgaattcgagctcgctgtattccgacctcaatgcatcccagatgctcacgaacgatgttgccaagctcctgaagagcgaccgcatcatcaaccaggtcggctccgaggtaggcatcgaagagctcaagggctattccgtagacgtcacgagcgagaccacctcccgcgtcatcaccctctctgtcaccggtcccgatccgcagaccgcagctgatatcgtcaacaggatggtcgaggatgtctcgggcgtcgcccagtctgtcatgaatatcgagtcggtgaacccggtcgatatggcacaggcccccgagaagccgagcggccccaaccgcctgctctatacgctcgttgcattcgttgccggcctttttgctgcaatagcgatagttgtcgtgtccgatatgctcaatacgaaggtgcgtggctctgaagacctcgaagagctcatcgatgtgcccatcatcggccgcatccccaatgtccagggagggagataagccatgctgggacagaggaactccaagcctgacaaggttgtcatgcagaatgcgctcaagacccttgcagcaaatatccgcttctcatcggtagacaacccggtgcacagcctctgcattgcctcgtccatcccctccgagggcaagacgaccgtctccacaggtctcggcaaggcatttgccgcaggcggagcgacggtcctcatggtcgaatgcgacatgcgtcgccgttcccttgcaaacgctctgggcgtccatggcaggcacggcctctattccgtcctttcgggacatcatacggtccaggaggcagtggtttctgcgggcacgaccaatctctacttcctcgatgcggagcccagcattcccaatcctgcagatcttctgcagtccaagcgcttccatgagctggtcgagatgctgacaagcatgtatacgtacgtgatcttcgatacgccgcctgtcaacaccttcatcgatgcctccatcgtctcctccatcgtcgatgccaccattctggtcgtgcgtcaggactatacgcacagagacgatgtgcgcgcctcctatacgcagctccagcaggctggcgcgaatgtcatcggtgtcgtgctcaactacgccgatgccgaggtctccagcaagtactatgactactaccacgagacgaaggacgctgactacagcgctgtccaaggcgaacagcctcccatcgctgcacgtccggagaccgcatccaaggcaacggctccggcagctgccgctgcagggatgccttcctatccgaagacggctcctgctgccaagaaggctgtcccgcgcctccgcccgctgcctgaacagaacgtgcggccggtacagccccagcgcagcgcctctcccgacgagacgacagagctcctgcagcaggcaggatatgctcccaagccttcgtctccctatacggttcgcaggctcaggaagtagcattcgatgagagacctgcactgccatatactccccggcgtcgatgacggatctcccaatatggagtacagcctccgcatgctcgatgctgccaagaaggcaagcgtcacgtccatcatctgcacaccgcattgccgcagcccctacttcaattacgagaagatgatggctgcctatgagagcttcaaggctgctgcagacggctttccggtatacatgggcttcgaggtgaaccatacgaagctcctggagctgggcatcagcacttgggcaccgtatcttgggttcgagcagacgggacagttcctgcttgagctcaacactgcctgcaccgaagcgagcttcgatgagtacgagcgcacgatctaccggctccagggcatggggtaccgcgtgatcattgcccaccctgagcgctatgacgcaatccgcaaggatgtgagcctcgccgagcgtctggtggatctgggatgcgatcttcaggcatcggccgatttcatcaagggtggcaggttcggcaactccaagcgcacggccaagaagctcttcaagatggggctctaccgctacatcgctagcgatgcccacaaggtggagcactatgagatgctggccaaagccagggagctctatggcctcaaggggtctcatttcgcctgatacgctgatgcttcaggcattgcagcgccagagatggtgcacaaacgaagggacagcaatccatgggaaacagcacaccgaacgggaacagattccgcggtgacaatgacacgcgggcaacaagagtggtcagacccaaagctgtgcgcacgacgtcgggcgtccatttcaaaccggaagagccaaaggactatttcggtgccaccgaaggtcctgtaccggtacagcctgtctatggagcctcttcggactgggatccctttacggctcagagctatgacgcgggaagcagaagctcttcgcaccggcatcaccatcaccatcatcgccaccaccggtcgcatgccgtcctgatcacagtcatctgccttgtcgttgcccttctggcagcagccgggatctccggctacctcttctaccagagcgccaaggcggtggcagctgatgcaggctctctcgtggcggagacctccacattctccaagagccttgcgggaggcgacacggcagccctttcatccagtgcggagaagatctccgccctttcctctgagatgacggaagagacctcgagcccgctctggagcgttgccgagaacctgccccaggtggggtctgacatcgcgaaggtgcgcacgctggtctcggtggcatccgacctctctgccaacgtcgtgacgccggcagcacagaatctcgcgggcgtcacgatgggaacggtcttcagcaacggaaagatcgatatcgcgacgctccagacgctctgcaatacgatcgcgcagatccagcctgccattgccgcttcggctgcgcgtgtcgatgcactcggcatgccccagctcgagcagctgaaagagccgctcgcgaaggcaaagacgaccctggattccctgaacgaggcagcgacagggcttgcaaaggtcgccccctcgcttcctgcgatgctgggtgccaatggcacgcggagctatcttgtgatcgcgcagaacaactccgagatccgctccactggcggcttcccgggctccaggatgctcatgaccatcgacaacgggcagatcgagctcgaaagctttgaagcggtgggtgctcacttcccggcgggcaccatccctctgactgacgaggaatacgccgtcgtgaatgacctcatgcagaccggtgccaccttcgctccgggcgacgtgaatgccgtgccttcgttcccgcgtgcagcgcagctcatggagtggtgctgggaagaggagggcaacgacgatgtggatggcgtcatagcgatcgacccggtcttcctgcagagcctcctggcgctcactggcggtgtcacgacctctgacggcacggtcgtcgatggaacgaatgcggcccaaatccttctgaacgagacctactatctgccgacagacgagcaggatcctttcttcagcgaagtggcaggcctcgccgtcaagaagatcatgggcagccttggctctgtctccatgacagaccttgcctccaccctgacagcaggcaccgagcagggacgtttcctcctctatatggacgaccctgcagaagaggctaccgtcaccgacctgggcgctgacggagaggtcaaccaggatgcagcgaatcccgtcaccggcttctatatctacgacaagaccggctccaagcttgactggtacctcgatatgagaagcagcgtgagcgcacctgtggtgaatgcggatggcacgaagtcctacaacgtgaccgtgacgctccacaacaccacgacgctcgagcagatggaagacgagctgccctcctacatcacaggcgtgacgcccgaggtgcaccactactcgatgatcacctcctaccttgcgatggcacctgccggcggcacgatctcgaacttccaggtgagcgccgacgaggtgaacgccaaaggcgaagcgacgctctacgggaacgatgtgtgggcaggctttgtgaacatctatccctccaatactgcgaccttcacctataccgtgacggttccggcaggcacacagacagaccttgcggtctggacaacgccgacaggacgcagcttcgcgtagggaagcagctacccagaaaccaagaaaggctccggatacaggctgtccggagcctttcttcatgcttctttgccattcatcgaaaggcagcaccgctgcatcctttggaggctgtcttcgaaggcaggaatcctctccgccagtaggttccgttctggaggcactgctgcatgctcggacctgcctgatccgctcagccgattgtttctgccagggcctgaatccggcatccaggcatactgctgcaccgccaggggcttcagggcgaagcggggctgtcctggcttcatgccccggaggggcgtccagtgcttcctgccggaagcagcagaggccggataacctgatggcatgagatgatcgatgatgccgcctgtgcccccgctgcaggcttggcatagggcagctgcagcacggtgcagctgagtccaggggcagatgccattgatatggagggtgccgtttgggggatattggctaccagagcaaggcccaggcaggcatatgacagaaaggactcccatggacgaactcgagatcctggaagaacgcttccgcgcccacccttcccgccatccctccctcacctgggatgaggtggtgtctgcgctggatgcccagaagaaagtatcccttgcctatatggaggagaccggaggagagcctgatgccttcgtcttcgaaggccggctctatatggctgacttcagctccgagtcaccggacagacgctctttgtgctatgacgggaaggcgaggatggcaaggaagcgcaacccgcctgagacgagtgcccaggagcttgcagaagcgcatggcctcgcgcttgtgtctgaggagatgtatctcgcgcttgaagacatagagccgctcgacgagaagacaaccagctggatcatgacgcctcaagacatgagagggcagggaggggcgctcttcggctcccggagatatggccgcacgttcatctactgcaacggagctgactcctactattcctcccgcggcttcagggcctgccttgagctgggctagcacggcatgaggatagcgtgccaagaagaagggcgcccgctgttgcggacgccctttcgtgtgtgcttggatatgtcctgggtcctagaacttgaccgaaggagcctttcgggctgcttcgtcttccaccttgaagccttcgcgcttcttgaatgaggagccggcaacgacgttgcctgggaaggtctcgattgcgttgttgtaggaaagcacgcagtcgttgaagctctggcgggcataggagacgcggttttccgtgtcggtcagctcggactggagctgctggaagttcgcattggccttgaggtcgggataggcctcggcgacggcgaagagctggcgcagcgctgccgtgagctggttgtctgcagcaaggcgctcgccggtcgtctgtgcgcttgttgcagcggcgcgcgctgccgtcacggctgcaagggtctcggactcgtgtgctgcatagcccttgacggtctccacgagattcgggatcaggtcaaagcggcgctggagctgggtatcgatcgtctgcagtgcattgtcgcagcggttgttcttctcgatgatgccattgcgcagggtgatgaaccagatagcgaggataaccacaagagcgatgatgatgagtgcaactgccatggaacgtcctttctgatcggggacgccgcgtgatgcagcatctgtgccgtacagcaggccgctgtacaaaaatggcggagggggagggatttgaaccctcgagacggctcagccgcctggcggttttcaagaccgctgcattcaaccgctctgccacccctccgtgggtgctccatcatcataccccaaacggcgcatcttcagaacgggcaactccttacagcagatcgggctcaagcatgaaggggatgactcctatgtattcaatgccgcaatcatctacccagggacgctgattgccatccacaatcactatcttctggttgaaatcgccgctcttcacgagcgatcttgtctcctgggcgcgtttgtcggggtcatcgaccgtgagcgctgactggatatatatctttctgtcacccagattcacgacgaagtcgatttcggccattgactgggttttcttcccatctttgttcccgtacattcgcactgcaccgacatctactgcatagccgcggcggatcagctcgttgtagatggcattctccatcagatggtttttctcgaactgcctgaatcccagccgtgcgttgcgaaggcccagatccgtcgcataccacttcgaggggaattcgaagtagcgctttcctttgacatcccagcgcttggcttcagagaacaggaatgcgtctttgagggcatccaggtacttcgcaacagtggcttcggtagtgtgggcgtgcatctggctgttgagcgcttttgtcagacgtgctggattcgtgagggagccaacggaggaggagagctcgtctgcaagagcgtcgagcacatagccgttctggatcttgtagcgctcgatgatatctgcccggtatacggtttcgaacaggccggacagatatcttcttcgttcctgctcgtcttcttcgagcgccgcgacgggcatgccgccccagagcaggtagtctgcccagtcatcgcctttgtcgcccttcctgaacgcatggtattcggcgaagctcagaggctggatcctgatttcagtgccacgatcgcggaagttcgtgacgatgtcggatgacagcatacgcgaattggagccgctgacatagatatccagattgtcgtgtttcacgagatcgttgaggatgtcatagaacgtcgtatagagcaggtccctgtcttcaggaggcactgacttctcatcgacgtctgatctcttcacgcggtatgagagctgtatctcatcgatgaagacatagtagaggccattgtcgcgcacccgggcaaggatatggtcgtacagcaggttggggtttcgcagctgctcgttctgcttgatgtcaagcgcaacttcgatgaagtggtcttcaggaactccttcagcacggaggcgttccttgaaaagcttcgtgaggagatatgacttgccgcagcgtctcgtgcccgtgacaatcttcacgcggccgttctgacgtttcgacatgagcctgtcaacgtatgaatcgcgctcgatcacgtccattaagctgccttccaatagacttcatctactattagataaaatctattatagcaaggaaaatctcataatagactttatctagtttgccgcgaagtctattgcagcaacgttcgctgcataaggcaatggcactgcctcgatagccgatacgtataaacagccaagccttgatttgaggctcgaagcggttcctcgatggacggcaaagaaagaccccgccccgcacttccttatgcatggcggggtctctgcagtgctcttgcgagagatggcagctctacagcgtatgcaggtccaccttggagaggagcgactccacgacagagcgctctgctgcctgggtgcccgactgcatgacattggcagagccggtggcgatggcaagcgttgcagtatcggagagtctgtatccgcgctcccaggcaaaggcgatggcggcaagcgcagcgtcgccagcgcctaccgtggagccgacgggcacatgcggggccctggcagagatcgtgtgctccttcgtgcagaacagggctccctggtgccccagggagaccacgacggtcttgatgcctccggagaggagctcatgcgcggcggcgacgatgtcttctgttgtcgtgagctcctggcctacgaggtcggagagctcctggagattcggcttcacgagcgtcggggctgcatcgatgcctgcggtaagcgccctgccatccgtatcgaggaagacagccgctcctgcctgcttgctggcacggatccaggtggcataggtgtctgagggcacgcctctcggcaggctgcccgagagcacgacgacatctccctcttcgatatctgaggtcaggcgctgcaggaggtcgaggagctcctgggagtccacgacaggaccgggttcgttgatgtcggtatgggtgccggtctgggtgtcgatgatcttgaggttcgtcctcgtatcgccctcgatcgcgacagagacgcagcttatgcccatgtccacgatatcggactctatctgcgtgccgaccgtgccgcccagaagcgcataggcgcaggtcttgccgccgagcttggccacgaccttcgagacattgattcccttgccgcctgcatcgcggcgcaggctcacgatgcggttcacgtggtcgatctggaagcccgcaatgagggcggtcttgtccagtgcgggattgaggcagacggttctgatcatggacatatccttttccgccctgcctgagcatgtgcaggcaggagtttgtggcttccctttcagaagagcctagcacgcagggcatcgggggccagtgcttgcggctccctgattcggtggaggacccaagctctgttgctgaggggagcctgctatgcttgggatgcggatggaggctatacgggctctgcatgggagggatgcatggaggaaagcgcgaaggagaacaggcggatggaagctgacgagcgcttcatgcgccttgcgctcgaagaggcccgccgtgcggccgcagaaggagaggtgcccatcggcgctgtcgtcgttttggacggcgcggtcatctcttctgcccacaataggcgcgagctcgaccacgacccatcggcccatgcggagttccgggcaatgacggaggcggcgcagaagctgggtcgctggcggctttcaggctgcacggtctatgtgacgctcgaaccctgtctcatgtgcgcgggccttatggtgaactcgcgcatcgaccgctgcgtctatggggcacctgaccccaagggcggagccctggggacgctcttcgatgtgagccacgataggcgcctgaaccatgagtttgcggtcacgtccggcgtgcttgaagacgagtgcgcttctgtcctcagggagttcttccaggccaggcgtgctgccaggaaggcagagaagcgcagctctagacaatctggaacgtcaggaagtccagatagtgggtgtcaggcatcccccagagaataggatggtccggagcctgctgcctgagctcgatctgcttgagctgcacatttgcgttgtgtgccgcctcggcaatcgcttcctcgagcagccttgttgtcatgaacctcgagcatgagcaggtcgcgagatatcctccgcggggaagaaggcgcatggcccactcgttgatctcgcggtagcccttcttggcatgtgccacggcagagcggctcttcgtgaaggcgggaggatccaagatgatgaggtcgaaaggacctccctcttccttgagacgggccttgctcttcacaagctcaggcaggtattccacgacattggcgcacgtgaagtccatcctgtcttccaggtggttgagccttgcattctcctgggcaagcgcgatggcggtatcggagatatcgacgcagcggacgaactcggcccctcctgcggcagcattgaggccgaacggccctacatggctgaagcagtcaaggacacggcgtccctttgcaagctctctaaccgctcttctgttgtacttctggtcgaggaagaagccggtcttctggctgttctctatgtccaggtcgaagagaaggccgttttcctgtgccatgacacgggcattgtccggtgtggggacgcccggctctttccaccagcccttgtgaagatcgagtccctcgagccttcgtgcgggcgagtctgcccgctcatagatgccacggatcttttggccatcggaacgcaggacatcgaggatcagagggaagagcatctctttcctcagctccatgccatacgttcctacctgcgccacgagcacatcctcatagcggtcgacaatgaggccgggcacgccatccgcttcgctgaagaggatgcggcagcagttcgtgtcaggctcagctccgggaagggacctggcccccatgacagccttcctgtgctcccaggcccagaggatgcgcctcctccagaatccctcatcgaagcggtcgttcgcgttcttcgagagcacgcgcacgcggatcttggactcctctgagagaagccctgctccctgccaggtgccgttctcctcgaagaggtccacgatagcgccgttttcgacgggacgtccgtcagcagcaggtgcgatggattcgacctctccctcgaagacccagagatagccctgtgcaagagtacgggccgccttcttcgtgattgtggccttcggatagggtcgtgcctgtttcatggggtggtgctccttgtatctttagatcagcactcgaacttgtccacggtgcccgtggcatgggcgtggaccttcgtgatggtatccgggatgtcctcgaggcggtagggcgtcatctggtagacccagttgagccagttcctgtagaggaggttggcatgtgccctccacgtgaagcgcggctggtacttgggatcgtctcccgggaagtagttcacggggagcttgatcggctttcctgcattcgcatcgcgccagtactcgtttgccagggtatccctgccatactcgaagtggcccgtcagatagatctcgtggaagtccttcgtggcaatgatggcaggtccgctcgtgatgccctcagacagcacctggagctcaggatggagcctgagctctgcctcatcgagcattgcatgcctcgaatgcggcatgtagtggagctcgtcgaagccgttcgtcaggaagctgtactcgtcgcagagccgctgcggaaagaccccgaagagcttttccggcaggtcgatcttgtggatgccgtacttgtagtagagcttggccatagctccccagcagaggtgcatcgtcgagagcacatgctcatccgcccagtcgaagatctcggtgagctctttccagtagtccacatcctcgaagggcatctgctccacaggggcacccgtcacgatcaggccatcgtagttgttggccttcaaggtatcgaacgtctcatagaacttcacgaggtggtcgcgcgaatgcgttgcctcatggctcgagacgcgcatgaagtcaaggctcacctggaggggcgacttcgagatgaggcgcaggatctgcgtctcggtctcgatctttgtcggcatgaggttcagcaggacgacacgaagcgggcggatctgctgtctggctgccacttcctcttcgagggcgaagatgtgctcgtcgtgcaggatcttctttgcgggcaggccgtcagggatattgataggcatgaagggtctccagagtcactttcaaagggatggatatgcgcaggcgccaaggcacccaagaggctcagagcccctgcattcgataggagagcgtcttcggaaagcttcccattgcgcgtatcccttctggagtacatctgcgtatatgcgactagcgtaacacggattgaaggagaagattgcgttgaggagcggcaaacccatgccattgctacagctccgttgccgctggccgcatcaggcggttaatggcttcccgtatacgctacgctggtgaggtttggagcttggctcctatacaaggctgaaacgtccaatggagggggaggggcagcctgtgaccatcgtagacatgctgcggcacaatgccgcggcataccccaacgagaccgcactcgtcgaggtgaatccggagattcaggacaaccgccatgttacatggcgcgagtacgagcttgtagagacgacagaggacaatccgtatcggcgagagatgacgtggaaggtgttcgacgagaagtcgaaccgcttcgcgaatctcctgctctcccgtggtgtccgcaaggacgacaaggtggcgcttctgctctacaactgcatcgagtggctgccgctctatttcggcatcctcaagaccggcgccacggtcgtgccgctcaacttccgctatgcagcagatgagatcgagtactgcctcgacaagtcggatgcaacgatccttgtctttggccccgagttcataggcagggttgagcagatcgttcccaagatcaagaagggacgcctcctcttctatgtgggagatgactgtccgacctgggcagagagctaccgcgagctggctgcgctctgtgcctccacagacccgatgatcccgctttcggaggatgaggatgctgccatctactactcatccggaacgaccggcttccccaaggccatcctccatcatcatcgctcgctcacgcaggcagcagagatggaggcagtccatcacaagaccgtgcatgaggacgtgttcctctgcatcccgcccctctaccacaccggcgccatgatgcactggctcggaagcctgcttgtgggcggcaagggcgtgctccttcgtggcgtctcgccgaagtcgatcctctccacggtctcctcggagcgctgcacgatcgtgtggctcctcgttccctgggcacaggacatcctcactgccatcgagcaagggacggtcacgctctccgactatcacctcgaccagtggaggctcatgcatatcggcgcccagcccgtgccgaagagcctcatcaggcgctggaaagaggtcttcccgaaccaccagtacgacacgaactacggcctttccgagtcgacaggaccgggctgcgtgcatctgggactcgagaacatcgaccatgtgggggcgatcggcgtgccgggatatcgctggcaggcaaagatcgtcgacgaggcaggaaacgaagtatcccagggcatggtcggcgagctctgcgtcaagggtcccggcctcatggagtgctactacaaggatcctgctgctacggcagaagcccttcaggatggatggctccatacgggagatatggcgcgccaggacgaggacgggttcttctggcttgtggaccgcaagaaggatgtcatcatcaccggcggcgagaacctctatcccgtgcagatcgaggatttcatggcagcagatccggatatccaggatgtggccgtgatcggccttcccgatgagcggctgggagagattgcctgcgctgtcgtggagctgaagccgggctcacatgccacggaagacgatatcaacgagttctgccttgggcttccgcgctacaagcggccccgcaagatcattttcgccgccgttccgcgcaatgcgaccggcaagatcgaaaagccgctcctgcgcaagcgctacggcgcgcaggggcttgtagaccacgagaaccagtcttagagggaagacaggagagggatatatggcaaagcagcttctttcgggcaacgaggcagccgcccagggcctctgggaggcaggcgtcgcggtaggctctggctaccccggcacgccttcgaccgagatgctcgagaacctggtcaagaaggatggccccacctgcgagtgggcgccgaacgagaaggtggcgctcgaagtcgcaatcggtgcctccatgggaggcgtgcgctctgccgctgccatgaagcacgtaggactgaacgtcgccgcagaccccttcatgtccgtcgcgaacacgggcgtgaacggcggcctcgtgctcttcgtggcagacgatccttcgtgctacagctcgcagaacgagcaggattcgaggaactatgcagcattcgcgcgcattccgtgcctcgatccttcggactccgaggagatgtatgccttcgcaaaggaggcattcggtctctccgagaggttcgatacgcccgtgatgctccacgagacgatgaggatcgcccataccaggacgatggtcgaggtcgaaggcgagcgcacagaagttgctccccgtgcctatgagtcccacccggagaagtatgtcatgatgccggccttcgccgtgaagcgccgcgccgtgacagacgagcgcgaggatgcgctcgtcgcctgggcagaagagacgcccctcaaccgcgtcgagatgaggagcaccgacatcggcatcgtctgtgccggtgccctctacaaccatgtgcgggaggcgctgccggaagcatccacgctgaaactgggtgtcacctggccgctgccgccgaagaagcttcatgacttcgcggcatctgtgaagaagctctacgtcgtcgaggagacctgcacctacttcgcagaccatgtgaaggcactgggcatcgacgtctccgtaccgccagagggtccccttcctcgcggcggtgaggtcctgccagcacatatcaaggctgccttcggtgtcggcgagccgccccatccagcccctgcccagggccttcccggacgtcctcctgcgttctgcacgggctgcccgcataggcttgtctatgtggagctccacaagatgcatgccatcgttacgggagatatcggctgctatacgctcggtgccgtcgccccctacaaggcggtcgattctgtcatcgatatgggagcatcgctctcaatggcgcacggcatggagcttgcacaggcaggggagcgctcgaagcgcccggtcatcggtgtcatcggcgactccacgtttgcgcactcgggcatcacaagccttctgggcacgatctataacgggggcaagggcacgctctgcatcctcgacaacaggacgacggccatgacgggagcacagggaaatccgtgcaacggcgtcacgctcaaggagcaggcagcgggcgtctcgccgctctcagtgccaaaggggaaataccttgacatcgaggcgctctgccgcgccatgggagcagatgaggtcgagaccatcgatgcccaggatgccgcaagcatcaggaaggcactgaggacggccgtgaagcacgaggacaagctctccgtgctcgtgttccgctctccctgccgccttatcgaccgctccacgcacccgcagccgcatatcgtcgactgccgcaagtgcgggacctgcatccagattggctgcccggcacttggcaaggccgcggatggctctgccgtcatcgatacgaaccagtgcatcggctgcagccagtgcatccagtcctgccccttcggctgcatcaaggaaggtgagtagccatgctgcacgcaacagcatccaccaagagctcctcggtcgagcttaccgggcatcaggtagagctcgaaggcacccgtaccgtccttcttgtcggtgtcggcggccagggcacgatcctggccggaaatatcctggccatgacagcagcagaggcagggctcgacgtgaaggtctccgagatccacggcatgagccagagaggcggctccgtctccacggtcatccgcatgggcagccatgtggactccatggtcgcagatccaggctgcgctgacgcaattgtcgccttcgaggcgatcgaggccctccgtgcccagcagtacctcaaggagggcggcaccatgatcgtgaacgacgagacgatcgtgccggtctctgtcgctatcggcaccttcaagatgccggacgatgtggaggccaggctcgatgccctcggagccaagaagatctctgccggcgccattgcccgcgctgctggcagccccaagtcgacgaatgtcgtgcttgtcggtgccctctccacgacgcttcccttcgacgaggaggcatgggagtctgccatcaggcgccgcgtgccgcccaagacgatcgaggcaaacatcgaagccttccgccagggacgcgctgccgtagagggataggccgaaaagcctctatatacaagaagcaggcccagtccggcgcatgtccgggctgggccttgtcatgccaagcatttcatgcgagatatctcgatataagaagagcctgacacatcgggctcttccaggtgtgggccgaagccgtccaccgcaattcgatgatgcattgcagcatgtatccacagggcaataagcatctgctgcaattcggaccgcagagctgtgtctgaggtttagatgactgcttcttcagcagggcagaattgcctctgctggggtttccgttggtgacgccgggcgattttggccccatatagccgaaacaaaatagccgattgcagccggaaaaagattggccaccgctccgctgcatccctcctatgctggttgtgccaatgtgccggcgataggaggaatatagagaaagatggacagcagatacgatggcctgcagaagattatagacgaggccctctcggcgatggcagccgaggcgggtccggggttcctgccggagaaggcgaacctcgcggagttctgcaggaggaccggactcacgagatcgaaggcaaggatgctccggaagaagggcttccacgccgggccgcacggcaatgcaggcaggaaggcagagacgacggtcctcacgggatacaccggcgtcgtcgatggccagctccgcaagggggtgacgaactcccagacgatcttcgacctcctgaaggggcagggatatgcaggcggcatcacgtcggtcaaggactgcatcgccgcccaccgcccgctcgtgcctgcgccgaggaggcaggcggattccaggggcccgcgcggcaggagataccatacagagcccggcgaggcataccagatggactgggggttcgccaatgcggaggcggccgacggcaccgtctcgaggatcgctttgccctgactggtagcttctagattgccattaacacaggctgggcaccgacaagtatgacaacacgtggtatgcgagaatggagccggacggttcgcggacgtgggttaccgtgcgcgacggggtcatccaggagggtggtagaaacgacgagccccatccctgggacaacgagacagggctcaaccgcaaccccaagaagaacgctttcaagaagagggggggaaatgatatgcaggtcgatgtctacgattcctttgtcgcgatgtaccaggcgctcgacgccgccttcgacgagcaccctaagtcggagaggctccgcaccttcgcctctgaggccaacccgttcctttggaaaggcgagggctcggctgaccctgccgtctacatcgagttcgagcaggcatgggagaaggagttcggcgaccgcaaagtcaccgcgctcgaagcccggcagttcgtccgcagccatctcaagacgcaggacgagggcgagtacgctttcgcccccgcaggcgacgtgacgctcgctgaggccttcgactctgtggccgacgagaaaatctgggaggaggctctctcggagtcttaatggccatgcgtcaacgcccgattgacggggtcggcggagctcgccggccccgttttccagcgatgtcatacgccggccaagtaccccggcgtgtctgccgtgtcgatgacggccatgtccgcaggcaccttcgagctgccgaacgccttcccgttgcctcccacgagcggctgtcctcgtagaagcactgacccttgttccctgacgacagctcgctcggaagctcccgggtggagtccaccttgatagttgtgagcgagaacatgttggcaaacgtatggccccacttcgttatcgtgggggtcgaggccggtgaggtcgagtgaagtcacgtccgagcagttgtggaagagagagtagatgctcttctggtgtgcgtgctcccagtcggtcacgaataaacccgcgtgcgtgcacgaggcgaaccagtacaccatgtacaggtcggtcacggagctccatcgtctcgaagaagttgaacgaccggatcgacgcccgtatgtcgctccacagcatcgaggggtagattctgtactcggcgttctcgaccacgcgagtccacgtgccgcgcgaggagatgagcctgtagtcggtctcgtcggtggcgaccacgattatctcgtactcgctgagcgtcccgtcgtcggcgtacacgaggtagacgtagaagtagacccacatgtgctcgtcgtcgccgccctggtcgtaaacccgcccgtcccgctgcgcagcggcgaccgcccgctcgtgttttgggctgcggtcgggtgccctcccacgagccggttacacccgttgaacgggtaggtgccgtcgcgttcgagcggtcgaatccctcgacctatatcgtctcgaggttgccgtcagctgagccttcttgactctttcttgactgcaggcggccatcccgacggacgagccttctaccagcgcctttggaatgaccgatgggttacaatcccctcatgcaataagggccatgtcccaagaacaggccacccgctatgtgggtggccatgatctgtgctgatgcagctttgcggcccctagcggccttcctgctccaggatgcggtgctcgaaatggccgtccacgtagatgccgaagctgtgggtgccgtccttggggatgccgacagagcctggattgaagcaaaggatatccgggttgcctggggcaggctcgttgaccttcttgtgcgtgtgcccatagacaagtgcagaacccttggggagttctggcagatggtcaactgagttgtggatgccggggccccagacatgtccatgggtgaagaagagttcctgccccttgctatgagttatggggttctctgcttcaggatcccagagcacgtcgtagtctgccatgcaggggaagtccaggaccatctggtctacctctgcctcgcagttgccgcgtactgcaatgacttgatcctttatgccattcagcatcgctatgacttcctttggtgcatagtcctcagggaggtcattcctggggccgtggtagaggaggtctcccagaaggatcaccctgtccgggctctctttctctatctcgtccatgagggagcggcaccatctggcggcaccgtggatatcggaagcgattagaagcttcatatatgctcctctgcactcgtatctctatatctatgtctgattgtacgcgcaggaacttggtctttctgcagcatgaagggcatatcgtggctgtgagaaagcatgcgtgagcttgaattagaagtctttcggtggctgctagaaaaaatctaatgttttgagacttagattatgtataagaatcagatttatgggatatcatagagactgtaaagcaaaaggaatgcggcacaacgtgcagagggcacgcaatccgcagcgaaggaaggaatagaccatgggaaagattctgggaatcgaccttggtacaaccaactcggctatggccgttcttgagggcggcgagccgaccattatcgttaacgccgagggcgaccgtacaacgccgtccgttgtgggcttccgttctgacggagaccgcatcgtcggcaaggcagcaaagaaccaggctgtcaccaacccgaagaacaccgtcttctctatcaagcgtttcatgggccgtcgctacgacgaggtcggctctgagctgaagaccgttccgtacacggtgaagagcggcaccggcggacgtgctgtcgttgagattgacggcgaggactacacgccggagcagatctccgcaatgatcctctcgaagatgaaggcagacgctgagaagtatctcggcgagccggtcaccgaagctgtcatcacggtccctgcctacttcaatgacgcccagcgtcaggcaacgaaggatgcaggcaagatcgcaggcctcgatgtcaagcgtatcgtgaacgagccgacggcagcagctcttgcctacggcctcgacaagaagggcatcgatcagaaggtgctcgtcttcgacctgggcggcggcacgttcgatgtctcgcttctcgacctcgctgacggcgttgtcgaggttctcgccacgaacggcgacaaccacctcggcggcgatgactgggatcagcgcatcatcgactggtgtgcagagaagttcgagaaggagaacggcatcgacctgcgcaaggacccgatggcacttcagcgcctgaaggaggcctgcgagaacgcaaagaaggagctctcctctgcccagcaggcacagatcaaccttccgttcatcaccgctgatgccaatggcccgaagcacctcgactacacgcttacgcgtgccgagttcgagcgcatcacgcgcgacctgctcgaccgctgcaagcagcctgtgacgaaggctctccgcgatgccaacctccagatctcccaggtcgacgaggtcatcctcgtcggcggctccagccgtatgccggctgtccaggagctcgtgaagcagatgaccggcaagcagccgaacatgtccgtgaacccggatgaggtcgtcgctgacggtgcagctgtccagggcggcgtccttacgggcgatgtcaatggcatcctgcttctcgatgtcaccccgctttcccttggtgtcgagaccatgggcggcgtgatgacgaagatgatcgaccgcaacacgacgatcccgacctccaagaccgagatctactccacggcagccgataaccagacctctgtcgagatcaatgtcctccagggcgagcgtgagatggcacgcgacaacaagtcgctcggcaagttccagctcaccggcattcctctggcaccgcgtggcgtccctcagattgaggtcacgttcgatatcgatgccaacggtatcgtgaaggtcacggcaaaggacaagggcaccggcaagtcccagcagatcacgatctctggctccacggctctctctgacgacgaagtcgaccgcatggtcaaggacgcagagtcccacgccgaagaggacaagaagcacaaggacgagatcgaggtcaggaaccagaccgactctcttgcctacagcacggagcagacgctcaaggacctcggcgacaaggtgcctgctgatatgaagaagcaggtggaagacgctgtggctgaggccaagaaggcactcgatggcaccgatatcgatgctatcaaggccgcaggcgagaagctccaggacgtgggccacaagctcgccgagatcgtgtactccacgaccaatgcccagacggctggcggcaatgctggtgcaggcgcccagcagcagtccggctctgctgacgacgtggtcgatgccgactacgaggtcgtcgacgacgacaagaagtccgagtaggtctgatttgaatcagggaagcgcagaaggcttggatagcttctgcgccttccctgccttggaaggagggcgacgtgaaggtgcccatcgatagcgatgagaagaagacaagccctgagaagggtgcatccgatgctgcccagaagaccgacacatcgggcatgtcagagcaggatatgatcgaggctgccatcaaggcaggcgagcaggcggcggcagacgacctcaagaaggatgccgacaagcttgcagctgaacgcgatgagtatgccaagaagcttgacgcggcagaggaaggccagaagaaggccgaggatgccgccaaggaggcccaggacaagtatctgaggctccaggcagagtggcagaacttccgcaagaggaccgagcaggagcgcacgaacgagcgcgcccgtgcaaacgagcgcctcgtggagaagctccttcccgtgcttgacgatatggagcgcgccatcgagcatgcgaagaatacggcaggcgaggatgcgaacctcgcgcagtttgctgatggcatccaggcggtgcacaccaagatgctcggggtgctcggcggcgagggggtcgaggtcatcgacccggcaggcgagccgttcgatcctctgacgcaccaggcggtaggacgcgaggagaatgccgatgtctacgaggacacggtctcccaggtctaccagaagggctaccgcatgggaggcaaggtcatccgctccgcaatggtgacagtcacctacggcgggaagaagcgcccgcaggagaagaagggtggcgcggctgacagcgcaaagtaagaggccacaccagatgcgcgcccgggcccttgggctcgggcgcttgtctatgagaagagaagaagggggcgagaagctttatggctgacaagagaaacttctacgacgtgctgggcgtaaagcgtgacgccacccaggacgagattaagaaggcattccgcaagcttgccgtgaagtaccacccggacaacggcggcgacgagcagaagttcaaggagctctcggaagcctacgagacgctgtccaatccggacaagcgccgcgagtatgaccagctcctgatgttcggtggcatcccaggtgcagacttcggcggctcgggcggacgcaacaggacgtatacgtacaccacgaacggccagggcgtcgactggggcgatatcttcgacaatatccgctcgggagacggagccttcaatggcttcgacttcgcgacgatctttggcggcggtgcagggaatatgcgccgtgagccgaggcctcagaagggcggagacctcaccgctactatcgaggtgcccttcgaggatgccctgaagggtgcgacacggaaggtctcctatacgattccctcgacgggggagaagcagaccatcacggtcaagattccggcaggtgcggtcgacggcggcaagctccgctaccgcggacgtggcgactatggctacggcggcggcgagcgcggcgatttcgtcatcacgactcgcgtgcaggagcatccgctcttcaagcgtgacggcgccgatatcaggatggagctcccggtgagcttctatgaggcggcactgggctctgtcgtcgatgtgccgacgcctcagggcgagacggtgcgtctcaaggtcccggcaggatcgcaggatggcaagacgttccgcttccgcgatcttggcgctcctgatgtgaagcacaagggacagaagggcgccctctacgtcacaatcaggattgccgttcctcgcaagctcacgcagaaggagcgcgaggcactccaggtcctgaaggacgcagatacccgcgactacagaaaggatgcggagcgctatggctcgcagtgacgaccgtacagggaagaacaagccgctctacatgatcagcgtagccgcagagcttaccggcatgcatccccagacgcttcgtgtctatgagcagaaggggcttgtgacaccgggacgttcgagaggcaatacccgtctctactcccaggcagatatcgagcgcctgaaccttatcgcgaagctcacggatgaaggcatcaaccttgcaggcgtcatccgcatcctcgatatgcgcgaggttgcagacaagcgcaacaaggagatagacgagctcagagaacgtgtgcgcgagctcgaggacgaggtccacgagctccgcatgcgcgagaagatagtggcgcttactccctacaagggacagaccgcagagcaggtcatgcgcgtcctcctctcttcaggggcagatgcggacgacgacgtcgatgaagatcgggacgtctagggaaaactgcatacgagcgtgcttggaaggcagcctcgcggctgccttccttcgtaggagagaaatctcctgaccctatctatcgtcactgatactcccgatagccctcaaagactaagtcatggagatacaaaaaatctgatatgagatgacttagatatgtatgagagaggggcaatgcgggaacactagtacctgaaaaggaaagacggattggaagagatgccttccattccaaagagaggtgagtgctatatgaacatcaacaaatgggctgtgacagcccaggaagcgctgcagagcgctatgggtgtggctgttgatgcgcaggctggcgctctggagcccatccatctgctgaaggcgctgctcgattccggcgagcgcaacatcacggctatcatcgagcgtgtcggcgcagacccgaagagcatacagaaccagaccgaccaggcaatcgcccgtgctcccaaggtatcgggagacggctctcagatgggcatgagcaatgatttcgtgcgcctcacgaacgacgcagagaagattgcagcgaagatggatgaccagtatgtcacatccgagcatctgctcattgagctggctgacgacaagtcagatgcaggttcgatcctcaaggcttcgggcgtcacggcaaagcgcatccaagaggcctatacagagctcaggggcgactcccgcgtcacatcgcaggatgcaaagcctgagttcgaggcgctcgagcgctacggcaggaatgtcacggaccttgcccgccagggcaagctcgatcctgtcataggacgagtggaggagatccgccgcacgattcaggtgctctcgaggcgtacgaagaacaacccggtgctgatcggcgagccgggtgtcggcaagaccgctatcgtcgagggcctggcccagcgtatcgttaacggcgatgtgccgtccaccctgcgcgacaaggagctcatcgagctcgatatgagcgcactcgtggctggcgccaagtaccgtggcgagttcgaggacaggctcaagagcgtcctcaaggaagtcgagaagtcgaacggcaagatcatcctcttcatcgatgagctgcacacgattgtgggtgccggtgctacggaaggctccatggatgcaggcaacatcctgaagccggctctggcccgtggcgtccttcacgcaatcggtgctacgaccttggacgagtaccacaagtacatcgagaaggaccaggctctggcccgcaggttccagcctgtcatggtcggcgagcctagtgtcgaggatacgatctcgatccttcgtggcatcaaggacaagtacgagcagcaccaccgcgtccgcattacggactcggcgcttgttgcggccgccgatctttcgaaccgctacatctccgacaggttcctgccggacaaggccatcgacctcgtcgatgaggcagcatcgaggctccgcatggagctcgattccatgcctgccgatatcgatgcagtagatcgccagctcacgcagatgcagatcgaagagcaggctctcatgaaggaggaggacgatgcttcgaaggaacgcctgaagacgctccgcaaggagattgcccagacccaggagaagcttgatggcatgaaggcgaactggcagaacgagaagtctgccatcgacaaggtgcaggacctgaagagccagatcgaggacgcgaagaccgagatggagcgcgtcacccgcgaaggcaacctggcccgtgcctccgagctccgctatgccacgatcccggccctgcagaagcagtatgacgctgcagagaaggcgctcaatgccaagcaggaagagggagggctcctcaaagaggaggttacctcggaagagatcgcagaggtcgtttcgagctggaccggcattcctgtgtccaagatgatgcagggcgagatggacaagctcaggaacctcgagaccgaactccacaagcgtgtcgtggggcaggacgaggccgtgcgtgccgtcgcagccgctgtcaggcgcagccgtgcgggactctcggatcctgaccgtcctatcggcagcttcttcttcctcggccctaccggtgtcggcaagacggagcttgcaaaggctctggctgagtgcctcttcgacgatgagaaggcactggtccgtatcgatatgtccgagtacatggagaagttctcggtccagcgtcttatcggtgctcctcctggatatgtgggctacgacgaaggtggccagctcaccgaagccgtacgccgtcatccctactgcgtgatcctgctcgacgagatggagaaggcacatcctgatgtcttcaacatcctgctccaggtcctggacgatggccgcctcacggatggccagggcagggtcgtgagcttcaagaacacgatcatcatcatgacatcgaacgtgggcagccagtacatcgccggtgccaatgcatcgagcgacccggcagaggtccagcgccaggtcaacaatgccctgcgccagacgttcaagcccgagttcctgaaccgtatcgacgacgtcgtggtcttccatccgcttggactcgaagacatcgagaagattgtcgatatccagctcaaggacgtccgcaagcgtctcgagcgtgaccgcatcgtgctcgagctcacggaccccgcaaagcagtccttggctctcgatggcctggatccggtcttcggtgcacgtcctctgaagcgtctgatccagcgccaggtcgtggacaatgtcgccaacctcatcatcgacggcaagctccacgagggcgatgtcgtgaaggtcgatgtgggggcagacgacaggctctatgcagagcgcgacgatgccgcttctgaggcccgcaagaaggagcaggaggcaggcacttccgaaagctccgaagacgaaccgctcgagcctgacgacgtcgagtaattgcgcatagcagctgataagccagctgcctgatatgagaggcctcctgtgccagcaatggtgcaggaggcctctttgcgtatgcggatatatgccggggaactggcgctggcgtatcatttcattcaggaatgtttcgggcagacgcatgcctgcccataagataaggagcttgccgattatgaagtgcccgaagtgcggagcagaagtcttggatacagcccgcttctgcacgcagtgcggctatcccttgaagcctggtgccaaggcgccgaaggtgcatgtcgtggaagcaaaggatgctgcagcgaccgttgctgcaggccagatcgatgaggcagtgaggaaggccgccgaagcacgttcccagggacagacccagcctatgggggcggtgggagatgccacggtccctacgacccatgcacctgaagcgacggcccgcgtcgtccctgaagccatggcagaaacagccaaggtcgaagaggggcccacaaatgcggtggacttcgaaacctatatcaaggagaaggctaccgaggctgtcttcgagaatgaggaagaggacacagatccttccttgggccttgagcgcatagacggcgagagcatcgattccgattccacgctcacacaggtcgcgccggtcgcggtgccactcgatatggcggcagcgcctgagccggcaccagaagagctgccctccgaggaggggcctgcaggagaagagggcgcggaggctcctgcagatcaggagaagccagaagagggagatggcacagagcacggctccacacccaagcgccgccgcacgaccgctatcgcaatctgcgccgtggctgccgctcttgccattggcctcatcggctacatgttccagtggtggggaggcgtgagcgtccctgatgtccagggacttacagaagatgtagcggtccagaagatcgaggaggccggctttgtggcagacgtcggctacacgtatgtggatacagatgccggcaaggtgctctcgcagggaaccaaagcaggagagcgcgaagccaagggcacgacgatctctcttgaggtgggcaaggcccgcaccatccccgacatcatcggcaagacgaaggaggatgcatctgccgcactctccgagatcggtgcaggcacgattcactgtgtgtaccagagctcagactccgatgctggcacggtcctagctgttgatcctgatgtgggtaccacaatctcttcaggcgataccgtgacgctcacggttgcccagggctatgaagtgcctgacgtcataggcatgacaaaagacgctgctgtgagcacgctctcccagagcggccttgtggcaaaggtcgtctatgtggatgcagaccgtacggcaggcaccgtggattcgaccgatcctgccgccggaacccaggtctcttcgggcacggtcgtgaccgtgcgtgtcgcgaacgagaagaaggaagagaaaagctcgtctctcaccgatgcagaccatatcgcagactacttctctgccaccccgcaggacattgccaagttcatggagcagcagggctatgcgctcgtctatggcgcgtcttctgacaatgtagccacctgtacctatacgagggaatatgcaccgaccattgccttcacgccgacgcctcatgcaaaggcacagacgtcaggtgcgacggacgatgtgcttgcctctggcgccacgatttcgggcgtgcagctcacggttgccgcctccgatgcgggtgccacggcattgacggatgacggagtgtctgcggccatgtcgttctgcggcctttccacgaagggtgccacggtatcgagcagcagctcttcctcgacatccgcgaatggcagcagcacatcttccagcacgtcgtcgcagagccagacggcgaactcctcgagctcctcttcgagcacgtccacaagcacgaatacgaactcgaatggctctacggatgcttcgaagggcagctcgagcacgaagaccacatccagcacttcctatatctgcagtgctggcagccagggagacctcatctggaccgtgctgctctatcaggagtcgggctcttcgaccatccaggcagtcgtgacctgcgctccgaaggatgcctattcggcacagtcgggagacctgaagcagatcgcacagtatgcagcagatacgtatctgggggcaaagtagccatgaagaagccagacgatagcaagaagaaggatctgaagaaggaacagggcagaaagaagctggatgtcgatccggccttcgcccgtcccgagaacgaggacgacgacggatacgacccgtggtctgacagaaggcccaaggcagagccgctcttcgagcgcgatccgtgggactagctctgccattcagaagatagagaagaaggggcgtctgcgaagtgcaggcgcccctccgtcgctgctattcggatgggcggatgcgccagcagaatgacgcctgagctcgcggcgggctgatatcagctgagcaaatgtcgcttccccgagagcaaatgcagctcttggccccttgtttttcgtgcctgccctgcgtcagcgtaggcgagcgcgtctcggagatttcctccaccatgacacaagcatcgtcttgcttcttcgtccctgcatgtgccgctcccggctcaatccctgccgcgtagagatgggcactgcatcgcccttcgctcgcgaaaattacacgccccataatgagagggaaactttcgcaggctaggagatatccatggaaacccagaacaagccggccaagggcaagaagatcaagcgcaccattttcgcgttcttcagcggcctgataatcggagcagtggtgtgcggtgctgtcatctactacatctttgccatgacttccaaagaggtggtgacttctgatctcgaaacgctttcgccgaccattgtcttcacgcgtgttcaggaccagggcgagcttgtcagtgcctcgcaggactatacctacgtcgacaaggtcactaattcgaaccgtgacctcttcaaccagttcgatgtccccttcaccgagaacagcttctggtatcgctactcaggcacgctcaaggccggtgtcaatctgaagaccgctgctatcgagcaggatagcgaggacttgactgtgctgaatatcaccctcgaccagccctacatcgtctcgaacactcccaatatggacctgtcgggcgtgctggaggagaacaacaaccttatcaatccgatcagcatccaggagtccgatgccttccagaaggaatgtatcgaaaggagcgagcaggaggccatgaatggaggactcctggaagaagcaaggaccaatgcagagaagcagattacaaacctatcctgcccagtgatatcttgaatgcaaggctccgcaacgggcatgacggagcctcagcccaggattgcgaggatttgggaccggtccttgcagtcaaggacaagagcgattttcatgcgctgcggagacatgtgattcgcaagcgctgcttgccggctggcggagatgcttgcagcgggacctgtgagtgttgaacaggggcacacagtctatatagatgaggccattaccttgctgcgcggggagctctcgagatgggtaaagcattcaggagaaaagcggatgcctgatttgcaggcatcagctgacaggcaggccatgtgagagctatgccctgagaacaaaccgctcaccatgtgagtgatattgattgcgaacagactctcgcaacctatcattgcgaaagattctgatggagccgcccccaggaatagagatccttgcaggtgggcggttcaaatgctgaacggtgtgtggccaccttgtcttcagcgcgcgggatactctgcttgcccatgctgcctagctttgctgccaggacgtccatatccgcaagcggacggctggcacgtgagcctctgcgcattcttctcacgtaagcagcattctgcatggccggttccgtcttttcgatgagagcagaccagtcgagcttcctgctctgtttggagtatccaggccaatgccgccgaagttcagcgatgacatcagttgctgtgggaaaatcacgtgtggtccggacaaaatgaagcaggaaccagtactcgatgctcggagaatcaagcacgagatgaacatcgtctcctgcttgattgattgcatgggagatattttctgaagatccgttctcgtgctcagactccgcgtcagcgacaacccagatttcgtcgaagttttctccttcccgtttcttgccggatttggctagcagctctcttgcctcaccgacaatcccgtttgcatcggtacatcttgatttctcaatctcgacgagtcccttcggtatcccgagtgcttccctaagggcatcaaggtattcgggctcagtcaccttgccttccaccaagatgacaatcgaaggcctgggagttcttgagggacgcctgcggctatagctatggctacttgtcattgccctcgcctcccctgtctgatgaaggcaacatgccaaagtcttcaggcagcactggtacggctgcatatctgcccagcaaatagccctgtgcaatcggctcgcctttgcggggagagtaatccgaaagaggatatagaacagtgccaccatctggacccttgtcggtcagccagatctggtctcgctccagagtgcctcctgacatgaggtatgtctgatgcgccgtgaagatgagctgtgccaatctatctgcaagttctctgcgctcgaacatctctacgatctgtttcgaaagaatagggtgcatagaagcatcgagctcatctacgacgagcgtggcatcgttctccagggcctctccgataaaggagctcaaagagaacatctgcatcgttccaagtgactcgtccatcagattgattgatccggctcccgccgttccggcgtgctgcaggacaacggtcttgcggactacatcagtcccattttcgttgccttcatttgaagactgtttggcgggcttgcgcactacattggctttggtgatgccaatgtcagaatcctgcatcatcttctgtacaaggtccctctcgtagtctgttcctagctcgccatccagcacctctccagagacgggaaagtcgagccatctgtcccgcatctgatcgaggacgataaggccgttcttgaagaaatcgcctacaggctttatggtgtcaaatccctgtactcctggatgcccatagagcaaggacagaagcagcatgttcggattgagcatggttgcaatgactttgtctatcggcagataggaagagtcctgaacggcggatcttgagcccgcatcggctgtgcgagtatacagagtgcgtctcagcccctttggaaaagagcagagctgctcctcgacaatctgcttgctgtcataggagaattcatattcatatcggatgccgccccactcaaaggctgcgaagaattcggtcggctgcgtcttggagttctcatccaagatgaatgggttgtagggaagactgtcatctggggcatacgacgaagaatcacatacgattttctgcatagtgcgcatggcatgaatgacattcgatttgcccgatccattcgccccatagatggcaatggaacgaaggaagctcttcccggagaggccaggcagcgatttcttgatgagctgcctctcgcgattctcccgagcgtgcatatccgatttcttgcccgagtagtacggagatgcgacgagattcaattcctgttcgtcacggatggaacgatagttcttggcagaaaagagaatgagcatttcggcacctcacaaacaatgcgcccaagcaaatacgtctcatattggtaattatatagagctacgtaagatcggcaatactaaaacgatttacgacgaaaaaccgcgaaaaacgaactgcttgtgagatattagacagaaaatgatggagcatggcaaatgaagccaatttgacgatttgcggtatctcagacatttggaagatatccgaactataaaaaaggcctctgttagaccacagttgacatgatgggccccagatggtgtcgcgccccccgcgtatgatgtgagctaccacacagacatcagcacaacggagggcgcatggcaacaagtatattcaagcggcagaggaactgagctacgaggacaaggtcaggctggcgagggtgctcgaggggctcatcgcagaggagcgcgcggccatcgcggatgcaggcttcgccggagcgctgcccgcattgcggctgcggccagcctcgtcaggaagggccatggacgcgacgggtccagaggtggatgtgcagggcgcggcaggacttctccgccaggacgatggggctcctcgggtactcgaagctgggccccgaggtgtgggccaggttcgtgaggtgcgagctttccggcgcagcctggcagggatgcggggagtgccatgtgtgcctgaagactgcaaggttcatgcgaatcaggctctgcgaggccatggagaggtgcgtcccggagttccgccatggagcctcgtctccgtggaggccggggacctacctcaccaatcgctcaaggggaaccggaagcgcgcgaggtgaagatgcccaggaaggcgcatgattccgggaagcgtgcacgaacgcggcatatcgtccggcaaggtctgatcgcctgcggcgccaacagcctgggcgactgctggctcgaggttgggcaggggcaggccacggatgccgagctcgcggatggctcgatgggatcgtggagggcagcccgtctcactgacaggctccaggggtacgcccgaatcctcggagctgggcgcctcggcacacaggagcgccgacccgaagaccgaccccggcgcgctcggcatggtcaatgccctgcaccagcggctcaaggcatggctcggcaggttcaacggggtgtccatcaggtggctggaccactatccgcctggttccgctggacagagatggcgaggcattcggacatggacatcgaggagatgctctccgggcaggcggcccaggggcgctacaggctcaccagggccgaggccgtctccaggccgcagccgctctggagctggtgggagggtgccgacgtgtcaacggaggtctaaaataggctaaaaaagaaagcgggcgcctgttgaacaggcacccgctgcgagtcatgctctgcggatgaagcctcgactacatgccgaagttagacacgagaagctggaaaacacagatggcggcaatggcaagatggccgcgaaaactgccagagcgagacgattcgtgcgggtgcacgctccgggaagcgaagatggaacggcgccccttcgggatctcgaggtactggccgtagtgcagatcgcgcgcaggcgcttcatctcggagggggaacggcggtaggaagcacggagaggggccgccaccgccgatagcgatgccggaatcatgcgtatagtcgctcggatacttcgtgttctggggctcgagatcgtcggctgggtcttgcggggacgggacggatgacatagcgcctggcgcgggaagctgccggttgggcggacatcacgtcggcaggagcagcatagtgatcctgctcatggggaggcaggggcatagccattctgtgcaggagcgtatcccgtattgtccatattgttcacatgctgcgactgggtcctcggacggggctctgcagagccttcgtattccccggcgtctgcatcctcatatctatacacgttctcgtccacagatatccctccccataggcgagcgaagttctatctcgcccattctatctcatggagccctgccccatgcaaaactggacagctggcggctttcagattccgagaaaccacaaagcggcgctgtgtcttgcggcagactgaatgggttagactgttacgctcaatatctaacaatatagaattagatagctcagtctatgaagagcagaatatcttgtttctgtgtttaaaagacctctcggagggcacatataccagcagacaacaagagcgtcccagagaagggggcgaggatctgctaggagtgatagaatgatgggcctgtttccgttgatcgctatggtgatatgcttcgtgccttcgatggtatggtgaccttcaagagcttcccgttcgtcgagaccacatgcctcccgatggatgtcgaggatgcagatgacaagtacgtcgtctccgctccgcctccgggcctgaagaaggaccagatcgatgtggagctgaatgaaggcaccctgtcgtctccgtcgacaagaaggaatcgacgaagagaagggcaagaactacctccacaaggagaccggcgagtggaggctacgcgcagcgtctatctgaaggatgccgcaacgagggcctcaccgcacgctacgcagatggcgtgctcaccgtcacggtgccgaagcagtctgcaaagccgaacgcaacgaagattgcaatcaatgagcttctctcgcatcggctgcatgagatagcaatggggacagagcttccgggctctgcccccattttttctgtatggcaggttttctcagagcggtcttctaccagacatcactgccttatgctgcggggaaagacggtaagcggccatcaggtgtcctggcttccgtgatgaagtggttcgtaggctctgcgcccagtggctctgcgagcggtgcggatgcagacgctcgggcggttgttctcctcggaaagatggagggctacgacgcactccgtatccttcgtgacgaggtgcggcaacggctgctgcctgggcgttcgagagatggccgtcctctcccttgacgggtccttgaggggaggttaggggagtaagagtagaggcccgtttcgagcatcttctcgtcgtggttgctctcaagccccaggatgcggcagccgtagagtgcatccaaggcttcgtctgtcacatatcccgtatcggtgcaccagccgagcgagtcctggatctctccctcgccgtctatcacatcgaagcggaagcctacgggatcgttcacatcgtgcgaggtggggaaggcgcggatgtgcatgccggcaagatccagggaatcgttgtcctggatgagctcgaagggcatctcctggagataggaccttcctgccacggtgcctgccgtggcaaagagagggccgtcgaagtggttgcagaagacagagaggcctgaggtatggtctccgtgctcgtgggtcagaagcacggcacagatatcgtccagaggggctgctacctcctgcgctctggttctcagggccttgtaggagatgccgtcgtcgatgagaattgagccttcagggccctggacgatggcggcattgcctttggagccgcttgccagcacgaaaagatgtatcgaaggtgtcatatatttcccgtttcttggggcgctgttctagaatcagaccttactagcttagacattccttgcctggggcaccgaaaaccctagggaaggaacatgcaagggagagaaatgacaagcgttgccagaagatatgcgccgcctgccaaagcggcgcccggctcggagggacgagctcctgtcgtcctgatggtctcgggcggcgctgattcgacggccctgctcgttctggcagccacctcgaagctcgatatcggcgatggcaggggcctggcccatatcgcacgggagcgcttggtcgtcctccatgtgaaccatgggcttcgtggcatcgatgcggaagaggacgaggagttcgtacgggggcttgccgagcgcttcggcattccctgccatgtggagcatgctgacatagcagcgcttgcaaagaagggcgatggaaacgtcgagaatgcgggacgcgagttccgctatgccgctgcagcaaagctcgcaaacgagctctgtgccgaatacggcgctccgcgtggagcagcaaggatcgtcacggcacacacggcagacgaccgtgccgagaccttcttcatgaatgctatccgtggcaccggcccctccggcctctcctcgatcccccggcagagaaacaggatcgtgcgtccgcttctgggatattcgcacgaagagctctgcgatcttctgcgcatgcgcggcatcgtctggcgcgaggaccagacgaatgcggacacggtgtatcttcgtgcctatgtccggcatgagatcatgccggtcgtgaaggccaggaatccgaaggtgctcgcaagccttgccacgacctgcgacatcctctctgatgaggatgcgtacctcacgcaggtgacgtcccgcacgttccatgagctggagagacgtcggcaggagggcatggtcgcgctcgatgctgcacgccttgctgcgaccgatgtcgccgtggcacgccgcgtcgtgcggcaagccttccttgcggtggtgcctgacgcccgcctcgaggccaggcatatcgagcgcacgctcgagcttgtggcagaaggcacaggttcccagaccatccctctcggtgtggatgtgcgcgtggagcatgggcttctctttgtccgggcacggtctgcgagggaacgcttcacgggcggctttcttccggtgccgggcacgctcgagcttccggatggctcggtgctcacggctgctatcacgcctgttgccaagggttccgaccctgtggcaatcgcccgggttcacggacgcgagtgggcaggatcttcggtcctgctcgatgcagagcgtgcaggtgcctctgcccatgatgcagagctctgggtggagccgccgcaggcaggggaggtcttctgccctcttggcatgcatggccagtcgaagaagctctctgacgccctctgcgatgcgaagattcctgctgccgacaagcaggacgtcgccgtcgtccatacagggccgaccggacacatcgtctgggtggccggtcttcgggcagatgagcgatgccgcgtgagcgctgccacgaagctgctgctagaattacggcttgagagtccctctgagggagccaagtccaaaggtgcgaatgcaaaggagcaatgagcccatggaacagctgcatcctgatgtagaccatatcgttctgaccgaggaagacatccacgatatcgtgacgcgtctcggaagcgagatctcgcgcgactatgcggggaagaacccgctcgtcgtctgcgtcctcaaaggtgccttcgtcttcacgtccgatcttctgcgtgccatcacggtgccctgcgaggtcgatttcatggccgtctcgagctatggctcgggcgtcaagacctcgggtgtcgtccgcatcgtgaaggacctgtccacgaagctcgagggcagggacgtcctgatcgcagaagacatcctcgactcgggcctcacgctttcgtacctgatcgacctcttcaaggcgcgcaatcccaagtcggtccgcattgccgcctttgccgtcaaggatatccccgaccatgtcccggccgtcgagcctgactacgtcggaacgcatgtcccgaacgagttcatcgtcggatatggcctcgattacgccgagcgctatcgcaacctgccctacatcggcgtgctgaagcctgaagtctatagctgatctttttgagccgcctgcctccgcaggcggctcgaccctgcctttaaggagcgattcgtgcctgacaagaaagacccgaagcggggactcgaccccgacaagctcgacggggccacgacccgccgcgcttccatcatctccctcctcatcatcattgccctgattgtctatctgattgtgaacatgggcggcagcttcggtgccccgcagacgaagagcctgaccacgagcgagttcgtggctgcggtccaggacgggcgtgtcgatacggcgacctacgccacgaagaacggcaccctctcaggcacgtattgggagaacaagggcgatgtcggcaatgacagcaagctcgagcactacagctcgacctatgtcggcacggacaacctcgacgacctcatgcaggaccataccgaggtcaagttcgatgtgaacacgagcacggatgactggctcgagacgatcctcatctcggtcgttcccaccatcctgatcgtcgcggtcatgatctacttcatgaaccagatgcagggacagaacaaccaggcgatgtcgttcggccgcacgaaggcaaagacgaccgaggagacgcgcccgaaggtcaagttcaaggatgtcgccggcatcgatgaggctgtggaggagctgaaggagatccgcgacttcctgaaggatcctgaccgctaccacaggatgggcgcaaggattcctcgtggcgtccttctggtcggccctccgggcacgggcaagacgctcctcgcgaaggccgttgccggcgaggcaggcgtgcccttcttctcgatctctggctccgacttcgtcgagatgtttgtcggcgtcggcgcaagccgtgtgcgcgacctcttcaagcaggcaaaggaagcctctccctcgatcatcttcatcgatgagatcgacgccgtgggtcgccagcgtggcgctggattgggcggcggacacgacgagcgcgagcagacgctgaaccagcttctcgtcgagatggacggcttcgaggagaacgaggctgtcatcctcatcgctgccacgaacaggccggacatcctcgacccggcattgctgcgtccgggccgcttcgaccgccaggtcacggtcgacaggccggatgtgcgcggacgcgagcagatcttgaaggtccatgcaaagggcaagccgatcgacgaatccatcgacttcgcgaagcttgcaaagctcacgccgggcttcaccggtgccgaccttgcgaacctcatgaacgaggcagcgctcctctcggccagaaggaacaagggcacgatctcacaggcagagatcgaggaggccatggagcgcacgattgccggccccgagcgcaagacccgcgtcatgacagaaggggagaggaagacgatcgccttccacgagtccggccatgcccttgtgggacatgtgctcgagaactccgatcctgtccacaagatctctatcatcagcagggggcaagctcttggctacacgctccagcttccgaccgaggaccactacctcgagacgaagaatggcatgctcgaccagatcgccgtccttctggcgggccgcacggcagaggagctctgctgcggcgacatcacgacaggcgcttcgaacgacctcgagcgcgcgacgaagatggcccgcgagatggtcacccgttacggcatgagcgaagagctcggcacgcaggtcttcggcgaggcgcagcaccaggtgttcctgggccgcgactatgcaaaccatcaggactactcggctgagacggcaaagaggatcgacgacgaggtcgagcgcatcatgcgcgaggcgcacatgcgtgcacagaacgtcctctccgagcgcaaggaccagctgaagctcatggagcaggtgctcctggagcgtgagaccgtcgagggcgaggctgtggaagcgcttctcgacaacaagtgggacgagtacctggcgtcccatcctgaggagcagaagaaggaagaagaggctgccgaggaggcaggccatacggaggactgagcctttcggtttgccggaggcagaaagcgaggaagcatggatatcaacgagacgagctatggcctgggtgcatccaagtcatcgattcgcgagattgccgcctacggctcgcgccgcaaggcagagatcggggcagacaaggtctatgacttctcgctcggcaatccttccgtgccggctcctgcggaggtaaaggaatccatcgagaagtcgctcgagctcaatccggtcgccctccactcctatacgccggcagcaggccttcccttcgtgcgtgacgccgtggcagagcacctcaacaaggagtatggcacctcctacaagggcggagacctctatctcacctgcggcgccgcagcatctttgaccatcaccttccacgcaatcgcgaacccgggcgacgagatcatcgttatcgctccctacttcccggagtacaaggtcttcatcgaggccgcgggtgccacctgcgtcgaggtcatggcagaccccacaaccttccagatcgactgcgacgccgtgcgtgctgccatcacgccccgcacgaaggctgttgtcatcaactctccgaacaacccgatcggcacggtctattcgcgtgagacgctcgagaagctggccaaggttctctccgaggctggccaggacatctgccttgtctccgacgagccgtaccgcaagatcgtcttcggcgccgaggtgccctgggtgccctcgatctacccgaacacggtcgtctgctactcctattcgaagagcctctcgcttccgggcgagcgcattggctgggtgcttgtgcctgacacgaacccgaaccacgacaggctgattccggctatcgctggcgctggccgctccatgggctttgtctgcgcgcctgcgctcttccagcgcgtgcttgcagactgcgtcgatgtgccgtccgatgtcgccgcctacgagaggaacaggaaggctctgaccgagggcctctctgcacttggctatgagtacatcgagccggaaggcgccttctatctctgggtgaagtcgctcgagccggacgagaacgcgttcttcgagaaggcaaagtcgctcgagctcctgccggtgccgtccgattccttcggctgccacggctgggtgcgcgtcggctactgcgtgagctacgacacgattgtgaactccatgcctgcctggaagaagctcaaggagctgtaccagtaatggcaaagaagaaaaggagctgcgaggagtgcgcgctctcgacggagaagccgggtttcctgcgctcgaagatcgtctgcatggcgccggcaggctctggcgcagacaattccgagggcggcaggcactgccctgagttcgtgccgcgcatgaagagcctgaacgccgtccagaaccttgaggccatgaacctctgggcccacaagaacgtgagacgtgcggaggcaggagaggaagtcacggtcacagagaccgccgaggccactgacgacgacctcgcgcttgctgcggctgaggcgaaggcacgtgctgccagggcccgggccgaggcggcagaagccgaggcagagctcgccgaggcacgcctgagggcacgccagaagcgctcctaaaaaatatgggcatagcgtgagagagggcaggcacccatgcggtgcctgcccccttgccgctacgatgggcatgaaaaagacgatttcagcttcagaaggtgtgcctcatgaatctggcctcagatgtccatacccatacgctcttctcccgccatgcctactcgacgatccaggagaacgtgacagcagcgaaggcccagggtctcgagctcctgggctcgaccgaccacttctcctcgatgctctttacagagcaggacctgcgcaacttccagttcttcgtcaatctctcggtctggccgcgcatctgggacggcgtagtcgtccttcgcggctgcgaggccgatatcgtggatatggacgggcacctcttcggctgggatatcgacgtgcccacaggcatcacggacatgccgtaccagaagaagcggagcctgaaggatatggtcttccgcggcatcgactatgcaatcgcttcggtgcatgggaaggcatttgcagatggcgccgatccggtgcaggtctcggagatgtacatcaaggcattgcaggacccgaaggtcgcgatcctggggcatatcggccgctcaggcctcacgttcgagctcgatcccgtgctcgaggaggcggcacgcctccacaagatggtcgagatcaacgagcacagcctcgatatctccccgtcaggcaagatcagcaagaagtgccggaggattgccgaacgtgcggccgagctcggcgtccagattgccgtgagcacggatgcccatattgcgacagacatcggccatctcgatgccgcccgctcgatgctcgaagagatccacttccccgaagagcttgtggccacgcgctcgaaggatgcgttcctgaaggcgctgagagtcgccaacgtcgcagatatccagattggctagatgaaagaagaggccgggtcaccccggcctcttctcgtagctgcatgttctgctctaaagcgcgatatcgagctcgatcgggcagtggtccgatcccatgatctcgtcgtggatctttgcgtcctggacgcggtcctctgcaccgtcgctcacgaggaagtagtcgatgcgccagccgatgccacgggcacgggcacgcatgcggtagctccaccacgtataggcaccctcgagtgtcgggttcgcctcgcggaagacatcgtggaagccggcagcgaggagcttcgtgaagccctcgcgctcctggtcggaaaatcctgcattctcatggttcgtgtcagggttcttgaggtcgatctcctcatgcgcgacattgaagtcgccgcaggtgacgaccggcttgtcctttgcaagctttgccaggaagtccgtgtaggcacggtcccactccatgcgctcgtcgatgcgggcgatcccctgcttcgagttcggcgtatagacgcagacgaaccagaatttcgggaattcgagggcacagacgcggccttcgtcctcggcgacaggcgagccgatctcgcggatcacctggaggggctcctcgcggctgaagaccgccgtgccggaatagcccttgcgtgcggcatagctccaggtctgcgtatagccgggaaggtcgagctcgacctggccctcctggagcttcgtctcctggattgcgaagatatcggcatccaatgattcgaatatctcctggaagcttggctccttcttgaggacggcgcgcaggccgttcacattccaggagatgaacttctgcgtatgtgtatcacccataggatgctccttgctggttggaaatgatgcttcaagactagcgtatctcaggcctcagccaaagagccactgctcccattggggccactcctcgactccctgggcatgtccctgtgcataggcatcctcgagcttcgggcggtcgatcgtcgtggacttcaccggcatgacgcgtggccggacgacaagggcgcgtccttccttttccagccggtcaagctcatccaggctctcgttgtagcgctcgttccttgtctggagcgcctgctccaaggcttcgtctccctttgcgatcctgtggtagacgcggcgcatcagaggtgtcggctccttcttgcggtagcccttgggacgggtcgcaatgaccatgaggcgcttgaagccgcgctcgcggaccaggtggagcgggatgccggcaccgtctcctatgccgccgtcaaagagcttgtggccgcccaatacctgcggctccatcatgccgggaagcgtcgagcttgaccagactttcctcatgagctcatggacatcgggcatatcgtccttcgtccagacaagcgtgcgtcccgtgtcgccttcgaagcactggatcgcgatgggcgtcgggtttttcgcaaaggcctcgtagtcgaagggcagatagccatcgtcgacgcagccgatgtagtcgtaccacgcattgaagtagccgtgccccgtcaggaacgagcgcacgcctcctgcctcgggccgcctgtcggcgagcacgatgaaggcgttcttcacgcgctcctggtctccagagacgaaatcgaccgtatggcttgctcctgcgctcacgccgcagacgaaatcgaacgatacgccgtgctccagaagcacattggcaaagcctgcggtataactggctcggtagcctcctccttcgaagaggagggcgcaatcgctcacgtggcgctcatatgcagctgtctccatgactgcgacctttctggaacagcgctcatgagcactgtggcatgcgagaagggatgaggtgctatgggagaatatcttaccaatccggccgatgcgcaggctgcgatgaagaaggtgatggagaaggcacaccatgcggtcttcttcggaggtgctggcgtctccacggcaagcggcattcctgacttcaggagcccgaatggcctctacaaccagcgtggctacaagtatccgcccgaggagatgctctcgcacagcttctatatgacgcacagggaggagttcttcgacttctatcgccatgtcatgtgcgtgccttcggccaagccgaaccagtgccacaggaagcttgccgagctcgagcaagaaggaaagctcgactgcgtgatcacgcagaacatcgatgggctccaccaggcagcaggctccaggcatgtgatagagctccatggctcgacgcaccggaatatctgccagaagtgcggagcagtctactccgaggagtggatcctggatacggaaggcgtgccgaagtgcccgaagtgcggaggcgatgtgaagcccgatgtcgtgctctacgaggagagcctcaaagaggagaacctgatcggcgccgtgaaggcgatccagaaggcagacgtcctgatcatcggcggcacgtcgctgtcgctcgtcgtctatccgcggcggggctggggtggacaacttccagggtgacacgcttgtcgtctgcaacctcgaggcggggccgcgtgacagtgctgcgccttatctgcgcctgcgatatcgcaaagaccttcgacttctaggtttgaagaacgcacaggtacggccttcagcggcacaagtgcggcgcgacggctacaatcgaaaccatcatctacagattctgctgcccttgcggcatggaaggaccgatcatgctcagagagaactatgccacgtggcactgtgcggacatgagatctcgctggcgcggccgcacatcatgggcatctcaatgtgacccctactcgttcagcgacggcggcaagcacgctgacgccgactctgcgattgcctatggcctcaagatgctcgatgacggcgctgacatcatcgacgtcggcggcgagtccacgcgccgggagcgacaccggtcgatccgagaccgagctcgcacgcatccttcgtcgtgctgccttgccgatgctggcgccatcgtctcggtcgatacctaccatccgcaggtcgcagaggccgtgctcgaggcaggagcatcgatcctgaacgatgtcactggcttcacggacccggagatggtgcggtcgcttccgagagcgactgcggcctcattgtcatgtactggaacaaggaaggcctcgcacccatgcgacgaggcgctctgtcgagctcgacgtgaacaggccgaaccgccccgtggcacgtcgcgttccttcggccaggcgcttcacgcttcccgaagaggcgcagatcatgcgccaggtcatgggctttctgggcgaccggcaaggaagctcatgcgtgccggcatcgcgcatgacaggatctgcatcgatccgggtcctggctttgacaagtttgccgggacaggatgtcgtgatccagcgtgcgacgccgaagatggtgaggcatgggctatgcctatctctggcgcacgtcacgcaagcgcttcgtggtgccgtctcgggcgtcacggaagcagacaagcgcgatgctgcg

SEQ ID NO: 92 - DNA, 25069 bp, Unknown
  Metagenome-assembled genome
gttcgcgaagtcgtggcagatgccggcaggcaggaagacggtcctagatgagaaggatgctctggtccacgattgagccctatggggatttccggctggcttgcggcggccccgtcacgcctcaagggtccttctgggagcagagtgccacgcagttcctgtggttcttctgccgtgcgctgcaatccatacctttggcatgcgctaatccgagtgaatccgatcggctgcggcggatgccgaaggactcatccctcgccgtagcctcggtcttcctccggggagcagtgtcggtgccggaactttgccatcttcgagcgagggcgcatctcgatcgctgtttttcggcgcgagcggacggagcccggtgctcttgcgcgcaaggacaatgagtgagcgttaatggaagtctcctgcaggatgcaacttcacgaaggtatgtccccctgcgtgcgcgcttcttccgggacatgcatatctgctatggatgcctctatgatttttccgaccatccgcaggccgatagcggcctcgccatgagcttgtgcgagatgcggagccggcagcgcctaaagcgaaaagaccgcaaaggaacgcgtcatcgaagcggcagctcctgctgccgtagcggttccggacatgacaggagatggcaacgataccgagctcgacctctcgcacaagagtcaaagaaagaaaggccgcaagctctgccttcaacctgaccttcgtgcgggctcggcctgtcggcgacttcgagcgacggggcccatagggtagagggtgtcacgatcgggcgtgccccaggagaacgcatcgtcctccatatcccgctcggtctctcccgccatcacctcgcctttcgctcgggatgggcgtcgtgctgcgcagcacctcctcggttgccacgaaaaaaaaaattttgttttttttcaccccccccaccccccccacccccaccccacccactatcaccccccccccccccgcccccctccaccagtgaccccaactcccacgccacccccacccccctccccctccccaccatcgcgcatgccccacacccgcccgcaccccacccccccgggaatggttagaattaccccccccccccgccgcccgccccacgtgaagtgtggtgtgatataagaagtggggtagcgtggtaggggagggaagagcccccccaccctccccccgctccccgccctccgcaaaagggctatgtgttttttgtgttgaaatgatggtaagagttgggtaggacgggttttttgttgttggtatttgtctgtttgttgtgcgcgaggtgttggggaaatgcgggggggtgttaggggggggggtgggggttcccctcaccgcgcccccttcttccgccccccttcacccccccctcctcgccgcccacaggggggtttattgtggggtgttggatgtcctcttcgacccccccccctccccccgagcccgatccccccctccccctccctcgacccctcctcctccccccctccactcgacggcggctccgccgtggggggtggggctcacaccgtgattgttgagggtcccctggggcttggtgatggcccctcccccctcccccagcttcccgtggacaaagggccttcacggccccccccgccacccccaccccccgccccccgccatggcaacctatgaaggaaagccgatcgagggaagcgtgcttctcagcacgggagatatcttcacatctcaggcgttgccgttcgagataggggtggatgacgggcatgaggcaccacttgtcgaacggtcgggccatggcagatttgctaagcttgtctataggcaggcttaaccagattggagacctccatggaccatcctgtacggcatcccctcgaggcttgtgccagcttcttgtcggcctcttcgccttcattgcatgtcttgctgttgcccatacggcttgggctgactactcgatagacaggtctcgatcgatgcgacgatcgggtcagatggaacgctttctgtcatcgaagaccgcacgttctacttcgatggctcctaccacggtgtgtactggaagctgcccgaaggacctatgagggggcagagctgacaccgcatatcgcgcctctgtcggtatcgtcgaggacggcgtctatacggagttcgcccacaatgccggaggatcgacggcagcttcgtgtgacggatgagggctcctatctcgaggtcaagctctatttccgctcatgagacgaatcggcgacgtccgcatcgtctactcctatcccgatcttgcgcagcgctacgaggatgtgggcgagctctactggaagttcgtctccgatggctgggatgtggcatccgacaatgtgacctgcacggtccatctgccggtgccgtccggcagagcgtcgaggcaggctcgaatgtgcgtgcctgggccgggccacggtccgctcgacgcgagcctggccttcgatgtgtcggccatcgtctatacggtgccggtgtcggcaccgatgtatgcagaagcgcgcatcgtcttccccgaatcctggctctcgggcgcaacgcagcgctccggcgaggtgcttgattccgtcatgtcaagagcaggcgtgggcaacgaggccaatgccaagcgcgagcgcgcccggaccatgagcacggtcgcactcgtcggctcgcttgctcttgcagcgctcttcattgccctttctgcccgtgcctatctgcgcgacaagcgcgaacatcgcccccagttcgacgacgagtatttccgcgatgtgccgaccgatgaccatcccgccgtgctcgatgcgcttcggggagacggcaagccggacggaaatgcccttccggcatcgatcatgcgtctctgcgatctgggctatgtacagcttgctgcgtctgtcccgagaagaaggcttcctcggcaagaagaagcgcgagcgctactaccgtactgattggtaaagcgacctgccggcacagatgctgcaggcgattgacgcaaggaccctgtcgctgctcttcgacgagatcgaaggcatggcaatggggatacagcgccgtccggcagccgcgcctctggttctcttcgatcgagaaggcggcaaaagacgctcctgagcgctatagcgacgcaatcgagaaatgggaaggcgctgtcacgggtgcctgcagcaagaagaactaattctcgcggacaaccccaacaaaaggtgccgtatgcctcgctgcgctctgagcatcgtccttgctggcatcctgatcttcttgggaattgctgagaaatcacagctggtgtggcgtttgccggccttgctgtggcagtggcggcggcagtggtctgcggcttccttccgcaaagatgtgcagcaagacgaaggaaggcatcgaggtcgaggcaaagctcgagcgctcaggcgctggcttctcgatttcacccgtctcaaggaggctatgccccaggatgtggtgctctggaaccgcctgctcgtgatggcggtcgtgtctcggcgtgtccgagaaggtcatcgcccagctcaggttgcagcccccgagctctatgagacgctttcggcagacccgtattctccgtggtactggtatgcattctggggccctggccattacagcacgccgatggatgccttcggcaagagcgtcgagtcggcccactcagtgagcaccgcacccttgcgaagagcatggagtcctcgggcgcgggttcggcggcggcgcttctccggcggaggcggaggaggattcggcggtggcggaggcggaggcgccttctagatcttttgggggagacatggtacgtcctattggcatgcagcagatcatcggactcaagcgtgcgctcatcgaagctgcattccggtcacggtgcatatgcacgacgcttgcggcggacaaccttccgtctggagctcaccgacgcagaggctccccgagaggagtcgcttggccgtgcaccacctttgccgagctgtatctcggccgccatctgacgttcgatggtacgggagccacgttctgggctgctgactgaacaacaagaacaagaggcatgcagaaggccggtacgcatcgagcgtgccggccttcattcgttctatccgaaatctcaggcccggaattctgctgtgtcgattgcagggtcctcgataccgtcttcgggatgtgctccgaagccccagagcgcaagcgcagggtcgtcagcctgattccctgcctgcgagcagagcctcatgatctcttcgagcgtcctgatcgtgccctcttcatgatatagcgcttcttcatgtcgggcattccggactccataaagactcctcgtagcttggctcctggaagggagcatgcctacgcaacgtaggcattctagcaaaaagatggaagatggctgcactgcgcaggctacgagacaaagacattgatgcagtagcgggagccgcgatggtcctcttcgagctcttctgcggttgctgcaagcaggtggtccggatatttcctccggatcttctggaacgagtagctcttgttcggaagcgtcgcaacgaggtggtctccggcataaaagttcatgagctggccgcctgccgcatcatgtgcgccgcctacgtctctacgtcgagcggctcgatcggcttcgtgccgccgccaaggccctgccagtccttgtctgcaatataggcacggatgacatcgacatcggcagggaggctctcgatgcccgcggatgcagcctcgaaccagggattgcctggcacgaggatgcagagcccatcacccctgcgctcgcaacacagatagcgagggctctctcgtgagcagggtggcgacaggctcggtcggcacgattgcgaaggcgcatttgccgagacgggcaggaatccctgaattcgccggagtcaatcgcgtgcccttcttcgtgtccttcatgcctgcggcttcgtggagacagaagcgtggtcctgccagcaatctttgctgcgcatttctcgtcatgacctggatcttgagggcacagggtcctcagaacagcgaacggttcctcttcaggtccatggaccagcttcttgatgcttgcaagaattcccatgctttccctttcttcagcttctctcacagtatgagcctagcgcaccattgctgcgccctgccgatatttccaaattgtcgaaggtgcccatctggcgtctgctatcattctcttgaagtatactaaggaatacaaagtcataccagaatcgcagcacgggggaagcgtggcagaaaagatgaccccgatcgtcgcgaagtactgcctgaggagaaggagagcttcttcgcagcgaccgagcggatcgggacgacaccctcaaatgcaatacgcattgcatctcggcgttcaaccgcgcggggaccttcccgttcgagataggggtccctgctgcagagaaaggacggatctcgccatgaaggctgatttccaatggtggctgctgaggcttgcgatagctgatatcggagcacctgcactgcaatgccacatcgagctgcgcagaatgccatcacgcttccatgaagaggctgacctggtaggccaggtccataaagacagacagaacctttgcgagccaggtgccagcagattgtgccggcaccctggcgcatgtctagtgtggagaagggggctgcacgtcgagcaggcaggaggaaagagccgtcacccatagacgatggtgacgtgcagcgccagagcgaagtcttgcagcgggctgattgaaagcgataaaacagggcagaacccttaattgcagcttgagcataccgctaccctagaaaagttgccgttcggctgggaggcctgttagagtctgcaaaggctcggtacattccatagacttcacggttcaagaatgggtgctttcgtatcaattgtgtagaagatgtgaagccccactttcccgcattgcaggggagcggagccgtgtaaagtttcttctcgcgctgaggcacccaccacccgaccgagcgggacgcagacagcgcggcgaaccttgaaaaccggatactgcgatcgaagagatcggaagacagactgagcgatgctatcgacaagacagcatccgtcgattcaattctttgagagacatgaatccagatcggcgagaactgaaaaagcgggacgaactcctccgttcagatatgtcatgccctgaggcatgttcctatcgagtgtaatggagcctccgtcccgcttttccagttctcgccgatctggattcatgtctctcaagaattaatcgacggatgctgtcttgtcgatagcatctctcacgtctgtcttccgatcctcttcgatcgcagtatccggtttttcaaggttcgccgcgctgtctgcgtcccgctcggtgcgggtggcctcagcgcgagaagaaactttaccacgctccgctcccctgcaatgcgggaaagtggggcttcacatcttctacacaattgatacgaagcacccttcttgaaccgtggaagtctatggaattgtaccgagcctttgcagactcctaaacaggcccccgccgaacggcaactttttctagggtaggcggtatgcttcaagctgcaatttaaggttctgcctgctttttatctgctttcaatcagcccgcgcaagacgttcgctctgtcgcttgcacgtcaccatcgtctatgggtgacggctctttcctcctgcctgctcgacgtgcagcccttctccacatgacatgcgccagggtgccggcattcaatctgctggcaccctgctcgcaaaggttctgtctgtcttttagaccggcctaccatgtccgcctcttcaggaagcgctgatggcatactgccgcagcctcgatgtggcattgcagtgcagtgctccgatatcgctatcgcaagcctcagcagcacccattggaaatcagccttcatggcgagatccgtcctttcctgctgcagcagagacccctatctcgaacgggaaggtccccgcgcggttgaacgcgaatgaacatgcttattgcatttgaggtgtcgtcccgatctccgctcggtcgctggcgaaaagctctccttctcctcagccagtaccttcgcgacgatcggggtcatcttttctgccacgcttcaccccgtgctgcgattctggtatgactttgtattccttagtattacttcatagagaatgatagcagacgccagatgggcaccttcgacaatttggaaatatcgtcaggcgcagcaatgcgtgcgctaggctcatactgtgagagaaagctgaagaagggaaagcatgggaatctggcagcatcaaagctggtccatggacctgaagaggaaccgttcgctgttcctgaaggaccctgtgccctcaagtccaggtcaaatcgacgaacaaattgcgcagcaaagttgctggcaggaccacgcttctcgtctccacagccgcagcgcatgaaggacacgaaaagggcacggggggggggtcacgattgactccggcgattccaggattccctgcccgtctcggcaaatgcgcttcgcaatcgtgccgaccggcctgtcgccacctgctcacgagagagcccttcgctatctgttgtctgcgagcgcagggtgtgatggtgctctgcatcctcgtgccaggcaatccctggttcgggcgtgcatccgccgcatcgagagcctcccttcgcgatgtcgatcatccggcgctatttcaatgccttcagggcttccttgtcggcggcagctaagtccgtcatcgtccgctcgcgtagagatcgtaggcggcgcaatgatggcggcaggcggccagctcatgaacttctatgccggagaccacctcgtttgcgacgcttccgaacaagctactcgttccaaagatccggaggaaaatccgaccaactgcttgcagcaaccgcagaagcctcgaagtaggaccatcgcgtgctccgctactgcatcaatgtctttgtctcgtagcctgcgcagtgagccatcttccatctttttgctagaatgcctcgttggtaggcatgctcccttcccggagccaagcttacaggagtcttgctatggagtccggaatgccgacatgaagaaggcgctatatcactgagagggcacgatcaggacgctcgaaagatcatgaggcctgctcgcagcaggaatcaggctgacgacccggcgcttgcgctctggtgctcgagcacatcccgaagacggtatcgaggaccctgcaatcgacacagcagaattccgggcctgaatttccggagaacgaatgaaggccggcacgctcgagcgaccgccttctgcatgcctctttgttctgtttgtttcagtcagcacccagaacgtgggctcccgtaccatcgaagcttcagatggcggccgatatacagctctgcaaaggtgcgtgcacggccaagcggccgactctctcggggagcctctgcgtcggtgagctccagacggaaggtctgtccgccgcaagcgtccgtggcatatgcaccgtgaccggaatgcccagctcgatgagcgcactcttgagtccgatgatctgctgcatgccaatggacgtaccaggtctcccccaaaagatctaaaggcgcctccgcctccgcccccgccgaatcccctccgcctccgccggagaagccgccgccgaacccgccgcccgaggactccatgctcttcgcagggctgcggtgctcactgagagtggggccgactcgacgctcttgccgaaggcatccatcggcgtgctgtatggccagggcccaaagacataccagtaccacggagatacgggtcctgccgaaagcgtctcataaagctcggggctgcacccttgagctgggcgatgacctgctggacacgccgagcacgaccccatcacgacaggcggttccagagcaccacatccgggggcaagtcctccttgagacgggtgaaatcgagaagccagcgcctgagcgcctcgagactttgcctcgaccctcgatgccttccttcgtcttgctgcactcttctgcggaaggaagccgcagaccactccgccgccactgccacgcaaggccggcaaacgccacaccagctgtgatcttctcagcaattcccagaagatcagatgccagcaaggacgatgctcagagccagcaggcatacggcaccttcttgttgggttgtccgcgagaatgtagttcttccttattcttcttgctgcaggcacccgtgacagcgccttcccatttctcgattgcgtcgctatagcgctcaggagcgtcttttgccgccttctcgatcgaagagaaccagaggcgcggctgcccggacggcgctgtatccccatctgccatgccttcgatctcgtcgaagagcagcgacagggtccttgcgtcaatctcgcctgcagcatctgtgccggcaggtcgctttaccaaatcgaggtagtagcgctcgcgcttcttcttgccgaggaagcccttcttctcgggcacgacgcagccaagctgtacatagcccagatcgcagagacgcatgatcgatgccggaagggcatttccgtccggcttgccgtctccccgaagcgcatcgagcacggcgggatggtcatcggtcggcacatcgcggaaatactcgtcgtcgaactgggggcgatgttcgcgcttgtcgcgcagataggcacggacagaaagggcaatgaagagcgctgcaagagcaagcgagccgacgagtgcgaccgtgctcatggtccgggcgcgctcgcgcttggcattggcctcgtctgcccacgcctgctcttccgacatgacggaatcaagcacctcgccggagcgctgcgttgcgcccgagagccaggattcggggaagacgatgcgcgcttctgcatactcatcggtgccgacacccggcaccgtatagacgatggccgacccatcgaaggccaggctcgcgtcgagcggaccgtggccccaggcacgcacattcgagcctgcctcgacgctctcgccggacggcaccggcagatggaccgtgcaggtcacattgtcggatgccacatcccagccatcggagacgaacttccagtagagctcgcccacatcctcgtagcgctgcgcaagatcgggataggagtagacgatgcggaacgtcgccgattcgtcctcatgagcggaatagagcttgacctcgagataggagccctcatccgtcacatcgaagctgccgtcgatccctccggcattgtgggcgaactccgtatagacgccgtcctcgacgataccgacagaggcgatatgcggtgtcagctctgccccctcataggtcccttcgggcagcttccagtacacgccgtggtaggagccatcgaagtagaacgtgcggtcttcgatgacagaaagcgttccatctgacccgatcgtcgcatcgatcgagaccttgtctatcgagtagtcagcccaagccgtatgggcaacagcaagacatgcaatgaaggcgaagaggccgacaagaagctggcacaagcctcgaggatgccgtacaggatggtccatggaggtctccaatctggttaagcctgcctatagacaagcttagcaaatctgccatggcccgaccgtctcgacagatggtgcctcatgccccgtcatccacccctatctcgaacggcacgcctgagatgtagaagatatctcccgtgctgagaagcacgcttccctcgatcggctttccttcataggttgccggattcgtggcaccgaggttctgcgcaagcacgccgcccatcccgagcgaaaggcgcaggtgatggcgggagaccgagcggatatggaggacgatgtcgttctcctgggcacgcccgatcgtgacacccctctcccctatgggcaccgtcgcttcaagctcgccgacatgcgcccgcacgaggtaggtgaaggcagagcttgctgccttctctttctttgctctgtgctgcgagaggtcgagcgtatcgtctgcatctcctgcatcgtccggaaccgcttcggcagcaggagctgccgcttcgatgacgcgttcctttgcggtcttttcgctctcttcaggcgctgccggctccgcttcctgcacaagctcatggggaggccgctctatcggctgcggatggtcgaaatcatagaggcatccatagcagatatgcatgtcccggaagagccgcgcaccgcagcggggacataccttcgtgaagcttgcatcctgcagggcaacttccataacgctcactccttgtccttgcgcgcacagagcacgggctccgtccgctcgcctgccgaaaaccagagatctcgagatgccggccgctcgaagatggcaaagcttcccggcacccgccactgcctccccggaggaagaccgaggcatacgccgaggatgcgtccttcggcatccgccgcagccgcatcgatcggatagcgcatgccaaaggtatggattgcagcgcacggcagaagaaccacaggaactgccgtgcacctgctccccagaagccccttgaggcgtgacggcgccgacgcaagcagccggaaatccccatagggctccacgtggaccagagcatcccttctcatctagaccgtccttcctgcctgcccggcatctgccacgacttcgcgcacatgcacgagcgcgaagtgagcttcggagtcgattcctgccacgacgaagtgccggggccagggatgataggaaagcgtgcagcgaaagcgcatgaggcgcggctcgcccagaagggccagaggcgcactttcggcagcttctgcctcgaccgagatctcgatatcgtctgcatcttcaaacgccttgcgtatggatgcctccgccgctgaaactgctcccacgctcccatcttcagctccagctgcagctgcttcggcaagcactgcatccggagcgacccggtcgaagagcacgcaggcagagacatagcgtgcaaggttccagaggatgacaagagagacgagaatgaccggcatgagcgcagccagctccaccgccatctgtccccgctcctctctgagcgcgtacatcatgctgcgctccccagaccgaccttgagaggcaccgcggtgcctcccggcacgaggagctctgccacctcgaggctatcctcgcccgaaaggtcggaagcgatgccaagtgccgaggcaagccgctccggcgcagacgcatcctcatccagaaggctgagcagccgctccctttccccttccgtctcgagccctgcctgcacaagcacatgcttcgtggtcgtgagcacggggcggcgcggtctcaggtctgccggctcgaggccggctgcgctcacactcgcacggagcttgtcgcgcagccaggccgcagcgctcccgccgaagatgccgccaataccgtcaaagatctcatcggagacgctctccacgctcttccagccttttccatagccggaaagaatgctgttccagaccgagacgatgcctgcgacagcagaatccggctctccaagctcctgctcccaggcatgcgccgaatccagaaggacgctttcgtcctcggtctcgacaggtgccagaacggcagcagagattgcagcaccaggagagagcgttctcggcgcaaggaagctgcctgaaagcatctctggcagagctgtctctgcaggtctcgatacaagcgcaatcgtgccccaggcaccaggcggacagaatgtgacgtctgcgctcttcagcacttcgagcgcctcatcgaagcgtccctgcgccttgcctgccgcttcatgcgtctcggcatctgcatcctccattgcagcacgcgctttctggtagcgcttcgaggcttcctcgatgatgcgccaccagtgctcgaagccgctcttcgtattcgtcgtcgccgacgccacaaggcccaccgccttcgtatcgagtccgcagacctcgcagcgcctgaccctgcccgcttcgagatctgccaaggatgctgtgccggatccgtctttggctgcagggcatcctgcaaaggcatggattgtcatcccgtctgccccatcggacgtcggccagatacgctccgtgaaaagagcactctcgcgcgtctcgcctgccgtatgcggaagtgctggcagatccatatcgaccgtcccatcaggcctttcctcgtaatgccccgcattcatctgctcttctgcaaagcggtagtacgcgctccttatggcggagcgcgcctcttcctcgacgcctgcatcttggggcacttcctcggcaaggcgcgccgcatagtaggaccgcgcccttgcaagcggcgctccgaacgtccaggaagctggcgagggatagctcggattgagcgcatcgggaaggtctgccagcttcgctgcccgctccttcaggcaatagggctcctctgcgcagtcagcccgccacgcctcctccttcgaagactcggcttccttctgggcctcctctgacttcttcgaagcatcggcaagcgcatctgttgcctcgtcgagcccctctccgtcgaccttctggtccatgcccgagaaatccgacctgcccaagacgggatagggcacgacgatgccttcataggagatgcgctctgtgctctcagccgcaatcgttgccatccctcgcctgatgatgagaagagggaggatctcctcgagacgcgaaaggcccgcggaggccgtctcgacgaggtgtccacgcgtctccaggagcttcatgccggcatctgccgaagcagctcctgtcacctgtcctccaggcacggcagatgcgaccatgccagctgcgaccatgagcatgccggccgtgccaagcgtctgcgctgccgcatcgagcacctggacgcaggcactgtaggcaccagtcgcctggcttgcgctcagggcagccgcatcggccacagcctggatgtcggcactccgggagagtgcccagcctgcagcagcaaggctgaagacaagcgagaagctcacgagcagggagaccgcgacagcgaccgaggtatagccgctctcttcgtcgatgaagagagacagggaaaggggcagcctgtcctgtgctccgtcatccagcatcccacacctcgatccagtcatcgtatgtgccttcaagccatgcagggcgcagctcttcttcgacctgcaccttgaggacgattccatcgccgtcagatccaagcgcggaggcagcgattgtgctgagaagcggcagcggctttgcgtgccccgcaatcgagaccgtcacagcctgctcctctgcccctgcaatctcgatatcccagtcgccatcagagaagattgcaattcctgggatggccgcaagcctgcggcggcagaactcgtcgagacgctcttcgtctgccgtaccggcagcagcgcgtgccgtctctgccgctgcctccctcatgaccatctccgaataggcacagcagagtggctggagcaggagcagtaccagaagcgagacagcgggaagaagcgctgctgcctcgacgcttgcctggccccgctcctcggcaagctcagaagagaagcaggtcatcgattgcgccctgcctgatatctgccagaagatgcgagcaggctgcaagggcgcagtcgagaaggcgcccttcggcccccgccttccagagcgcaccgagcgccacgaccgcgaccagcgccgctccaagcaggagcgcatattcgagcgacgcctgtcctgtctcctcctgccagagcctcatgagccatccgacccttccaccgcttcgagatggacgacctcgacctgcgtcttgcccgatccggtctccttcaggatgcagacatctgcccatccctgcccttcgacgctgaagccccagaccttgccgagaaggtcgagatactgcgcttcgagcagcacgcagtctcctctgtcttcataggactccatgagctgggaggaagcggtcttgagcggcttgtccacggtgtagctctccacctcatcagctgagatgtcctcggaaaacgtccctcctgcattcgcaagcagctgcgccgtctcggacgagagatcctcctcggcgcttccggaagcttccgacctctctgcatccatccctttgaggagaaggccgagaacaagcaccgctgccaggatggccactgccagaaggagcttccttctgcttttcatgccgctcatagcgagttgatgccctgggcgatggcatcccagagcgagctcagcttgtcgcggaatgcgaggattgcgacaatcgcgatcacgacaatgacgccgacaaggattgcgtactctgtcgttccctgccccgtctcctcgcggcggagcgtatgtgccgcctcagcaagcgctctatatgctttcatggatccacctttctcatatgagctgtgcctgcgaccccaggagggggccgagtattgccagaagcattgcaggcacgacgagcgtgcccagagggatgagcatcttgatcgggaccttctcgatcctctcctcggccgcaaggcgctcttcatccctcaggagctttccctgcgcttcaaggaccgaagccaagggcgacccgaacgccagcgcctcttccacagccgatgcgaagcgcccgaaggcagggcttcccatttcctccgccaagctctccagtgccgtcgagcgcttctcgaagccgcttctccaggagaagagggcagatctgagcgcgtgggaaagctcgctgtcctggcgctcgcagaagagctcgaccgacgcatcgaacgaaagccctgccgagaggccgagcgagaggatatcgagaagccctggaagctcttcaagacagcgtctctgccatccccggcgctgatgtctcgagcctgctggcagcttcggcacgtcgaagctgaggtgccggtgcgctgccgtctttttccccaggaagatgaaggctgcgaggaacgcaaggccgctctcggctcctgtcagtgcatatgcccacccatccatctagagcaccccttcggcaagacgcctgatgatgaggatagcgacagcatcgagcgcccccgccagaagaagcgagagcgtgcccgcctctgttgccatccccactctgaagtcaggcgatatgaaggcaaggagcgagacgattgccaccggaagcgtgcagacgacctggaccgagaggcgtacctgtgctgtctttgctgagagctcgcgcctgagctctccctgctgctccacataggaagcgcttgccgcgaagagctccttgagcgggcttcccgtacgctgcgcaatctcgagcgcgctcaccatgagcgccatgcccggtcctttgacctcacgctcgacagatccgagcgcctctgcaaccgatgcgcctgcctgcatctcgagcgtcgcctcggcaaagcttctgccgaccggccccgcatgcgtgacaccgacatactccatcgcctgcctgagcgtctggccagcctcgaggccaagcgcaagcgtgcggaacacctcgggaatctcctgctctgtcgcatcgcgccgctcccttctgtagcgcagggcaaggccagccgcagacgcccccagcgcagcaggcaggatgagccctcccagaagggagcgggaaaggagcatgcccagagggacagagagcatccccatgagcagcatgaagccgcccggcgccgcaagctggaagcgctctgccagatacctttcagcatcgcgccacagcgcatgctcctcgagccttcgcgcaccgtctgtgccttcgagagcttgtgccgcatggagaagcccccgccggacggatgcctcgagctggggcgttgcagacatgaaggcagccgcccctgcaagcgctgccgtgctcaggcagagcaggaagacatccatgcgagcacctcgctctccgaaagaagcccgtctgccatcgcacgctcgacgaaggacggcagctggaccaaagtccagctccgtgcctgccggtcgaacgatatgcactctgcaagggcgaccgtgccatcgggggcacggtccacctgatggagcgatgtgatatagcgtccaccgtcagggaagcgggcgctcatcacgacaaggtcgagcgctgtcgccacctgctcctcgatgagatgggccggaaggtccatgccatagcgggccatgaggacaaggcgaagtattgcctcgtcagccgttcctgcatgcagggtcgtaagcgatccgtcatgtcctgtgttcatcgcctggagcatatcgatgcactccgaccctctgacctcacccacgatgatgcggtcaggcctcatgcgcagcgcattcttcacgaggtcgcggatcgtgatctctcccgatccctcgatcgaggcctcgcgcgcctcgagacgcacgaggttgagtccgggctcgaagcgcagctcgcaggaatcctcgatcgtgacaatgcgctcgtctttgccgatctcatgcgagagggcattgaggagcgtcgtcttgccggagccggtgcctcctgccaccgcgatatcgcagcgctccttcacggcccaggcaagaagctgcgcataccaggcaggaagggagccaagcgacacaagctcctggagcgagacgagcgcatccgagaacttcctgatcgtcaccgctgtgccatcaggcgccagggcagacgagacggcattgacgcggtagccattcgaaaggcgcgcattcacgatcgggcttctctcatcgaggcggcggcccagaggggcaaggatgcggtcgatgaccatgaggatctgctcatcgttctcgaagacgcgctctgccttgtggagcctgcctccttcctcatagaagagcgctcctgctccgttcaccatgatttccgtcacgcggtcgtcgtccagaagcggctgcagaggtcccagcccgcagatctcatccacgacctggctggccaggacatggcgctcttccggcgtcaggtcatcgtagccgccgccattgcagagcgcctcgagcgcaaccgagagctcggtccgtgcctgggcgacatccccctgcgttgcaagcgaggcaaccgtctggagcccgagccttgtcacgaggtcgcgcttgagccgctttctcgcttcttcatccagcccatggcgggaaggcgcgccttcgagacgggcacgttcctgcaccctcgcaagcaggctcatctacatggcctccttcctgcggctgaagaatccccggcgctgtccatgctcatgcacctcgagcgcgcggcgggcatcgttgcagtcgggaagccttccgagctcctggaggatctgtgccaggcaggtggcaacagagcgtgaaagctctgagtcctgcgcgctcagctccacgacatgtcctgccatcaggagctcgtccgtctcttccccgccatccatgacgcggaaggtacgggcagcttcgaggccgacatcggcccggtcgatgaaggcttcctgcgtcttcttcggattcgagagattgacgatgcggacgatgcgggtccttgcaacaccgagacgcacagccagggcgccgacacgcgatagggacgatgccgcccctccgctctcagggcagaccagcagcaggcggtcgcacatctgcgctgcctgcgcgactgcatcggtccaggctgtcgcgcagtcgacaatcacgagatccgactggcggcagacaagctcgagcaggtttcctgcctgaggtgctacgagctcggcattctccggacgaaggcaggaaccccagagcgagacaccgtctgtggcaatcttgccctgggcagcaagcgtctttgcatcggcctgcatatcgaggttctggtcgagagctgcaggacccggaaggccgaagcatgcgtacgcattgccgcaggcaagatcgaaatccatgagggagaccttgaggccccagcgtgctgccgttgctgccatgaggcaggaaagcgctgtcttgccgacgcctcccctgcctgatgcgacacagaggacaggacagggattcgggccatgcacgatgctggaatcgatgcgcggaagctcctggtccatccggttgcgctcaggcctcgatggcctggaggcaccacgcggtgccgccgctgcagggatgctttccacttcgtcgagatcttccgcctctggcgctgcagcagaggaagcgcccttctcggctctctgcctgcgctcgtgccgtgcggatgccccgcttctcgctccttctgcatccggcgctttctgctgcgcctcttctggctggacatcaagcgcaatgacacgggagatgcccgcctgggctgcacgcgagcggagcgaccccgaaggccgaggctgcgcaagcaggacgattgtggcatgggcatcctgtgctattgcggctgcaagattgatgggtgcctgggcaccgcgtacgggaccgacagccgctgcatactggccaggcatcccgtgcacgagcgtctcgcgcatctcttcaggagaggaagcccaggatatgcttgagccgggatattcggctccgatcttcgcctccagctcgccccgataggacttccgtgcaaaggcaagccacttcatgaatgattcccttcttctgccgtcgtaggaacagagctcggtgccgtcgtgagcaccgtgcccgtcgcgctcacgtcggatgccggaactgcgaggcgcaggtctccctgggcacctgccgcaagcacatctgccacctggctcggagccacggcaagcgtgaccgactgcgtgccgagctgggactgctgctccggtaccgagaggagctcgatatcatccgagatcagcgtggcagtgccatcagacatgcgataggcaagaagcctcgagccggccttggcctctgccggaaggccgaccttgtccgaaagcgcgaggctcagcgccacatggcctgaggggacatctgcagcgcctgctccctgagcgaactggaggctgcagagcggcgtgcctttcggcacggcacttgtgaccttcctgcctatgcagtcatccatgtcggtcatggcaacagcaggggcaaggtccgagagccattccttcacggcaagttcttccttcgtgaccgtctctccggcagcaagatccttcgtcgcaacgacgagcttcacggtctccccgccatagcgctcgagcgcctcggcacgttcctgctcggtctgtgcctgcacatgctgggcatagaccgcacacaggagcgctgccagaagcgcgcaggctgcagcaaagacgattctgaagcgcatcgacattggtcctcccggcatgtggctgatgtggtctcaaacctacgccggtgccctatctgacaagggaaagcagagccattcaggcgtcgccgggcagccacaaagctcgcagccatcttccacaaggaagcgttttccaaggcaggacgtctgacagaaggaggcactgtctcaggccttccgacctctctcctcattgccgctgcaaccctgaaagccaggatggctggacatagagaagcggatgctccctttcgggaacgtccgcagcttcaatgtgtcttgctttctcagagcacgatatcgggatcgagcgtctccgcactccggcgcatttcctgggcaagcgccacataggcgtcgtagcgctcctggcagaaggcaccttctgccagggcctcgcgcacggcgcagcccggctcatgcgtatgcgtgcagtcacggaagcggcatgaacgggccgcatcggcaatctctggaaagacctttgccaggcccctttcatggccgacaagcggcaggctcctgatgcccggcatatcgacaatcgtgccgccagaggggatggcaaccatgcggcgggagaccgtggtatgccgtccggcatcgtccgagcttctcacggcacctgtcttcaggagattgcgtcccagaagggcattgagcagggtcgacttgccggcacccgactcgccgaggatgcaggcgaccgtaccgggagagacaagcgaaaggatgccttcctctccccagtcagcacctttggcgcgggcgcacgctgccagctccgacgaatccttttcgccgagagcgcaggcgacgatcggcaccttctcgccgagcacctggcgcacgcggtcgatatcttctgcgaggcgtgcgtcccctcctgccctgtcagccttcgtgaggacgcaggccacctgggccccgcagtcccgcacgacaacagccgaacgcacaaggcggtcgcatatcaccggctcgggaccgagtgcctgggccacgagcacgagcccgacattggcggcaagcgtctgcttctcgccacgcgcgcctccccgccagcgctcgagcgcgctcctgcgtggcaggatctcctcgaggagcactccgtcatgtccttcgggacatctcacacagacccagtcaccgaccgcagccttgctgaagcgctccttcgtgattcctgccgcaaactcggcgcgggcaaggcgcctctcggtgaggacggcaggaaagccgcgatcgagacgcacgacacagccgagctcgtactcggccgggtccgccacttcttcggcagcaaggcgtctgcttgcctctgcaaaggcagatctctgctcctccgtcgcttcgaagctctcgaaggcagggatgccctcgagagaagaaagggccggcagggtcgcttgggccctgccggcactctgtgaatgcttatgcctgttctgcacgcgcttcttcacgtcagtccctgctcttctccactgcacgcatgatggccttgtagatctccacgagcgggatgatggccgctgcgaggagcatggcaataccgtactcctgcacgctgatctctgcaaagtcgaaggcgacggagagaggagtttcgatgacaacgaaggtgaggacaagggaggctgcgaaggaaagccacagccacttgttctgggtcgggagcttgaagacagactggcgacggctcctcatgttgaaggagtggaacatctcgaccatggaaagcgtcaggaatgccatcgtcattccatcgaggcccttgtcggcgccggaaagcacgtcagcaagaggcacgttctcgagcgaaaggccgacgaagtaggagatgagggtaaggatagcgatcattgcgccctggacgaggcagtcgaggcccatgccattggcgaagatgccatccgtggcctttctcggctcacgctgcatgatgtcaggctctgcctcttccatagccatggccagtgccgggaagcagtcggtgatgaggttgagccacagaaggtgcgtcggctcgaggatcgtgaagccgatgagcgaggcaacgaagaccgagatgacctcggcgaggttcgaggacagcaggaatgcgatcgacttcctgatgttgtcgtagatgcgcctgccctcttcgcaggcggagatgattgttgcgaagttgtcgtctgcaaggaccatgtctgcgacgttcttcgtgacgtccgtgccggtgatgcccatgccgacaccgatgtcggcacgcttgatggaaggagcgtcgttcacgccgtcgccggtcattgcgacgaccatgcccttcttcttccaggtatcgacgatgcgggtcttgtgctcaggctggacgcgagcatagacgcggtagttctcgatcttgtccgcaaactcctcgtccgacatcttgtcgagctcggcgccggtgatggcctgggagcggtcgacgatgatgccgagctccttcgcgattgcgacagcggtatcgatgtggtcgcccgtgatcatgatgacgtgcatgccggcggagtgggcctcggacacggcctgcttgacctcaggacggaccgggtcgatcatgccgcagaggccgaggaacgtcatgtcgtgctcgagagcatcggcagagaagtcagacggcttctccttgccgtagttcacgcgtgctgccgccatgacacgcagagcatcgtctgccatcgacttgttggcatcctggatgcgcttgcgccattcgtctgtcatgggcacatcgccctgggccgtgtggatcttcgtgcagcgggaaaggattacgtcgggagcgcccttcgtatgctggatgtagttgccatccggcgcctggttcacgacagacatcatcttgcggccggagtcgaacggcgcctcgccgacacgcgggttcgcatcatcgagatctcccgacgtgaagccgagctttgcggcatcggcgacaagggcggcctcggtcggctcgccgacagccttgttctgtccggcatcccacttggcatcggagcacagtgccatgcagcgcacgagacggtcctggtcctcggtgaagtggcggacgaccgtcatcttgttctgcgtgagcgtgccggtcttgtcggagcagatgatctgcgtgcagccaagcgtctcgactgcagagagcttgcggatgatcgcattgtgctggctcatcttcgtgacgccgatcgagagcacgattgtgacgacagcggcaaggccctcaggaatggcagcaacagcgagagagacagcgaccatgaaggtgttgagcacgagcgacatatcgctgaagaagcccatgccgtgcttcagccacgtgacgacgaagacgagggcgcagatcacgatgcagatgacagaaaggatcttggaaagctcgtcgagcttcttctggagcggcgtctcctcgtcctctgcctgggtcagagcgtcggcaatcttgcccatctccgtgttcatgccggttgcgacgacgacagcacgtccacggccatagacgacggtcgagcccatgtagcacatgttcttgcggtcgccgagagggatatcctctgcacctgcgacaagctcgagctccgcctcgatcttgttcgcaggcacggactcgccggtaagcgctgcctcctcgatcttcatcgaggcgctctctatgatgcggcagtctgccggaacagagtctcctgcctcgagcacgacaatatcgccgacgacaagctcagaggacggcaccgtgacaacctggccatcgcggatgaccttggactgtgcggcactcatctcctggagggcggcaagcgcctcttcagccttcgactcctgcacgacgccgaggacagcgttcacgacgacaacgaagcagatgatgatgacatctgcgaagtcggcatcaccctgtgccatgccggtaagggcactgatgactgcagccacgatcagcatgatgatcatgggatcggccatctgagcgaagaaccgcttccacagcggatccttcttcgcttccttgagcttgttcagcccatcccgctcgagacgcttcttcgcctcggcagacgagaggccataggtgccgtcggacttgacgtcttcgacaaccttggcagggtcttgcagatactctttcaaagttccctcctgggttcttgggcgtccagcagattgatgcccgataataattccccaggaggggcaagggcccatcaaggctgccatgccggacgcatggataaggacgtaccgactatcttaccctgcgcgcctcgttttatggaagcgcgcagggaaaagtttctttgttgcgcaagaaacgaaaacgctatgcctcatcccagtactcatcagagagcaccttgaagcagatcttcttgatcggtcccggctcggtgccttccggcacgaggttcggcatatgcggctcgccgaccatgaagacgacgaagcgtccctggtcaagcgacccttcaaggaggttcgtgttgccgggagcctcatggcagtagcccttgtcggctgccacatcgaactcccctgccggcacggtctctcccggtgtcgtcatgaaccgctcaaagccttcgagatcgacctgcacatccatatacttgcgatgcgtctcgaagcgggcatcctcgaacctgcgggtcttggcattcatgacatttgcgaagaccttcgtgcccagaatctcggtcttgccgagcggaagctccttcacatcatgctc

SEQ ID NO: 93 - DNA, 3026 bp, Unknown
  Metagenome-assembled genome
gtgaggacctatggggtcctatcaaggaagccatctgcgcgatatgggaggaaagcgacaggcgctttagcttttgctaggtctgatccaagctcacaggagatccgaagttacgcaaaatttacaggcacgacccgctatcgcgtgcggaggtgcatggctaagcttgggcatctgcggcatctgatccaatgcatcgaagagaacgacgctgcccgcacctgatacccccgagcgccccgccctcacccggtgcggcttttcgtgccctgtcccgacagccaagctcgtgggcgatacaacctatcgcaggaccacggcaggctttatatatctcgccgtcgcacacgatctgtgcacacacatggtggtgggctgaagcatacaggacaacatgagggcaggccttgtcgtctttgccctgaagatggcatattcgcgcggatacgtggccggaggggccatattctaagcagcccaggcagccagtacataagctcagagctggccgcctgctcagccgtacacgacgtgaggctctccgtggggagaaccggaagctgccacgacaatgcgctcgccgaatcgcttttcgccacgctcaaaaacgaatggtactaccacaagcgcctcttagacgcatccacgaccaagcacaaggcacacgagtttaatcgagtcgtactacaaccgcttccgcccgcataagtccataggagatcgcgtgccggcagaggtgatgcaggagttcttcgagcacctcgagaggccttgcatacgatccaaaggtgatgcagaccgcataaaaaatctgagattcctctgtccattatattgacagggctcatacatcctaaagcatcgtctttgcaccgtgcacatgcctgacaagagcctgtcagtagtagctggtatctaccagaacaatccagctatcccatggcacgatcgcatccatccactccaggaatacctcccgccgagtcttcttcctaagaccttaggatgtaaggtcctaaaagctcatctggctgcccatatcttccttttggatatgctggaatacgttgctgtaattataacatatccgcaggcagataggcatttatgtgggtatgggcactgcgtggttcgagacattttgaaccgatgtcatacagcgtacagccccagctacctcaatgaggcgaattaatcatcgtttccctagggtgctcagagtccgccatcgtggctcttttccgcagcgccttaacccttggagaggttgccccgtccgttgtggccgcgccacatcgggcaccgtcccggctgcagctctagccggccgcctcgattcgcgcgatgagcccgttggcccactcgatcgcatcatcgaggccggtgatgacgggaaggccctccgcctggctgtcgtaaagcgcactccacccctcgcgggccactgccctgggcggccattcctgcagcttccgataggcgaagagccgttcgcagaccttcctcgcctccgcgaggtccggatcggttgccgcgaccaggagctgcaggtcgatgaggtcgcgcacgcggtccccgctcccggtgagcccatgcagcttctgggcgatctggtagggaaccgtcatgagcggcacgcgccccggagcggggaagccgagctcctcgaaagcgccggcgatgtcggcctggtccgtccagtcggcgctgtcggcgtcgccgatctcgtcgaagcccacctcgagtggaacggtgcaccagggctttcccaggtaggagagcttgacgtcgaaggggcgcatcacgtactcgggcggaacgtccctcggggcggcgggctcacgctcgacgacgcgccccgtgaagccctcccatccggcagcgagcgacctcgcgagcttctccgcgtagagcttcgggtcggtcgcggtggcggtgtcgaggtccgtggtgtagcgtgcgttcccggccccgagccgcatcctcatggcgctcccgcccttcacgacaccgtcgggcagcatctgggcgacgatcgcgttcgccatggacgtgcgcaggcggatgtagccatccgcggagcccccggcgatcctccgtatcgcgccgtcgaggtgacgcatgctattcggtcttctgggcatctgccgccaactctcttcctatctcgtcttcctgctcttcggtgatgtatccctgtcgggcggcgttgcgcgcggcctcgagcgcacgtgccggccccatcgtcgcagcggcgctgactatggcggcagccgcgtcttggcagaagatgccctcgtaggggacgacggtgtcggcgtccccccgcgcgacgagggtcgtgccgccgatctgccggcgcacgcgccccggcgtcgccacccacatgcgacgcgggtcggtcggcgcgaggccgaggagcgccaccacggactcgccgaacaggtaggcgccttccccggccgccttgactgccacggcgtagggcgcctgctcctggtagggccagaccggcatgcggtagaccccgcgtgccacgcggaccagcttgccgcggtgcgccatctgcacgagctcccggttgcccacgcctagctccctcgcttccgccgaggtcacgagtccgtagtcgtctaccgctccgtatatgtcgtcgatcttcgccatgtcaaaaatatagcatatgagtaatacaattgacactatttggcagaatagccggagcattgcctgtctgccacggctacatgaacctgaaggccgccttcgctatgagccggatcgccttgagaagcgctctaagcactcgcatggccggcctcccgcctctccgcctccgcgagcatggcccacactgtgagctgtaatcttttggtggacagtgggattcagggactaacaacagatatgctctgtccagatacccacctaccaacaccagcagattgaagagatgagatgtcgctaagcgcaagcgagatagagaaggcaaagtcccgcacgaagccggaaacacccaaacacta

SEQ ID NO: 94 - DNA, 22468 bp, Unknown
  Metagenome-assembled genome
ggggacacaagataagggattgctgacaaatatccgcacatcagacgaaaagattggaacatctgatgtatacggaagagataaagagacgtttcggtgaaggacatgaacacaatgttcacttcatcacgagagtaatgagaatgcttggttagtctcttagtaggtctataacactttcattttgactctgttagaccactgtggatatagggaagcgaaaagatgtcacggggtcaccttacaatcgggttcgaccaagaaactgacttgaagaaggccccgtatactctacatgatacgacaactagcaaagtagctgacccgcaaggagaaggtcgcacttaccgccgacctcaagcgcatgatagccgagaagctggcagcgcagaccgacaagtccgccacatgtccgcactgtggatgccttgagttcaccaggtgtgacgctaggggttcgcagcgctatctctgcaagggatgttgttaatggcaatctagggaaacgatgattaatgccctatgacgtgttagaggggaccgaccacacgacttttctaggccggaatgcgggaaaggcagggaaggatgctcatctagcacgtacaggagccaccatccttacatctgtcctgccgcatgcaccgcaagaagactccaagacagatcaagcgacgctgagagccgggaggtgcagcctgccggcaaaagatgcacatggtaaggtttgcaagggcgaagcagacattgagcatacaggagttcttctctatcccctgtagcgtgtccttacgtgtttgaagcgccgcttcacgataaggaagggatgctctacctttgagcggatggaggccttcctggactcgatgcttttttcggctgaaagcgcacagttaaggccctttatggtcgaaggtttccttgcaacgctttagcgcatagatgagaggtgtgggtctttatgcgtccttaagggcgcttcgctatacctatatagcctaaagtctgcatagcagaacctgtcatcttcccttacgagtgtgtgtgccacaggatatgtcggacacattctaagcggtcgtctccacggcatgcacaaggccacctgcggcatccacgccgatatgcgccttgtatccgatacgccaggctccccctttcttggactggtgcgctttaagagtcgcgcgcatggtccttgttcttcgtgaagctttaaggcccagatgaaggtcacatccaccatggagccgccccgcgccgtgatccctgccttcttaagttctaagttcaggcgcaaagcacaagctttaccgaactcctctcgctttaaggctatggcgcctcttcgcgagtgtcattgcatccggtacctgcgcctgcatgaggtctgcgtgcacagaagcgctgccaggagtggcaatccagaatagcatctttaagttccctcgtcttaagagagcaaacatgacctaaagcagatacatcctaaagctttgtctttgcagcgcgcacatgcctgacaagagcctgtccgtggtagctggtatctaccagtgcaatccagctatcccatggcacgatcgcatccatttgctccaggtgtgcctctcgcccagtctttttcctcagaccttaggatttaaggtcctaaaagctcatctatctgtccatatctgtcttttggatatgctggaatgtgtggatgtagctataccatatccagaagacagataggcatctatgtgggtatgggcactgcgtggttcgagacattttgaggcggcggcatacagtgtgcagctccactggcctcatcgaggcgaattaatcatcgtttccttagggagatgttgcactcagtttgacaatctgccgtccgaaatattgacacaggtcattcgagggacacttcaagctcgaggcgatctgatgcatcaagcgatacattgcacgcgagctctattacgacattatcactcagaatcgcatgctgaaaacaacttgacaattagaagggcatcacaggggtacttcccgaagggcgccgacctgtcgggtgtcagtgacgcggaggtccaggtggcgtatgatggactcaatcacaggccacgcaagtggcctgggtggaagtgcctcctgggaggtctatcataaccagtcgttgcacttgctctgaacaaagtcataaacgaataagaactaggcaggctggcctcctaattgttctgctctacttttctctttactcaccggggttctcctggaaccatgtatattccaaacgtacagatgaagatttaattacttgatattcatcccattatgacatccttataaggtaccttgaatgagctgtcggatcacttcgatgcttttgtcaccaggaggtcagtcaagcgggtgagaggccaggacagtggttccccgtccatagcatcggcgataagctgactgagtgcaagctcctttgcggcgtgatcgaaatagcgctgcaatgtctcttcatcgcccctcatgctgatctttggcaaggcactgacatagttgacgtttcggacaacttcgttcgtccaggttttgtcaaaactcaagataatctggaacccttcaggatgcttccttgttgggattcgcatggtcatgccattctggcccgtagtcatgttcgaggaaacgctgtcaaacaggaagaagcgctctgggcattggaagtggagaagcttgctgctgaaggagatgcagatggattgtttcccttcctggatcgtgtccctccagtcgttgaggacctctttccaattagtgagatcagctgatatctgggctctctgaatagggtctttcaggatgatcgaggattctttgagaatcgcggcatctcgcaggagccgggcgctcataatcagctgggtgaactgggcaatcagctttgttgtctgtgccgttgtgtcgatcagtgacttttgagacgtaacccatgggttctcaccatagagcttataaaaccgcaagaagaaagatttccgatattccttcctcaataggtagcaggcattcctgaccgactgcatacgcagatagtcgaaaaaatccccgtcatatagcacatctctgtcctcagtgagcggtaccgcacaatctctgaggtaccccacgggaatacttccgtcctttcctgggcccctcattaacaagagtgcgatgtcaccatagaacgagccatgctccttgtctggaagatattgttctgtcggtctcacaaaggaattccgatagtgatagcgctgcactggaggtgggcatcttcttccgatgagccacaactgatctgcgagggtgacctcttggcttgtcggtctgacacgggaaatgtgctgctctgcctgctcatagggagacgtagactcactctcgaatgcagggttatcgaggtcttcgggctggggaaacggatacctttcgcatgcgtcatagagcgcctgatagccgggatcatagctgctgacggaggtctcgatatacgatctgatagccttcagcgccaagcggtattctccatcggtcatgaagggatacgatttagacaatgtgattctcctcagctgctctaacccactgtcgtattatatttcttgtgttctagtttagtccgtttctctatgggatcggcttggggattgacaccaatagaagcgtcaggagcatcgccgccagctcgtttgtctcagggatatcagcgtgcagtagaggtcccagtcggctagcgcggtgttggctgccttccacagtcgcttgaggagatgggcgtgagcgatcaccagggcgccgtgctcggtaagtgtaccggtgtccatgaactgcaatttgacatggtggaagagaatctgatcgatcgcatgggcatccctctcattgccggtcagcattcggcacaattccatcgcgtcgagcttcatcagtacgtcgcccacatcgaacacgatagttttgattattcccgcttcctggttttccctcatctcggttataggctttctggtatgcgaaagcccgactaaatgttgtctgtacaacatatcttggacgtgatattgctaccctaataaaggagcacggcgagaggggcacaatggatactttgacatggatggcgactgaggatggcatcaaagtgatcgatgaaacgggcgcaacggttgcgcgcctcgatatgaagcgtgttgactcaaccaccgtggcaatcacgcacacatatgtgtgcgagcaacggcggggccaaggcattgctggaaagctcatgagccgtgcggtggatctgatccatacaagtggctcgcgcgtgagacctgactgcttgtacgcgaagcactggctcgagaaacacggatgttgattggagagatctaatgttttgttttcaatgtgaacagacactcgcctgcaaaggatgcatgggtaaggctggcgtctgcggaaaaagtgcacaggtagcgcaggaccaggatgagctggttggagcgcttgtcgcctttgcgcagatggtgccgcaagacgcacagcttaagcctgcagcctgggattcgctgatcgattcgctgttcatgacgctgacgaatgtgaacttcgacgacgagtcgatcaagaacgagttgaacgcgattcatactctcaaggattgcctcatcaaggagtgcatcactgacaagctactcgacgacttcgatatgaatacagtctggaacgcggatgaggatacccgttcactcaagtccctcatcctcttcggtatgaaaggcatcgccgcctatgcgcaccatgccgcgctgctcggctaccgtgaccgcgaagtggataacttctttctagagggcctgcgcgccctggcaagcgatatgagtaccgatgagctgctgcagaccgcactcaacgcaggcaaggcaaacctcgcctgcatgaagctgcttgaccaggccaataccgagacttacggcgatcctgagccgacgcaggtgccgctcgatatcgagcctggccccttcatcgttgtctccggtcatgacctaagcgatctgaagctgttgcttgagcagaccaaaggcaccggcgtcaacgtctacactcatggcgagatgctgccggcgcacgcttatccagagctcaagaaatacccgcagctcaagggcaacttcggcactgcgtggcagaaccagcagaaggagtttgcggatatcccggctccggtgctctttaccaccaactgtctgatgccgccccgtccctcctatgcggatcgcgtctacacgactgatgtagtgagcttcccgggtctggtccatatcggaaaggataaggacttcacgccgattatcgagaaggcaaaagtgcttggcggctatccgaagaagcacgaaatgaccggcatcaacggtggtcaccaggtaacgactggcttcggtcgtgcggctgttctctcccacgcaggagatattgtacaggcagtcaaagacggcaagatctctcacttctttctggttggtggctgcgacggcgcacgtccgggcagaaactactacaccgagttcgtgaagcagaccccgaaggattccatcgtcctgacgctggcctgtggcaaataccgcttcaatgatcttgacctgggtacggttgcaggcttcccacgtattctcgacgtaggtcagtgcaacgacgcctacggtgcggttcagatcgcccttgcgcttgctcaggcctttaactgcagtgtcaatgagctgccgctctccttcaacatctcctggtacgagcagaaggccgtcgcgattctcctgacacttctgtatctgggtatcgagaacatccatctgggacccacgcttccggctttcatctcaccgaatgtcctcaagatcttggtcgacaagtatcacatcgccccgatttctacgcctgagaaggatcttcaggagatgctcgcataggagtagcttcaccgatcaatcaactgatacgcgtgcatcttccctctgtgtggagtcagatcagcacactacaagcgctggtctggctcctttttgtacttctttttggctggagggttgcatgcctgtatttcaggcttgcagaatgtgcaatacactcggtagaggaagctaatgttgtacagcaggggtggtaacgggaattcgtgcctgtatctcctaagccgcgagccccaagctgtgcctgtattggagtgggctcatgcttgcgagtgacattttctggcacttctcgttgcatcagacgatatatttgtctatctttgcctccagctcatccagggtggcggctgaccagccccttccatagagcatcttgctcttcatggtcccaaagaacccattacagtgagagccagcccccggggacttcttcgagctttggggtcttcgacaatgaagtgcctgcggattccctaaccttgtagatggccctgaaaggggctgctggccgaccttccccggacagccgtgtgcacctgcctcttacgaagacccggggggatgttgctgctaagggatggtggtctgtctgagaacggctgatagggatgtgcctcacgataagcagggtagtgtgggatgcccgcccctcagacacgctggacagcgaggaaagtaccaccatggaacacaagcagaaagactggttcgggcagcagcgcttctatctcgggatagatgtggggaggccattcctccgggcagtgggcctggatccgggtggcaccgacgcgatcagctacaggcaggacaggtgccaggaggatgtcgaggctctgctcgacgaggcgggagagggtgccctggtcatcgtcgaccagaagaacaacatcggctcgcttatcgtgtacaggtggtgcgcgaaaaggatcgatgtcggataccttccaggaaaggcgatgaagtacgcctgtgagatgtttccctggaacggccaagagtgaccgaacatataccgaggccatcgcgcagatgggcataggcggcaggacggccatcaggccgatcgccgagaccgacgagctggacgcctgcgtctcgctggtgtccttacagctctcatatgccacgagtggcgccggcccgcaacaggctccatgcggtgcttcttaagtccgaccccgtcgccgtgcagctctcgagcacatggcagctcgcggccatggccgaatgcggaggggcaaagggcatcgccgcagcgggcaggaggcactactgcatgctgtgcgcgagacacggcatcttcgtccaggcaagggatgccttctggaagctgtcccacgctcttctcctcctcatccttccatcccgatgcgaaggacatgctggcaagcagccttgccagggagatccttgcggccgattccgagagggcggagttctccgcggagctggggcacctgctccaggacgataagacctaccgctgcctgctcaccatcttggggataggccccaagagcacctcggcgctcgccacctcgctcttcctaagagacaacaagctcgccgcatactgtggcctcgtacccgcagaccatgactgcagatcctccataaagtcgcagaagagcgcccataaaggcaacaaggccctcaagaacctgctcatattcagctgcaactcccttgtggggacgaagaagcgcttcgggaagcactacgatgcctgcgtggcgcgggcatgaggcacaacaaggcgctcaaggcagtggcccgcaagaggctctgtgtcatctatgcaatgatgcgcgatggggtgccgtatgtggagccgccggcggacgatgcagaaaagtcacctgccacggcttgacaattagaagggcatcatagggacacccctagcaaaccatgatgtcctcgcgcttctcgatgctaagatggctgtagcgacccctgcctgcctccaaggtgatgtcttcgcaagcaccatcttagggtcgtgcgtgggtcgctacctcgtaattagttgttgcacttagaatgtggattcgccgtagcaagctagtttgttctagcttgcatgtccccgttgccagggacagctccaggtctcgcatcggtctcccgaacgcctggttcgcgtttcatcggatcgcgcctagcgcccgcgcgggcggcgcgcgggcgggcgcccggcggaggaccctccgcggcgcgtttagcgtctccggggcactcccggcgacgagtatgttgattgccgcgttcaatccctgtcgatggtcagtccgcattcctcgcatcggtacgtgcgctccgacaggggcagcttggctttcactgccccgcatcgcgagcacgtctgctgcttgggaagaagcactccaccaccgccacctggacgccgttcgcgttgcgctccgccttgtattcgagtgccggcggactcgccgaaggaggcgggtcgcgaccgcctggcgaggggtggtgcgcatcatcccggacacgttcagatcctcgatcgccaccaggcgtacgtccgcacgagccggcggtgagcttgtgcgtcgcatccgagcgcgagtcggctatgcgcgcgttcgcccgcgccaccttgaggcgcgcgcgctcgcgcctcgccgatcccttgcgcttgcgcgagagctcccgctgggctcgcttgagcccgctgaggcgggctttgtaagcgtgcgggttcgccacgaccgtgccgtcggaccaaacgtggcgagctccttgacgccgatgtcgacgccgaccgacggtctgccccgaacgggggccgggacgcacacccggtctctcgaccgaaagcgagggctaccagtcccgccctccgggagatcgtcatgcgcgtgaccttcgcgtcgccaacgcgccgcgcgacgtcctcgaagcagtggacgcgcccgacgcgcgggagcttgagcgccttggggtcgccgtcgatcgggccgaaggagcctgtggtgtacgagtaggaggggcgcagccccgtccttggttgaaccttgggaagcccgcgcgccgccccttgcgctcgcccgccttggacgcggagtagttcttgagggcgcggccgagtgattccaggccggcgttgtaggccttttgctgttctccgcgccaccaggggggcaagcccgtccttgccggcgttccaccacctgcgcagggagtaataggaccaatcgggcctctttccggcctcgatctgggatttcacgtgagcgagggccgcgttgtacgcgaaccgcggcagcgccggcgtgggacagcagcgccctctcctggcgcggcgtggggtcgagggcaccttcatggcctcaagcatcgtcggccgccttcatggccgcctgggcctgtggcttggccacccgccttccgtagagccgggcacagaaggacgtaagcacctcggtcatgtcgcgcaccaggtcgtcgtcgcgctcggtgtcgtccaccaccacgacgcggcggccctgcgccgaaagggcgctctcgatcaggcccgcgttcatccgcgccaggcggtcgcggggctcgacgatgatcgtccccacggtcgggtccgcgagaaggcggttcagcttgcgcctgcgctcgttcatgccgcttccggtctccttgaggacctcgggtgtctcgactccactgccgattgcgaacgccttgagtcggtccgcctgcctctgcaggtcgtcctttttggtcgcccgacgagacgcgggcgtagcagaccgtcctacccgacggggctttcgcttcgttcctctcgtatttggggtcgtgtatgaggatgatccccgtcgaggtcttctcgaagggcacgggcatttgcccctcacggcaccacttccataccgtctggacattcaatccttctctttttgcccattcgcttgctctcatggataaatcataccatacggtaacaagctattacaagcatttacctatactgctggtagcccctactgtacgcctgcagcagcgactgtctcgcgctgtttctcagggagttttatgagagcaggctcggccatatcgaggagggaagtgagctccgaacgcgtaagcagtgagcgctccccggtgtcttggatctccacgatgccgccgttgggttgctctaccacgttgaggtcgacatcgacttgactgtcctgcgaatagtccagatcgcacagcagcttcccacccacctttcccaacgagattgccgcaacctgtaccactaaagccccaggcttcaccgctccggcggcgacttccttctgaagtgccaggttcagtaccactcaggctccagttatcgaagcggtccgcgtacctccatccacctgcaggacgtcacagtccagcgtaatcgtgttcttcctgaaggattttatatccacagcgctgcgcagacttctgccaatcaaccgctcgatctccatggagcgccctttccgtttgaggtgctcgtaccaggtccgggtattggtgaccgccggcagcatcgcgacctcggcggtggcccagcctaagccctacccttcccgccagcgaggtacgcctgcctcaaagtttgcagtatacagaaccttggtctttccggtcgcagtgaaacaggctcttgcaggattatccagcacctttggggtgatggtcaccgtacgtgtctcgtctgcggcacggttgtaggagcgtccactatccatgtattggtccccctcatagcaaaagaggctgaaaaccgtacgtggcttccaacctctcatcaggtcatatggtgggcgatgagggatttgaacccccgaccttgtgcgtgtaaagcacctgcgctaaccactgcgccaaacgcccgtacgaggaatcagtgtatcacagtctaagtttcaggtcatccacgcgcataagtatatatactcattactatgaacactgcaaagacacctacactggcagacctttcccgtctgctgcaggagaagggctccctttctccggtcagtgagccccttactgcagaagaggcggcgctgaccatcaccggagccgactgtgactcccgcgtcgttaagccccaccacctctttatctgtaagggtgcacagttcaagagcaactatctgagcgccgccaaacaggcaggtaccgtagcgtatctgtgcgatgaggaacacgcagacgagctcaaggcgatagagccgacgcttcccgcgctcgtcaccaaccagctgcgtcccgcaatggcagacgtcagcgctgcggccttcggacaccctgaccgggagctcaccaccatcggtatcaccggcaccaaaggcaaatcgaccacaggctacatggtgcgctcggtgcttgaagcgggatctcagcatcccacctgcggtttaatcggctcggtcgaatacttcgacgggatcgagcaggaggaagcggtcaacaccaccccggagtctccggacctctggcgccacatcgcaaatatgcgtgacagcggccttccctatgcggtaatggagatctcaagccaggcgctcaaatacaaccgtgtggataacttaagtctcgatgtcggcgcgttcctcaatatcgggtatgaccacatctcccctttagagcaccccacttgggaggattacttccagagcaaacttaagatctttgaccatgcacagacggcggtcgtcaatctcaactcggaccatgcggaccgtatcctggcacgctcccacgagtgtacgcaggtactgaccttcagcaccacggactcaacggcgactgtttcagcgcgcgacattcaatcctcattcggaagcatccagttcgtgtgtaccacccccagctggaaggacccgatcaaactggtgatgcccggcctcttcaacgtcgataacgcgcttgccgcaatcgcgatctgcgagtatctgcatatcccctatgagcaggtcgctgaaggcctcgcccacacgaaggtccccggcaggatggagcttatccccaccccgggccgccaggtgatgggaatcgtcgactttgcgcacaacaagatgtcttttgagaagttcttccccaatgtgaagaaggaattcccgggctacaaggtgatcgcggtctttggggccaccggcgacaaagcagtcgaacggcgctacgagctgcccaaggctgcagcaccctatgcggacaaactgatctacacgctcgatgacccgggttatgaaaaggtggaggacatctgtaggacaatggcagaggcgaccccggcaggggctgactatgagatcatccctgaccgcgcacatgcggtgcagcgggccgtcgatctcgcctactcgtgcgaccagcccaccctcgtatgcctcttggcacgggggactgaaggcgctgagcacatcaaaggcaaactggtacctgccccgctcgatgcagacctcttcaacgacgctgtgaaacgccactcctaagttcacaggccctcgctatcacctacaactgttcgctcgttaacgcgcaataaaaaaggaaggaatctacggggatcaatgtcattaagttagactctgttagaccactgtggatatagggaagcgaaaagatgtcacggggtcaccctacaatcgggttcgactaagaaaccgacctgaagaaggccccgcatgctcgacatgatacgacaactagcaaagtagctgacctgcgaggagaaggtcgcgcttaccgccgacctcaagcagatgatagccgagaagctaacatcgcaggccgacaagtccgccacatgcctgcagctcaccaggcacgggtgctcgctcacagcagggacaggcaagctgctcacgcagtcgaagttagcagtatcccagtggatggagcttacccagtgcctagctggcaggctcacacagcacaggtgtgagaagagatgcggcgtgtgagtgtacagcgtctagttcatgcgccagcgcgcatgtgaggcgatagcgttaagacttaagttgttgtacgccgtcggcaaacacttcgcaaagagcctggccgacaaccatggggcaggctcattcgagatagtgctccctcaagcaccgcagcgtgttaatggcaatctagaagctgccaatcagggcaaaggaatgcgccagatgggggtggtaactgctttccgtaccattccacctacaaacctaagctgccagtgcgaggccgaggctctgcctgaactccattaggctcactcctttaagcgagcgcttgcgccttgtcgtgttgtaccagacgatgtagcggtcgatgcgttttccagctccttaagggtcacgctatcccacttgcgcttcctgaacatctccgtcttcagaagttggtcgtgtccgtaaagtggtgtaaaaggcgggcgagccagaggcccgccgccaaggtgggatcgcagtcgcccatgcaacaaggacaggtggaaagggtcatctacattggcgtcgacaccggcgggacggaggtcgatcgtaccttcttcccgacgagcaggcgggggtgcgccgagatgctcgcgtgggcccgctcgaacggcgaggtggcctgcttcggcgtggagtgcacagggacctacggtgccggagctgctttaagcacctctcgcgcgagcacgtgcaggtcgtcgaggtgagcgcctccgactgcttcgtcaggcgcagcaggggcaaggacgacgccgcgatggcgcacaaggacgccaggagcgaggtgtggtgcgcgacagtgaaggccaaggacagaatggtcgagagcctgcgggtcctgaccagggcgagggcatccgcactgaaggcgcacaaggccgcaatcgagcagatccgctccctgatcgtctcggccccccaacgctgtgcgagaccagtagtgcgcgatgacaaccgcccgcctcgtccccaggtcacgctgcatcaaggccgggcgcgtccggctagcgtggccccgcgctcaccggtcgcatcgccctcaagtcactcgccagtcgctaccaggatctcgacgaggtgggcgagctcgatgcagccatcggggccatcctcgaggaggtggcaccgctcctgctcgaggagaagtgtgtcagctcgcagggcgctgtccagctgatgatcagagtgggggacaatccggagaggctcaagcagcgagtcgtcgttctgctgtacggggtggcagcgcgtcctgcgtcgttggggctcacgacactccacaggctcaacaggggcgctggcagggcagcgaacagcgcaatacacatcgctgcaccaggaaggctgaggacggacgacaggactcgcgcttaggtggcccgcaagatgtctaagggacactccaagctcgaggcgatacgatgtgtcaagcgatacatagcgcgcgagctgtactacgacatcattgcccagagtcgcatgctcaaaacgacttgacaattagaaaggcatcataggagcgcttccgactctaaggaatacgtcttcctgctcacatccagagggaatatcccagagcatggacggcagggcgagatggagggacaacgctctggcaaagcaccggtttaaggccctcaagagcgaatgcctaaagacagacaaaatacagcacgcctgccagagcttagggacgctatcgcaaagttcgtcgagttctacaacagcaggcggatccactatacgcttagctacgacacgctggaagaaaatggtacatgagcggcatagctgagactgcataagcctacaatggtaaggttgcgaaagccagggactcgggaggaatagagcttctgtgtctcactacttcagccaattcgataagattgcacaggatgagaggaataagaaatgaaatataaaaaaatgtgcgagcaaatcattagggctgttggtggtgaaagcaatattagctccgttgttcactgttcaacacgtttgcgttttgttctaaaagatgaaagtaaagctaacgatagtgaagccgaaaatattgatggtgttttacaggtagttaaaaaaggcgggcaatatcagttagttatcggtaatacagttgaagatgtttacgatgatttaatgcaattactccatttagataatagcaataccgattctactgataacaagtcaaagaaaaagggcaatatttttgatacgattatcagtgtaattactggatcaattgcgccagctattccattactggccggtgctggtatgggaaaggttttgcttttaattttgacaatcactggctgtctgtcagatgaaagtcaaacttaccagatgcttaacttgatctttgacacaggatattactttatgcctgtttacgttggcttctcagctgccaaggtctttaacacaaatcaaatgcttggcgcttttctaggtttagtaactgagcatcccttatgggtgcaaatcgttaatgctgaaaagccatttcattttttaggcgttaacgtacctttgattcaatactcatcaactttaattacggctattttgtcagtttggattatgtcttatgtttataagtttatacgtaggattacaccaggaatggtcaaagttttcctggaaccaatgttaactatgctaatcatgggaccgttgacattcatagttcttggacctatttcaaactggatttcacaaggtattggatttattgcaatgtggttgtaccacaatgcaggattggttgctattcctattttggctgctgcctatccttggttggtttctatcggtatccacaaagctcttagtccaattagtattcaattagttgcaacgcaaggatttgacccgatcattcgtgttgtcgctttatgttctaacatgtcacaagctgccgcttcattagcagttggtttaaagacaaaaaatcaaaaattaagatcattagctctttcatcaagtgctactgcctacttgggtggtattactgaaccagctttgtttggtgttaaccttcgtttaaagaagccaatgtacggtgccatgattggtggtgctattgctggtgttgttgcaagtttcttaaagttaaaagcgtttatttatgtaactccagcatttttgagcttaccaatgtggatttcaaagactgaaaactttgttattcaagcaatttatataattgtaattgctagtattgcaacctttattgcaacttggatcattggattcaaagatccagttgacgaggatcaaattaagaaagcagctaaagaaaaagagaacttcaaacaagatcatcaaaagcatgaattacatagtccagctaatggtacattgaaagatgtttccaaggttgatgaccctacttttgctagtggagtgatgggtaaaggtattgctattattcctagtgaaggtaaaatctttgcaccagataacggtatcgttacagctacttttgaaactcaccatgcaattggattacatttagataatgatgctgacgtattgattcatattggaattgatactgttcaaatgaaaggtacaggatttaaacaattagttaataaaggtgatcatgttaagaagggacaagaactagttgactttgatattgatgaaatcaaaaaagcaggttatgatccaactatcattatgattgtcttaaatagtaaggacttcttagaagttttaccctcattacaagacaaagagatgactaaatcagttaaagccggcgataatgttatggtcttagcgtaggtgctaatatgaaatgttatacagtgccgcaagattttatgtggggtgtcgctacttctgctaatcaggtcgaaggtgcctggaatgaggatggcaagggtatgtcgattgctgattgtgagagatacaatccgcatcaagacttgaatgattataaaagagtcaatagcatgtcgactgcagaattaaatcaggctatcaaggatcattccactaaaaaatggggcaagcgtcacggcgtagatttttaccatcgctacccctccgacttaaagttactagctaaagcacacatcaatgcctttagaatttctatcgcttggaccagaatttatccgaatggggatgattctgaacctaatcaaaaggggttagaatactacgattcattgtttaagacaatgaaagattatggcattcaacctatcgtaactttatcgcattatgaaatgcctttaaatcttgtgttgaagtatgatgcgtggttcgacaagaaggtagcagactactttgttaaattttctaaaacagttattgatcgttatcataatttagttaaatattggattccgatcaatgaaatcgacagtattgttcggcaccccttctcgtcagcaggattagtagaagatcgttttcctgatcaaaattttacgcaagtgatttatcaggcaatgcataaccaatttattgcttcagctaagattactgcttacattcataagaattaccctgaagctaaagttggtagcatgattactagtacgatggtctacccttacaatagcgaccctcgaaatatgtttaaagccactgagactatgcgcgaaaactataattttagtgatattcaagttcgaggtgcttatcctaaagttttattggatcatatgcaaaaaataggtgtggatatcccgatcactcaagaggataaagctttgcttgaagctaatacagctgactttgttgcattttcctactactcatcagtctgcacagcatatgatacgacagggttgaaaattactaaagctaaccgtacgacaggtgtttacaataaatatttacctgaaagtgaatggggctggcagattgatccagtcggtctacgaattatcttaattaatctatttgatcgttatcaaaagccactgtttattgtagaaaatggtttgggtgctaaagatgccttaacttcaaataattacgttcatgatcaatatcggatagattatttgcgtcagcatattaagcaaatgcttctttccctccaaaatgatggcattgacttaatgggctatctgatgtgggggtcaacagatatggtttcggcgtcaacgacacaaatgtcaaagcgctatggcttaatctatgtggatttggatgataacggtaatggtagttacacaaggacgttaaaagactcctattactggtatcagaagttgttgagctttggtaccgaaatccccaccacttatctagaaaatgactaaggacttgcggcacagttaggctccatgaactgtaagctgcttagacaactttggctgcaccgtggatgtggttgcgatgcctgcgagcgggatgtgcataaggcacatcccgtcgaggagatcgacactaagcatcgaaagaatccctgtggctgtatctttagctgaacgagtcggcatacgacttgtatatgggccttcggaaggctgtggaacgttccctcgacatatgccttgatattcgagatgagcctgcagacctcagggaaagcgaggcgtcatcgtctgagctgtcgtactttttctagacgagctcgcagaagcaatccagccctgccgatatcctactccaggcatcggcacagatctttgtatattccgcttgagaagatcactttgcacggccgaatagatcacctttagcggagatttagatcacttgtcatggacaagagatcagtagcggcagttctgcctaagtaagcatttcttgccgacccaagcagaacagccataatcttacttaactatgataggcattgaccaccgctttattatgactctgagaaggcatggcgtttgcgcatggatactctgccttgaacatcgatcgaatacttgttgtgaataatccggtcaaggatggcttcagcaacagcgctgtcttcatcttctccacggtcacagtcaatcctgaggtaccagtcatctgtgtcgtagtgggtgcaaagaatcatagcccctttgcggctgcaggcctcgatgatttcaaggagatcatacgccttagcctccggaagcagccttagcagccattcatcaatgatcagtaggtcaaactttctgtatgccgcctttactttgtcctgtgtgttcatagcttttgcaacagcgaactcattcagaaggtcgagtatttgcgtgtgtaggcaccagtggttattgcggctgagcaccggctgcgtcgcgaatcggcaccgggggcagcgccgtgcagcactgccccctcatgagggctcagctcactgcatcaggatctggggccggaagatgctgcagccctggcagcagcacgcatgttcatctctcccatgtcgacccatgccgtgttgtggacgatgcgctccatgcccggctcggccgtgacatccgcgccgaggcgggcatgccagtccttctggcgctactgggtgcaaaaagatcgtcgacctctcgtcgtagcgcagctcgaagatctcgagcaggaagcggcaaaagccgtcgtccggcctgctgagcagccattcgtcgaggacgaggacctggaaggccccatatttcctcacggccttcgcgaccccgcccgggcgctcctgcgcatccttccaggcctccttaaggtcggggcacctgatgtagttcgcgcgcatcctcgaggcgcacgcctcctttgcaagcgcgcaggcgagataggcctttcccgtgcctgcaggcccgaagagcacgacgtcctggcctctcaaggagaacccgcaggtcgcgagctcgcctgagagcacgcggtcgagcccgcgctcctttgcatagtcgatgcggcgcacgtctgcctgcggatatctgaggttcgccctcttcacgagattgcggatcttgtcggcgacatatcctgcatgcgccttaccgaccgccatctgcatcctctgctcgaagggcatccccatgcagacggaatcgtcctgggcaaggagcgcctcgagcagcgcatccgctcccatgtccctcatcttcctgcgcgtctcctgcccgatgttcatcgtgcaccatcccttccgtatcagtccttcccgcggaggcatccgccttcctcgtgcgctggctgctgcgtcgccgccgaatcctgccctgccttcaggatcggttctatgtcgcggtagcgcggcgatctcctgccggatgcgagagccatcccgcatgccctctcgagccgttcgctcccgtatatgtgcgagagcctcagcactgcgaggcacgcattgaacgcatacgactggaatatgcgctccgccaccccgcggcagctgggtgagccctgtcaatataatggacagggctcatcaagcacacagcgagcgtggcgaagaaggccgtgcacggcgagcttagcctcgtcaatgcgatgcagcgaaggctgcgcgagttcctgcttttcttccatggggtcttctacgaagtggctggggcacttgtcttgcctgcttcctgtggatagagcaggtaaggcattctgagcgggagaagaaggatatactctcaggcaagcttgcaggaggcaggtatgtccataccaggcgtgcgctcatagacatagagcagcccttctggagctattggaaggacaggggcgtcaggtcaattatggtctaacagcgagttttgtaaaaaaggaatcgaatctaaatgattcgattcctaaaaagatcagtttccaaatttcaatgtcttaacttaatgacattgccacgaggattccttccttttgtttagcgcttatactctagcttcaattagaagttgaccggctcatcgtagtagcagcacttgagcagcttttcgaagtcagcagcatcagtcttgcgcgggttctcaggcgtgcaggcgtcgccgacagcgttctcagcgatcttcggcagcttctcgaggaactccttctcagagaccatgactggcttgccagttgcgtcagccttaatgccgcccgcagcgtagttgtcgattgcctgagggatgttcatcttatcgttcataccacggatatactggacgaggttcgcgacacgctgatcgtcggtgtcgcccgggagatgcaggatctccttggcgatgtagccgtagcgctccttcgcacggctgtcgtgagagttccactgaatgaccttacccagatacattgcgttagcagcaccgtgaataatgtggccgccgctgaaggctgcaccagtcttgtgggccatggaatgggtgatgccgagcaggccagaggagaatgccagaccagcgaggcactgtgctccgtgcatatgctgacgagcctcatgatcgcccgtgtagctcttcggcagccactcggtgatctcacgaatgccgtgcagtgcgtctgcatcggtgaacatagaagcggcggttgagacataagcctcaatgcagtgcgtcagtgcatccatgccggtgtgggcagcgagttttgcaggcatgctgtaggtgagctcagggtcgacgattgcgacatccggggtgatctggaagtcacccagcgggtacttgatacccttcttgtagtcggtaatgacggagaatgcagtcacctcagtgccggtgccggacgtagaggagattgcacagaagtgagccttgtggcggagctcagggaagctgaacggctgaagaatgttgccgaacttctcatcaggatactcgtagaagacccacatagcctttgcagcgtcaatcggggagccaccaccgattgcaacgatccagtcaggctggaactcctgcattgccttggcgccttccataacaacatcgacagaaggatcagacgtaacgccctcgaacagctttacttcaaagccggcatcctcgaggtccttctgcagctcctgcaggaagcctccacgacgcatagagtgtccgccagagacaacaaatgccttcttgcctttaagattctttacttcgtgacgagagccctctccaaaatagatatcacgtggattggtataacggcccatatacagcccatcctttcgtacccgctgcatgtgcaacggctttatgccgatacgtctcgctgcgatcggtgcctctctaatcgaggaccaagcgcataacgttctatgcacaagatcctcaccagtactattatttatcccaccccggatgatttatgcacctctattccgttattgggcgagcggttgtgggatagagctttggcatagggtccgctataatataaatcttacctgtatataagaccaggtaaatgaccacatttctgtatgcatatcggaggctttcgctaccgtttgcgctgccgtgcggtgagaaccactgtcccttgttgctatcacagtagattccggatacgcgtgtaccacagacgggaaaccgtctgtggaacttcagtttcggctgagtcgcacttcgtttgtgtccactactctggtatact

SEQ ID NO: 95 - DNA, 27138 bp, Unknown
  Metagenome-assembled genome
tccgctcgagcttcaggatgtccgagacgatgccagcaacagcttcgcccaaggcaggcgccgaggtaaggcccggagattcgatccggagcagtcgaccgaagcccgcgcatcctttgcctctcccacaaggaactcatgctaggcctgtgggcgcgaagggcctgcgaaggaggtgatacctcacgagcggcagatccttcacggtcttggcagcgccctttctgacggcgtcgagcccctctgcggtcgttgcggtatcgtcctcgtctttcgacggtcgccgtcggccccagaatcaggttccgtggcaggtaggcgtcacgaggatgcccttgcccatcttcgatggcaggcagaagatcgtgtgatgcacatgtccgcccgcgcgcttgtcgagcaggagatattcgccgcgccgcggcacgatcttcatcttgtcggcagagacctggttgtgtatctctgcggcatgggtgccagcggcattcacgaccgtacgtgcatggaaggctccctcggctgtctcgatcttccagaggccatccgcctctttcgagagcgtcttggcctcgcaagatgtaaggatggtggcaccgttcgtctctctgcaatctcggcctgcgcaatcgtcagaaggaacgggtcgacgatccctgcggtcggcgcccagagcgcgcccacagcctcactgagatatcggctccatctcacgaggcggtcgcgccctccctccctcccttgtacgccgttctctcgccgcgcttccttcaatgcttcgagctttggcatatcctccacgtccgtgcagacgacaagagaaccgatgcgctcaaacggcacatcgaggtcttcgcagaccttgcccatcatctcgtttccggccacgttgtactttgcatgagcgtgcccggctctgcgtcatagcctgcatggacgatagcggaattcgccttcgaggtgccgagcagacatcgtctccacgctcgaggacgaggatgctgcactggcgcctgaaagattgcgcgcaatggccgtgcccacaacgcctgcgccgatgatgcagacatcatatacgtcattcatgaaagcataaccccctctcgttggaagaaagccgtacttccttccccgagagtgagtctatgcaatgtcaatccgcggcactgccacttttcggcaatgcagcccattggcttctgtagaggttcgcatagaagccgcccttggcaagcactcgtcgtgcgtgccgcgctcgatgatgtggccgccgtcgatcacgaggatgcagtcggcatcctgaccgtcgagaggcggtgcgccacgacaagcgaggtcctgccttccatcatgcggtcgaaggcatcctgcacctggagctcggtacgcgtatcgatagactcgttgcctcgtcgagagaagtatcggaggatcttgaagcatgacgcgggcaatgcagagaagctggcgctgtccctgcgagatcgtccccgccatcctcgccgatcacggtgtcatagccctgagccagctgctggatgaagccgtcggcatgtgcctgacgtgctgctgcctcgacctcttcgatggtcgcatcgggcctgccataggcgatgttgtcgcgcaccgtgcctttgaagagccacgtatcctgaaggaccatgccgaagcagagcgaagcgaggcacgcgtgagcgcctgtgtgtcatgccgcgtcgacctcgatcgatcccgaatccacgtcgtagaagcgcagaagcaggttgatcaagtcgtcgttgccgcagcctgtgggccgacaagtgcaaggtgtgcccggcttgcgagaacgcgatgtcctggagagagcttgcatctttctgtaggagaagctcacatccttgaaggcaagctcccccttggatcctcgacgtgacgaatcgcagatcgtctgcatcgggcttcttctctcggcatcaagcaatgcgaaacacgccctggccgggcgaaggctgtctggacctgctgcgtcccgatggcaagatctcattgaacggcttcatgtactggtttgcgtaggtgaggaagctctgcacctggccgacggtcagaggagatgccatccggtgatgacagcagaatgccgacagcggcaaccgcggcgtagatgatgttgttgcccagacggtcgaagggttcgagagggagcttatgaactgagccttgcggccggccgtatagagcttctcgttgatggcctcgaatgcagcaatgcttctcttctggtaggcaaagcgctcacaagcttctggttcgagatcatctcttcggcatagccggtaagcgagccctggagcgcctgctgcgcagcgaagctcttcgcagaccgcggcaatgagccatgcgacgaggatggatacggcgtcacacgacacgatgcgccaccggcaccgagcgagaacatgaagatgagcgtgcccgcaatcatcacgatgccattgaagagctgcgtgaagccctggacaagaccgtctcccaccgcatcgatatcgttgatgacacgggagagcaggtcgccatgagcatgggtatcgaggaaggagagcggcacgcatcgatttcgcataggcgtcgattctcatgtcacgcacggtgaggtaggcaagccggttcgtgccataccgcctgcccagttcgctgcggcagcaacagcgattgtggccgcaaggcggatgagaatgggttcgagcgcagcgaattcgacagctcctgccgagaccatggtatcgatggcctggccgatcaggatggggacgatgctgggccacgacagagacgacagagcacgcaaacgaggcaagcgccagcgctgcatagggcttcacataatgtgaaaggcgcgcaagcacggtctttaccggcatatctggtgcatcgagcggggtcgtggctttctccctgagcgcctgctgcggcagaaagcatggccttggcagaggccctccctggtaggcattaggcatggtctgcctcctttccggcaagctgcgacgagcagatctcgcgatagatgccgcaggtgccgaggagctcctcatggtgcccaggccttcgaccttgccatgatgaaggaccaatatctggtctgcacccatgacggcagagatgcgctgggagatgatcacgcaggccggatgctgaggaagagacctcagcgcctcgcgcagacgtgcatcggtcgcaaagtcgagggcagatgccgaatcatcgagcacgatgagagatggttcgccgacaagggcgcgggcaatcgtcagcgctgcttctggccaccggagaagttcctgccgctgcctccacgcacagagtcgagaccagcctccttcgcacggacgaagtctgctgcctgcgctgcccgaagcgccgcccaggcttctcatctgtcgcatcaggaccctccaggtcaggttcgagcggatcgtgcccgtcacgagatgggcggtctggggaacgcttgccacttcatgcctgagctcgtccaggggccatgcacgcacatcctgcccgaagacggagaccgtgccttctgttgcgtcatagagcctcgggatgaggctcgcaagcgtcgatttgccggaacctgtgccgccgatgatgcccagggtctctccctgccaagcgtgagtgtcacgtcggaaagcgccggctgccggtgccataggagaagccgacatggtcgagcgcgagcgcaggagcatcagcagctgcaggagcctccgcatcctgcgcatcgcagacagatggctcggtcgcaagcacctcgtcgatccttttcctcgaggcagccgctcggttgaagatgatggcgagattcgcgacataggcaatggcaatcaggacctgcgtcatgtagttcacgaaggcaacgatctggccctgctggaggacgcctgtctccaccttgaagccgcctgcccagagcacgcagacgacaccgaagttcatgagaagataggcgccagggttcaggagcgcagcaagctttccgacggtgatggcggtatcggcctgcgagacggcagcctcgcggaagcgctcctcctcttccttctcatgcctgaaggcgcggatgacacggacacctgagagcgcctcgcgtgtcacgagcgagatatggtcgagcttcttctgcatgagggagcagtacggaatcgagcgcttcatcacaagatagaagaccagggcgaccagcggccaaaaccctaaaacgacataagacgggaagggggcgacctatgagttgggggtcacagcgccagcctcgaagctaatgcgcttggggttgtggacgcattaatacgatatcaggttagtgtgtacatggcgcttgtgctcacgcgccgagggggggtgtgtttgatacgctcagttggccgctggcgtggtgttttgcggaactctgagaattttgaagagacggggccgagatcataagttgaggcctggatttaatctcagggtagctgggcaaggaggtgactgggggttgtagtgtcttgtgttgagtttcctttgaaggaacggggggggttgccagcagtaagctacaggtggactcgggtgtgcggtggccgttttgtgtggttgcgacggtgggccgtggagtcgagcagagggaggctctgtttctttgtggcgcgtagccagtggcgaaatgcatcttctcagatggattgggcgtgtggtggggtcgtgggctgtggtggtcgtgggcgaagcgagatgaatggggatcgggctggcccgtgtaaagtactcggtagtaaagtgacgcgttgacgagggttgatgggagacttataataccacgcgttctattgtgtgttggttagtgttagcggataggatttttgggtgtgggggcccagggtggtattccgcttggcgtagtttttatgggctccgcgcgtttaccgttaacatatctgtggtcggccggcttggcagtaagatggttgtgttagcactggtgggcgggtataccgctcttttggggttgtggagggtggtggcgggagttatgcctagtaattctcatttctcccgtggctgtggggaagttctaaagcattcctacagcttttggtagttgggtgattatactttggggggtagttcggttgccccttctcctcagagggccttagtagtgttatagtttttggtggcggtgtgtttttggtatgatggggggaggggtgatcgtatggctctaagtggggcaggtggtgggtgttcatgcgggttcgcgggtaccgaccatgtgtgtggggtgcattggctagacgttggcgggtctcatgtgtgggcatgggaggaggtgcatgttaatctgtgacttattgggcgtaggggcgccgttggggtttggagcgaggggaggtggtggcttcatgaattcccgtgatggtgtttagaaaatgacgggtatgcgggagtatgattctagggatgctctggctaggaaggtagcaggtgtccggtgggatgtgttggagtcgcatcttggcgttttgggggattgctgatcgttacgccttggtgggcccgtcacggcgaggaagatgaggccgagcgtgcggtcgatcatgatggcagcggcaagcgagccgaccgccaggatcggccagcggatgagctgccgtattgccatggcagccgcgagctggatctggttcacatcgttcgtgatcctcgtcacgagagacggggtgccgatgcggtcgatctcggcagcgccgaagctgtgatcttcctgaagagcgcattcctcatgtccgtgccgacgccctgcgagaccttcgaggcgacatgctgcgtcacgagcgtcgatgagtatcctgcgcatgccatgcacacagaaggatgccgcgccgcacgacatacccgcgtcatgcgtcgcgacacccacatcgatcatatcggccacataagtggcgtcatgacatcgaagacgacctcgaccgtcttgaagagcatgccgacgatggtcctcagacggtatttcttccagagctcctgctccatctacactccagaagctactcgatgccgagcgtgtcggagagctccagccactcgtcttcgagatccgatatttccttctcggcagcggcaagctcgttctggagctccatgaggtgctcgtagtcggtagggtcggcttctgccatctccttgcggatgcggtcaggctccgcctgcctcttttcgagctttctcgagctttcgtgccacagcgtcgaagcgcttcctgagctcgcggcgctctgcattcgagagtgcaggctcagacgggctctcctgtgcctggctgccatctgacattgtagtttcagaagagggtgcctgggcattcctgttttgtgtggctgcattcagaagacgaaggtattcatcggtgccgcccgggacatggcggagatggccgtcgatgagggcgaactggtcgtctgtcacacgctccatgaggtagcggtcatgggagacaagcaggagcgtacctggccatgtatcgaggaggtcttcgaggacagcaagcatgtccgtatcgaggtcgttgccaggctcgtcgagcacgagcacgttcggctcgtcgagcagcacgcacatgatagcgagacggcggagctggccgcctgagaggtccttgatgaaggtcgggaactcgcggcgggcaaagccaaggcgttcgagcagctgctcggggctctgcggcttgccgtcgacgacatagtacttcttgtaggtggcaagaagctcctcgacacgccagtcatccttcttgtggagctcgtcgaggttctgggagaggatgccgaaacggaccgactttccgatcttcacatagccacgactcggcttcatgcgcccgcacatgaccttgagaagcgtcgacttgccggcgccgttctcgccgaggatgccgtagcggtcgccaggtccgatgagccaggtgaggtcctggatcaccggcgtatcgccgtagccggcggtgacattcttcatctcgatgacgagcttgccaagacgcgagacggcaagcctcttgagctcgaccgtgttcctcagaggggggtcgtttgcaatcagggcctctgcctccttgatgcggaacttcggcttcgacgagcgtgccttggctccatgggcaagccagttgagctccttgcgcagaatgttctgccttctgtcttccgatgcctgcgccatgcgctcgcgctcgacacgctgctggatgtaggcagaatagccgccctcgaaaggatcgatcgtgccgtcatggacttcccacatgtgctcgcagacctcatcgaggaaccatctgtcgtgcgtcacgacgaggagggctcccgtgccttcgggccaccttctcttcagatgctcggccagccaggtgatggcatgcatatcgagatggttcgtcggctcgtccatgagcatgacatcccagtcgccgacaagaagtcgggcaaggtcgcacctcctgcgctgtcctccggaaaggtcgccgatccttgcatcccagtcgacgccgacgaggagctcatcgatgatggagcggatcttcggatccgatgcccactcatattccggcacatcgccgacgacgctgtgagcgaccgtatcctcgtcgtcgagctcgtccgactgtccgagatagccgaccgtgatgttgccgcggcgcacgatcgtgccgtcgtctggctcgatcctgcccgcaatgagatccaggagcgtcgacttgccgtcgccgttcctgccgacaatgccgatgcgctcgccggcattgatgccgattgtcacatccttgagcacctgcttgcccggccattcctgggacaggtgctcgcatccgatgagtattgccaaaacgttccatccctcttcatgaaaagggcctctggcgaggccctctctcgttctttcctagagaagctcctgcagctgatccaggatcttcgcggcaacctccgtcttcggaagcaccggaagctcgatcgtcctgccaggcaggatgaaggagaccttgtccgtatccgacccgaaggcagaatccgcacgcgagacatcgtttgcaacgatcatgctggcgcgctttcgctcgagcttctcgcgcccatagcgctctgcatcgccggtctccgctgcaaagccgcagacgatccggtctcccttcgtggcgcccagatccctgaggatatccttcgtctccacaagggcaatcgaatcgagctgctcctgccccttcttgagcttgtggctgctcggcgctgcaggcgtatagtcggagacggcagcggaacagatagcgatgtcggcatccttccacgcagcaagagctgcgtcatgcatctcctcggcgctcgtgacgctcacacgctccacgccgtaaggacaaggaaggctcaccggtcccgaaacgagcgtgacctcggctccgcggcgggctgcctcagcagcaagcgcgtagcccatcttgcccgaagaggcgttcgcgatatagcggaccgggtctatcgcctcatgcgtcggccctgccgtgatgaggatgcgcttgccggaaagcccgtcagtcctcttcaggaccatgagcgccgcctcggcgatctcctcgacaggcggaagcttgccttcgccgatgtcgccacaggcaagacggcccgacgagggggccatgaccttgatgccgtgcttccgtgccagcgccacattctcctgcgtcgcgggattgcgccacatatgcacgttcatggccggtgccacgagcacaggagatgtcgcagcaaggatgctcgaggtcaccgcatcgtctgccatcccatgggcaatctttgccagcacattcgcggtgcaggggcagacaagctggagatccgcccactcggcgctgtcgatgtgagggattgccgtaggcgcaaagtcgaagaggtcctcgagcacgggatagcgcgtgagaccttcgaatgtcgccttgccgacgaagcgggaagcgccttctgtcatggccacatggacttcgcagccggccttctggagaagcctcaggacctctgccgccttgtaggcagcgatgcagcccgtgacatgcagcaggacatgcggcaccttctcctctgccatctattcctcctcggtgccggtcaccaggatgcggtggcagtacgggcactcgcagatctggcccttgcgggcgatgtcgccgaaatcggacggctggagcgcgacacggcagatcgatggcttgttcccatggagcgtctccacggccaggccgccaaagcgcgtcgaagtctcgctgtacttcttctgcatctcgggcgagatatgggaaaggacgcgcctgcgctcctctgtgagctccttcacggactccctgatgcctgccgtcacatcctgataggcacgggtctggttctcggtctcctcgtcgaggcgaatcttgagctcgccggcatgcgcctcggcatcgagcatcttctgcagattctgcttcaggccttcatgcgtgaactcatacttctcgcgacgctttgcaagcatcgtgagctggttctcgaagtcctgaagctcgcgcggcgtgtggccgtcctcgttcgcttcggccgtgacctcctcctcatgctgcttcaggcgctccgtcatgtcctcgttgtctttgagctcgagctcggcatccttgcgctggcccacgatctttgtcatgtcctgcgcaagcttcttctgggcctgcttgatggctgcgagcttcttgagctgcggaagcttcctgatctccccgtcgtacctgatgagcgaaagatcgatctcctgcagacgtaccagcgcttgtgcctcattcatggattctcgcctttccttcatccactagttgtttgcagccacaatgccgatgagggcatcggcaaagcggtcaaggtcttcatcggatacgcgctcgtcgaacgagattctgagcgcacccaatgcatcgtttcttgctatgcccatggcagagagcacatgggaaggatcgagagatcccgaggagcaggcagatcctgccgatacctcgaagcctttctgatcgagcttcaagatcagggtctcggagtcgagccctggcacgtagatgctcaccatgcccggaagcctcgtatcgtcgatctgagccgtggtcgtcggctggatgccagttccgggagcgcagatcttctggaagagcctgttcgccttggcagcgcaggcgctcctgcgctccgccagatggtcggtctgtgcctttgcagctgctgcaaaggcgagcgctccccttacatcctgcgtgcctggtcgctttcccgcctcctggccgccaccgaagttctggggacggaacgggcatctcatgcgcagggccagagcgccgataccgacagggccgccgatcttgtgggcagcgatgctcaccgcatcgcacgtgtcgatagcgagcggtatgcgtccgaatgcctgcacagcgtccgtatgcatgagggcaccggctttgtgggcgatctctgcaagctctgcaacaggctggatgacgccggtctcattgtttgccgacatgatggagacgagggcgcagtcagggcctgcggcacgctcgagctcctccggcgcaatcctcccatcacgtcccgggcgcacgagcgtgacggcaaatccacggtccttgagtgcaggcacgacatcgagctccgagtcatgctctatggcagagacgacgacacgtgtacgcttccggtcgcgtgcacgggcgccctcggcgataccgtagagggcaaggttgttcgattccgtgccgcccgatgtgaagacgatctcgccggggcggaagccgccgccaagcgcctttgcaatctcgcgcctggccccttcgagagccatggccgcctcgcgtccgagcgtatggagcgagttggggttggcacccgcataaggtgcctcagcatatgcagcctctgccgcctttgcctcaggcaccatcggcgccgaggctgcatagtccagatatacgtatgaatccatgggtatacgccgctttacgctttcctgccaagcccggcttgcgcagcctgggcaatctctgccattgctttgtggcggtcttctgccttgaagacggcagacccggccacgagcaggcgtgcgcctgcagacgcgaccagccctgcggtctctttcgagatgccgccgtcgacctcgatcagaggatgtgccccatgggcttcggcaagacgcaggatggtgcggatcttctcgggtgtctcagggatgaacttctgcccgccaaatcctgggttcaccgacatcacgagcaccatatcgaccgtcggcagaagcgcatcgagtgaataggcagaggtgcccggattgagggcaatgcctgcgcgctttccagcggcgtgaatctcatcgacaatgcgctgcgcatgctttgcgcactccacatggaatgagaccatgtcggcgcctgcctcgagataggaggcaacctcctcatcggggttcgagatcatgaggtggacatctaccgggatatccgtcgtcttcttgagggctctcagaaccggatgtccataggagatttcaggcacgaacgagccatccatcacatcgaaatggatatagcgcgccccagccaccgtcttcacctcatggcccagatccatcagatctgccgataggatagacggagcgattccaatctcgtcgagcatgccgcccctattctcttgcgctacagcccgtagaactccacacggggacttctccccagaagggttgcaatggctgcatctactggtgttccttcatacaggatagcgtgaacggctcctgttatgggtgcctcgatacccttttcacaacagagcttccagacgctctttgcagctctagcaccctcgacgaccatgtgggtgcgtgcctcataggcttccagactctcgccggctacgaacccttcgccgaaggtccggttcctcgaatgctcggaggtgcaggttgcgacaaggtcgcccatgccggcaagacccatgcaggtgagcggatttccgccgagcgctgccacgatgcggctgatctctgcaagccctcgtgtcatgaggacagcaagggtgttgtcgccggcatcgagcccgaccgcgcagccgcaggcgatagcgatcacattcttgacggcaccgcatacttcgacgccgacaagatcgtccgatacataggcacggaagttcggcgagaccatgagcctttggaagaaggcggcacaatcaggattggcagaggcgatgaccgcagcagataccttgccgaggcagatctcttcggcgtggttcgggcccgagaggcaggcaatgcgctccggatgccccacggcattccccacgacttccgtcatgagcctgcccgtcgcttcctccatgccctttgtgaggacaaggagcggaagctctgaagagatgatgcgggcaagctcggatgagacatgcgccagatgcgatgaaggcacgacgacaagagccgcatctgcatccttcacgcatgcagaaagatcggtcgtcgcatggacattctccggcagcacatagcccgtgagatagcgcgggttcctgtgctcatgctcgatgccagaggcgactgcctccgagtgtgcccagcccatgacctcatcagcatggagcgcgacaaggcctgctgctgccgtgccccaggagccgaggcctatgaccgcgaccttcatttcgcgtccttgctctcatgatggaacgagaacttgcgctcctcgccgtggacgagcttcttgatgttcgcgcgatgtgcccagacgacgatgacggtgattatgacaagcgggcagatcgtggctggcgcatagccgaagaccgctccccagatcggaagcgacacggctgccatggacgagccgagcgacacatagcgggaaggcaccgcaaagacgacgaagacgacaaggagtcccaaagcgactgccgggatatagccaagcgctgcaccgaagccgaccgcgatgcccttgcctccatggaaatggagatagggcgaaaagacatgtccgcagatggcagcaaggaagatgatggatgccatccatccgaactcccctgtcggcgccaccatggaggcattgcctgcaaagaccgccatgcagaataccttctgccagatgaaggtcgaaaggaatcccttgagcgcatcgagcaggagcgtgagccctcctgccttggctccgaccgaacgtgcgacattcgtcgtgccgatattgcccgacccgaccttcctcacgtcgatatggccctccttcgaagcgatgaggaggccgaacgggatgccgcagacgaagtaggtgacaacggccgcaacgaggagcagacagtatcctccggcatctatcatttctgcgcttccttccttctgaagttcaggcgaatcggcgttccttcgagctcgaactcatcgcgcaggcggttctcgatgaagcggcggtagttgtcgttcacgagctcagggctgttgcagaacagggtgaagacaggcggctggtagccggtctgggtgacgtagttgaccttgaggcgctggttcttgtggacgacggtatagccggtctcgcgcaggcgctccatgaggctgttgagcttcgaggtcgggatatggatcgtgcgggcttcctgcaccttgtcggcaagggccaagatcttgtcgaccgagcggccggtcttggcagagaccctgaggtagggtgcccaaggcatgaaggcaaggcgctgctggatggtgcggagcgcttcgtcccttgcatggtcgtccttcatgaggtcccacttgttgagaaggacagcgatggcgcagccgcgatcgattgccatctcggcgaccttctggtcctgctccgtcacgccttccgtcgcgtcgacgacgagaagggccacatccgcacggtcgatggcctgaaggccacggacataggagtagtactcgacatcctcatgcacgaggttgcgcttgcgcatgccggccgtatcgatgagacggtacttcctgccctcgcgctcgatgaccgtatcgattgcgtcgcgggtggttcctgccacatcggagacgatggagcgcttcttgccgatgaggtcgttcgtgatggaggacttgccgacattcgggcggccgataagggcgatcttaagcgtcccgtcgtcgatctcctcagtccctgtcccgtcatcttccgggaacacggcgatgatatcgtcgaggagatctcctgtgccgatgccgtgcgaggcagaaagaggcctcggctctccgacgcccaaggaatagaattcccagaggtccggctcgtttgccgggttgtcgcacttgttgcagaccaggaagaccggcttgtcgctcctgcgcaggatcttcgccacttcctcatcctcgtctgtcacgcccgtcgtggcgtcgacgacgaagacaatggcatcggcctcttcgcaggccgtgagcgcctgctcgcggatgcctggcgcgaacacgtccttcgacttcacggattcgatgccgccggtatcgacgagcacgaagtcacggccagaccagtccgcctcatgataggaacggtcgcgcgtgacgccgcgggactcatggacgattgcatcgcgcttgattgcgatgcggttgacgagggtcgacttgcccacattcgggcgccctacgacagcgacgatcggctttcccatattcactccttaagcgcgctcagcgcgcctcgctagctcacttgccggcgagctcttctatccttgcgcgcacggcatctatctgcttctgaggggtcgaagctccagcggcgatgccaatggtggaagcaccggcgagccagctgccttcgagctcagatacgtcttcgatatgatacgttctcggacacctatctgagcaaatctccgcaagatgcgtggtatttgccgagttgcggccaccgatgacgaccatcgcatcggcgcgcgaagcaagctctgccgccgccttctggcgcctctccgtcgcctcgcagatcgtgttgtagacacggagctcctcgacaagcggcacgagctcggagacgacctcctggaggcgggcctttgtctgcgtcgtctggacgacgatgccgacacggcgggagagcttcatgctctcataagcctgcctgacatcggcagcactgttgacgacaagtgcaccaggagcatgtccgagcgtgccttccacctcagcatgtccccgctcgccgaggacgagcaccgtgtagccgtcgcgcgagagctgctctgcaagatggtggaccttctgcacataggggcaggtcgcatccacgacatgcacgccggctgcctttgcttcctcgacagcctccggcacgacgccgtgggcacggatgatcagggtcgatccctgggcctggcgggggctctcggcaacaccgacaccttctgcctcgagctcagagacgaccttcggattgtggatcagaggccccagcgtcttcacggggccctctacctcgtgggctgccttctcggccaggtcgagcgcgcgggcgaccccgaagcacatgccggcctcagccgccacctcgatctttgccatctcctacctctttccgggatgctcctggcgaagctcgtctctgagcgcatagacgcgctccatcgagaccttctccatcgcggcaatctgctccttgcgcttcttcacgccgagggacgagaactcgatcggatctcccgccttcatgaagacacgcttcggacgcgggaaatgcttgcccttcggcgtgatgtcgcgggcaccgacaatcgcgattggctgcacgcaggtgcgcgccatctgggcgatcagggcaaagccgccgtggatcgtgacgggctggtcgtcggtcttgatgcgggtgccttcggggaagatgagcacccagtcgcctgcctcgagcgctcgctgcgcacggcggattgccttcacgtcagccgtgccacgcacgacagggatgcagccatagcgggagaatgcccaggagacgagcttgttcttgtcgaactcgctcttcgagatcgggcgggtcctgatgccgtgatggtagagcgcgattgcgacgacgaccggatcgagcatcgatacatggttcatcacaaggacacggcccttgtcgccgcgcttccagccgccccagagcttctctgcctcttcgatcttccaagggaagaagatcttcgtccagatccaggcacccgtcatcgagatggcaagccacgcgcgcgacggccacgggaactcgcgcataggatgctcgtagtagagctccgcagagttcccatggaatgccttcatgggctctgccttcttcggtgccttcttcttggaagctgcctcctttgcaggagcgggcgctgcctccttcacgggttcaggcttcgcatgctccttcgctgcagccttgtccatgagggcagagatcttgtccacgacctcctctaccgtcatctctgacgagtcgatcgtgacagcgccaggcgccggctcgagcttgaacgaggcgcgggaggagtctgccttgtcgcggcgtgccatgtccttcaggatggcttcctccgactgcggatcgacggcaaccgcctcccccttcgccgtatcgccacccgcacgctcgaccgcacggcggtgcgccctggcttcgggattcgcaacgaggaataccttgacttcggcatcagggaagacgaccgaggcgatatcccttccttcagccacgacatcgccctgggcaccgaatgcctgctggcgcccaaccatatcggccctgatctcaggaatgcccgcgacgacagagacatcgcggtcgaccttagccgtgcgtattgcatcgctcacgtcctcgccgtcgagaaagacctgtgtcttctcggcaaaagggccgaattcgatctttgcttcctttgcacaggcggcaagcgcctgggaatccttgaagtcgatgcccttgcgctcggcacgcagggcgcaggcgcgatacatcgctccggtatcgagataggtcagtccacgcttcttcgccagcgcctttgcgactgtcgacttgccagagcctgccggtccgtcgatagcaaccctcacttggcatcaccatcccagttgtcgagatccttcacgacatcctcttcgacgcggcgcttgacctcttcaggcgtaaggccgagcgcagcaaggaaatatctctttccatcgtaggagagaacgaacgaggagacattggaaatctggatacgccagaagcggtcggccggcgttccgtagatggcacgcaggatgctcctcgagatcccgccatgcgtgaggagcacggtgcgtccccgcacgctctcgaggtcgtccaggagcgactgcacacgtgcgagggcatgctcgtaggtctccccgcccggagccgtgatggagtgcccctcggcgtcgagcgcccacgggaaggaccagccgcgcttgtgcgcctcctgggcagagaggccctcggcctcgccgaagtccatctcgatgatgcggtcctctacctgaggctcgatgcccaggcgcttcccggctgcataggcaagcttcgtgcagcgctggagcggcgaggtcaggatgcggtcaggcttccaggtgacgatggcatcgacggcacggcgtgcctgctcctcgcccttcgggctcagatccacattgcgcctccccgaaagggtctggtcgagatttgccgtcgtctgcggatggcgcatcacgaggatgcgctggagttcctgtgccatgctatctattgcctcttcctgtcctggatgatcttctcgagcgatgctatctcgccctcgtcgagaagcctccatgagccatatgaaacacccttgagctcgagcggcccgaagccatcgcggtggaggaagaccacctcgtgccccaccgccttgagcatgcgcttaacctgatgcttcctgccctcatgtatcgtgagccctacgacggtctggccgacgcgtatgccttcgggcgtcacggcgtcccaggcctcgcttccacgttccgggaagtcgacctctgccggctgtgtcatcccgtcatcgagctccacaccctgctcgagcgcacgcctgttctctttcgtgatccttccctcgacgagcgccacatagtgcttccagacatgcttcgagggatgcaggagctgctgcgaggcatcgccattcgtcgtgaagagcagaagccccgtcgtgtccttgtcgaggcgtccgaccggaaagatccccggatactgcttctggggcacgagcgtgcgcacgcagagacgtccctgggggtcgtccatcgtcgtgagatagccccgtggcttgtagagcatgaggtagaccggatgctctgcaatctctacccgcctgccgtcgacgcataccacatcgtggctcggatcgacacggctgccaagctctgtcacgacctcgccgttcacggtgacgcgaccggcggtcatgaggtcctccgatccccgcctgctggcgacgccggcgcgggccaggaacttctggagtctcaagggatattggaaatccgtatccgtcactgctcgtcccctcctgcttcttcctcgtcgtctgcaagttcggcaccgtccagaagctcgcgctcgtcgtcgatgtcttctgcggtctcttcgagggtcgatgcgatggagctgcccgaaaggcgttcgcggatgaagcgcttcgactcctcgtcgggagcgaagtcctcgagcggcggcaggtccttgaggctcctgagcccgaactgctcgaggaaggcacgcgtcgtcccgtagacgattgcattcgcatgctcgggcgcacgtcccagctcacggaccagccccttctcgatgagcgacgagatgacggaatccgaattcacgccacgcacggccttcacaccttcgcgcgtgaccggctggtggtaggcaatgacggcaagggtctcgagcgcagcctgcgagagcttcctcgtgtcccagctcaggacatagcgctccacgatatcgtggtaggcaggatgcgtgaagaggcgccagccgcctgcgacctcgcgcagctggaagccacggttcgcgtcggcatattctgcagagagctcggcaagcacgcctgccgcctctcctggctgtatccccaggatctttgcaagatctaccgcagagagcggatctgacgacacgagcaggatcgcttcggtcgcacccttcacggatgcatcgtcgagatgtgcgagatcttccactatgagtcctcctcgaattcatcgagatcggttgcagggtcgtaggctggagcgccttcgaccctggagatctcgatcggagcgaaattctcttcctgtctgacggtgatggagccccggtgatagagcgtgagcatcgcaaggaaggtcgcgacgaccttctccgggtccttcgagccctcgaggagctcgtcgaatgagcagtgtccgcgggagcgcgtgaagcggtcgaccgatgccatgaccagagcgagcgagatccgcttcggagcgatatgctccgcctcgagcaggaaatgctcgtggcgcgaatcgaggtcggcacagatgaccgcaaggctcgatatcgtgatgcccttcgtatagtcaggcatgaggcccagaaactcggggtcggggcctgccgtctcggcagcatcctgctctctgcctccatccatgcgcgacgagagtgcagctgccgcattcctgatctgcttgtaggcaatgagacggcgatcaggacctcgcgtgcctgtgtcggatcgaggtcttcgagccccgtatcgtcgaggtcgtcaggatcctggactcttgccggctcttctggacaagggatgccgccttgatatccagaagcgtcgaggcgacaaggacgaagtcgcttgcgacatcgaggtcgaggtcgcccatgcgattgacctcttcgaggtactggtctgcgacctcagagatggagatggcgccgattgcgaccttcttcctcgtgacaagctggaaggaggtcgaacggtcccgaatacccttgcgtctgacacggaacgacacgctctcacgcccccagaagcaggctgtagagcctgtccgccgtgacgtcgaggtagatgccgagcggactgcatggaacaccatgggcacgagatgaggacgatgatgaggatcggcatcgcgtactgctggatcgcgtagtacttcggtgcgtgcctcgccgtgaagcagcggcatgatgatcttcgaccatcaagcggcggcagcggaatcaggtggaagaacgcgagcatgaggttcacgtagacatagctcgagaggatgtagagcagccagtacgcgcggccatagagcgaaagcggcagcaccggatagaggatgtcgaagagaagggtcccgatgagcgcctgcaggatgttcgaggcaggccccgcaattgcgaccagcacctcatcgcggtcgggatgcggagattgcgggggttgtagggcaccggctttgcataggcaaagaccggccctttgaggaggaccatgatgagaggcaggacaatggagccgaagggtcgagatgcgccttcgggctgagcgtgagcctgcccgcattctttgcgcgtcgggtctccgagcttgtaggccacccagccattggcaacttcgtggaccatggcagagaacatcaagagcgcgacggagatcgctgccgtgattattgtcatcagctgatacatcgtgccatctcctccatcttcgtcgagggctagatgcgccgggaaagccaggcgcaaaggtgcgagagagcagtcgaggctgctgccatgatcaggaagtcgccgcgcaggcttcctcctgtcggaagcggaaagacgagcatgccgcgccagacagaaggcacgaaggctgcagccgcattcgtgaatccgaccagcaggaggcggttcgttcccgcatagagcgcaacagcaagaacgatagccacccatatgattgccatgaccctgaaggccaaagacaggatagggagcgctctctctttcactcctggcctgcctcctcgatcttcgtcgagagctcgagccactcgtcctcgagggccggaatcttcttgctgagcgctgtgtattccttcatgcactcatcgaacttcttggcatcgttgtagagctcctctgatgccatctcagccatgagctcgtcgtagcgcttgcgggcaggctcgagggctgcctcgacctccttcaggcgcttgcgctccttcctgagcgcacggttgagcgcatttctggcctctgcctcggcgcggcgctgctccttcgtcttcacgttgcggcccgtctgctccgtttcaggcgcaggcgccttcttctgcggagccgccacgacgccggagccttcctcatcctcggcggcacgtgcctcgagctctgccttcttccagaggtagtactcgtagtcgccgtcgtagatcgtgaccttgtggtcgcggacatcgatgaccttgttcgcgacagcacgcacgagatgctcgtcgtggctgatgaggacaatcgtgcccgggaagtccttcaaggcctcctcgaggacatcgaccgaatcgatatcgaggtggtttgtcggctcgtcgagcagaagcaggggatctggcttcacgagcatcttggcaagtgccagacgcgcccgctcgccgccggaaaggacgctcacgtgcttgtccacatcgtcgccgtggaagaggaaggcgccaagcaggcgcctctcttccgatgtcgtccagcccggtgccaccgcatcgatctcctggagcgccgtatgcgcaggatcgagctcctcgagctggtgctgggcgtagtaggactccgtcacgttctggcccagctcgaccgtgccctcatcgggcgtgagcttgccattcatgagcttcatgagcgtggacttgccggcgccgttcgggcccacaagcgccacatggtcgccacggtagaggctcacattcacatggtcgtagacatggttcgtaccgaacgatttcgcgacatccttcatagcgatcacggtatcgcctgtgcgcggaggatcggggaacgagaagtggacctgcttctggccttccggcaggatcaccagctccttcttgatttcctcgatgcgcttcatgcgctcctgcgcctgcgctgccttcgtcggcttgtagcggaacttgtcgacgaagacctgcatatgggcaatctcgcgctcctgtgccgcacgcttcgcacgcatctgctcgaggttgtcctcacgctgcttcaggtacgagtcgtagttgccgacataggtctggatcttgcggttctcgatcgaagccacatggctcacacaggcatccatgaaggagcggtcgtgcgagacgatgaggactgctccatcatacgaggagatgaagtgctcgagccactggacgctttcgaggtcgaggtggtttgtcggctcgtcgaggagcagcaggtcgggatggcggagaaggagcttcgagagcgcgatgcgcatctgccagccgcccgagaagtcgacggcaggcttgtcgaagtcctcgacaggaaagccgaggccagcgagaatctggcgggctcgggcatcgagctcatagccgccgaggtgctcgaagcgctcctgggcatgtgcatagtcctcgagcatatggtcgagggcaggcccttccggcgtgttcgagatctccctttcgagctcgtgcacgcgcttctcccagtgcctgatctcggttgccgaatcgatgacctcctggagagctgtcttcgtgccggagatcttcgtctcctgctcgaggtagccgaccgtcgtatccttcgcgaaggagactgttccctcatcaggcgtctcctgacccatgaggatcttgaggaaggtggtcttgcctgctccgttagggccgacaagcgcccagcgctcgccagcattgagctgcaaggtagcggccgcgtagagaacgcggccgccgaatgactttgtgatcttgtccgcaagaactatcacgtggaagactcctacttctgcacggtcagatggattgcgaatccagcaatctcatgcttgaaatacacgaggtatgtcgagccgtccggattcttcacgcgggaatcctcgttgatctcgaagccacgggacttgaaccacttctccgcagcgtcgatatcgtccacatggaagccgatatggcccttcgtgccacggccacgaccgggacgcatgacctcgataaggtcgctcgcgaagacggaggccggcgagatgacctgacgggcaaggcccataaggtcggagaattccttcacgatggcctcggcctcctcgtcagacgaggcgttgatgccgacatgtgccacatacatgccgaagagctgcttcggatcttcgctttctgccatagcgtcccctttccggactttgccttaaccaaagagtataaggtacggaaagcacgtctgcgaaaacgccacgtgaagtacagggaagcgcctggagctgcagctttgctgagctctctcagccctcgagatgctcccgcacggcacgtctcgtctccggcatgatgccgcaggagtcgagataggtatcggccgatccatatcctgcaatgagcaggtcccaggtctccgatatcgccttgatgcggctcttgagctcggggcgcacgcgcatcttctcgggaggctttccggacatgaccgccttgtcgacctcgcgggcgccaccgaaggagtaggagtagtcgcagacgatgtggtcgcggtcgacgccgcagaggcccaagaggagcatggaggtcacgccggtcctgtccatgccagcggcacagtggaagagcacgcaatcatctgcgcctgcctctgcgaagaactcgaagatctccttcacggcaggcttgttcgcgagtatcgtgcagtaactctcggcgagatatcccgcagcacccgtgcggggcatgaggtagggatcgctcatgttgtagtcgaagagcggcacattgatccaggagatgtcaggatcttctgcaagcgggccatcgcctcgggccacttcggcctctcctctgaggtcgacgacatgcgtgacgccgtagctcttcaggaagtcgcagtcggcagctgtggctgtgtccaaggcacccgaacggaggaaccggtgaggtagcgtgagtccgccttcagcaggatatccggcaagctcgcggaggttgaagatcgatgtcgcatcctcgaggccgaaggcatcgctgtcctgcgtgccggattccgcattcttgccatgccgcttcaggaactcgaacatcggcagaccatcctttccacaaaaaagaggccagcagcgctggctgccggcctcgatcttctggtgggcccagcaggattcgaacctgcaacccagggattatgagtcccctgcgctaaccgttgcgccatgagcccgaaatagagaaaaaggcgacggcctgagccgccgccctcatattcctggtgggcgatgctggattcgaaccagcgaccccttccgtgtgaaggaagtgctctacccctgagccaatcgcccgtgcgggagtgatattagcagattcagcctcttcagtccatccagccggatgaaatgcagcgcctcgctgccctcccatagcaagcaggccactaagtggcctgcggagtaatcatggtggagaataggggattcgaacccctgacctcgtgactgccagtcacgcgctctcccaactgagctaattccccatgcggtgcgggaattactataacagaagctcgattccggtcaagcacgattttcgcaagtttgcgccttcacgctttctcgacatgccggaaaccgctgtccagcccatccgctcccctgcgcgtgatgcccttcaggcgctatttggcccgaacacggcttacgcacaggccaatgtggtacaaggacctagaagctcgattacacctgaaaggaatcatcctatgacagagaagcagaagttcctgaagatctggagccttgccagcatgttcgcaggccttgtccttgctatcgtcggtatcgtcgctgcctgcctcggcaatggcatggcatacggcgtgctcggcgtggacgggctcgtatgcgccatctccggcttccagggagcacgtgctgccaatacgccgtctcgtacgaagggcatcatcccgatctatatcgtggcctgcgccctcggcgtcgtctctgtcatcctctatgccgcaggcctcttcgcacccaatccaggtgtcgtcttccccttccttgccatcctcgtcctcgccgatggtctcacaggcgctcttgccggcaaccgcgtctatcaggaaagcctgaagtagcgctttcgcgaataggtacagaaaggcgcccagaagcctctgagagcttctgggcgcctctttcatgcgctgtatgtctgacgcagcgtctttcagtgcttaggcacgcttcgagacgatggcatccacgagctcgtcgactgcatcgtcgattgcaatctcctggcgctcgcccgttgcgcgctccttgatctcgacgacaccgttcttgatgccacgcttgccgcagacgacctgatacgggaagccgaagagatctgcctcgttgaacttgacgcctggacgctccttgcggtcatcgacgatgacctcgatgccatgctcgacaagctcgcctgcaagcttctttgcaatcggccacacgagctcgtcatgcgtatcgagcggcacgatctccacctcgtagggagcgacgctcaccggccagatgatgccgtgctcgtcgtggtgctgctcgacgatggcctgcagcgtcctgccgacgccgataccgtagcagcccatctggaacggcttctccgtgccatcctcatccgtgaacgtggcgcccatggtctcggagtacttcgtgccgagctggaagacctggccgacctcgatgccacgagcgatcttgagcggagcgccgcagtgcgggcagaggtcgccctcctttgcggtgatgaggtctgcccagttcgagatctcgaagtcgcgcccctgcttcgcatggatgaagtggaagtcctgctcgttggcgccgacagcccaccactcggagctcttgagcgtctcgtcggcgtagaccttcacgttctcgggcaggccgatcggcccgatgaagcccttcacaaggccatactccttgagctcatcgtcggacatcaggtggtactcgccgaagacatggcctgccttcacgtcgttcaggtcatggtctcccggcacgaagacgacgaccggacacttgtcgccgtcgacgagggcaagcgccttgcgcgtgcctgcctcggggatcttgaggaaggcagcaagatctgcgatggtgctgcaggagggcgtctctaccttctcgagctctccagcctcgccctcgacgaggctgatcttggccgttgccgcctcggtgtctgctgcaaagccgcaggcatcgcagtagcagatctcggcctcgccggcatcggcaagcgccatgaactcgacggaggtgtcgccgccgatctggccggagtcggccacgaccggaagggccctgagcccgacacggcggcagaagcttgcataggcttccttctgctcctcgtagcactcgcgcatggactcgacgctcgcggagaaggaataggcatccttcatgatgaactcgcgggagcgcatgaggccgaagcgcggcctgcgctcatcgcggaacttgtcctggatgtggtagagcatgacaggcagctgcttgtagctcttgagctcgttcgtcacgagatcggtataggtctcctcatgcgtggggcccagcgcatactcgtggccatagcggtccttgagacgcatgagctcggggccataggcattccagcggccgctcttgcgccagagctcggcgtcggtcaggatcggcgtcatcatctcctggcagtcgatcttgtccatctcgtcgcggatgatgttctcgatcttca

SEQ ID NO: 96 - DNA, 19040 bp, Unknown
  Metagenome-assembled genome
gtgtattcgaccttgtcgccgagacggtagttggcagcgtggccgttgccctcctccatcatgttgacgacagcgatgacatcctggccgaggctcgtcatgtgcaggtgcaccgtggagcccatcatctcggacacatcgaccgtgccctcgaggcgcgggccatccgtgacgccgagcgtgaggtgctcaggacggacgccgagcgtgatggtctgggactgcacgtcgtgggaagcaaggttggcagccttgtccttcggcaccttgatcgtgacatcgccgagcttgacggcgtagtcagcgccggagcggacgaggtcggcgtcgaagaagttcatctgcggcacgccgatgaagcctgcgacgaagaggttggccggcgtctcgaatacctcctgcggggtgccgatctgctggacctcgccgtccttcatgacgacaatgcggtcgcccaaggtcattgcctcggtctggtcgtgcgtgacgtacatgaaggtcgtatcgatcttctggcgcagcttgatgatctctgcgcgcatctggttcctgagctttgcgtcgaggttcgagagcggctcgtccatgaggaggaccttcggctcacgtacgatggcgcggccgatagcgacacgctggcgctggccgccggagagggccttcggcttgcggtcgaggtactgggtgatgcccaaggtctctgcagcctcgcggaccttcttgtcgatctcgtccttcggaagcttcctcagcttcagcgggaatgccatgttgtcgtagacggtcatgtgcgggtagagggcgtaggactggaagaccattgcgatatcgcggtccttcggcgccacgtcgttcatgagcttgccgtcgatgtagagctcgccgccggagatggactcaaggcctgcaaccatgcgcagggtcgtagacttgccgcagccggaaggtccgacgagcacgatgaactcgcggtccttgatctcgaggttgaagtcctcgaccgcgacgacgccctcgtccgtgaccttgaggttcgcgttgtgcttcttctccggctccttcttgccgaagtgcttcttcttggcaggctccgtattcggatagatcttggtgatgtgcctgaggctcacatcggacatgctacttaccgtcccttccatagaggtgagtcatcgcagcgaggcgctggacgagctcggggcttgcctggcccgggagcagccgccattgccaattgccgcccagaacaccaggaatattcatgcgtgactcagaaccaagctcgaggtagtcctgcatctgagccacaaagagattggcaatgctgctcatgccgccgcggatgaatccccagacgaagtcctcgtcggacttgatgcccaggtagtcgcacgccattgcgacatcttccggtgccgcctcgtgcttccaggcgatgagcggtggattgtcgtgcgtgccggtatagcacacgcagttccagatatggcaatggggcatgtagtccgatcccccatcgcgcgaatcgaaggcaaactcgagcaccttcatgcccgggaagccggaatcgaggagaagctggcgcactccaggcgtgggatagcccaggtcctcggcgatgaacgtgatgtcggggaactgctccttcaagagtcccacgagcttcatgcccggacccttgacccaatgtccgttgcgtgccgtcttctcgccgtaaggcacagcccagtacgactcgaagccgcggaagtggtcgatgcgcagggcatcatagagcctgcctgcacctgcgacgcgctggatccaccaggcgaagccgtccttctccattgcgtcgtagtcgtagagggggttgccccagagctggccgtcggcgctgaagtagtcaggaggaactcctgccacctcgtagggcacgttcttctcgtcgagctggaagcactgggggtttgcccatacgtcggcagaatccattgcgacatagatcggcatgtcgcccaggatcttcacgcccttggcatgcgcgtaggcgcggagcgcttcccactgcttgaagaagaggtactgcacatagatgtagtaatcgatatcgtccttgagctcagaagcgtagcgcttgagcgcttcgggcttcctcagccttgcatcctcgtctggccactcgttccaggcgaccatgccgaagtgctccttgatgctcatgaagagggcatagtcctcgagccaggtggaattggcctcgcggaactccttgacctcggcagcgtcgcgggaaagtccgcgctttgctgccttccggaggagcttcggcctcatctcatagagcagagcatagtcgacgcgcgccggatcctctccccaggagatgccctccacctcgtctttctcgaggagcccatctgcgacgagcaggtcgagatcgacgaagtaggggtttcctgcgaaggccgacggactctggtaaggggagtcgccgtagctcgtcggcccgacgggaaggatctgccaccaggactgcttggcgtcggcgaggaagtccacgaactcataggccgcctcgcccaaggtgccgatgccatgaggagaagggagcgacgatatcggaaggatgatgccgcttgcacgtttcatgagatgaagcctatcccttgactgcgccagctgcgacacccttgatgatgtacttctggcatgcgaagtagaagatgatgacaggaatgatggacatgaggatcagtgccatcgtggcgccgagatcgactgtgccgtaggagcccttcagatactggatctggataggaatcgtgcggtacttgttgatgtcaagcaccaagtacggcagaaggtagtcgttccagacccacatgatctcaaggatgccgaccgagatgagcgtcggcttgagcatcgggagcaccacgcagaagaacgtacggacgggtccgcagccgtcaatggcggcagcttcctcgacctcgagcgggatggacttgacgaagcctgtgaacatgaagatggcgaggcctgcaccgaagccgaggtagacgacaggaatcgtccacggggtattgagcttcagggtatctgccgtcttcgagagggtgaacatgaccatctggaacgggacaaccatggagaagatgcagaggtagtagaggatcttgcagaacttcgagttcacgcgggcaatataccacgctgccatcgagcagaagaacaggatcaggaacgtggagagcacggtgatgagcgcagagtagcctgcggccatccagaagttgtagttgccgaacgtgacgccggtgatgaagttctgccagcctgcgaaggactctgccgtaggcagtgcgaacgtatcggtcttgacgaaggtattgagcttgaacgagttgatgacgacagcgacgaccgggagcacccagatgaagcagatgatggcgaagatggccgtgagggctgtctttccgtgcttttcggacgtgagcgtctgctgtgcttgcttcattactgctgcacctccctggagcgggtgtacttgagctgtgccaggcccatggcggcaacaaggatgaagaagatcacagccttggcctgtgccacgccgcggttcgcagcgcctgccgtatagaacgtgttgtagatgttcagagccatcatttcggtcgtgttgatcgtcgagccatcggcgagctgcgtgtacggcaggccgcccgtgagtgcgaggttctgatcgaagagcttgaagccgttcgtgagggtcaggaacgtgcagatcgtgatggacggcatgacattcgggatgatgaccttgaagagggtctgcgccttgctggcgccgtcgatcttcgctgcctcaatcatgtcttcagggacagcctggagacctgcgatgtagatgatcatcatgtagccgatctgctgccagcacatgaggatgatgaggccccagaagccgtacttcgtctccaagaggatcgaggtaccgtactgctgcaggatgccgtcgaagatcattgaccagatgtagccgaggacgatgccgccgatcaggttaggcatgaagaagatcgtgcggaagagcgtcgatcccttgatgccctgcgtgagcacataggcaacgaagaaggcaatcacgttgatgaggaccaaaaggacgattgccgtgagcgccgtgtaccagaacgagtgctggaacgactggtcggtaagcgctgcagcgtagttgccgagaccaacgaactttgcattgttcgtcgtcttgaacgagcagaacgacagatagatgccctggatgaacggccagacgaatccaatcacgaaggcagcggtgaccgggaggacgaagagccatgaccacttcttcgtggcacgaatctgcgaattctcggccaaagccttgcttttcatatctcactcctttgcttggaacgtaagaggggcgggaaccaggcgcgaacgcgtccggctcccgcccttgctgagactgattcagctggccttagccattgaccttctgatagttggaagcccagccatcgacgaaggcggtcttgacgtcagcccaggtcgtgtcggaaggatcggccgtgtaggagttcagagcagagacgagagcggcacggtaggcgtcgacgttcggctggaagttcgttgcccagtccatcgtgtagcagcccttgtccgtgtactcagctgcgttgttgaggtaggggttgtcgccttccggagcgttcttgtacgggaggatgccgaggttctcgaccatggtcttggaagcgtcaggatcggagaccagccagaccatgaagtccatcgtggccttcttgtcctcgtcggaggcgttgtcgttgatggcccagcagttctcggtgccgcagttgaggccggcgttctcctcgccgtcaacgccgcagtagtacgggatgcagcaggagtttgcaaccttgcccttgaagtccttgtagccgaaggagccggtgaagatgaaggccgccttgccctctgcgaactcggtcaccgggtcatggccgcccgttgcaagcgtattcggctcgacgagggagttgttgatggcgaggtcgaagaggttcttgtagttcggcaggtacttgccgctgatcgtggcaggagccttcgtccatttggagccggaatccttctcctcgtagaagtactcgaggttggcaaggtggccggtgacacgccaggaagcagaggggtcgaggtcggtagcgacgaaggcgtcgaagccgagcgttgctgcgttcttgtggatgtcctcgacgacggtcttgagggaagcgaagtccttgatgtcgtcgacgctgtggcctgccttctcgacgaggtccttgttcacgacgatgccgtagcactcgtagcagtagccgatggagaccagcttgccggactcgtcgtagaggttgtagtcattcgtcgtgagctcgtttgcgatgggggtgtcggagaggtccattgcgtagtctgcccactccttgacgccggcctggttgccgatgacgaagagggtcggagcctcggacttgtccatctcggacgtgagcgtctgctcgtaggtgccggaagctgcggtctggaccttgaccttgacgttaggatacttctccatgtagtcggaggcgagcttctgagctgcggtatcgagctcaggcttgaagttcagccaatagacgttgccggaacggtcgtcggagttggagctggaagagctcgagctcgaagaatcggaagagctggagttgccgcaggcagcaagaccaagagctgcgagacctgcgccggcgccaccgacgaacgacctacgtgtaatcgacttcataggaactactcccctttctttgtccgccctccctgggcggatgccctacaacgacttaacggttccaccaagccgcggagtcgtctccaaccggatatgacggttgccagcacgtccctcaagcacatccaccagaatgcgcactgcttcctctcccagacgatccttgggctggcacaaggtcgtcagtgtcgggatgaggtaattggatatctcgatgccgtcgattgcgatgaccgagacgtcatcgggcacgcgctttccggcatcgtagagggccttgatagctgcgatcgcgagcgtatctgcgaccgcgaagagtgcggtgaaatcctcgtgcctgtcggcgaagtccttcacgcacctataggaggaagcgagatcgaagtctgccgcctccaggacgagatcgggatcgggctcgatgcccgcctcacgcagcgccttgcagtagcctgcatagcggcgctcggagatggagtggtcttccgggttgtccagaaggatcgcaatccttctgtgtcccctcgagaccaggtacttcacggcacgctcggcctctgccttgtcgtcgattgcgacggaggagtagctcgagcgatcgaggttgccgaaatggttcgtatacgtgcagcacacatacggaaccgtgagcccctgcatctctgccttcgtatagtcgtagcggccgccgaggaagatgacgccgttcaggcgcttggactgcacgagctccgtggcggccctgacctcgtcgtcggtcgtggagacctggtgcagcaccatcgtgtagcccgctgcctcgcacccatgctcgatcgtgcggatgatgggcgtgaagaagggattcgagatgccacggaccacaaggccaatggcattgacctgagtgcgggcaaggtctctggctgtgctgttcggcgtgtagtgcaggtcggacacagccttcatgaccttgtttctgacctcgtcggagacgtcgggatggttgttgaggacacgggagaccgtagagaccgaaacgccgcagtaggctgcgacatccttgatggtcactgctctccccttccatccgttacgtccaccgattcgtgaacggttgttcctgtacgcatagccgtttctggtatcgtttctggtagcgttaccggaaccgttgtctacataaaaccaccatcccctcattcggtcaatgcatgtggggcgaacggtattttatgagcggcgaacgttcggaaaagattctgcaaacggtctgcaagggtccggtcatgtccctgcagcgcaagagagaggaaggactgcatggctgaaagcacaccttctgccctgaggcagaagaccatctattccatcttcgtgagaaaccatacgaaggagggaaccttcagggcggcccaggctgacctcggtcgcatccgggcgctcggcacagactatatatggctcatgccaatccatcccatcggcaaggttgcccgcaagggagcgctcggcagtccctacgcaatctctgactaccgtgccatcaatcccgagtacggcacgctcgaggacttcgctgtcttcgccgacgcggtccatgccctcggcatgaagctcatgatcgatgtggtctacaaccacacctcccccgactccgtgctctggcagacgcatcccgagtggttctaccacaagccagacggcacgcccggaaaccatgtcggcgactggtctgacatcatcgacctcgactacacgcacacagagctctgggactaccagatcgagacgctctgccagtgggcacactacgtcgacgggttccgctgcgatgtagcgccgttcgtgccggtggagttctggaagcgcgcccgcgaggaggtcgcaaaggtccgtcctgactgcatctggctcgccgagacggtacacgcctccttcggcgaccttatgaggagcaaggggctcagctgcgccacggacgacgaggacttcgaggccttcgatatcgagtatgaatacgatatccgcgagctcttcgaggacgtgctcaaaggcaagaagccgctctctgcctgggcagaagcgctcaatggccaggagacgcgctatcctgccaactacgacaagctccgcttcctcgagaaccacgatacggagcgcatcgcttccttcgtgcacgacccgaaggcgcttgccgtcttcacggctcttgtcttctatctcaagggcacgaccttgatctacggcggccaggagatcggctcgaccttgcgcccctccctcttcgataaggacacggtcctctgggactggaggcgcgcagagctcgacggacgcgacttttccgaccttatggcacgcatgtcgaagatcgcacacgaagtcctcggcggcgatgacacgttccaggcagctgcagacgacgagcggggcatcatggtctgccgccgcgatggcttgcacccgacgcttggcatcttcccgctcaggggaagggacgcagaggttgccgtcgatcttcctgacggcacctatcgaaacctcgtcacgggccagcctgtgacggtatccgatggcacggtctcccttccgggctgcgcctgcatcatcgagcgctaggcagcccatagagctacgcagaaggccccgcacgccacaaagagacgtgcggggccttctcttgcctctctgtcgctcttactgctcgcgcaggtagctcaggaacgtgagggcagcaagcgagagcccctgccccaggcggtgcgccatatacatcgtgcggaaggcgcggatctcgagatggtggatctcgagcgtatcggggagctttcccaaggcgagcatcggcagaagcgagatgcccaagcctgcatcgatgagggcaagtatcgcattgaagtcagacgtctcgcagcgcacgaccgcgtgcctgagctccttctggagaagaggggccgtctcggtatctgcgatgaagcgctcgtccttcagaaggtcgatggggatggagctgcgtccctctccgaagtgcccgcgcttcgagacgacgacgatctcatccttgtggaagagcttcgaggagaaggaagcaggatcgagcttcttcggcacgaaggccacatcgaccgcaccctccgtgaggagcttctccgcctcgccgtacgtcgactccgtgatatcgatctcgatgttgggatggtcctcggcaaaggcgccaagcgggcgtgcgagcttccaggacacgattgaggagggggcagcgatgctcacgtttcccgactcgaggccattgatatcgtcgaccttcatggtgaggcactcgaacgactgcacgacggcgcgtgcctcgggcaggagcctttccccttccttcgtgagccttaccgtgcctcccgccctctcgaacaggcgcacgccccagtcctcttcaagcccctgcaccatgcggctcaccgatgactgcgtatagccaagctgctgggccgtacgggtgaagcttccgcattctgctgccttcacgaatgcctggaacttgtggatgttggcctccatgcaatccctctcattccgcttcggctccggcatgccggagcgcagctgcgcattgagagcgccatgggctacaggccgcatccgcactcctgcgtcttccaagagtctatcttctaccacggaatggccggcatgcagtttcaatctctggcacgggtctcccgctgccgttcacggcacaatttccaccgtccgggatgcagaacccatagtcttatggagacaaggttcacacagccgtctctttggagcatatatctgccacatcggagcaacgcaaaaaggccgggcctccgaagaggcccggcccacaccatcgatctgtttcgggacctagattcccaggggcaccttacagggcgcccttgatcatgatgtcgccttccttcatgatgacgtccatcttgtccgggtcgaggtcgcggatctccttcagaggatcaccgttgacgacgaggatgtcggcgagcttgccagcctcgacggagccgaagtcgttctcgtggtgcaccatcttggcgccgttgagggtagctgcgacgatggcatccatgttcgggatctcgcagtgctcgacccaggcgtatacctcatcgagcgtcgtgtagccgtacggcgtggagaagctgaaggagtcggagccgaccgtcagcgtgacgccgagcttgtaggcgcggttgaggtttgcataggagcgggcaatgcccttctctgcattgttcttgccaggccacttgtcgagctcgggcgtccactcgggaggatacgtcgcgtaccaggacggcaggaagccgaccgtcggcgtgaagaacgtaccctgctgtgccatgaggtccatggtcttgtcgtcgagctcgaagccgtggatcagctgctctgcgccgaagcggacggagtcataggcggcagagatcgagttgtaggagtgagaccagaccgggatgccgaccattgcgcactcgtcgcagacagccttgatctcttccgtgctcatgagctgggcacgtcccgagtcccagcgccagatgccgccgccggttgcccagatcttgattgcgtcagggttctcgcgcaggcgcatgcggatggcgtggcggagctcccacggaccatctacctggtcaccccaaggatggccgttcttcgacatctcgaacggaagcttgtggcagtcgccgtgtcctgccgtgcggcagaagccgaggccggttgcgaagatgcgcgggcccttcatgacgcccatgttgacgaggtcacggatagcgatgccgttgcggccgatctcgcagaccgtcgtgaggccgtgggtgacggcgtcgtaggcctgcttgacagcgcatgcctgcttctgtgcgaccgtctcgatgacccagtcattgtcgttgtccgtgaggttgccggagaagtggatgtgggtatcgatgatgcccggcatgaccgtcttgccggtcgcgtcgatgatctcgtacccctcaggaatctccgtggcctcgccggcatacgtgatcttcttgtcgtccaccaggacaagggaatcctcgaccggagacgcgccggtgccgtcgacgagtttgccgcccttgatagcatactttgccattgcaaatcctcccaatctttccaaccacgtttcttgaccagctatgcgtcgccttgtggcgtatgcatacgtttggagctatgcagcgtgctttgctgcggggtgcgtgtcggcttccgtgtgcttgttgccgaaggcaacgaggatgaagacgccgatgaggatccaggcacccgtgataatccactcgaccgtgtcgagggctgcagggctcataggcacgaccatgaggccgatgatgatgaggccggcgatgatggcgcaggcgatgatgggcttgccgccattgaccttgtagggcctcggcagatccggctcggtcttgcgcagcttcaggcaggcgaagccggccatcgtgcaggcgaagatgaagccgagcgatgcgacgttcgtgagcggcacgagcatgttcctgccgaggaaggggccgacgagcgtcagcactgccatgaccgtgttggccttcttcggagcgcccgagacaggatcgagctctgcgaacgaggaggggatcatttccttcctgcccatggcgagcatgaggcgggcagaagcaccgaagaacgagttcatggggccgagagggccgagcgtgccgatgatgagcatcgcgatgtagaagaagatgttgatgcgctcgaggacggccagggcaggcacggaggacttcacgaactcatgccagtcgatgatcgtgccgaacgagtagatgcagacgaggtagaaggcacccgaagcaagaagcgcgatggccgggatcaggccgaacttcttccagtcgaggttcgcggaggcttcctccgcctgctgcggaatcgtgtcgaatcctgcatagaagaacggcgtcatgaccaggactgcgacgatgccgcccagaagcgaggtcgcctcggtggagctgccgcctgccgcgtcatgcacctgcgagaacaccggaagcgcattcgagggggatcctgtcatgaacgagatgaccatggccagcaccatgccgcacagaagcgccttcgtgaggaagctcgagagcttcgcggctgcgccggcaccatggaagttgaggtagatgacgaggatggcagcagcgagcgcgatgacggtcggccagagatagacatcggcgccgaggatcgtgtagagcttcacggagcgcagccatgcaagggccgggaactcggcgaagcggtccgtcaggagcgtggagatcgcgatggcctcccaggggcacagcggtgcattgccaagcagaagcatccagccggtgaagaagccgagcttgcggccgaacgtgcggtccacatactcgatgatgccgccggagatcgggatggctgccgtcagctcgccgaagcacatgccgatcggcacgaggaacacggcaccgatcgcgaatgcgatcatggccggaatcgggccgccgcccagaaccatccagtcgcctaccagcagcacccatccggttccgatgatagcgccgaagccgatcgtgaagaagttgaagagcgtcagctccttcttcatgcccccttctgccggtgcagtctctgccatatctctctcccctcgcatgcactcgccctgaaggcgaagatccggtttgcgggcaagatgtgcccggtgccttgtcttcggcacaattcaatgttcggagaatcgcctgtatttcgcaaaggtttcggggatgctgcagggccgagagggagaatgcggaccctgagcggattatgttcgcaaaggctaacatagcaatgcacgctaggggtcattcggatgctacatcaccgcaggtagatgcctatatatgagatgccgttcatccgttttgaaaaaacggcaaacggttttcagattgcgaacaggaacgcccgaaatatgagcagaggcccctcccggcgcaatgtttgccggaaggggcctatgaagcaaaacaggatgcagctttacgcaaactgggagcggtagagctccgcatagacgccatgcgcccgcagcagctcttcgtgcgtgccctgctccacgatcgtgccgtggtccatgacgaggatgaggtcggcatcgacgattgtcgagaggcggtgcgcaatcacgaaggacgtcctgttctccatgatggcctccatagcgcgggtgatggcctgctcggtcctcgtgtcgacgctcgaggtggcctcgtcgaggatgagcatcgcagggtctgcgagcatggcgcgggcaatcgtcaggagctggcgctgtccctgcgagatgccttctccgtctgctgtcaccatcgtgtcatagcccttgggaagcgtcctcacgaagaagtccacatgcgctgccttcgccgccgcctcgatctcctcgcgcgtggcgtcgggcctgccgtaggcgatgttctctgcaatcgtgccctcgaagagccaggtgtcctggagcaccatgccgaactggcatctgagctcgtggcgcgggatatccctgatatcgacgccgtcgagcgtgatggtgccgccgtctatctcatagaagcgcatgaggaggttgatgagggtcgtcttgccggcacccgtggcgccgacgatggcgaccttctcccctggctctgcgacaagcgacacgtcgtgcatgagcgtcttctccggacgatagccgaagcgcacatgggagaactcgatgcgaccacgcaccggctcgggaagctcagcgggcttctcggggtcaggcacgatctcgtcctcatcaagcaggtcgaagacgcgctccgctgccgccaaggcaccctggagcatgttgaccgtgagcgagagctcggtcaagggttccgaagcttccgtcacatactggaagaaggcctggaagacgcctatcgtcatgctcccctgaagcagcatgccgcctgccatgatgccgatcgtgacctgtgccaggcgcacgatgaagcggatggcaggagagatcgcattcgtgaggaagtcggcatgcgcgctctcacgggcaagcgcctctgcctccgcctcgatcgtagcctcggtcttggcctcgaggccataggcggcaacgacggcacgtcctgcataggcttcctcgacagagcccgtgagcgtaccgagcagtgcctggcgctttgctgccacatagatcgtgcgtcctgccacgatctttgtcacgaggaacgtggctgccgcaaaggcgacgaagacaagcgtcaggaagatgttgtaggcgagcatcatgatcacggagcctgcaagcatcgtggccgcgatgatgagctggaggagcccgcgctgcaggacctcggagatcttgtcgaggtcgttcgtcgcacgcgagatcgtgtctcccggcttatgtgagtcatagtaggcaagcggaagacgcccgagcttgtctgcaatgcgctcgcggagcttgaggttgaggcgctctgcgaaggactgcatgaccagggactggagggcataaaaagcccaggcgaaggtccagatgccaaggtaggccaagatttcctccccgccatcgccgatcctcacgacatagacctctcctgctgcaaacgcagcctggatgttcttccagatgaggtccacaaggcccgccgagtaggcgaccgcccagagcgttcccaccacatagaagatggcagagatcgatgccacgacaaggcgccacctctggtctcctgcaacctcccagagacgcttcgcggtctcccaggggtgctcgggcacctcctcttcgagctcgtcgtcggaaagggaaagagccttcttctgctcttcatcctttcggccttcatgcttcttctcagcgcgctgcatctgcgccacctcccctctcctgggactcgacaatgtctcgatagtcctggcagctctccatgagctcgtcgtgcgtgccgatgccggagatctcgccgtccttcaagaccacgatcttcgctgcatcgcggatcgtcgagacgcgctgggcaatgatcaggaccgccgcatcagaaagctcatgcgaaagggcatgccgaagagctgcatcggtcttgtagtcaagtgccgagaacgagtcatcgaagatatagagatctgccttccttgtgagcgcacgtgcaatcgccaggcgctggcgctggccgcccgagaagttcttgccgccctgggcgacaggagctgcgagcccttcgggaagctctcgcacgaagctggcctgcgcgatatcgagcgcatgccagagctcgtcgagtgtggcctcgggtgcgccgtcacgcaggttctctgcaatggtgccgctgaagagccaggctgtctgcggcacataggcgatgcgggacctcagatccttctgcctgatgttcctgatatcgtggcccaggaactccgccttgccttccgtcacatcgtggaagcgcagcaggagctttgcaatcgtcgacttgcccgatcccgtattgccgatgatggcagtgacagcaccgcgcggaatcgtgaagtccatgtccttgagcgtatcctccgaggcatccgcaaagcggaaggaggcatggtcgaaggaggcgacgtcctggatgcctgtgccatcgagctcttccggcgttacggggtcctggatggcaggcacagccgtgagcacttcctgcgcacgcgccatgcatgccatggctcgaggcatctgcagaagcgcgaactgcgccatcatcgagaaccagaggatgaggatcgcgtactgcacaagcgccgagatcgagccaatctgcatcgcatgggcgccgacacgatcggcgccgagccagaagatcgcgaactcgacgaagttcatgaagcagaagcaggtggcatccgtgattgcgaagatgaagttcacgcggatggcgtttctggcatagtcctcgaacgtctcgtcgaggcgcttcttggcatgttcctccttgccgaaggcacggatcacgcgcgtgccggtgatggcctcgcgcaggcgcgcgttcatgcggtcgatgaagccctggagccgaaggaagatcggtgccgacttcttgatggcaagggcggagattgcaaggatcacagccgtcacaagaaggaggagctgtcccatcacggcgtctgtcgaataggcaagcacgattgcgacgacgcaggtcaccgggaagggggcaagcatcacgaatgacatgagcagcgtctgctgcacgacgttggcatcagagagcgtgcgcgtgatcatggagcccgtgccgatctgggcaaactccgtgccggaaaggtcgagcgacttcttatagaccgccaccctcagatcgcgtcccacattggcagcaaagcgcgaggctatccagtatgaggcgacgcatcctcccgagcctatgaccgaagcaagcagcatggctgtgccatggtggatgagctcaggcgttcctgccccctcaatggcagcattcatgagagcagagagctctgtcggaatgaagagcatgccgcagatatcgcagagcagaagcacgagcgcagctacagccatccctctgtagggacgtgccagcttcacgagaagcgcccatgaggacttcctctcagcggctttcgtcatttccatcttctgtctcctccttccttttctctctcagagcatcgatctgacggtcgattgcctccgcataggccccgacgaggcggacaagctcttcctggtcatgggccgaaaggcctgcaaatgcccgcgtctctgcctccatggcaggcacgagccgctcctcgcagagggcacgtcccgcttcggtcaggagcacgaccttgcacttgcggcttccctcctcgaactcgaggcgcacgagcccctttgcctcgagcgacttgatagccgtattgacggtctgccgcgagtaggcaaaggactgcgcaagcgagcgctgcgtcgccttgccgccgcagtagacgatctcatagagcatccagtaggcagcatcagacagcccgcagccccgtgccagctcatagtagaggcggtccgactcgcggtagagcacgtcgagatctcgtgcggtcggtgcgtgggcagtttcctgcccgtcttccctctccatcgttcctcattttcatccggtttcggacaatgcggaaggtacattaatccgtatccggacaattgtcaatgagctgccgagattttcttgaggttcttccgaactccagaaatcccgattccggtgtcttgccctggcctcggtatatgcaccccgaatgagggcacgtaatctgtcagaagaagatttcaataccgcagcgccgctgcggctggaggtgcaccatgaacggaacaatgctgcagggattctcgtggtacctcgatgcggatggcacgcactggcgccgcatcgccgaggatgcgcagctctttgccgacaatggcatcacagccgtctggctgcctccggcctacaagggctctgccggcggggtggatgtcggctacggcgtctacgacacctacgatctgggcgagttcgaccagaaggggtctgtccgcacgaagtacggcacgaaggaagaataccaggctgccatcaatgccctccatgatgcaggtgtccaggcgctcggcgacatcgtgctggaccaccggctcggcgcagatgcgactgaagaggtcacagcccaggagatggactcgaggaatcgcgagaaccccatcgcagcgccccgccagatccaggcgtggacccgcttcacattcccgggacgccacggcaagtactccgacttccaatgggactggaacgacttccacgcggtggactgggacgaggccacaaagagaagcggcatctatctcttctccggcaagcactggagcgagcaggtcgaccaccgcgacaacggcaactacgactacctcatgggtgccgatgtcgacgagatgtatgagccggtctacaacgagctcctgaagtggggcagatggtatctcacggcctgcgacctcgatggcttccgtctcgatgcctgcaagcatatggacaggcagttctacctcgactggctcccgacccttcgctacgagttcggccgcgagctcttcacggtcggcgaatactggtctcccgatgtgggcgagctcgagagctaccttggccaggaaaaaatcatgagcctcttcgatgtgccgctccactaccacctgtttgccgcctcgagctccttcggcgatttcgacctcaggaccctcttcgaaggcacgctcgtctcggcagatccctggcacgccgtcacattcgtcgagaaccatgacacgcagccgggacaggccctccagtccttcgtgcagagctggttcaagccagctgcctatgcgctcatcctccttcgccaggatggctatccctgcgtcttctacggcgatctctttggcatgccgaacgacggcaacatcccggcggtccgcgagctgccacttctcatggagctgaggcagcgctttgcctatgggcagcagtatgactacctcgacgatcccgacacgatcggctggacacgcgaaggcgacgccgaccacggcatggcgggcctcgccgtcatcctcacggacaggaacggcggcaggaagcatatgtatgtcgggccgaaccacacaggcgagcattggtgctctgtcatcggccctgaagacttccccatcgtcggtgacgatggctgcatcgactgcacctgtgcaccgggatccatgagcgtctatctgcctgaacgtgcagcagaggtgctggcaaacgacacgatccgctacagccgcgatgcaccccgcgacctcacgaaggagctgccgacgcctgaagaagccctccgcctcgcagagaagttcgaggagagggcagaggacgacggcaccgaggcctagagccccatctcgtaccaggcgatgagatcgtccacgacgagaccgtaggacttgacaccttcggtctcgccgaagctcttgagatagctgttgttgacagaggttccgacctcttcgaacgtcccctcataggccgcatagtgctcctgcgagaggcgcgttctgccaatgagagcggcacaaggctttgtctgtgcggaacgtgcc

SEQ ID NO: 97 - DNA, 2694 bp, Unknown
  Metagenome-assembled genome
tggtttgaggagcgcagatgagcgcaggacatcctgcatgtgagggtggtacacgccagggccaggtaagtggtgagcccggtcggccacaggcgctgtagcacctgtggcagacgcgagaggaccttgtggcatctcgacatctggcagcacgagacgattgtacacggcgcagtgttgagggcccctaagaaacggcgtgcctgccgcaaggatactctgggaggtccggccgaagacgcatcacggcgctctttgaggcccaggcaataagggatggtactctttgtcatgagcgttgtggccataagcctctgcacgagacagcccgcgcgcatatggaggctgcttgggaaggcgacatcgaaggcaagggatgcagcagactattccggagtcgtgcgtgtgggtacagacgacaccgccaaaaggtgcgaccaaagctgtatcagcatcatggccgacctcgactaccagcgcacccgcgccatcacggaaggtaaaagacaagggagcagtgtgaaggctttgaaggagcacgcagggaccagacgaaggtcttagaggtcatacgcgacatggcaaagacatactcgctcaacgtggcggcgaagatgtcccaggccgcccagatcctggacagcttccatgtggtagcgactcttcgcgagggcgacagaccctgtgaggtgcgcgaagaggcgcgcgcctgccagatggcagaggcgatgcaggacgtctattcatgccccgacagggaatcggctgctgcagccccaaaccgcctttgcttgtagatgatgcactctgccgtggctaagatgaagagggtggcaggcacgcttagaaaggagtgggaagagatcttgaattggtggaagaggagtttgaccaattcgtttctcaaagggctcaactcccttgtccagtccgtccggagcgctgctaggggcttcaggaacatgtcctacttcgaggcgatgatcttcctcagactggaaaactcaacttctcggcctagaggcagctggcctgcactacccactagaaacgtcgaagagccataaaaaaggtgcggcatgccgcaccttttcaactcttcatttgtctttcatatcggtgttgtagaaaccggagcctttcagctcgataccgtagggttcaaatacctgattggcagtgtggccacatttcgggcatttgacgactggagtttctcccatcgggtgcttcacctcaaagacgttgccgcatgaggcgcacttgtagtcgtaacgtgccatatcgttttgcctccgaatgctatgtgtacagaattgattttattgactttaattccgaaagtactctacccagaaatggggcctttcacccgcgcaatatcgaaaagctcaaagttcggataccgtttagtaaccttttgcaatgatccttcagttcctaccctgcaggagtaccttgaacactcctaatcagactgtctgatagaggcaatctagctctgattcggaatagttcacccggtgtgcgacagccaaaaaaatctttcttgacaacaagctataccaggcttcggcatgatgtcttgaaaagagtaggtggcactgtagtccccttaagggatgagcctgcaggctacgctgttgtgccgctcagtagttcccttgttacaggaagtgtaggggggtggacacagcagatgagcgtcgttgagatgtcctttagctgtaagagtctacaaactaaaagctcttgtcagccgtgatggttttgaaagatagcgtagcggtgcttgctgcagtggccctgtagctttctgaaagcctgcatggcgcttggcagctgttgtatccaggacagggatggatgagacactcacggctcaaacacttatacaaggttaggtgtgccttatcgcctttggtcttgtggctcaagaccaaatcgtacccccttgcgcctaacctcaggcgtgcacattgtgtctttaggggcgcttttcaagcttgtggcgagctcttctttgttctggtggacaggtgacctgcgcttttaagcttttcaggcaggctatagttgtggatacccagcaagctttggtcagtgtaggtataaagtgtccttctacacaaactcccctgcagctcctgagcggttgcagcacgcctcaggtgagcagccaccttcgaagaggtgatcctctacacagtgtgtgagctaaggcctcttcagaagattctgttctgtgacaacagctcttgcgtctttccttacagatgccctgcccttgtttggctctgtggcgcactgccttagccgtgacagagctcgaccctgccacgtagctgatgaagcatacaggccgactgagctcttaggcagatgcttctcagcaaagccatccttccaggcagctctgtagtgtgacccgctcttcaaatgtagagtgcttttccttctgatgcgcctcaatggtagaatgagggcagtccatctgttatcttagatagattgttgtcgtgtggtgactcgcatgctatcagacaggttcagctggacttttcccattaggtgttcaagttgatagtacagtcgacaatgatcctttagttgctatagaaggaagtgtattcatgcgtgttgtaatcgtcgccggatcaccggaaccgagcagcccccggttcgtcgagaagc

SEQ ID NO: 98 - DNA, 7555 bp, Unknown
  Metagenome-assembled genome
aggcgattatgagccgtttaattccagtgatccgcctctgtggtcgatttcgttttctgatgtatgcctttcccctgcagcggtatggcttgtctggtccccctcgaacacagtaaggtaccgtcccgcctcggcctggtgtcgacctctatcgaaatacccggggctgtggttgatgcggtcatgatcatgtcctctatgcgtaggtattctttatcgatgtcgtgaaccttggacagtgcatcgtcatccattccgaaatgatgctgcctgttccataattagcgaatgcactgacggtcttgaggaaagactcggataccgaggccttgagttctcgatcattggactcgagcagtgccatagcagaacctcctatgtacctggaattgaccagaaaaattatctgttcaattataagtcattacatggccatactattggtcagtaattgaccagataaatttatctggtcaattagagtgagcggaaacatgaatccatcccggtggcaaggctcgagcctctgcctggcttcgtccatttggatgcgtgctaggatggtctagcgcctgaatgaaaagtggtggcctggctccggagaaggagcatagctctcagtccctgtgtgcttggttcaaggcctgcccgatcctgcgttctttcgttctcttggagggacccttgccagaaaatccatctgcgtcccttgagcggacctgtgcccgtcgtctggcgttcacgacattcttccgcgctctgggattccaggcaacctattttgtcggcatcatcggctcggcgacctatcttctgggctccgatgcaatggatgtctccctgcttgtcgtcctcttgaacgtcacgctcgtggcggcaggcgctgcagcaggtgtcgtcgttgaccgcatcgggccaaggaagacgatgcttgccttccttgctctcctgggtgttaccggcatcatcggcgtctcctttccgatgagcatggcgctcctcgtcgtcgtgaacgtgcttgaagggattgcaggtggcttctgcatgacggcaagctctgcctatccccgctatctcgcagaggatgcgacgaccctccagaagttcaacagctacaacagcacggccatgtgtgtggccgttatcgtcggtcccctgattggcggctggctcacagcgctcttcacgagccagatggtgtttgcggtccttcccatctcatcggcaatatctgcgctctttgtctggaacctgccggagctcctgcatcctgaaggcaccggcaagaaggaaggggagggcttctggaagcagcttctcgagggcatccatatcgtgttctcccatcctgtgattgcagcgctcttcctgatctatttccttggctactttgcttatggcgcattcgactcgctcgagtcgctcttctaccgtgacgtgctcagggtgggatccgagtggatgggctggctctcgtcggcagcaggcctgggatctacggtcggtgccttggccgtgctgcgcttctcgacgaagcggctctcgctcgagacgattgccctgcttctagtcgtgatcggtgtcgggtccatggtgtacgtcggcacgacgtcggtgcagattgccctcataggccagctcattgccggcttcggctttggtgccatgggtcctgtgaaggacacggtgctgcagaagagctgcgatatccgctatatcgggcgtgccacctcggtcctttctgtcggcatgaactctgccggcacgctgccgcttctcgttgccccattcgtggcaggtgccttcggtgtgcagacaacgctctttggtgcctctgccatcgctgccgccatcggcgccgccgcgctggcgtggacacacgccggcaatccgaaggcggcatagcgaaagcctgcggcacaggggcaggcgcacaggggagctgcaggcggcacggcatccggcaggaggtgccgggcagccgcagccaaagcaggcacgggaggcaggaacaaggaatcggccacgcagccagctggggatgcgcggccacggacagggatgcaggcctggcagagcgggaacaggaggaccccgagcggaagcggcaaagaagatgcgcctgccaagccatgctggcaggcgcatccatgtgtggtcagcggtttctctttgctgccactgtcctttgccaagactctaggcggcttcgatgagggcctttcccggatgggctgcaatcagctcgtctgccgagacggagcggatggcagggtcgtcgtaggtgttccagtaatacgtatgggtcctctgggaatatccgccggtatagacggtcttctcgaactccccgttcgtcatccttgcggcgccgtcgatcatagcaacgcccgcaagctcatggaacatgcgggagacattggcctcctccgtcgtctgctcagggtagtttgcattgaggtaggcgatgcgcacgaagcgggaaggcgagtagtagtcgcccgggatgccgcgcatgccggcacccgatccatacggtgtgagcgcagctgccctccaggtctgggttgctggcacgtcgcttgtgacgttgaggtagttcctgaggttctcgcggtgccatccgaatcccggctggtttgcaaggacgtcgacgtcgtctgtgaagatctgcatgccatcttgcgtgtattcgaccgcgatgctgcgcttgccgtcgccgacaatccagtggagaagcgaggtcggatatttgtcgacgatgggggagtcgacgacagcgacatccttgagcgctgcctcggcttcatcgacggtcgtgaagttcgcgacgatccagagcggaagctcccaggaggcgacattcgtcttgccggggacagcttccttctcatactgcgcatagcccgggaagttgaggccggcgcaggcaaggccttctgtatttgcgcagtcgaagtagagcggcgtatccttctcgacgatgcccatgccgatgacgggatggggaagggcgggcgtagccttgaagggcgagaagggcgcatagccttcgggcgccacgacgacacgctccccatagccctggcttcagtcgaggttgcgggcgaagtagagattgcctttgtcgtccgagaaacggattgcagtgcacatggaaccctccgatgcttgatggaagcgcaccctgcgcttcggctacagagggatatacccatgccgggaaaatcagtcatacagagtagactaattttggaaaaccgaggagtgtgcgagaggaggctcctcgaggagaagcatcccggaggcttcgtctgccccgcatgcggaaaccgcactgctccaaggtgcacgggcatgcccacaaatggcagtgcaccaggtgctcccaccagttcagcgtcaccgcaggcacgatgatggaagggacccacctcgagctcaggaagtggttcgtggcgatctggctcatgtcgagccagaaggcaggcatcagcgcatgctccctgcagagccagataggctgcagctacaagacggcagggcgcgtccttgcgcgcatccgctgcgcgatggccagatcggagtggccttcaacgtcctcgctgctgactatcgaggcggacgacttctatataggcgcagggccggaggcacgaggggaaggggcacggagcagcagccgatgcttgccgccgtcgacagggcccctgccgggaggggctcctgcgccatcggtgcgcgcaggactgctcgggagactcatggcgccagttcgggcacgaccacctctgccatgcatcgaggataagggcggatgcctggagcggcatagctgccggctctcgtccttcgcgggcctcgagcagaaggaatacgacagctcggacggcgatgcctcgctccccatggtccacagggtcatctccaacttcaaggcatacgtggagggagccttccacggcctctccaagaagcgcctgcagtcatatgcggactcctacagctggagatacagccacaggagctcctccgatgcctgcatggagctcctcacgagatgtgcctcatgcatgtcccgctctccggcatcgcagccacggccacggtccaccagaagcttcctgcgagcttgctaagccgtttacagttcagggagcctaactatgccggggtggactcagccattctggtcaattagagtgagcggaaacatgaatccatccggtggcaaggctcgagcctctgcctggcttcgtccatttggatgcgtgctaggatggtctagcgctgaatgaaaagtggtggcctggctccggagaaggagcatagctctcagtccctgtgtgcttggttcaaggcctgcccgatcctgcgttttcgttctcttggagggacccttgccagaaaatccatctgcgtcccttgagggacctgtgcccgtcgtctgcgttcacgacattcttcgcgctctgggattccaggcaacctattttgtcggcatcatcggctcggcgacctatctttgggctccgatgcaatggatgtctccctgcttgtcgtcctcttgaacgtcacgctcgtggcggcaggcggcgcagcaggtgtcgtcgttgacgatcgggccaaggaagacgatgcttgcttccttgctctcctgggtgttaccggcatcatcggcgtctctttccggagagcatggcgctcctcgtcgtcgtgaacgtggttgaagggattgcaggtggcttctgcatgacggcaagctctgcctatcccgctatctcgcagaggatgcgacgaccctccaaaagttcaacagctacaacagcacggccagtgtgtggcgcgttatcgtcggtccccgattggcggctggctcacagcgctcttcacgagccagatggtgttgcggtccttcccatctcatcggcaatatctgcgctctttgtctggaacctgccggagctcctgcatcctgaaggcaccggcaagaaggaaggggagggcttctggaagcagcttctcgagggcatccatatcgtgttctcccatcctgtgattgcagcgctcttcctgatctatttccttggctactttgcttatgggcattcgactcgctcgagtcgctcttctaccgtgacgtgctcagggtgggatccgagtggatgggtggctctcgtcggcagcaggcctgggatctacggtcggtgccttggccgtgctgcgcttctcgacgaagcggctctcgctcgagacagattgccctgcttctagtcgtgatcggtgtcgggtccatggtgtacgtcggcacgacgtcggtgcagattgcctcataggccagctcttgccggcttcggctttggtgccatgggtcctgtgaaggacacggtgctgcagaagagctgcgatatccgctatatcgggcgtgacactcggtcctttctgtcggcatgaactctgcggcaacgctgccgcttctcgttgccccattcgtggccaggtgccttcggtgtgcagacaaacgctctttggtgcctctgccatcgctgccgccatcggcgcccgcgcgctggcgtggacacacgccggcaatccgaaggcggcatagcgaaagcctgcggcacaggggcaggcgccacaggggagctgcagggcggcacggctccggcaggaggtgccgggcagccgcagccaaagcaggcacgggaggcaggaacaaggaatcggccacgcagccagctggggatggcggccacggacagggatgcaggcctggcagagcgggaaacaggaggccccgagcggaagcggcaaagaagatgcgcctgccaagccatgctggcaggcgcatccatgtggtggtcagcggttctctttgctgccactgtcctttgccaagactctaggcggcttcgatgagggcctttcccggatgggctgcaatcagctcgtctgccgagacggagcggatggcagggtcgtcgtaggtgttccagtaatacgtatgggtcttgggaatatccgcggtatagacggtcttctcgaactccccgttcgtcatccttgcggcgccgtcgatcatagcaacgcccgcaagctcataacatgcgggagacattggcctcctccggcgtcgctcagggtagtttgcattgaggtaggcgatgcgcacgaagcaggaaggcgagtagtagtcgcccgggatgccgcgcatgccggcacccgatccatacggtgtgagcgcagctgcctccaggtctgggttgctggcacgtcgcttgtgacgttgaggtagttccttgaggttctcgcggtgccatccgaacccggctggttttgcaggacgtcgacgtcgttgtgaagatctgcatgccatcttgcgtgtattcgacgcgatgctgcgcttgccgtcgccgacaatccagtggagaagcgaggtcggatatttgtcgacgatgggggagtcgacgacagcgacatccttgagcgctgcctcggcttcatcgacggtcgtgaagttcgcgacgatccgagcggaagctcccaggaggcgacattcgtcttgccggggacagcttccttctcatactgcgcatagcccgggaagttgaggccggcgcaggcaaggccttctgtatttgcgcagtcgaagtagagcggcgtatcctctcggacgatgcccatgcgatgacggatggggaagggcgggcgtagccttgaagggcgagaagggggatagccttcgggcgccacgacgacacgctccccatagccctggcttcagtcgaggttgcgggcgaagtagagattgcctttgtcgtccgaagaacggttgcagtgcacatggaaccctccgatgcttgatggaagcgcaccctgcgctcggctacagagggatatacccatgccgggaaatcagtcatacagagtagactaattttggaaatcggcacaggaaacggcatttgcctcaatcatgaaactcttattatagcgcggtctcttgcagatttgtcatcaatatcttctgtacggcaatttgcgtcggtttgtggaattcgctgacctgcagttttatgtatgtcgagatgaactcgacatcagagatttctgaactcgacgcagctcgacgtctgtcgaggtgaactcgacaaggagcaaaaaaaatttcggaaatgtcggtttctcggaaacgcttcagagtttgtagctaaccaatacaccactctgctggaaggcgtttccggaaaactcgaacatttccgaaatttttttgctccttgtcgagttaaagctcgacaggacgtcgagcggcgtcgagttcagaaatcctctgcctgtcgagtatgcgacatacattccaaaactgcaggcaagcgaattgccacaaacactcaacctgacgcaaatggcacgagacagagacgagcagccccctacagaagagatgatgacaaatctgcacgcacaagagacagcgcttaccgcccgcgcttcgctataataaggagtttttttttttcatgatgaggcaaatgccgttttcttgtgccga

SEQ ID NO: 99 - DNA, 23798 bp, Unknown
  Metagenome-assembled genome
tctccttcgtcgctcatctcgttcgtgtgaatcgcatcgggcgcggtcttttgctaccactctgtcgaaccatgtccagatccgtgtccgccatctgctcgacccatggtcggatgcgcggaggcacgggctgctaccagaagtcgtgcagtcgctctactcgcttctgacgggccggcctggtgggcacccggagtcggccgcgggtcttggtctcgcctacatacgtagccatccatcggtcagtcctacttcacagcttcgctgccctccgaggatatggggcctgcttggtgcttcgcaatcacatctctcctctcatgactccttgcagtaccgcggctctagccacggcagtcacttgcaaagtccgatgtcgccaggattcctggcagtggccttacgacggccatctgttccaggcatttcctagcgtcgaaggcgtacctaagttcctgcaatgaccgggtcagtgacgctgcgttctggccatggcgctcttccctcctctcccagcttcatacgctgtcgccttctttcaagtggcgtgacgaggcgacagacgcgcagacaggagatggacatcgctcacgaaaacgtccccagaagcctgtcgtcgaaggcaaatgcgggcacaatgcctctgccagtcgtgcagggccaagccatgcccgtggcccgttcaagctccagacgctgagtccggctctcggacgtggttgccctcgtgcaagcgctcacagcgctcatcacggtcttcacgccctcttgccgccctgatcgcaacacctcacctatgtcaggtcgtcaaggcacacgagaccatccagtcgatgactcgaacaaccaaaacatcgcaaagagctccacaccgtgcgcgcgcgagcgatacataaaagcgggtacggcggaccttggccgaaagccccaataccagcagtccgagcgcgcctatgtccgacacctatcgaacggcaacctcgcatccacacggtcggcgacctctcgacgcaagtatggctcgaccgccatcgaatcctcgtgaacgagacgctcacacgcgccacaaggactactcgaacctggcagttctgcctctactcctggcaggcgtctcgcaggcagggtcctcggtcgtccttactattcaactcgcagatgcaggagatctgcgaggaggccgtcttgcggctgaccggcaaaagtcctgctcctcgatcctttcgaacgcgcaaggtctggcatcggacctcctccccggactatacctactacaggtcgcggcgaccagctgagctctggcggaaggaagcgaccctcgtgaaccgcgtgacgactcgcctcatgcaccaggcccgaccttcaaggtcgtgacactccggcctgcactcgaacgggcgcctattcgctcactgacatgatacgatgctgagtcctcgatcgatatcggcgcgcgaggcggtcacgaacattacacaacaatcaatacggccgcacatcacgcttgagcgcgcgctgtcgatttctctcgaaacgtttgccttcggccaggtcggcgccaatgtcggctctgcgaacctcgtgagcttagcgaacgcctttcggctacagcacgcagatcggcaaggacttctatacgtcgcctccctcatgcccgacccgagcgagatgacggaatgggagacggctatgggcagcctgcggccagcctgtcggcaacaccagcccggcagaccccagaccacggttcatgcagaacgctgtcgtcgcagccaccatcgctaacggcggccgtcgcgagtgaaacccctacatcgtcgacactctcctcctgacgggcgtcacgtcacacgacgacgacccagccgcgcctcgctcggccagcccatctcctctacgacggcaatccgaagtcgcaagaagcgatgctcggcgtcgtgatgacggctacaccggcggcaggtgcccgcgtctccggcgtcaaggttgccggcaagaccggaacggcgaggtcggcggcaatgtctacaattcgctcttcatcggctttgctccctacgactctccgacgctggcgatctccatctgcctcgaaggagacggctcgaacatcgagggctctgcagccaagatggcaggttccatcatcaggcagtgcctccaggtccaggcagaagggagcgcatcatgagaagctggcctgttccttcccccgatgcttccgggccgaggcgcgataaccgggagccttccccgatccggtccgcagaagaggcgcatcttcctgcatccggcactgacagaatcaccgctcgaagcatttaggggtcatatatggcaacagagttctcggttgccgctatgcgtccaagacaagatcggcacaggcggaatggcgacagtgtaccgcggccttgaccaggtcctcccgtactgtcgctatcaagaccatgctgccccagtacgcagcagacccgtcgtttgctgcccgcttcaagcaggaggcacaggcagcggcagcgctccgagcccctatatcgtctcggtctatgactggggcaaggacggggacacctattacatcatcatggagtacctgcgcggcacgagacctgaagaacgcgcatcagaagcacggggcgctggactgccgcaaggtcgcacagatcggctcccagattgcccaggcgctctccgtcgcccatacacgacatcatccaccgcgacatcaagccgcaaacatcatggtccagcctgatggcaacatcaggggtcatggacttcggcatcgcccgcgccaagaacagccatctcaccgactgacaactcggttctgggaacggcccactatgtctctcccgagcgacgcaggcaaggagctcgggcccacctccgacctctatccctcggcatcgtcatgtacgaggccgcaacagacgtgtccccttcgacggcgatgacgcaatctctgtcgctatcaagcaggtgaaggagcagccgactccgcccagccagatcaacccgaacgtcgatcccgcccttgaggccatcatcctgaagtgcatgcagaaggacccgaaggcccgtttccagacagctgacgagctcttccacacgctcagggactacctcgcagcaggcttggcgctgtctccgaggcaacctctgtcatcgcggcacccagacgaggaacatggcaggaacaacccggcaggacccagcagatgggccgtgccgtcgctccgatctctgctgtcctggcgcacgacccgcttccgccagcagtctgcaagggccgaagccgcagagcaggagaagaagcgctcgaagcacaagcgcaatgtcgctatcggcatcattgtcgcaatcctcgctgtggcaatcgctgcctatgctgccgtcacctatctcggcagccagaccgtgcagacgaaggatgtcccgaacctcgtcggcctatcagagaccgaagcgcgctctgcaatagacaaatacgatggcttcttcacgatatctgtcacctatgactactctgactccgtcgaagagggcaaggtcatcgatcaggatcccgatgcaggaaggagcgcctctgaaggcacgaccatcacagtccatgtctcgaagggctcggagcctgccgcaaccgtcgaggtgcccgacctctcgaactgcacgccgaaggaagcaagcgccaaatgctctgctctgggtcttgtagcccaggcaggcgactctgtctactcgagctctgtcgatgtgggccatgtcgcatcccaggaccaggcagccggctccacggccaaggcaggagacacagtaatctaccacctctccctcggacctcagaccatccccgtcccgaatgttgtcggcatgaccgaatccgatgccgttcaggagatcgagtctgctggattcacggtcgtgcgcacgacgtccgagtactcgagcacggtcgcagccggttccgtcatccgccagtacccgacctccggctccctcgagaagggctcaagcgtccagatcacgctctctcttggcccgaagccagcgccggcggagagctccacgacctccaattcctcgaactcctccaacagctcttcgaacagcacgaacaccagcagcgccgccaatggcagcaatggctccagcagctcctcgaacaccggcagctcaagctctccgactgccgaatcggatacgacgggctctactgcgggcacttcatcgcacagcagcggcacgggcgagtagagcggaaggcacgccgctttcctgggaggcagatccaaaagggtctgcctcccttttttcattaccgcttgggacgggggcttctgagataagggcacgaagctgcatagttcttcaaacacccaaaaacacagaaaggcagtgggaatcgcccttttagaaaggagcgctttaacccgctcttcctttaagcagcgtgcccatccaggacgggacggctcggccaggcgtggtgcacctttcggagcacagacccttggggccacgcgagtgcatgagcccggttttactggcggcacagattccctggggcgcatgaagaagaaagcgggctctgtctgcagggctgccatcgtatgcagctgccttctggtcatgaaaaagcccgtatccgcattgctgcagatacgggcgatgtgtgctggtgcccccagtaggattcgaacctacgccaccaggtttaggaaacctgtgctctatcccctgagctatgagggcctatcgcagatagctattctataccaaacagccgttgctgtgtggcgagagccttacttctcttccttcttcttgcggaagcggtcgaagaaggagggcttgtcggcaacctcctgatagctctgctcgatgattgcgttgagctgcttctccttgaggctgcgcacacggtcgttgtacatgttgcgcaccttgtggaggcgagcccagtccataatgaagccgccgatgacgccgatgtaggcgacgacgagcatcacgattgccgtgacgccccagaacgacgtgaggtccgtctgggagtcagggacggcaaaggcgatgacccaggagagggcagtgcagacaagacctgccacaatcatgcccatcgagatgccatgccacttctggtaagccgggtccttcttgaggagggcctgtgctgccatggtgcgcctgtcctcggcgtcgcgctccttctggcgctgggcacgcttctcttcctttgtcatttcggatcttggcttggacgtacccgaagccttcttgaccttgccggaggacgtgacgacacgcacgcctgccgctgcctcgcgggcaggcttggccctcgtcacagacttcttctcgaagcccgtggacttgggctcctcctgggcatcctgctctatggtctcttcgctcttcttgtacgcatcgcggttctcgttcagctcttcgcgggcgccgttcagggtatcacggaatgacattaggcttccttcatgggaacaaatggcttgccacagatgagttcgaaggcttcctggtagcgcttcgaggtgccctcgatgacctcagcgggaagctcgggcggctcgccctgcatatcccagttggcgcgcagccagtcgcgggcatactgcttgtcgtagctcggctggacgtggccctcggagtagccctctgcaggccagaagcggctggaatccggcgtcaggcactcgtcgatgagggtgagcttgccgtcgatgaagccgaactcgaacttcgtatcggcaatgatgatgccgcgggtcagggcatactctgctgctgccttgtagatggaaagggaggcatcgcggagctgcgttgccacatcctcgccgacgatctctgcgcagcgctcgaacgagatgttctcgtcgtggtcgccgagagccgccttcgtggacggcgtgaagatcggctcagggagcttcgatgcctcggcaaggccctccggaagcttgatgccgcagaccgtgcggtcctggtcatacgtcttcttgccggagccggtgagatagccgcggacgatgcactcgacggggatggtcttggccttcttcacaagcatggagcggcccgcaaggtagtccttgtagggtgcgaactgctcaggcagatctgcaggatccgtcgagatcatgtggttcggcatgaggtccttgaagcggttgaaccagaatgccgagatgcgggtcaggatctcgcccttgtagggaatctcgttcggcaagatgaagtcgaagcagctgatacggtcgcttgccaccataaggagcgtatcgccacagtcgtagatgtcacgtaccttgccatgcgaatcaggacgcagttgaatctctgccattgcctgcctcatttcatcggattgctgacagattgagtatagccaacgaagcgcaccggctgcattgcgcaaagctcattccttagagcgtgcgcattactgcttctgctcccccttctgtgccttgggaagcgagcgggtgcgatggagcggaatcctcagcgtgaatgtcgtgcccttgccgagctcggactccacggtgatcgtgccgttatggcgatcgatgatctccttcgtgacagcgaggccgacacccaggccgcctgactccatctcgcggctcgcatcggagcgccagaagcggctgaaagtacggggaaggtcttcctttgcgatgccgataccggtatctgagacggagatcaaggcatctgcgtggtcctgcgtgattgcgacaagcacccagccgccggagggcgtatagcgcatcgcgttcgacatgaggttcacgactgcctggcggatgaggtcggggtccacatctgcgatgagggtctggctcggagtctcgtctgcaaagcgcagctgcagccccttgtcctcgaagagctgctcctgcgacgtcacgaggctcttcacgagccagacaagatcggtctcctccggtctgaacggggtcttgccgttctcgagcctcgaaagctggagcatggcgccaacaaggcgcgaaaggcgcctgacctctgctgccacgacctcgaggtgctccgcgtccgtcggatagacgccgtcctgcatggcctcgaccgtcgcctgcattgccatgagcggcgtcctcagctcatgggccacatcgctcgtaagcctgcgttcgtgcttgatatccttctcaagcgaggtggccatatcgtcgaaggtctcgccgagctgtcccagctcatccgagcccttgaggccggtccgggcagagaggtcgccgttcctgatctggcgtgcggtcgccgtgatcgtgccgataggcgctgccagcttcctcgagatgatgaagccgatgatcgatgccaggatgacggcgatgatggcggcagcaagaatggccatgtacgagttcgtgcggaatgttgcatcggcctgcgtaaggagggcatccgatccgaaggcccagaggcgcaccgtgcccacgatctccccatcggtgagggtgatgtcggaggagacgatcgagttggtgccggaaggcgcgttctttcccgcatcgatatccttgccatggacccacgtatcgtcgtagatcgtcgtgccctgggcattctggacctggaccgcaatatcggacgaggtgttcgatgccatccctgcatagtcaaggacctcaggcgtccagccgcccgcttcctcatacttcgaggcaagcgtcgaggcagtggcctgtgcgaggctctgcatgttctggcgcgtgtaggtattgaactggtcttcccagacaactgccagcacaagcaggaacacgactgctgtcatgaccgaggtcgccgcaaaggcgatagtcatcttctttgtatagctggccttctgcttctcgtgcgggcggatcgtgttccaggaagccttgctttcattagcagaagacacgcccccctcctgggaggcgtgcctgtcagatctgcctatctcgaatcttgctcgtggcacctatgcgctcctatgccttcttctcttccttgttcatggcaggcgcttcgaagcggtagccgacaccgtggacggtgtagagccagcgcgggttgcgcggatcgtcgccgagctttgcacggaggttcttcacatgggagtcgatcgtgcgctcatagccctcgaagtcatagccgaggaccttctcgacgagctccatgcgcgtatagacacgtcccggatagcgggcaagcgtcgtcaggagcttgaactcggaagccgtgagatcgacttccttgccctcgacgagcaccttgtggccggagatatcgataacaaggtcgccgaagtcaagcacctcgagctggctctccacctcggtgtgggcgcggcgcagaagcgcgcggacgcgggcaacaagctcgcgcggagagaacggcttgatcaggtaatcgtcggcaccgagctcgaggccgatgatgcggtcctcgacctcgccctttgcggtcagcatgatgatggggacattcgaggtctcacgtattgcgcggcagacgcgctcgcccgaaagcttcggaagcatgaggtccaggatgatgagatcgaaggaatgcttctcgaactcctcgactgcgctctggccatcgccgacaccacgcacgatataattctcgcgctcaagatatgcagccactgcatcgcggattgccttgtcgtcctcgaccagcagaatcttcttctcgtctgaagccatatcggcccccctataagacatgagagcaaactttcatacactctacattctaccccactgtgcagagattgtgcgtcaagccttacaaattgaaggtcctgacggtcacagctgaagggtagccggtcgatgcatccttcacggtggcgaaggtcacgaaggtgtcacaggcgcccatgcgtgccggatattcgccgtagtcaagcgagcggtcgaccgcagagatcacgcggtaggactcgtttgctgtatcgatcacatagtaggaggcgcggaccttcacgatgtaggtgccatccttgccggaagagacgcagaagggctcgcgtccgacagacaggaacggtccatccccgtgtcctacataggtgcccatggaggcaagaagtccgcctgtgctgtagctggcctcgatcgagaagacgaactcgtctccgatgcgggtggcgcacatcggctttaccgactggggcagcacaagctggtctgtgaccgtgcccatatcatcggacagggagtaggcggtgatgccgtaataggtgccagaagaggcgttgacgcgcggcgcaaggatcgcgtggccatcagatatcgagatgtcgcagccgaagcggccagatgactcgatgaccgcctttgcgctcgaatctccggtcttccagagatagcagtgcgagctttccttcgtgctcgagcctgaggtggaaggctgaacctgccagatgaccttggagccagagactgcgaactcctgagtcggcggcgttcttgtgcgcaagcacgcacgaccacagctatgtgaggagcttgtcgatgccggagaagatcacggcagacgaaggcaaggggccattccttcccgctccatcacacaacgtgccctcggcgcgggaccacgacatgtatcagaccctatcacgcctcgatgtccatgcgggagcccgcatcatctctgctctcctatggcctctgcatccatggtgcccgtgccaagatcgaatctgttgccatcgtcctgcgcaacgacgagcgcaagcagcaccgacacccttgcgctgcagccctcgaaggcgtggccacgacaacgtcacggtcatgttgtcgatgtggatgacgacgggaccagcgggcaacgccattccaagatcaggaagcgcagcctcagtctgggtgggtcatcgttctttccatcctcttcggcttggcgtgccttcatcggcgtgaactcggcgtccgactctcgtggtatctcggcaacaaaccggcggactgtcggcaatctacagggcagcgatgcccatatactgaacgtggccgcttgtccgcatctcgtcgaagaacctctgtcgggtcgatgacctcccccaggctgtcagtcccacttgctcagggctgcattcgcaaatgagcgaggagcatgccctctcctgccgttaattcctaccacgatccgatcgtacgcagagaagacaacgctgcaggccgtccctccgacgtgaaggtcctcgacgaccgacacaacgcaggagagcacgtctctgaactaccgcatcccaggacacatctccacgacagacaacgcacagatcacaacacagaatggcagggtgatagccattgcataccagaggaagcaaacagggctggcatccgccgcacgaccgagctgcttcttctcatctctttcttctcaatcgctctgcgataagaacggtcactcctcaatctatgcgatgtatgtcaatgaacacgggaccgagctcacgcaagctcgctctcccatccccatcggcctctttgctgcctttgggccgtccgctcctcatatcgctgtgagacgcgtcagctccaggcgcatacccggtgatcctgccgtcgtcttccttgctttctttcgtcgggcatagtcataacgttcgtgcagcgcttggcgcctgagcaggaccacaggtcgtactggctcttcctctccgatcacgccatgatcttggggtcctcttcttcttgagggcatcgacgatctggctcatccagttcaccttcggcacgcagcgtcgtcctgctgctcctgccccatgtgtccatcggcacggagcactatggatccaagccctggaggaatgcggcggcttctcgttcgcaagccgggcgagagaaggtcctcttgtcatcttccttgccgctcctgtcagagaaccgggagccttctctccgcctccactcgcgatctcggacctctggctctcccagcaaggatgcttgccggtctttgtcgatgtggggactcagccttcttgtcgtcatcttcgagcgcgacctcggcagcgccctttctctcttctcttcgtgatctttgtcgtatgctctatgtggcgacaggacgcctcatccttcgtcctcatctctttcgtgcttgctcgcaatcggcgcggtcttttgctaccactccacttgcttcgaccatgtccagatccgtgtcgccatctgctcgaacccctggtcgaatgcgcagggcacgggctataccagatcgtgcagtcgcctataactcgcttgctgacgggcgggtgcctgtgggcaccggcaatcggccgctgtcttgcgactacggtgcctatcgtcgagtccgacttcatcttctctgccatcggtccgaggagatgggccttcgtggtgtctttccgccatcctcagctccttcaatgctccttgcagtccgcggctaggcccacggcgcacgtgcaaagtccgatgtccgcagattcatggcagtcggcccttacgacggtccttcgtttccaggcattcctgaatcgtcgcaggcgtcacgaagtttccggcccatgacggcgtgacgctgccgttcatgagccagggcggctctttccccctctccagctcaatcgctgtcgccttcgtctcaagtgcgtttacgcaggcgacaggacgcgatcactgagatgacatcgctcacacgtcccagacgccctgtcagtcgaagcaatatgcggcacatgcctctgccgtcgtgcatgcatgccttgcccgtggccgcttcaagctccagactgtctgagttccggcgtcctctgacgtgttgccctcggccagcgctcacatctctcatcacggtcttcacacgctcctcttttgccgccctgatcggcaacctcctaatatccaggtcgtcaaggcatagacctccagtcgatgccttcgaacaaccacaacagacgatcgcaagagcgcacaagcacccgttcagcgcgggcgatcatgacaagcgacgcggcgtgaccttggccgaaagcatccagcagtcgacggcgcctatttccgcaccaccatccaacggcaccgatcgctccacacggtcgtctacctctcgactcagtatggcgcgaccggcatcgaacctcgataactgaagacgctcacaggcacaggactactcgaacctggcagtctgccctctactccttgcaggcgtccctcgcaggcagggtccgcggtcgtcctactatcaactcgcatatgcggatgattctgcgaggagcgcttgacggctggaccggcgcagtcgtgctcctcgatccttcgataccggcaaggtcctggcatcggcctctccccgacctatacctcgacgaggtcgcgaccagctgagctctggcggaagcgcccctcgtagaccgcgtgacgaaaaccgcctctatgcaccaggctctacctcaaggtcgtgacactctcggctgcactctatacgggcgcctattcgctcactgacatgatcggatgctgaggtcctcgagtcgatatcggcggcgcggcggtcacgaacttcaacacacaatacggctgcacattcaccgctgaagcgcggctctgtcgctgtcttcgaaagtttccttcggccaggtcgtgctcccatgtcggctctgcgaacctcgtgaggctatggcgaacgccttcggctaagcacgcagatcggccaggacttctataccgtccgcctccctcatgccccgacccgagcgagatgacggaatggagacgcatgggcagcctcggccagcctgtcgggcgaacacgcaagccccgcaggaccccagagaccacggtcatcggggcagaacgctgtctgtcgcagccaccatcgctaacggcggcgtcggcgatgaacccctacaatcgtcgatcactcctttcacgtcctctcccgagggcgtcacgacgcacgacgacccgccgcgctcgctcggccagccccatctcctctacgacggccatccgaagtccgcagaaaagcgatgctcgtcttcgtggatgacgcaacatacaccgcggcaaggtgcccgctcctccggcgtcaaggtttgccggcagaccggaaggccgaggtcggggggcggcaatgtcaacaattccatcttcatccgtcctttggtcctacgactctccgacgcttgctggcgatctccatctcctcgaaggagacggtctcgaaccatcgagggcttctctgcagccaagatggcaggtcctccatcatcaggccgtgcctccaggtccaggcagaagggagcgcatcattgaggaagctggcctgtccttccccgtgctgtgtccggggccgcggcgcgataaccgggagccttcccgagccgtccgcaggaaggaggcgcatctttccttgcatccggcccacggaccgaatcacccgctcgcagcatttaggggtcatatctggtcaaaaagtttctcggtggccgctatgggtcaagacaagatcggcaccggctaatggcgacagtgtaccgcggccttgaccaggtcctcggccgtactgtcgctatcaaccatggctgccccatacggcaggcacgacccgtcgttttcccctgcccgcttcaagcaggaggcacagggcagctgagcgctaccagatcccctatacgatcgtctcggtctatgactgggcagacggggtacacattacatcacagagagtaccttcgcggcacggactgaagaactgcatcaataagccacggggcgctggactccgaacctaaaggtccgaacaatccggctcccagattgcccaggcgctccagtccgtcgcatagcacgaacttcatccccgcgacatcaaagccgcgaacatatggtccagccctgatggcacatcaaggtccatggacttcggccatcgcccgagccagaacagccatctccacactgacactggtttctggacggcccactatgtcctccgagcagacgcaggggcaagagctcgggacacctccgaccttattccctcggcatcgtcatgtacgagggcagccaacaaggacggtgtccccttcgacgccgatgcgcaatctctgtcgcttcacagcaggtgaaggagccgccgactccgcccaccagatcaacccgaacgtcgatcccgcccttgaggccatcatcctgatgagagtgccttgcagaaggacccgaaggaccgtttctttccagacagctgaaccgagctcttcacagctcagggactacctcgcagggcaggcttgcgctgtctccgaggcaacctcctgtcatcggcgtccacccagacgagaactggcagggaaccaaccgcccggcaggacccacagattgggcgtgccccgtcgctccgactctgctgtccctgcggcacgagaccccgctcttccgccagcagtcgcaagggccgaatccgccgtagcaggagaagaagcgctcgaagcacaagcgaatgtcgctatcggcatcattgtcgcaatcctcgctgtgcaatacgctgactatgcgctgccgtcacacttctcggcagcagggacacgtgcagacgaaggattccgaacctcgtcggccatcagagagaaatagacccgagcgcgctctattgcaatagcacatacgatggcttttcaccgatattgtcacctatgactactctgactcagtcgaagagggcaaaccctttggaatcgatcaggatcccgatgcaggaaagagagagctcgaagccgaacccatcacaatgaaagaatccatgtatagaagggaccgttgagagtggacaattacagcgaggctaggcccgacctctcgaaactgcacgccgaaggaagcaaagcgccaaagcctgctggggtctggtgcccatgaggcgactctgtcacctcgagctcctgtcgaggtggggccatgtgcatcccaaggccaggcagggccctccacggccaggcaggagacacagtactaccgacctctccctcgacctcaacctccccgtcccgaatgttgtcggcagaccgaatccggtagccgtatcaggagatcgagtctgctgattcacggtcgtgcgtcacgaacgtcggtactcgagcacggtcgcagccgttcccgttccgtcatcgccctcccgacctcacggtccctcgagaagggctcaagcgtccagagcctacaactctctcttggcccgaagcccgcgccggcggagagctcacacgacctcaattctcgaactcctccaacagctcttcgaaacagcacgaaacaccagcagcggccgccaacggatcatggtccatccagcagctcctcgaaacccggcagctcagctcctccgactgccgaatcggatcaacgagtgctactgcgggcactttcatagcgacgcagcgcacgggcgagtagagccggaaggcacgccgatttcctgagcagatccaaaagtgtcttcctcccttttttcattacccgcttgggactgggggcttatgagataagggcacgaagctgcatagttcttcaaacacccaaaacacagaaagggcagtgggaacgcccttttagaaaggagcgctttaaccgctcttcctttaagaaggcgtccatccaggacgggacggctcggccaggcgtggtgcacactttttcggagcaagacccttgggcgagcgtcccaatgtagttttagtgtaagttttttggttgtgactggtgtgaagcgaagtgtgatggttttgggggagtcgttttagaataggttaggtgtttattgacggggatcggttcgggagtaatcctgggcgtgggtttttttttattggttactggggactggtgctttgtgggttgggcgagggttttgtggcgattggtggaatggagtgtgttgagtaggtggtttctgagtttcgtttggcctagtgtgtgtttattggaacttgtattttttgataggggactggaaggggggaggtggaggcgtgggattgtattttgtgtaaatgatattgcggtttttggagatatgggtgggttccgtttgttctggacctgttctctgggtggagatggtggacggtgagttcgttgagtagttgatttaaagtgatagtaggggagggttggcggcacagattccctgggcgcatgaaaaagaagcgggctctgtctggcaggtctgccatcgtattgcagctgccttctggtcatgaaaaagcccgtatccgcattgctgcagatacgggcgatgtgtgctggtgcccccagtaggattcgaacctacgccaccaggtttaggaaacctgtgctctatcccctgagctatgaggcctatcgcagatagctattctataccaaacagccgttgctgtgtggcgagagccttacttctctttccttcttcttgcggaagcggtcgaagaaggagggcttgcgcaacctcctatagagctctctcgatgattgcgttgagctgcttctcctgaggctgcgcacacggtcgttgtacatgttgcgcaccttgtggaggcgagcccagtccataatgaagcgccgatgacgccgatgtaggcgacgcgacgagctcacgattgccgtgacgccccagaacgacttaggtccgtctgggagtcagggacggcaaaggcgatgacccaggagagggcagtgcagacaagacctgccccaatcatgccatcgagatgcatgccccttctggtaagcgggtccttcttgagggggctgtgctccatggtgcgcctgtcctcggcgtcgcgctccttctggcgctgggcacgcttctcttcctttgtcattttcggatcttggcttggacgtacccgaaccttcttgaccttgccggaggacgtgacgacaccacgcctgccgctgcctcgcggcaggcttgggccctcgtcacagacttcttccgaagcccgtggacttgggctcctcctgggcatccggctcatggtctcttctcctcttctgtacgcatcgcggtctcgttcagctcttcgcggggcgccgttcagggtatcacggaatgacattaggcttccttcatggacaaatggcttgccacagatgagttcgaaggcttcctggtagcgcttcaggtgccctcgatgacctcagcgggaagctcggcggctcgccctgcatatcccagttggcgcgcagccagtcgcgggcatactgcttttcgtagctcggctggacgtggccctcggagtagccctctgcaggccagaagcggctggaatccggcgtcaggcactcgtcgatgagggtgagcttgccgtcgatgaagccgactcgaacttctatcggcaatgtgatccgcgggtcagggcatactctgctgctgccttgtagatggaaaggggcacgcggactgcgttgccacatccgcgccgacgatctctgcgcagcgctcgaacagaggttctcgtcgtggtcgccgagagccgccttcgtggacggcgtgaagatcggctcagggagcttcgatgcctcgcacagccctccggaagcttgatgccgcagaccgtgcggtcctggtcatacgtcttcttgccggagccgttgagatagccgcggacgatgcactcgatggggatggtcttggccttcttcacaagcatggacggcccgcaagatagtccttgtagggtgcgaactgctcaggcagatctgcaggatccgtcgagatcatgtggttcggcatgagtccttgaagcggttgaaccagaatgccgagatgcggtcaggatctcgccctgtagggaatctcgttcggcaagatgaagtcgaagcagctgatacggtcgcttgccaccataaggagcgtatcgccacagtcgtagatgtcacgtaccttgccatgcgaatcagcgcagttgaatctctgccattgcctgcctcatttcatcggattgctgacagattgagaatagccacgaagcgcaccggctgcattgcgcaaagctcattccttagagcgtgcgcattactgcttctgctcctcccttctgggccttgggaagcgagcgggtgcgatggagcggaatcctcagcgtgaatgtcgtgcccttgccgagctcggactccacggtgatcgtgccgttatggcgtcgatgatctccttcgtgacagcgaggccgacacccagccgcctgactccatctcgcggctcgcatcggagcgccagaagcggctgaaagtacgggaaggtcttcctttgcgatccgataccggtatctgagacggagatcaggcatctgcgtggtcctgcgtgattgcgacaagcacccagccgccggaggcgtatagcgcatcgcgttcgacatgaggttcacgactgcctggcggatgaggtcggggtcacatctgcgatgagggttcggggccggagtctcgtctgcaaagcgcagctgcagccccttgtcctcgaagagctgctcctgcgacgtcacgaggctcttcacgacccagacaagatcggttctcctccggtctgtgaacggggtcttgccgttctcgagcctcgaaagctggacatggcgccaacaaggcgcgaaaggcgcctgacctctgctgccaccacctcgaggtgctccgcgtccgtcggatagacgccgtcctgcatggcctcgaccgtcgcctgcattgccatgagcggcgtcctcagctcatgggccacatcgctcgtaagcctgcgtttcgtgcttgatatccttctcaagcgaggtgccatatcgtcgaaggtctcgccgagctgtcccagctcatccgagcccttgaggccggtccggcagagaggtcgccgttcctgatctggcgtgcggtcgccgtgatcgtgccgataggcgctgccagcttcctcgagatgatgaagccgatgatcgatgccaggatgacggcgatgatggcggcagcaagaatggccatgtacgagttcgtgcggatgttgcatcggcctgtaaggagggcatccgatccgaaggcccagaggcgcaccgtgccccgatctcccccatcggtgaggtgatgtcggaggagacgatcgagttggtgccggaaggcgcgttctttcccgcatcgatatccttgccatggacccacgtatcgtcgtagatcgtcggtgccctgggcatttcggacctggaccgcaatatcgcgaggtgttcgtgccatccctcatagtcaaggacctcaggcgtccaccgcccgcttcctcatacttcgaggcaagcgtcgagcagtggcctgtgcgaggctctgcatgttctggcgcgtttaggtattgaactggtcttcccagacaactccagcacaagcaggaacacgactgctgtcatgaccgaggtcgccgcaaaggcgatagcatcttctttgtatagctggccttctgcttctcgtgcgggcggatcgtgttccaggaagccttgctttcattagcagaagacaccccccctcctgggaggcgtgcctgtcagatctgcctatctcgaatcttgccgtggcacctatgcctcctatgccttcttctcttccttgttcatggcggcgcttcgaagcggtagccacaccgtggacggtgtagagccagcgcgggttgcgcggatcgtcgccgagctttgcacggaggttctcacatgggagtcgatgtgcgctcatagccctcgaagtcatagccgaggaccttctcgacgagctccatgcgcgtatagacacgtcccatacggcaagcgtcgtcaggagcttgaactcggaagccgtgagatcgacttccttgccccgacgagcaccttggccggagatatcgataaacaggtcgccgagtcaagcacctcgagctggctctccacctcggtgtgggcgcggcgcagaagcgcgcggacgcgggcaacaagctcgcgcggagagaacggcttgatcaggtaacgtcggcaccgagctcgaggccgatgatgcggtcctcgacctcgccctttgcggtcagcatgatgatggggacattcgagtctcacgtatgcgcggcagacgcgctcgcccgaaagcttcggaagcatgaggtccaggatgatgagacgaaggaatgcttctcgaactcctcgactgcgctctggccttcgccgacaccacacgcacgatataattctcgcgctcaaatatgcagccactgcatcgcggattgccttgtcgtcctcgaccagcagaatcttcttctcgtctgaagccatatcggccccccctataagacatgagagcaaactttcatacactctacattctaccccactgtgcagagattgtgcgtcaagccttacaaattgaaggtcctgacggtcacagctgaagggtaccggtcgatgcatccttcacggtggcgaaggtcacgaaggtgtcacaggcgcccatgcgtgccggatattcccgtagtcaagcgagcggtcgaccgcagagatcacgcggtaggactcgtttgctgtatcgatcacatagtaggaggcgcggaccttcacgatgtaggtgccatccttccggaagagacgcagaagggctcgcgtccgacagacagaacggtccatccccgtgtcctacataggtgcccatggaggcaagattccgcctgtgctgtagctggcctcgatcgagaagacgaactcgtctccgatgcgggtggcgcacatcggctttaccgactggggcagcacaagctggtctgtgaccgtgcccatatcatcggacaggagtaggcgtgatgccgtaataggtgccagaagaggcgttgacgcgcggcgcaaggatcgcgtggccatcaatatcgagatgtcgcagccgaagcggccagatgactcgatgaccgcctttgcgctcgaatctccggtcctccgagatagcagtgcgagctttccttcgtgctcgagcctgaggtggaaggctgaagggcctgcagatgaccttaatatatcaccagcccttcaatggtcctggttctgcttctcccctttttacattctttatcctattctcccccctctccctctgttagggctccctttcttcctctctcccaattggccccggtccttgtgtcgtgttgtccttattccttagttcttaataccttgccgtttaccgattgggttttcgtggttacctcgtttctggctgtcttggcccgtattctccggaatcatggcgtaaatggcagagtcaagcagcgtgctaataatctccatgttatccagctcttaattgttcttcgtcgtttttccccttcttttctcttttctaacgccttagtcttctgtttcttctttctgcttgctcctcccttgttctcctggtctttttcttttccctgtatcaatcaccacttctatatgctctatccgagtggttagattattttcgtgtttcccttttttgtgtccaacctttggttccgctttgcggtgtggggagtatttagccgcgtcgtctctgtgttttgtttgccgcttttttcgcctgcactacgatctgctggttgtcctgactgtcttcttctagtccccagtgggcgtcggtggagtagagtccgagtttttttcttggtgaagtgtctttaggtttgtctttttctggtacagcgggatggccatcctaatgggtgggctgttcggtcgtatgaagatgcggtaactttttctttatttttttttgtggtttccgtagagagggtctagtgtatcgcagttcgagagatcgtgcgtcgttggtggggtttctgtgggtttccctctgcttgttatttcatttgtggcgctcgttacgcagtggttttttgtggttgactcctctctgttctgcctttctcttccctcctgtttggttcattagctcgctatgggatggtgcgtcaatgaatttaaggggtgtggtcagtctcaattctgttggcttctatcgttggttctctctgatatgctgtactggggcctgtgttgtctgtactcctgtctactgtccttgggtgtataaggggtgtgtttgactgagggatggttcttcgcagtgttgcttctccaaaggatgtaaagggtcgggggtccgtggcatccgtgctgccttgcccttgagaagggcactggcgagaagatgtggtggtggcgggccatccttacgcttcctgtgtgtctgcatcttccgcctgcttcaagggccttcgagagctggtcctgccaggatgtcggacgggtccgcaggtattgccagcgaggaccctctgcaatctcgctgcagacgtgccctgtaccaggcgggccgataggccttggaggttgccattgcaagccaaccgccctcgaagctgaaccgttctctcgtcgtctttccttcgtctcaaagagcgataggtggcacggagcaacccccccgggggcctgaaatcatagtggaacctggaactctccgtattcgaaacgggctgcgacgcttctcgaggcgttcctcaatactattcagtccttcgccgaggaaggaccagccaccagggtcgagatgtgagcgaacacgtctccatatcctgtgggagacacacacacgcaggcagtctcaccacgccgcatcttactactcatccgcagtgctctctcgtcgccctctctgtaccggcatcacccgctaggatgcctacaagatcgtcttttcagacgaactgctatggctacctcgtcaggcagcagtgccgagcaggggacgaaccttcgtgtaggagaagcgcctgccgagtcttctctccgtcgctccctgccccgctcggcccaagcgtggtctctgctatctcactcttcgatccctggtccttcctcgcaggatcgaaaaatatgtcttcgaccgcctcggagctcgagttcgaataaaggattccattttccacgatgattccaggccccggggcgtctgctcccgtgccatccatatcgatcttgctgacgacgtaaagacgatcagaacgtccttcgatggtggctgcaatggcaacctcagctatcggccgcctggtacggcaacgttctgcagacgaattgcagagtcctcgctggcaatacctgcggaacctcccgggtcctacatcctgcgcgaccagctcccaaggcccgaagcaggcggaactcgcacagcaggaagcgtaggatgcccggacccccacatcttctcgcgccgtgccccttctcagggtcacggcaatcaacggctgcccacggcggtagccgtcgacactctatggctgcaatagctctaactctacgcgatgcggccgtcctcttcggtcgtcgtggtcgattcctcgggcaccgatgtgctcgaggagtaccctaagatgaatcactgtcgacgccgcctcgccctggtcgctgcctttgggctcgtgctgcatccgcagagggccctggatcccctgtcacggcagcaggtgccaaggcatctcctcttatcaccgctctgcactcgatacatcctccggcaacgctcaagactgtcatcgcgcagcccatacttctggctccaacatggagtctatgactcacctgctctgactctgcctatgcgtgggtcgagacaatatcctcaacagttcctggaagctcttggccaggccgtctcggatggtgccgtgacaggctttttctgcgtcgccttctgtgggaggcagatcaaactgatccgcctgccttg

SEQ ID NO: 100 - DNA, 30766 bp, Unknown
  Metagenome-assembled genome
ggctgcaacagagctgcgcccagaccgaagagaaaggattcaggaatccatggccaagacaagtaaagatcatcatgctctaccgggcgtatctcaggtgtgccggtccagacgacccttcgaaccacatctctgaacaatgtgaccaggcattccgcgctgctgtcatcgtgaacgatatcggcgccggtcaatgtcgacgcatcactcatcaagggacggcggcctctcgaagactcgactcctggatccccgcctcaccgaatggctgcactgactgacgctcgcagcgacattgcacaaaccagcttgacgcaatcgccagtccggggacttcattacactcatcatcgaggcttccgggcatcgcgcgagcccatccccacggccacacgatctcacgaaacttctgcgaccagtccaagacggacggcgaagcgcccgcatccatctgacaacatcgtagctgtagtcgacgcaagcgcagtgacgagagttcaatgcggctggcaagggacctgcgtgccgctggacgatatcgagggaaggacggattgtttttttttatcgagtcgcgcgtgattccagaagctcgaagtctgcccaccgtcatctggaacaagcagcgacctcgtgacggaggactgcagtctccggctaatggcttcgtcaggagcctccagcgcgatgccaaagatcgttttatttgtcgccgaccacggacagttgcgatggacgagctcctcgataccggtacgaacttaatgctgctgcgcctaaatcatctaccctgcgcctggtatgatgcaatggataaccccgaggagcattgagaaccccgaggtcctcgatgtacggatttgtcacgaccttcgtctacgagacgcaggcagccctatttcgacgagaaagttcaacgagttcctccagacccctggccggggagtccatcatccagcttgcatgagggcatgttctggtgctcgcaggatccgacatgtgctacatcttcgagcaggccggccagcagtgtctcccatcacgagagagaacggcctctttcgtcgacttctgcccctgatggacgaagaagatagatgattcgaggagagccccgcgagctatggacgactggttatccgagtagtgcggcgacaggatgacgaagctgtgcttcatggcagtggcacatggacaaggatgcccttgttgccggcctcgacgcctgcctcgttccctggaagcggcgactagggaaaggccccgctccatgcatgtccgaaaagcaggcccgcaggtatcccggccataatcaagtcctatgagctcgtccacgatgaggaagaggcaggacgtacgacgattggcgggtcgcggcatctatccggtccccgaggatgcccggcgtgccctcgatgagggagcactctatgcgatggagggacttcgtcgaatggcgagagagacttgttgcctctggcatcatcaacagacgcaggtgccggagtacgccctcgcccactggacggaggatacgccggacgaccaggtgctcgtactccataccctggtcgtcgatccgcgctacaagggcaaaggctacggcttccttcgtcggcttctatgaggagagtgcagcaaaagcgcggcttgcacagcctgcgcatcgacacgaacgagcgcaatgcttccgcccgcaggctctatgccgcctggctacagggaagtgagcatcgtcccctgcaacttcaatggcatccccatatccagctcgttctgcctggagaagctcatataggaagcaccgctaagaaacattgccaagggccgccggaaggtgcacacttccggcggctatttttctgttcttgcaggcatcttctggcgtcctgccctctctgctgcatgtcctttttggaagtgggtacaaagtccagaacagaaggagaagcgcaggaggtggatgagcatgtgccacaggatcgtgcccgtacagatggacgagctgcagatggcgctcgacctctatgccacgacggggcacgccgcatcccgaaggacaatccgtgccgaaggagtctaccccgaacgaagcttgccacggtcgtgaaggagcgtggcggcgcactcaaggccaggagctcatgggctttgcagacgcagccgaagcgccagggacgcgtcttcaacacccgcatcgagaccgcgcgctcccagctccaggagggctacggcatgtgggtcggcccatcacgcgtggccgctgccttgtgccggtacgcgccttctatgagtcatggacagagccgggctctccggcacccgacggaaaggtcgccgtccgcttcacgtcggaaggccaccgcatcttccttcttgctgctgtcatgaaaggtggggaagtctcgatcgtgacctgcccgccgaacggcgatgtcggtccggtgcactcgaggatgccgctcgtgctgggtcccggcgagtcctccatctggctcggaccgggcttcccgaagcttgccgaccgctcccagattcatcttgcagcagagaccatcctgcccccgcagaaaggctgattccatgcgcatcgcactcatcaccggagcatcttccggcctcggcaggcagtacgcacactggtgtgccgaccataaggctgcagacgagatctgggccattgcccgaaggcgggagcgtctcgaggagctgaaaagcgagctctcctgccctgtccgtcccataccgctcgatcttgccgacacgaagagcctcgatgagctggagcatatgcttgcggaggagaaggcgaaggatccttccttcgaggtgtccctcctcgtgaatgctgccggcttcggcaagttcgggacatatgcagacatgacacgggaagaggtcgacaagatggtcgacctcaactgccgtgctgtcgtggacatgacgcagatcgcccttccctgcatgggcaagggaggccacatcatccagattgcctcgtccgcctcgttccagccgcttcccggcctcaacgtctatgctgcgagcaaggccttcgtgaggagctacacaagagcccttcgcttcgagctcaggggcaagggcatcttcgtcacggctgtctgccccctctgggtcaagaccgagttcatcaaggtcgcccgcgatacgaagaacggccataccatgaaccatccgttcccgcagctttctgccgcccacgtcgtgaactggtccatgttcgtgaaccgtatcaactatcccattgccacctgctgcatcacaggcttcatcatgcgcatcgcagacaagatcctgccagcgcccctcatcatgtgggcctgggaggggctcagaagaatctagtcctctgccgtctcccacgagaacggacagaagtcttccggcttctgtggcatagtccgcatcgtgaactccccatccgtgcagctgatgatcgagatggagccattcggtaccttcatcgtgagacttgcgatcttcttcgaggctgcgctcacgcgcgagaactcatagacgcaggagcgcaggagcgccccatgggcaacgacgaggacgacgtcgccgttgcgtgctgccttgtacatcttgcggaaggcacgctcgacacgcccgcgcacttcttctcccgactctccgccgatatcggagaagtcctgcttcaagaagtggcgggcaaagtcgagacggtggcccttgtagggcttcccatcgagctcgccgaaatcgaactcatggaggttgtcgagcgtctggatcttgatatttcgtcctgccaccacacgctcagccgatgcctgggcacgccccagaggagagcaccagactgctgccagcgggatatccctgagcgcctctcgtgtcctgtcaagcacaggcaaggtctcgtctgtcagggcagaatcgacccgtcctccctgtatcacgccgtcacggttgaactgcgtctcgccgtggcggacgtaatagaagactacccgcttgctcatgctcccgctttctctggatgcttcatacacgcagaaggatataccactcccccatctgccctaagcgggcccttgcccaaacgctcgtctctgccacaatagagattgagaaccattatgaacaagaaggagcaccctcatgtctgagatcgtcttcatcgagtatccccgctgcacgacctgcaagaaggccaaggcctggctcgacgaacaccacgtcgcctataccgaccgcaacatcaaggacgacaaccccaccaaggaagagctcgatgcgtggatccccgcctcaggcctgccgcttcgccgcttcttcaatacgtcaggcacgctctaccgctcgctcggcgtgaagaagatgctcgacgaggggctctccgaagacgaggccacaacgtttcttgccaccgacggcatgcttgtgaagcggccgctcgtccttgtggatggcgttcccctgacacctggcttcaagccggcagaatgggaagagaagctcctctagagccagctcaatgcccgaaaccgttcttcctcgttgcacaatatttatcgtaatacgataaatattcattgcgttacagcatgatatcccgtaagcttatgctatggtccccaagagagggaggtctcccatggacgagaagaagctttcgggatatctcatgtctgccaccgctatcgtcgctgtctgtctggccattgcagtcatagccgtggttcccgcagcaggcgaggcaatcctctacgactatccggagttctctggctggtatatgccctggcttgccttcatctggctcgctgccatcccctgctttgcagcccttgcccttgtctggaagattgcccaggcaatacgtgcaggacaggccttcgcctctggcgtggcgcatctcttggccgtcatagctaagctcgcggcaggagatgccctcttcttccttgccggcaatatcgtgctcttctgcaagggcatgaaccacccgggcgtccttctgctgtcgcttcttgtagtctgcgcaggcattgccggcgccgccatcgcctctgccctttcccatctcgtcgagcgcgcagccgagctccaggaagaaagcgacctcacgatatgagcggcaggattgtcttcaacatcgatgtcatgcttgccaagcgcaagatgagcgtcaccgagctggctgaccgtgtcggcatcaccgtagcgaacatgtcggtcctgaaatgcggcaaggccaaggccatcaaggtgagcacgctcgagaagctctgctccgcccttggctgccagccaggagaccttctggaatatcggcccgacgacaaggagtcctgaccggccacacaatgcccttgccggtattgttctgacatctctccaacgctgcatgtccttacctatgccctgcatcttctccgcacctgaaggatgcagggcatttccatggagcgatctgccgcaagctacagaccttatcgatcctttagctgctcatattgatacgcgtgtatatatacgatatatacattaataacagagggaaggagatgaaccatggtcgacataccgatctcgaacagatcggggaagcccatctatgagcaggtcgcagaggggatacgtgcccagatcatgtcgggcgaccttgcgcccggagagcagctcccctccatcaggcagctcgcggcagacctgaggatctcggcgatcacgacgaagcgggcctattcggacctcgaggcgcagggcttcatcgctgccgtgcccggcaagggctcgttcgtcgcggaaggctctgccagcctcatccgcgaggagcagctgaggctcgtggaggagaacctcgcgaaggccgtggacagggcacgcactgcagggctttccctggaagagctccatgacatgctcgacctcgaatgggaggaatcatgagagaggcatccgccccctcgcctatgaggggcgcgcaaagcgctaccccgcactcacggtcggccccgtctctatatccgtgccgcaaggcatggtcctggggctcatcggcgcaaacggcgccggcaagacgaccctcatccgtgctgcgcttggcctcgtgaagctgacggaggggagagtcctcctttcggccaggacccgaaagccctctctgcagcagagctcatagccctgaagcagcatgttgcctctgcctgcgccgtctgcccctatcccgaggaatacaccgcaggagatatcgtacgtatcgagcacggtctctatcctgccttcaatctggcctatctggaggagctgctcgaaagattcgagcttgcacagaacgtcagagccctttccggcataacggcaaagagcctttcgcgcggacagggcatgaagctccagattgcgctcgccctcgcctcgggagccacgctcctgctcctcgacgagccaaccgcagggctcgaccccgtcgtacgcgacgaggcgctctctgtcctgcgcgagcatcttgccaagactcctgatacctccatcctcatctcgtcgcacatcacgtctggcctcgagtcccttgccgaccgcatccttcttatggatacaggaaagctcatcttcgccgaagacgccggcgtgctcgagaagcgctttgcgacgctggcgctcagagcttccgatttcgaagagaggaaggacgcactcagggaggcaggagccacccgctgcctgcacgagggcaggcatctgcttctcctgatagaggacaggaagcgctttgcccgcgccttccctgaccttgcactcgatacgctcgccctcgacgcgcgtctgcgtctcgctgtgaaaggagaggagatctgatgatgaagagcctgcttctcaacggatggatcacgttccgccacgccgtgcgggccatggcattcacccttgctgcagtcaccgtgaccctcgctgcctcgttcatgaacggcagctcgatggatcttgtcgcccttgtcaatctcttctccacacttgcggcaatggttccgctctacatgtgcatccaggcctttgcatctgatgaaaagagtcactggggagaggcactccttgcgcttccctctgcaccccgaagcctcgtcgtctcccgctacctcttctgcctcatgtcgcttgctatctgcttcgggttttccttcgcagcggattccatggcggcggctatgctcgaaggcgccccatgggccctcgtcacagatgggttttacgacggaatcctcctgcttcctgctgtcatcctctgctttgcgcttgtactcctgtctcttctcatgccgctgctctatgccttcggccagaaggggctcgtgtcgattctcatcctccccgccatcgcgattgccgcctccttcgcaggtccgggcgccgcagctccagccgatttcatccattcatgtcccaaaggcatgcttgcagctggcttcatctgcgctggccttgcgctctatgctctctcctgcctcatctcttccgccatcctgaagcgccgctcgttctgaggaccgacagcccaatcccgctccatgcgaaaggcccgcaccacacgtaatgtgatgcgggccttccaacggggagaagggagacttgatgccttacggcaccatcatgaaatcggagatcagagtgcaagcgccgattcgaagcgtgcttctgcagcacgccccatatactggcttgccatgagctgccctgcgctctgccccagcggcatgagctcatgggagccaaggaaggcaatgaggccttcgggcatcacgccgccacgcggcagctcgaagaggacagagccctccagcagcgcctcgtctccggcatcgccggaaagattcaggcccgtatccctcgagcgcagatgctcgacgagcttcatcttcatgccatcccactcgatctcgatgccagaggcatagacggccacctttggctggagcgggcccgcctgggcagcaagcgtcttcacagcgagctttgcggggctcagcacgaacatatcctcctggctgagcaggagcgtctcgagcagggacgatttcgtatggaaggtatagccgaggccggcaaacgactctgcgaccctgagatccacatcgtcctcgaaggttgccgccccttcgctctcaagccagacctgggccctgaaggcagatccgcgcatgatgctctgtgccagggcaaatgcatcggaatcgagatagaggcggcgcttctcgaagcgcttctcggcggtgcccttctggctgcgtgcccagaagaggagctctgcgcattcgtcttgggccagaagatagctctgtgcccgtaccgtcgtagcctctgcgttcttttcattctgtgccatctcgtgcctcctgacggatgctcttgtctgtctgtgtatggctcaagactacgggacggagcttaaacacatctgaggctttcgtttcctcgccgtatcgcgacgcagtcgcgacaaaggtttgagataactgaaaatcgctgcctttgcctatttgtaccgtttcccgattgctgcttgtaatcagtcctgtttattgatactaattttgtgacatatggacgaagaacgccatatgtctcaccaaaagcagaacgagaggacttccccatgagcacgatcgtgattgtcggcgccaaccacgccggcacggcagcagccaatgcgatactcgacaaccatcccggaaacgacgtcatcatcttcgaccagaactcgaacatcagcttcctcggctgcggcatggcactgtggatcggacggcagatctcgaagcccgatggcctcttctaccagacgaaggagcagttcgaggcaaagggtgcagctgtccacatggagacccgtgtcgaccatgtcgactacgatgcccagatgctctatgcagaagggcccgacggcaagacgtatgagcagcactacgacaggctgatcttggcaactggctctgtgccagtgcttccccgctgggaaggacgcgacctcgagaatatccagcaggtgaagctcttccaggatgcccaggccgtaatcgaaaagctcagggatgaggcaatcaggcgcgtcgccgtcgtcggtgccggctatatcggtgtcgagctcgccgaagccttccagcgctgcggcaaggaggtcacgctcatcgaccaggcgccgacctgcgtctcctcgaacttcgatgcaccattctccgagcgcatggcagagaacctctcctcccacggtatccatcttgccttcggcgagaccgttgagcgcttcgagggcaaggatggcaaggttgcatccgtcgtaaccgacagggggacgcatgcagcagaccttgtctgcgtctgcgtcggtttccgtccgaacgcagagctcttctgcgatgcaggctttgcgacgctcggcaatggagcccttctcgtcgaccaccatcaggagacctcgaagaagggcgtctatgccatcggcgactgctcgagctgcttcgacaacgctgaagacggcgaggctgcctatatcgcgcttgcaacgaacgctgtgcgttccggcatcgtggctggccacaatgctgccggaaccgccattgacggcatcggtgtccaagggtcttccggcatctgcatctacgacctcaagatggtagcgactggtctcaccgaggcaaaggcgaagaagctcggctacgacgcaaaggtgagcgacttcacagacgtgcagaaggccaccttcatcgagacggagaaccccgaggtcacaatcagggtcgtctatgacggcacgacgagaaaggtgctcggagctcagatggcatcgacctacgatatgagcgcaggcatccacatgttctcgcttgccatccaggagggcatcacgatcgaccgcctggcgctcctcgacatcttcttcctgccacacttcaaccagccgtacaactactacacgatggcaggataccaggcactgctcgcgaaatagcaggctcaagagacgccatgggagaggcgccggatctttcggtctggcgcctctcttttcccgcatcaaagcctgcccttcaggcaggcccgtgccgtcacggagggcaggtgccgaagccgccgcatgcggacccctggccggcactccgctggccccgcctcttgcaggcattccatccttcctcggaaggcagatgcccttccgggccctctgccgctcggattccggcgtctcgggcacaggatgcagggaaagcgttccagcccgcagcgccagaaagccaaaaggcagcctctgcaggccggacatgaaaagaccgggtggatcgtccgcagacaggcagcgtgcgaaagattctgcctgcagcctgaagccaatgtcagcatccgtccatgctttcgccactccaacagcacgtccataggcagctggtatactttgctgtgcttgtttctatacatggacaggcatcgtctgtcctgagtgcaaggagacgtgcatgagcgaaaagaaggatccgaaggatacctgcgtccttgtcaccggtggtgcaggattcatcggcagccacacggtcgtcgagctcctgaacagcggctataaggtcgtgatcgtggacgatctgtccaatgcctcggagaaggtcatcgaccgcatcgatacgatcgtcggcgaagagaaggcaaagaacctcacgttctatcgtgccgatgtgaatgaccgcgaggcgatgaacgagatcttcgacgagaacgatatcgaccgtgtcatccacttcgcaggcttcaaggctgtcggcgagtccgtcaagaagccgatcgagtactacacgaacaacctcggcaatacgctcaccctcgtcgacgtgatgaggaaccacggctgcaaggacatcatcttcagctcctccgccacggtctacggcaagcccgattcgctgcccctcaccgaggagagcccgaagaagcctgccacgaacccctatggctggacgaagtggatgatcgagcagatcctgaccgacctccacacggcagaccccgagtggaatgtcgtgctgctccgctacttcaaccccatcggagcccatccttcgggactcatgggcgaggacccgaagggcatccccaacaacctgcttccgtatgtcgcacaggtcgctgtcggcaagcgcgagtatgtccatgtctacggcgacgactacaacacgcctgacggcacaggcgtgcgcgactacatccatgtctgcgacctcggtaccggccatgtcgcagcactgcgctggatgaacggccgcacaggcgtcgaaatcttcaacctcggcaccggcaagggcacctcggtcctcgagatcatcaaggccttctccaaggcctgcgggaaggagctcccctacaggatcgagccgcgccgtccgggcgatgtcgatgcgaactacgccgactgctcgaaggcagagcgcgagatgggctggaaggccaagtacacgattgacgatatgtgccgcgatggctggaactggcagtccaagaacccgaacggctacgagggataagacatcatgggagaagcgcacggccgcctctttgcggcatatcttgctcagaagcgtcctgccatcaacgcgtacctggccgagcatgcaccgaagcccgaagccgggacacaggcgcaagacgatatggagcgctatgcctatgcgccgcttgcccgcttcaccgaagcaggcggcaagcgcacccgccctgcccttgtgctcttgggcgccgaggccgtaggcggagacgaggtccgcgcgctctcctgtgcctctgctatcgagtatttccagtcagctgccctcatccacgacgatatcgccgatgaggggcagctgcgccgcggcgagccctgcacctacctcacggagggcaccggcgtcgcaatcaatatcggagacctcggcatcgtccacacctttgcaggcatcctggacgattgcacgctcgatgcagagacgaagctctccgtcctttcccttcttgcccgcatggagcagcgcactgtggagggccaggccttggacctcggctggacgagagatgggcgctgggacatcacgcccgatgactatagggtcatggcaaggcacaagacagcctactattcggcagcaacgcctctcgcagcaggcgccatcacgggaggcagcacgaaggagcaggtggctgcccttcatgcctttggcatggatgcaggccttgccttccagctccaggacgaccttctgaatcttgtcggcgatgccgagaagcagggcaaggacttccggagcgacatcacggaaggaaagcgcacgcttgcggtctgccttgctctcgagaagctgcctgcagctgcgcacgacgagctcatctccatcctctctgcccatacggaagatcctgatgcgcaggcccgtgccgttgccctcatggacgaggcaggcgccatcgacgccgtgcgcgaagaggcccacggacttgccgcctcggccaagagccatctcgaggggctcagctgggcagccgatgccgaagagctcctcctcgatatggccgacttttttgtggagcgcgtcggctagaccatctagcgaagacgcgtaccatacaaagcgtgtagcatgcgagaccttcccaaattgagctccgcataccatccgcatgaagcgatatggggtgcatagacatgaaagaggaacggatgaatcccattcttgagggaacaagcggcgacgctgtcgaggatatccaggaccgtctcaagcatcttggctatcaaatcgacgacgaggagtgcaacgagcgccactttggcccttcgacggcaaatgcggtcgcgaagttccgcatcgagcacgatctgccgctcggccaggctgtggatacccagacctgggcagcgcttgtggacgagtgctatgagataggcgaccgcaccctgtatctgcgcctcccgaacttccacggcaacgacgtgcgcgagctccagaatgccctgaacatcctcggcttctcctgcggcgaggcagatggcttctttggcgcccataccgaggctgccgtgaagtccttccaggaaggcgtcggccagcttgctgacggcatggcattccccgagaccttcgatgccatcgagcgcctgcaccatgtgtgggccggaaagcccgcagctggcccgcatcccatgggcgtcatgggctatgcccgcgcagccaacgtgctcgaaggcacccatctcgccatcaccggcgaggatccgatctcgaggaatgtggccggccgcatgttcaacctcgcaagcgcaacagcaaacaactctggcctcgagctcgtggacgatcccgaccatgcgacgcccgactgcgaggcaatcttcagcatggcagcatctcccctgcctgagaactcgacgaatgtcgctaacctcacgctcgatgacaccgacacgctggcaacccgcatcaggagcgccctcgagctctccgatgcgaagcagccgatcctgcgcatcgagcttccggtcggccccgactacaatggcacgttcacgacaagcgatgcccagacgctcgcagtccttctgctcgatgccatctgcgcagccttcgcaaagtagcttccatctggcacgcagctccaagacctgatacactgtattcccagctttggagcatcgtccaatggttaggacccgggtttttggtgcctgtaatgggggttcgaatccctctgctccagccactgaaacgcaagccccccctcttcggaggggagctttttctttgagaagcgaacggatatcctggatgctgctgagcacataagctttgactcaattcctattgagtcaattccatctgagcaaacagctcccatgctatgccttgaggcaggaccccctatctcgcgtatgcgcttgttcagggacgcattcaccggcacaaggatatggtgcttctcggcccttctcatgacctcgcccgagaactcgtccacttcggttcggtggcagttggtgcggtcctgccccctggaaggtgtcgaggcagggtcgagcgtacgctcgggcgctgcataggcagaaagagcctcctccgtgagcgcgaccccttctgcctgggagagcgccacgactccgcgcgtggcagagataaacgtgcgccagagctccgaggtctcatccgcatacacatcgccgtagcttgcgccaaaggcgcagcaggtctggttgatgccgacattgagcatgagcttcgcccacatgcgatagcggatgtcttcctccgcgacatgtgcgatgcccgcttgggaaaggatggcgtccacgtcgacaagcgcctcttgaggcgtgctctcgaagcatccgatatggagcccgcccgtctttgtgcatgtgagcgagcttccgtcttccaacgaagagggctttttcgtattgcggtgctcctgctccatgcccctctgccccgatatcccagcagcgcctggacttgcgcatccaggcactgcgccaggcctttccctcagcgctgctgctcgagaatccagctgcggatctcggggatgctataggcatactgccaggtgaagttatgggtattgccgccctggatcgaactgtctgtcccatcgagcgtgccctcggcgatatggaagaagacgatatgcgcgccctcggcatcagccttgccgagcgtggatgcagcttcggcagaaagatctgccatgagctcatcgagcgtcctgtcagagtcagccgcgcgggcaccctcctggttgcccgagggattgctctcgccggttgccgcatagtcgacccaccggccggaggtatgcccttccccgtcgaagtcgtaggtgcagtcgagctgtgcctccacatagggaacgccgatggcagggatgcccttctccggatcgctcagcccgccatacgagctctcgtcgtcttcggatgcgaaggcaatgaagggcgtctgcttgatctgtgccatatcgccctgtcctgccacgaaaagataggcggcgaagcggtcatcgtctgcatgctctgcagcataggagatcagcgccatgcatcctgccgactcgcctgtgccatatatgcggtccctgtcgatggtgcagcccttgtcgaccaggctgtcgacaagatcgaggcaggtctcgacatcggcagtggtgcccgccaccgtgagcacgtaggcctcctcgtcgttccaggccacggcacccgggccctggcgcaggttgacctcggggtcgcttgtcgtgacaccggcgtccggcaggaagaggaccagagggtagctcttcgagctgtcatagcctgcaggctccagcagctcgaaggcggcatggcagccggtcgcctcgtcgtcgaaggtccctgccacatatcctgccgtctgggcattcgaggtggaggacgagaccatgtatcttgtcatcgtcgcatctccggcaaagacagcccccgacgaggaggagatgtccttgacctggcagatcctgagcgtgtctgtccccagctcgaccggtccgttcgagccgacctgccctctgctcatctggaagagcagggtctgggcgcctgcatcccgagggtcgagctcgatgatcgcataggtgccggaagagctgccgccctcctcggagagctccggggcatcgttcacatagagcgcagagatcgtcctgccgagcacatagtaggtgcccagcccctgctgtatggcctgctgctggatgccgccgcctccggcatcgagagatgcggcatcgagcggagcatcgtattcgacggcagcacctatgaccttctctcccgccggataggtccttgccaaggcagtgacggacctgacatgcccatagaaggaagcgacatcgtctgtggtgcccgcactcgccctgctttgggatacgacaagcccggatgcggcctgcgcatcttctgtgctgccagagcctgctgcagatgcggcctcctgggaagctgccggctgggccccacatcccgccaggaagagcgctcctgctgcaaggcctgcgccgcccagaaacgatctcctgctgattcctgcatcctcgatctgcatagccatgtcctgttcctttctctttctgcatcgccttcagatacgaaacgggcgcggccggatgcccagccacgcccgtgcacctgctctgcgcagggtctttctgttggagctcgaagaagctattcgaccttgagggtgaagcccttgttgcccgcatcctttgcggagccgatgacaagcgctgctgcgaaggcgcagatgagtgccacgacaccggagatgatgaggccgacgaagccggcgtcgatgccagcagggttgatgaaggaggggaagccgagcgggccggaagcgccgaaggagtagagctttgcgcctgcaaggccggcgatagcgccgccgatgccggcagagatgaaggttgcccacatgagcttcttgcgcggaatcaggattgcgtagagggcaggctcgttcacgccgaagatcgaggagattagggccggaacgttgacatcagcgttctcctgggcatccttcgagcggacgatcacgccgatcacggcgccgatgatagcgcagccgccggcatagacgagcgggttgatcgggtcatacccataggtggcaacgccgatgaaccacagcgggatgatgccccaatgcaggccgaacatgacaagaagggaccagaaggtgccgataacgaagccggcgatggcaggctggaagttgatgagcgcgaggatgatggcagcgacgatgttggagagaaccgtggtgaccggaccgatcacgacgaggccgacgatgccgcagaagaacagggtgatgatgttggcaaggaaggtggcaacaagcgacgggagcttgtccatgagccaggcatggacattggaggcaaaccagaccacgaagatggccggaatgatcgtcgaggagtaggcctgcatgaccagcgggatgccgaagatgtcgccgtagacattggcctcgaagatggtgccggcaccgatcgtgtagagaggatcgcccgacatcagggcgacgagcgtcggatagacaaggatgccgccgagcgccatgcccatgaccggcttgaggccgaagcgcttggccgaagtgaagccgatgatcagcggaaagaagtagaagacggagtcgccgatagcggaaagcgccacataggtggaccttgtggttgcaagccagcccgcagccgagcacagggcaaggagcgacttcaggaagccgccggccataaggacgccgagaaccggctgcagaatctcggagacgacgccgagcaggcgcgtgaacgggtcctgcttcttgtcctgctcgcgtgcaaggtcctttgcggcatcagggttcatatcgactgcaggctcggcagaaaagccgccgatcttgatgaggtccgaatagatggcctcgactgcagagccgacgacgacctggtactggcctcctgcctggataacgtcgatgacgcccttcgttgccttgaggcccgccgtatcggccttggcctcgtccttcagatggaagcgcaggcgcgtgatgcagtggctgacgtcctggacattctccctgcctcccgccttgtcgatgattgtttcgcagagttcttggtatttcatcgcgatatcctccctgaggaatctccccatcggtgacttcgacggtgcacttccctagtcgacagtcaggaagtccggacgagccctgttgatagccgcttgcctgagcagaccttctgcctgctgggcaagcccagtgtagggtgcgaattattccgtatcaattcttgttggatgaatacttattccatttgagatatacaaaggccatgagctgcccttttggcggcaggccctaaggcgcacctgccgctcgcaggattgcggtaccgctcagcggcgcagggtcccgtcataggctccgagcagcttcgaagcctggcagaacttgtccacgatcttctcgggctctcccttgggtatctgggtatgctcggtctcgaaggacaggccatactcccatgccggaaagaagtattcgaaatagccattggtatagccgaagacaagaccctggaccgggcattccttgcgcatgcggatgccgaagtcgccgccaagctcgctcgggaagacgaagagatggagccctccgaggcttatgacctcgagcttcaggtcgaggtggaagctgtcgtgcgcgaccgtgtggtaggctgtctgcacctcgatccggtccagcgccaccgcgcgctctggccgtatcttggagattgcgcgtgcaagcccgtcggatacccgctctacctccgcgatgcctctcccctggcggaaattgcggtcggagcagtcgccagcagcgccgacaatcatggcagggaaatagccgagagaaggctcgagcttcttgctcacgagccctgcaagctcgcttgtgagctccgtcgtgtcaggaccgacgaccgcagaatgcaccgcccagttcacgagcccggcaaacggcacgccctcttcatcagaaaactcgaggacgatgacttcgttgtccgccagctttcccgggacattcctgttcccgtagaagccggtgacgatctggcttccgaccttggctgtggcctggcgcgcgttgctgcggcattcctcgaagcaggagcagatcgtctcgaggagccagtcgtagtagtgctggtcgaacttgtgggtccaccagctcttgtggtaggcagcgatcgaggtatggtcatgcgtggcacagagcagcaccagatcgcggtcgatcccatagcgggaggacagaagcgtcttcacctcctctgtcatgctctcctcgaattcgaggacatcggcgctcagcacgaagagctcgcgcgtcccgtcctggaagtagagggcgttggcgaagacatcgtcgtggacagctgttgccggctcgagacggttgggcaggtcccggtagccgatcagatagatatctccttggggcgtgatgtcacgccgggcgcatcccaccttcatgcgcatcctccttctctcatgcgctccgtaccccgaagcacggcctgcctgagctgggaggccgcctcgcgggcgaagcctgaattcatcgcttcataggtgatgaggtcgaagtcctcctcatcggccagatacttctgggctccgttcaccatcgtgaagaccgcctccggccccgcctcagcatccctgagatatgctccgaagccgctcgatacctcgggctcaaggccggcaagcacgcaggacccgatcctcaggaagctcacggtcgtggctacaggagcgtcctggcgccagacgatgcttctgcggggcgcaagcgtcgcgaagtcttcccgcacctttcctggcagaagcaccttggcagcacaggcggcaaggccgcgtcccggcacgggagagaggctggccagagcatcctgcacgtcccgggcaagctcgcctcccagccggccaagcactgcatctgcctcgccggtacaggaaggtccctcggctgccaccacgctctcgcgtggtgcctgatcggctgcgcacccttcgatgaagagcgcgatgccggcccctgcctgctcgagcttcgcggcagcggcacctgccagatctcccgacaccatggtctgcccctcggcatcccttgcatccttcaggaccgaggactggacatctgcagagaagacggtcgcgataggcccgccttcgggcgtctgcacgctgagcacgaagaggcgatggtcgctcgggcctgcagggttcttccccagccaccagccacgctcggtctcgacatcgcggttcaccatcaccgaggtcgtacccgagccccgaagcacgcaggcaggctggcgctcatccatcgctttggagaccgccgaaaagaccgcctttcccagggccgcacgcagcgcatcgtttttctgcctgagcgtatccgacgccagatgctggggagtccttgcatggggagcggagaaggtatgggtcgccacgacccagagcgccgcccccgagacgcccgaagccttcttggcctgggcacgcagctccgcaagcagatcgggcctgatcgaggtgagctcgagcgcaaccacgcagatccgctctttgtcctcgagcaccaaggcacggaccgcaagaggatgacggacagcatcgaacccgtcgaagggcaggatgcctgcgagctccacgtctgccttgccagctcctgcccggcagggcgcttccgctatatgctccatggcgccggtcccttctagtcaagatgatagaggcgcttcgcgtttccggccagcatgagctccttgtcttcgtccgaaagagcaaggctccgcacgaaggcgggtccgtcaagcagccattccttcctgaccggataggatgtgccccagatgatatggtctgccccgagcaccttgacggcgcattcgagcgcatcctttccccagggctgggcatgggacatctcgaagaacagatgctcgcgcaggcgcttggcaagctctccgccatccgtctcgaagcgctggaccgcatcctttcttctgctcggcttcggcaggagcatctcggcgatcgcgaatatgccgccgcccagcatcgagtgcacgagcctgagatggggatagcggacgaagaaatcgctgaagagctcgcgccccacagcggtcgtctggtcgacgcagcggccataggagcgccgcaggttgttgtagtcgagaagcgacgaagcgtctaccggaatgggcacatggtgcacatagaccgtggcgcccttctcgtcgagcttctcgaagagcggggcaaagagcccgtcatcgagatagcgcgtgccgtaatgggcgcagagctgcacgccggcaaagccgagctcgtcgaggcagcggtcgatctcggcatccacgcgggggccgccagtcgcaggcacgaccgcaagcggcaccatccgcccgcccgacgcctcggcatacgctgccatcccgtcattgaagcggcggcacatctcgagcgacagccactcgttgcagcctggcaccttgaggatggccctgtcgacccccgcctcgtccatatcggcaagcatcgtctcgagacggtagtctccctctgcatagttgaggctcgggaagccctcaggcttctcgaccacgatctgcgtcggcccttcgcccttcttcagatagacattggtcccatagacgcggggcgcttccgcgatgaagcgatccagcgcttcgcggtccccgaagagctcctcgggaaaccagtacatgtttgcatcgattaccattgttgcctcccgtatcgcaggttggctccagtgtacgggagatttatattccacaacaattctgtttgtctgctgtcttattccatattggatatatagaggtcccgatgggatggatcaggcaccggctgccccggagcgggagaccgcatcgaggaagcgctgggcagcaggagaaggctccctgcccctgagatagtagaccttgatctcggtcgtgatcgtcggctccacgtcgaccagcacgacatccggagtcgccagataggcagcgggctttctcatcagaagcgacacccccatgccgcgccccacaaggtcgatgatgttctcgccgcgccgtccctggtagcgcacacgcggcacgaagccttcgatcgcgcaggcatcgaggatcagggcatgcatgacagaacccttgggaagaagcaggaagtcctcgtctgcaagctcgccgagcatgaccttctggcgccctgccagaggatggtcgaccggaagcacggcgacaagccggtcttcgtcatacggcacggtgccgaattcctcgtcgcccgagtccttcgaggcatccccatcccattcacggatgaaggcaagctcgagcctgtcctgtctgagcgcctccctgagctcgtcggcatctccctcgaagagccggatccgctcggtcggattgtcgtgctcgtagcgcgccatgatgcccgtgattccatagggcaccatgatcggaatcgagccgatatcgaggacatggagctcgttttcctggacatcggacagcgctgccagcatctcgttgtccacccgcgtgatcttctgtgcatagggcagaaacacccgtcccgccggactcaggtctaccgagcgggtcgaacgcacgaagagcgtgactccgagctcgtgctcgagcgacttgatatgcttggagagcgaggactgggagatgaagagctgctcgcttgccttgagatagttcctggtgcgggcaagaaccacgaactccttgcacttctcgacatccatctagtacgccgcctctatttcacgtatgcgcttgttgaggaaggcattcaccggcacgagtatgccatgcttctgggcccttctcatgacctctcccgaaaactcgtccacttcggtcctgtgatggttgatgcggtcctgccccatcgagggcgtcgaggaaggatcgagcgtctcttcgagggcagcataggacgaaagctcctgttcggtgagcgccaccccttctgcctgcgccacagccacgacctcgcgcatcgccgagatgaaggtccgccagagctcggaggttttgtcggcgtagacctctccataggtggcaccgaaggcgcagcaggtctggttgataccgacattgagcatgaacttggcccacatgcggtacctgatgtatggctccacgacatgcgcgatgccagcacgggtgaggatatcctcgacctcacggagtgcctcctgaggcgtcttctcgaagcatccgatatggagctcgcctgccttcgagtaggtaagcgatgtgccgaaatgcgctgcatccataccctgtgcaacgcaggggacgatgcgctcccacccgaagcgcgccgctatccgctcttcgctcctgatgccattcagcacgcttatgacgcgcgtcttctcgccgagaagggacggcacaagatcgagtgcgctttcgagcccatagctcttcacggccagaatcacgaggtcctgtacgcccgcctcttcgggcacggcatcacggaacgggtattcgcacccgttcacggttgagacatcgcctgcatgcttcgcaagacgtgccggatccatcacgaaggtgacggcgtccgcacccagcgcatcctgcaccatgctcccgtagagcatgcccaaagcacccttgccgatgattgcgatgcgcggctttctcatccaaagtccttcctccagaaaatgtttcggataaagggtatcgtggcccatcccctcagtgcagcaggttcacaacctggcaacaagagaaagcgcacagacacctgctctgcatgagcagaatgcatcctgtcctttgaactcgacaccggaatctttctgtcgagctgagctcgacaggacttccccgacaaaggaatccaaaatggctgaaaagggttgatttaaaaactcagccgaacgcccggggctgattcggagattctcgaggtcagaggaacgcgcccctctggcctcgagcgctctctctcgggggagggccagcccaggaaggcggcgcctgccctttccgatgacttcggagcatgattccagaaccctccggcagtcgcctcaagactcatccgaaaggtctggctgtggtcctttttccggggcggaatctgcttagatggtcatgcctctcccttcctcatgggcaaggagcgagggtgtgaggttgagctcgccggggcctatctcctcgatgccgagggcgtcgaggagcctctcggcgagccctccataggcaagcctgaacatcctgatgggggaaaggcctgccagggacggcctgggctccgagttcacgtggctcatgagaagggcgcagtcggccctcgtgaggccatcgaagctcgtccccttgggaaggaccttcctgagctccacgtggttgcgctcgcaggagcccttctgctgggactgcctcacgtcgcagcagaagacgcgggcacgccttgccgcgctgtccccggccgaccgctccatgagcccgtggtccgagaactccgccccgttgtcggtgaggatcgggtcgaagagcctgccgaagccatccatccccacggcctcctccagcgcgtccagggcccgtgcagcctcctctgccgtcttccccccgagaagcagcatgagctggaacttgcagggcctgagatatagggtgagcaggcacttcgagtcatgcaccctgccgatcgcggtgtccatctcgcaggcagaggacctctcctcctctccgaggccgaggaaggcggcataggagcgctccgccccgtgcgaggtgctcctgggagctgccttcttcttcctcggcttgtaggagagcttgcgcctgagctcgatgttcccggtgccggcgtagccctcctctatccatcggtagatggtggcggggctcacgtcgagggcgtatgaggcgacgatctgctcgggagagaggccgcgcgcgaggccctccttcacgcaccccatgatgtgctcgaactgctccctcgtcttgtcgatgccgcgcctcgaggccgagagctcctcgtcggccagggcctgtgccctggccgccctgtactctgcctgccacctcttcgggcagtggtagttgcgcagcctgcagccattgcacacatagggccaggagagcagcttcgggcaggcatcctccgggacgtccgcggccttctcccccttgccggggcccctcttcaccacgcggttcctcttcacctcgcagaataccgtggaaggggatctgccgaggccttccgcgatcgagcggcatgaccccctcgtgtcgagcgcggcctgtatcgcatgcctgtctgccttggtgagcctgcagtacttctttggtcctgccatgagatcctccagccatcggatggggcgaccttatgcgccccgtgcaagggagattctcggacttatctggacatgttcgcttcagtctgcgaacaccccatggggcgttcggatgaagttgctaatcaaccaatggctgaaaaggttgtgtcatgtgaatgagcacgtcattcgtgctgctgcaggcacaatagctgcgctatcataagcctagctgcggattgttcgggttctgccaaggaacagcaagcaccttccagcagccacagctttgacgattcacgcatagcaacttcgttggaggccgttctatgccatttaccgcgattgtcctcgctgcaggcgagggtacgcgcatgaagtctcgtcaccccaaggtcatgcacaaggtattggacaagccgctcgtgtggtggtgtgtccgcgcagcccgcaaggctggcgctacgcgtgtcattgtcgttgtcggcaatggcgccgatgaggtacgcgacttcttcgcccatgaacctgtcccggagggagaggcacctgtcgagttcgtcgagcagacagagcgtctcggcaccggccatgccgtccgcgtcgtgcgcgacgcaatcggcggcttctccggtcctgtccttgtgatggcaggagacactccgctcataaagcctgagacgcttgccgccctcgtggaggagcgcaaggcgcagcatgccgcctgcacggtgctgaccatgacaccagacgactgcacgggctatggccgcgtcgtcctggacgagcagggccaggtcacggccatcatcgagcacaaggactgcaccgaggagcagcgccagacgctcaaagagtgcaactccgcgacgtactgcttctgcggccaccgtcttgccgacaacctcgacaagatcggcaacgacaacgcccagggcgagtactacctccctgacctcatcaagatcttcgtctccgaaggcgagcctgtcggcatgcaccacgcacctgaggcttccgaggtcctcggcgtcaacaaccgtgcccagcttgctgaggtcacgaaggtcatgcagcgccgcatcaaccatgagctgatgctctccggcgtctccatgctcgaccccgaccaggtctgggtcggcgccgatgtgaccgtgggccaggacaccgtcctcatgcctcagaccatcctcttcggccacacgaccgtaggcacagactgcacaatcggcccgaacagccgcctcacgaacgcaaccgtcggcaacaactgcgtggtcgacgaatccatcctcgtcgactctgcaatcgacgacgacgtgaactgcggaccgcgtgcctacctcaggggccacacgcatctcctcaagggcgccaaggccggcacccatgtcgagctcaagaactctgtcgtcggcgagggttcgaaggtcccgcacctctcctacatcggcgactgcacgatgggcgccaacgtgaacatcggcggcggctccatcacctgcaactatgacggaaagcacaagagccataccaccatcggcgaccacgtcttcgtgggctccgacacgatgatggtcgcaccggtgacgatcggcgagaacgccctcgtcggtgcaagctcctgcatcacgcacgatgtgccggcaggcgcgctctccctcgagcgcagccagcagataatcaaggaagactgggcaaaccactactgggagcgtctgaaggaagaggactaatgtacgagaatctgtgcgaacccatccaggtggagaagaacatccgtctctactcgggcacgagcaacccgcagctggccgagaagatcggcgataccctgcacctgccgctttcgggcctcaagatcgagaagttcgcgaacggcgagatctacgcccgcttcgaggagaccgtgcgcggctgcgaagtcttctttgtccagtcccttgccggcaagaacgtgaatgacctcatgatggagaccctgatcgtcgccgatgccgcaacgcgtgcatccgctgcctccttcacggctgtcatcccccactacggctatgcccgccaggatcgcaaggccgcatcccgcgagccgatcacggcacgccttgtcgcgaacctgctcgaggctgcaggcgtcgaccgcgtcatcacgctcgacctgcactccaaccagattcagggcttcttcgacatccccgtcacgcatctgacggcactctaccagttcggcgactacttcaagacgaaggacttcgactgggacaacaccgtcgtcgtctccccggacatgggccgcgccaaggtcgccaagaagctcgctgactacctcggctgcgaggttgccattgcccacaagagccgcccgaagcacaacgctgctgaggtcatgggcgtcatcggcaacatcgtcggcaagacctgcattatcaacgacgatatgatcgacactggcggcacgcttgtcggctccatcaacaagctcaaggagatgggtgcaggcgacatctacatctccgccacccacggcatcttctccggctccgctgtcgagcatctccagaatgcaccgatcgtcgagtgcgtcgtcactgacgctatcccctgcgctgttgcaaaccagccgggctcgaaaatcaagtccatctctgttgccaaggagctcgcagacgcaatctacgccgtctacgtcaactcctccgtctccggcatcgccggcggcaactccgagatgtaggacatccgctcagagcaaagcgtttcagggccgccgcaaggcggccctttctttatgccaaggcccctttcccgaatccttctctccccttccctagcagaaagcctcctcctgcttgcgcagaaggaggctttcaggggagaaacgaaggaggtgctccacgcagcacaagggaggaagctgcgtggagcaggggattggggggcttaggaaagatgccagatctcgtcgttatactgggagatcgtgcggtcggatgagaacttgccggccatagcggtgttgacaagggacttcttcatccaggcagtgcggtcttcgtagtcggcgtagacacgctccttgacctggatgtaatcctcgaggtccagaagcgccatgaaccagtccttgttggccatatcgtcgtggagacgcttcaggcgctcaggattgccggtagccatgaacttcgggttcgtgatgaagtcgaccaagagcttcgtgcccgaccgcaggtagagatcgtgtggacggtaggcattctctgcgtagaggcgcacgacctcctccgaggaggcgccgaacgtatagatgttgtcctggccgacgaggtcggcgatctcgacgtttgcgccatccatcgtgcagagcgtcacggcaccgttgagcatgaacttcatgttcgacgtgcccgaggcctccttcgaggcaagggagatctgctcggagatgtctgctgccgggatgagcttctctgctgcactcacattgtagttctcgaccatgatgacctggagatacggggagacatccgggtcattggcaatccactgcgagagcgtgaggatcagatggataatgtcctgggcaatcgtgtaggcaggagcagccttgccgccgaagatgacggtgatcgggcgtgccgggatgttgccattcttgatatcgaggtacttccagatgagatagagggcaagcatctgctggcgcttgtactcgtggatgcgcttgatctgtacatcgatgattgcgtcgcgcggaatctcgacgccgcggttctcgcggatgaactcacgcatgctgcgcttcgcgatctccttggcatcagagagcttgccgagcatctctggattgtccttgtatttgaggaggccagagaggtcgcccgtcgtatgccagtcggtgccgagcgcatcatccagaatctgggtcagcgccgggttgcagcccatgatccagcggcggaacgtgatgccgttcgtcttgttcgagaacttctccgggtacagatcgtagaacggcttgagctcggactcctcgaggatcttcgtgtggagcgccgccacgccgttgatagagaagccatagtggatatcgatatgtgccatgtgcacgatatcgtccttgatgatagcgacagcagggtcgtcgtgctcctgcttctgcttgtagtcgagcttctcgatgatgtcagcaatgcgaggagagactgttctgaggaacgagagcggccacttctcgagcgcctcggcgagaatcgtatggttcgtgtaggcgaccatgcggctcacgatcgatacggcctcatcgaacttgaagctgtgctcgtcgacgaggatcctgatgagctcagggataaccatggtcgggtgcgtatcgttgatctggacgacggcatactcgtcgaggtcgtgcaggttggatccacgtgcaatggcatcgtcgacgaggagctgtgccgcgttcgacaccatgaagtactcctgatagacacgaaggagcctgcctgcctcatcggagtcgtcaggatagaggaagagcgtgaggttcttcttcacggcttccttgtcgaagtcgatggaatcagaaggcacgaggccatcatcgacaccgacgagatcgaacaggtggagcctgttcttcgtgttcctgccgtatcccaggacatcgatatcatagagcttcgacttcacatcgaagccgccgaaatgcacggtgtaggacgtaccggtatcgacgagccagtcctgctccttgagccactcatccggaagctcggtctgctggttcgcaacgaacttctgatggaagaggccgtagtggtagttgaggcccacgccgtcacccggaaggccaagcgttgcgatggagtcgaggaagcacgcagcaagacggccaagtccgccattgcccagcgacggctctgcctctgcttcctcgatcttgttcaggtcatggcctgcacggaagagctggtccttcacctcgttgtagatgccaagattgatgaggttgttcgtcagaagacggccaatcaggaactcggcggagatgtaatagaggcggcgcttgccttccgtcaccggaagctcggctgccttctcgcggaccatatccataagcatcgtgcagacgtcggaatcgtccagtgcggcaaggggaagtccgaacttctcgtgggcacgctgttcgagatcgatcatgggatgcactccttattgcatacaagaaaaagagagactgccatgcggatggatgctcgcatctaaacgaggcatctgtcctgcagcaagcccggaagcgcctcaggcgtgattggtgggtgtcacgctggaaacgcttccagctcttgcatagctacacaatacaccactctgctggaagcgtttccgagaaactcgacatttccgaaatttttttgctccttgtcgagttcaactcgacagacgtcgagctgcgtcgagttcagaaatctctgatgtcgagttcatctcgacatacattcaaaactgcaggtcagcgaattgccacaaaccgacgcaaattggccgtacagaagagatgatgacaaatctgcaagagaccgcgctataataagagtttcatgattgaggcaaatgccgttttctgtgccgatttccaaaattagtctactctgtatgactgattttcccggcatgggtatatccctctgtagccgaagcgcagggtgcgcttccatcaagcatcggagggttccatgtgcactgcaatccgtttctcg

SEQ ID NO: 101 - DNA, 48007 bp, Unknown
  Metagenome-assembled genome
atatatagtcaaaacctatttctcgtgtgaaagttgtggggttggcttcttgagcgtcgcacgctcaatgcgggctgtgaggtagaacagctgagctgcgctgcacgacagagccgctgcgattgattctaccgaagtgataccccaagtggtgacactccatcctccgattgtgctgtccaatgaaattccgatgttcatagcagaaggattcagggagcttgccagcgtcagcactttcgggtgctttagacgcgaggctttcataaagagggatacacagaggactgagaccgtatacattagaagaagtgcgatcacacacatgagtatgagcgagatgacggtattgctgcccgccacagcgaggccgatcataacggcggcattcaagaggtagttggccgcggctcccgcaacgccaaagtgttcgtcgacgacgccacccaaaagttggagataaagcagaagattccgtaaagtacgagggtactgctgatctgcgccgtatcgagggcgaatacttgtttaaagtggcccagttgattcgacactgaaatcaaccccgaaagagtgcccgcctccttcgatccgggggcttacgccgccatcagccctaagtgataccggtttgaggggcgtctcgtagctaagtagctggtggagccgctcgttgttgtactgcttagcgtaagcccgcgctgagccttcttgagctcgccgagcgctttgtactcgttgatcctcacgcactcactcttgaggcttctagatcatctcttttacgacagtgttgtcgacccacttggccttgccatccatgctctggcagatgtttcagcaagccagcaggcccttatacgttgtagcggagagaagcgatccctggtcgaagttggcgcaggagggtctttgtgctcctccagtgtctggcacgtgcactcgcacacgcctgcggcgcccatgtcggatgagtccttccggcccacgacacagcggaagaaccagccgatcacacagatcagatacaggtgcaagccccctatcggaatgtaggtgatctcgacgctacctggttggggaagcgtatcgccttgttcttcagcaggcaggggtgctttaccgagctcttggccggcttgggacaggttgggcgcacacccatcttctccatgagcctttgcgcccagcacctcgacgcctcgagcgtacggcttatcctccttgcacctgtgtaagggctgcttcaggtggacgttatccacgatgcgcatggcgcgcttgcgattcgatccctcaaaagagcgcctgcgcggcccttggccttatagtaggtgaacctggggatctacagctgctggagctgcctgaccacgttgatatcagcgtttcttgaatcgaccaggaatgtcttttatgtcgatgctgtagcgcttaagcaggcagtgttgaagatggtcgcgctcgccgacctcctcccggtgcttgtcgcactcccactcgtcctcggacgccgtgaacacgcgtgctatctcaaaggtagcctttgcgacccagttcttgaccaggttggggtttttaggtcgtactcaaaggcgagctcgttggcggtcttctttgcgtgcatgacctcgattgtgaccctcgccttgaactcggtggggtgcggctttcccttcggcattcacaaacctcgttttgcgtgcttgtgcacactgtgcgggttctcttttgaacgtcaaatcactgtccagatattgcgggccacactgcatacagcacaagctgtagctaagacaggaaagcttgctgtatctggttgtcctgtcaagaccagcacaccaaagagagacaaagaggtctgcgcagcacagcgatgtcacacagacactgaaagctgagtttttcttttgtctgccttatcacctgtgacaaaaagcgagcgttgaaagacagctatggtcctatctaagagtatctcccaacgtgtacaagctttcgtgataccaccttatctgaagtcagacagctctatacgaatgctatcaacctaagaccacaccagatgcctcgctaacaagacaccctgggaagtctttcactttcagacgttgcagttgatatgagaattcaagtaggatagtgtccataaagtttgtaaccagttcggcgatggggcccaatggagaggcctggtatggattcacagacattgattggtatcggggcggctatcctgactaccctgttgcagctatggttctggagactgcgaactcacgaagagcggagcctgtggcttggatttaccggtattttggctgccggatccttgcttgcatttgtgactatcgcgataccggcgatgcttcaagcagaggggtttgagacctaccgcaacgtcggtgctgtaatcgatatggtctttttgatcctgctgatgatcttcccggtcgctctggttattaccctcatcgtctcggggatcaaactgatccgtcgggaaggtgccagcttccgcaatgtcctgtccttaggactcggacttgggatgattgcctacctgatcatctggtcagttgtgaggaatgcgctctcaaacgtgccggtggcaggaggagtcttcgactttatctttggttttatcgcagttcttttctttatcttcggtatcgccttcacgctttacacggtctccgccatgatcgctcagatcccccattaccaccgtcactacgtcgcaatcatcgtccatggagcggggctcatgcccgatgggtcaccgactcccttgcttgccaagcgggtcgacaaggggattgagcagctgcataagcatccggaggcgatgctcatcctctcagggggccagggtgctgacgaggttcagtccgaggcaagctccatgaagacctatgcactggcgcagggggttcctgagaacaagatcctgttggagaatcactccgcgacgaccaaggagaatctgcagtattctgatgccgtgtgggcgcagtatcgaatagatcatccttcaaaagagcatcaggagacgcgttttctggtcgtgtcagataactaccatgtgtttcgcgcgctgctgctggcccgtgagctcaatattcaggcggacggcgtcggatcccatgtaagcctctactttgcgctcaatgcactggtgcgcgaatgggtggcttatatggtgctacgtaagcagttctacaacacatttacaatcgtgcttctggttatttacacgatgggggcgttgctgatcttaggctaagcctcgtagcaaggttgcttaaattgatgtcgcatatgccggttgagtatccatgcggggagctcaatcgacatttttctgttggcggtgcggctgatgtactggctcgctgtagcatttctatgaaaatggacgctcctatagatgtcaagagccgtttcatgggccttcgacatctatcggcatgctctcgagtacccaggcggaatacctctccgcgaacatccaactctcgcaccttccggactcaaatccgctcaccgtggaaggcgacaccccgagggcatgcgcgaccttggcctggttcaggccggcactcttgcacgcttccctgagcgagaacctgtcgacccgctcgacctccgtccctgagtgcatgagcgtatggtagacctcgcgcgcgatgtatcttttgacgcacctgattgcctcaagcttcgagagggcgtgtggccccgacatgcgccgcttaacgtagccttttgtccttggggtcgtatcgcatgcgcctcatcgcgacggtgtgcagcgccttgttggcacgccggtcagcgtccctgttgaggcgcatgcagcccgatgtcttgccagacgatgccgggatgggagacgccccgcacagcatcgcgaatgcggccttgctccttgagcctttctgggttgtcgcctgcgacggcgagctcggaggcgccccgggtcttaaggcactagattgtaagcagcgacgggcagggcttctcgaccgcacccctcatgagggactcgaaggtgtctgcctcatccctggcggccttccacgcacaccagggccagcagcgccctcgtcgatcttcagagccgccctcatcatcctctcctgggacatgccctcccagctgctgcgaacatcgtcgggggctgtcctggtaagcgaaagcgcggccacatggacctcgagcgcacaggacacgcagcgcttgcgcgccacaagcagcgaccttagctcgtcgagcctgccgcgcagcttggggatggacgtcccgtcggctgcgagcacgtcgcgcgcagccctttcggcatcgatctcgtcatccttgccctcaccgtgcctccttctttggtccttcttcttgttgaagacctccagcacattagagccgcacgccatcagcgcgtccgtgaggccagctccataggagccacataccctcaaagccgtccggcgtggacagaagcgctactctgcgcctctcgtccaagacgcacagccagtgcgtgtccgcgtgtgtgtcgacaccggcgacgaccttcccctcgagctttctgtctgtgagctctatgcccttcgacatcttccttccgtcccttcctcgcgccttgcctgccggcctaggcgggcaagacaaagcagtgaagggagcgctaacatagggttgtgtgagtcccaggcctgcgcttaggctcctatcaggtcatcgccaggccttagcttcggcccgtggcacaggacaggtccatttgagtgcagccccctcggagcgcaagcagcaaagatgggtcgccgcaccacggaccaattatccgacctgcccacgtgggcgggtcaactttgaattatcggtgctgaggacttacggcacagttaggtctgccgaactgcaagcggcttagggaaacgatgattaatgccccataacgtgtcagaggggaccgaccacacggcctttctaggccggtatgcgggaaaggcagggaaggatactcatccagcacgtgcatgagccgctatcctggcatttatcctgccgcatgcaccgcaataaggctccaagacggatcaagcgacgctgggagccgggaggtgcagcctgccggcaaagatgcacatggtaaggtttgcaagggcgaaggagacattgagcatacaggagttcttctctatccccctgtagcgtgtccttacgtgtttgaagcgccgcttcacgataaggaagggatgctctacctttgagcgaacggatgccttcctggactcgatgcccttttcggctgaaagcgcacagttaaggccctttatggtcgaaggcttccttgcgacactccagcgcatagatgagaggtgtgggtcttatgtgaccttaagggcgcttcgctatacctatatagcctaaagtctgcatagcagaacctgtcatcttcccttacgagtgcatgtgccacaggatatgtcagatacattcgcagcggtcgtctctacagcatgcacaaggccgctaccggcgtctacgccgatatgcgccttgtatcagatacgccaggtcttccctttcttggactggtgcgctttaagggtcgcgcgcatggtccttgttcttcgtggagcttaagggcctcgatgaaggtcgcatccacaatagagccgccccgcgccgtgatccctgccttctcgagctctaaattcaggtcgtgaagcatagctttaccgagtccccgccgcttaaggctatggcggaatttcgcaagtgtcgttgcatctggcacctgctcagacatgaggtctaagtgcatgaagcgctgccaggaccgggaatccaggatagcatctttaagttccctcgtcttaagagcccaaacatgacctgcagcagatacatcctaagcatcgtctccgcaccgcgcacatgcctgccacgcgcctgagaatggtagctgggttctaccagtgcaatccagctatcccatggcacgatcgcatccatccgctccaggaatgcctctcgccgagtcttcttcctctgaccctggaatttaaggtccccgaagctcatctggctgcccatatctgtcttttggatatgctggaatacgttgctgtaattataacatatccgcaggcagataggcatttatgtgggtatgggcactgtgtggttcgagacattttaagccggcggcatacagcgtacagccccagctacctcatcgaggcgaattaatcatcgtttccttaggcaactacggctgtagtgtgactgtctcggcgataccggagagcggcacatgcacgaggtacatcccatgcaggagctccatacatgcatcgttgcagcccctgtggctgtacctctagctgaaaaagtccgcatacgactgtgtgcgccttcggaaggctatggaacacttctttgacatatgccttgatattcgagatgagcctgcagacctcagggaagcgatgcgtcgccgtaagcgccatcacactccttctgggcgaactcgcagaaggaggagagcccgaccgatatccccttcatacatccgcccctatccgcgacctgtcagaagtcccccgagcagttcttagcccagtggatgacgcaggcaccctgtccatcacagtgaacatgggctgctgcttggtgccttttgccctggcttctatataggagacgtccacctcgagtgtgtcagctgagaggacatcgagtacacttcgatcttgctatggcgcagcagcaaggacgctgtcctgtagctgtggcctatctggcgcttgacgcacatgtgctcgtgctcagccgctttggtgtgccatgagccagaaggccacaaaccacgtcctgaaggcaggtaggtgttttccatcatcgtgtctgcagtgaggctaaagccggtgttaaatatctcgtgcactaccataggtgtgtgcatacccgtacaccttctgagcagctggcccctttgcaagccggacaggcaaagcttcagggggaacttctttcccaaaaagccttctttcgcacgactcctctccttgatacctctctgtgaggtccatgagcgtttctccctgcgcttgcattccttcaggctcaagcccgcctgtatgccctttggctatgtcttcctctgctttgccggatgcatcactttgtatccatatcgtatagtgcaggggtgaccggaagtgttgggactgtgccggaagtgcttagccatttctatgaaaatgcagtgagggatgtgtctacgatccctaatcggtttaatgtttgcgctgaaaattagttgacatatcaagggttgatatatcaactctttagaacgtgaatgaaaggtaggaaggtggttctgtggaacaatgcccagaacagacgggtgggcccggtcgctccctgttcgatatacacactctgctttcccaggcccaccatgcgcagcagaactatttctatccgtgcatgaaaccgatcaagttaggtccggggcagcctaagctcttgagctacctgcaggccttcggcccctcgacgcagtcgagtacggctgaatgcttcgggctcgatgccgcggcagtctcacgtatgctgaacgcactcagagagaacggatttgtaacgatccgcaagggtaccgactgccgaaccaagctggtctccctgattgaggtgggaaaacagatacttgccaaatgggagcaggtctgcgacgacgaggtgcgcgccatgctcaaggggctgagcgaccaggacattgcttgctttaagcgctgtcttcagaccgcccaccacaacctgattaacgctgaccagggaggaggtagccgtgaaagcaaacgataagcaaacagaactgagtgaccttgcgattgtcgggtcagcctttggaccctacaagcggtcctttgtgctcgcggcgatctgtgcctgcatcgaggcgacgatggagctcgttatcccgtttacgatggcacagatggtcgatgctgcgatcccttcgggcgatacagagctgattgtgcagatcggaatcaggatgcttttgctggcgcttgtcgcgggtgtctccgggatggggtatgctcatttcgcagcggaagctgcgatgggctttgggacaaacctgcgccgtagcgcctatgcgcatgtacagcggctctccttctccaacctcgaccactttgaatcctcctcactcgtgacacgcctcacgagtgacgtcacagtcattcaggacgctctggtgcaaggcttccgcccgcttctgcgtggtcccatcatgctcgttatggggctcattttgtcgtttacgatgagtccacagctcacgctggtctttgcggtcatcctaccttgcctggcgctggcactctttctgatcgtgcaccacgtggcaccgtacttctcagtgttgcagcaggcgatggatcgcctgaatgcagtgctgcaggagaatctcgttgcgatccatgcagtcaaagcctacgtgcgtgaaccctgggctgcggagcgctttgagggagtcaacaggaagcaggccgatatcgcgaccacaaccttcttgacaagcgtgctcaacatgccgatcttccaggcctcgatgaacgtcacgagcgtgtgcctgctgtggttcggtgggcagatgatcctgaatgggactctcggtatcggtgccctgacgggctttatgagctacgtgcttctgatcaacaactcactgcgtatgatctccaatgtattcctgctgcttgtgcgctcgcttaccagtatccaccgcgtgggagatgtcctgcgtgaggagccggagctcaaagagccttccgcgaagcaggcaatcaagcacgtgaagaccagctccttcagctacgaccacgtcagcttccaatatacgaagcacgcagagaaaccggtcttgagcgacatcacgctttcagttcccgcaggtagcacgctggggatcctcggcggaaccggttcaggcaagagctcaatggtgcaactcttggctcggctctacgacgtgagcaaaggctccgtggtggtttctggccacgatgtcagggactacgatatcgagtctctgcgtgaagcggtgggcattgtcctgcagaagaacgtgctctttaccggcacagtccggcagaacctggcatggggtaatccccatgccaacaataccaaagaactcacctgggcctgctacgttgcctgcgtcgatgagtttctggactgcatcggtggattggatgcggacttaggtcacgggggagccaacctctccggcggccaacgccagcggctctgcatcgcccgcgcgctcctcaagcatcccaagatcctcatcttcgacgacgcgacgagcgcctgcgatatgaagacggatgccttgatccgctcgcggctgtccaaactgactgacgtgacgaaagtgatcgtcgcacagcgtgtgacttccgtacaggatgcggatcagatcgtgatcttggacgacggaaagatcgaagggatcgggacgcaccaagagctcctggtccacgatccgatctaccgggagctctgcgtctcacagaacgtcgttgatgcaaaggcggtcgaagatgcccgctaaaggggaagctgcgaaccgccctcagaatctgtggcacaccgtacggcggttcctcacgtacttgggccatgcgcgttggcagctcttgctcgttgcgatcctagtcacgattgccggcgtcggaaacctcatcggtacctacatgattcggccggtagtcaatgccgtcggtaccggggatatcccgcgctttgtgcatctggttgccctgaccgcactcatttatgcgatcgcgatcacctcttgtatcggctatacgcagatgatggtgagagcggcgcagaagatcgtcttcgatatccgccacgaccttttctcccacatggagcatctgccgctctcctggttcgataagacgcgcaccggcgacgcaatgagttacttcaccaacgacgtggatacgatctccgaggcgctcaacaacagctttgcgaatatcatacagtcgatcatccaaacgatcggcaccttgatactgctcgttgtgctgaactggcgcctgacgcttatcaccgttgcctgcgacttcgtgatcgtgctctatgtgcgctattccggagcccgctcccagcggctcttctccgggcagcaaaagatcctgggtgccttggacggctacatcgaagagatggtcgctggccagaaagtcgtcaaagttttcaatcacgagaagcagaacctgcacgggtttgatcacctcaacaggagattgcagaagaccggcacctatgcaacctcctatgctctctcgatggtgccggtgacagttgcgatgagctacctcaactacgcggtggtagccgtcgtcggttccctcttgacgctgaacaatatggcagatgtcggagcgcttgcgagctaccttgtcctcgtacgtcaatcagccatgccgatcaaccaaatcacgcagctcggcagcttcattctgaccgccttggcaggagcggagcgcatcttttcagtgatggagataccggttgagaaggatgaggggaaggtgcagctgatccgcaccggtaagaatacctgggcgtggaacaagcctgacggattccggactccgctggcgggcgatgtgcgcctcgacgatgtgacctttggctacgtgccgggcaccacggtgctcaaagatctgacgctctacgccaaacccggtcagaagatcgcctttgttggttcgaccggtgcaggtaagacgacgattaccaacctgatcaaccgtttctatgagatcgattcaggtgagatcacctacgacgggattaacatcgaagagatcggccttaaggatctgcgaggatcgttgggtatggtcctgcaggaaacacacctctttgaggggacggtggcggataacatccgtttcggcaagttggatgccactgatgaagaagtgaggaaggcggcatcgatcgcaaacgccgactccttcatctctaggttgcctgaaggctacaacacacggattactgcggatggatcaaacctgagccaggggcaacggcagctcttagcgatcgcccgtgctgccgttgccgacccgccggtgctgatcctggatgaggcgacctcttccgttgatacccgtactgaggctttgatcgagcgcggtatggatgcgctgatgagagggaggaccgtctttgtgatcgctcatcggctctcaacggtacagaacgcggatgcgatcatggtgctggaacacggacgcatcgtggagcgcggtacgcgtgaggagctcatggcgcagaagggtgtgtactgggagctcgagaccggcgagttggagctcgaatagatatcactgcgctatctgacagaaaagcggaagaggatcgattgtggtcttcttccgctatgtctttacggttgtagcgtcatttgctgtgcttccgataaggattggtgtggcgtcgtttcccttgatgggagtggggacacatcggccgtacgaggcacttgggtccgtagccgatcaggccctcccggtgtgcccgatggagcgcttcaacgaccagatcatacttcttgggatcgcggtattggatcagggcgcgctgcattgctttctcatgtgggttggtgggacagtaaacgtgcttcatcgtcctggggtctaacccggtatagaagatacaggtggaaatggtagacggggtgggatagaagtcagagacttgctctggcatgtaacccagatcgcggcagaactctgcaagcttgaccgcaacctccattgtggagcctgggtggctgctcatcaggtaggggaccacgtactgctctttacctgcctctttgctgtaacgctcaaactctttacagaacttctcatagagcctgtggggtggtttgcccatgacgtttaagacctcagggcagacatgctctggcgccagacggagctgcccggaggtgtggtattctgtgagctccttgataaaggtgtggtcggagtcgagcatcgcatagtcgaagcggatgcctgagcggatgaagactttctttacgccggggatctgacggagcctgcgtaagagatgcacatacttcgtgtggtctactctcaggctcttgcagggggttggggcaaggcagcgcttgttcgtgcaggcgcccagtgtctcctgctttgtgcaggctgggatcatgaattgggcagtcggcccgccgacatcgttgatgtaacccttgaagtccggatcgtgcgtcatcgctgtcgcctcacgcaccaagctctcctcgcttctggcctggatgatgcggccctggtggaagttcagcgcgcagaaagcgcactcacctaagcacccacggttgctcgtaagggagaacttgacctcagaaagtgcagggataccaccttggttttcatacatcgggtgataggtacgggtgtagggcagctcgtacacctcatcgaggtccggggtggagagcggctttgcgggaggattctgaatcacgtaaagatggtcgtcaggatagggctcgaccagtgagtggctcaggtatggattcaggtttcgacactgcagcccgaagctttcagcgtaggtacgcttacttctctgaagttcattccaggagggaagcgtcaccgggtggtcgcactgctcggtgctctttgctcggtagactgtcccttggatccaggtgatatcgtggacatcgatgccggagttgagggcatcggcgatctcgacgatggagcgctcacccatgccataggagatgaggtcggcgccggaatccagaaggatcgagcgcttgagcgagtcggaccagtagtcgtagtgggcgaggcgtctcaaggaggcttcgataccgccgataatgatcggggtgtgcttgtaggtctgcctgattaagtttccgtagacggtggtcgcgtgatccgggcgcagattggtcttaccgcccggagaatagaagtccttggagcggcgatgctttgctacggtgtagtgcaacaccatcgagtccatgttgccgccgcacaccaagaatgccagacgcggctcacccaaggccgtgatgctcttgggatcgtgccagtccggttggggaatgatgccgaccttgtagccccgggactccaggacccggctgatgatcgcaggcccgaaggaggggtggtcgacataggcgtcgccgataacatagacgaaatcgcaccggtcccaactgcgatgcttcatatcttctttgctgactggcagaaagtgatcgcgcgttgggcgtggggtgatcggctcaaccgccttgctgtggtgtttttttgtatgggtatgcgcggtgtgcggatacattggttgctgagaatgtgacatagagagatccctttgcagttatgttcgctcacaacctagcataaacgctcggtcggacatggtggagctctgtggtatccacaaagttatgggatgggctgtggcagtgattgcaaaggtaaagccatctgtctccatagtggacacaacgaagcgttctgtctcagggctctcacagctacggggatacctgagcaggcgatgagcagtacccttaaaaagcgtttcttgttgagagtggcattgctcacttctgtggcagtgtcactgcgtgcagaagcttgaagtagatagatgactcccatgacagatatcagcgtgaacgctgctacacagtgtcccaagatcatatcgataaggtagaggagccacagcgcatcgcagagtatagatgacgttgtgtccatggctcgcctcaccggtatgagacagatgtcttaagaaccatacttcaggatgaattacggtggcacttcattcaataggtagaccaatacttactctcatacagcagaggagtctaggttatcggtcgtcgcagttgagctgttcgggcggcggagcagaagcgcacgcgaaaggatagcctgccgggagagaatcgataccgaaaaagcgttgccctgccgtaggggatgctgtcgagttcagggaggatgcgaggcgtatccgtcctggactcagaacgtgaggaacttgtgttccctttttgaacgttggctctcggtcgtgttcagatttttcagtatcacaattgatgtctaccgaggtgcatctcgacagatatggaacgctaacaggagtttcattattgagcccgatagaggcccttaccataggttgcaaaatgtttaaatattaaaggttctctgttggtggtaatatgtggaattacgtttcagatgcgttactatatgggcagtatgtattgtgacgcagggaaattgtgtcacgaacgtgctctgtgacttcgctcattgtgggcgaaagagcaggttcatttccgtccaatatgggacggaccgtatcacttcaaaggagaggatatggcaagaaagttcaagtcgatggatggtaacgaggccgctgcgtgggtctcctacgcattcaccgaggtggcgggcatttacccgatcactccttccagccctatggcagaccacgtcgatcagtgggcggcacaaggcctgaagaatgtgttcggaacgcctgtcaaggtaattgagatggagtctgagggcggtgcttctggcactgttcacggttctctgggcgctggtgcactcactacgacgtacaccgcttcacagggtctgctcctcatgatcccgaatatgtacaagatcgctgctgagggtcttcctggcgtcttccacgtcagcgcacgtaccgtcgcaacgcaggcgctcaacatcttcggtgaccactccgacgttatggcatgccgtcagaccggctttgctatgctcgctgagggcaacgtacaggaagttatggacctcgcaccggttgcgcacctcgctgcaatcgagggcagcactccgttcctgaacttcttcgacggtttccgcacctcacatgagatccagaaagttgctacctgggacttcgatgatctgaaggatatgctcgacatgggtgctgtccagcgcttccgtaaccacgcactgaacccagagcatccgcacgcccgtggctctcacgagaacggcgacatcttcttccaacaccgtgaggcttgcaacgagcgttacaacaagatccctgagatcgtccagagctacatggacaagatcaatgcgaagatcggtacccactatcatctgtttgattactacggcgccgacgatgcagaccgcgtcgtcgtctgcatgggttccttctgcgataccctcgaagaggtcatcgactacctcaatgcacatggcgagaaggttggcctggtcaaggtccgcctgtatcgtccgttcgacgtcgacgccttcgtcaaggcacttccgtccacggtcaacaagatcgctgtcctcgaccgtaccaaggagccgggttccatcggcgagccgctctacgaggatgttgtggctgccctctatgaggcaggccgctctgacctcgttgtcaccggtggccgttacggcttaggttccaaagacgagcctcctgcggcagccttcgcagtatatgaggaactcaagaaggatcagccgaagcgtgagttcacgatcggcatcgacgacgatgttacgcatctgtcccttccgatggatccggatgctccgaacactgcagacccgagcaccatcgagtgtaaattctggggtctcggcggcgacggtactgtcggcgcaaacaagaactccatcaagatcatcggcgaccacaccgacaagtacgttcaggcctacttccagtacgactccaagaagaccggcggtgtgacgatctctcaccttcgcttcggcgatgccccgatccgctcaccgtactatgtgaccaaggccgacttcgtcgcttgccacaacccgagctacatcgtcaagggcttcaagatggtccgcgacgtcaagccgggtggcacctatctggtgaactgccagtggagcgatgaggaattcgcagaccgtatgcctgcggaagccaagcgctacgtcgcaaagaacaacatcaaggtctacctgatcgacgctatcgaccttgcacagaaggtcggtatgggcaagcgcaccaacactgtgcttcagtccgcgttcttcgcactggcaaagatcctgccgctggatgacgcgaagaagttcatgaaggacgcggcacagaagtcctatgcaaagaaaggccagaatatcgttgaggccaattggaaggctatcgacgctggcgcttctgcattccgtgagttcaaggttcctgcctgctgggcgaacgctcaggacgaagagcatgagattacccttgagggccgtgaagagatcgtcaagcaggtcaaggagatcatgcagccgatcaaccgcatggagggtgactccctgcctgtctcctcattcaaggacaacccagatggccagtgggagctcggtgcttcccagtacgagaagcgcggtaccgcagtcatggttcctcgttggaatcctgacgagtgcatccagtgcaacagctgcgccttcatttgcccgcacgccactatccgcccgattgtgatggatcagcaggaagcagacaatgcaccggctgctatgaagaagtctgacctcaagcttccgaagaacaccggttacacctatacgatcgcggtatccccgcttgactgcatgggctgctacaactgcctgtacgtctgcccgaagtccgacgttcagaacggcggtgcgctgaccatggttcctcaggaagaggaagctgcgcaggctgaggtttgggactacgcggtcaacaaggtcaccgagaagtctgagctcatcgacttcaagaccccgagaaacacgcagttcaagaagccactgcttgagttctccggttcctgcgcaggctgtgctgagactgtctacggtcgtctggctgcgcagctcttcggtgacaacatgttcatctccaacgcaactggctgctcctccatttggggcaacccggcaggcatcagcccgtttgcaactgacgcagctggccacggccctgcgtggaacaactcgctctttgaggacaacgcagagcatggtctgggtctcgagatcggctatcaggcagagcagaaccgcctggtcgcactgacccagcagctgatcgcaatggacgacgttgatgacagcctcaacgacgctgcaactgcatggctcgagagccgcaacgacggcgcgaagtcccgtgcagcttctgatgcctacatcgcacagctcgaggcgaacgacatcaacagcatcactgaggagatcctcaagaataagagcttcctgtccaagaagtccttctggatcttcggcggcgacggctgggcctacgatattggctacggcggactcgaccacgtccttgcttctggcaacaacgtgaacgtcctcgtcttcgatactgaggtctattccaacaccggtggacaggcatccaaggcttccaacttgggccaggtcgcacagtttgcagctgccggtaaggccaccaagaagaagtccctggctgagatgcagatggactacggctacgtctacgtcgcacagatcgctgtcggcgctaacccggtccagacgctcagagctctcactgaggctgaggcctatgacgggccgtctctggtcatcggctactgcccgtgcgagatgcactccatcaagaagggtggtctcatgcactgcatggaggaaatgaagcgtgcggtcgactgtggctactggaacctcttccgttacaatccggcaaagccggctggcaagagattcagcctcgactccaaggagccgaagggcggctatcaggagttcctgatgaacgagtcccgttacgcatccctgaagagcttcttcccggaccgtgcggataccctgttcgctgagaacgaggaagccgcaatggagcgctatgctcaccttgtccagctcaaggaaatgtatgccaaggcgtaacgatacctcagcgagcgactagcttcgcatagacagtgagggccggaagccatccgtggcttccggcctttttcggtagataggtacgaacggtacaaaaaggactccgcaggtggtccctccgaagtcctttggcttatacaggtaagttgttctgacagtgtcagtcctcttctcctgtgaaggcgctcgagtaggcagccttggcactgatcccgtcgagggcgccgatcttgccggcgagtgaggagatcgtattgtcggttgcgtcgaggacgatcgagattacgtccatgtggtgctgacggtaggggatgcccatcctgccgataatgtattgagagtactcgtgcaagattttgttgagaggatcgaccgagtccggattttccacaatgataccgatcacggcgacgcgtgttttcatggcgctcctaactgctgaacgatcgttggtttgtgtgcatagcttaaagcgtatgcgccacatataatggttatacccgattacaaggcgcccctaagctccataggcgcatgacaggaaggaataagtatcatgagtgccaatctcacccggcgtgaagcccttgctaccttggcaggcctcggattttcaagtgttcttgccgcgtgtggaaattcacaatctcccgacaatcagaataatcgacagcagcaaaccgaagacgtagtggttagggtggcgacacttagaggtccctcctcgattggtttggtcaacatgatgaacgacacctccggtatccctggggatgggggagatttgagctctgtaggggatcctgaggaaggctccggcatcacctatgcctatcagatctcgagcgcaccggacgaggtgacgccgatggtggcacaggggacctgcgacatctgctttgtcccctccaatgcagcctcgatcctctacaaccgtaccgaggggaatgttgagcttatcgatatcaacacgctcggcgtgctctcggtcgtgaccggtgactcttcgatccagcagtgggaagacctggcagggcacaccgtagtgacctcaggccaaggctccacccctgagtacgtgattgagtacctgctcgatcaggcgggcatcgctgaccgtgttgaggttacctacgagagtgagcaccagcaggtagcgactgagctcgcctccgatcctgcggtgatcgcaatcctgccgcagcccttcacgactgtggtggagactcagaacagcgacgtccactccgtgatcaacctgaacgatgtctgggatcgctatgccggcgactccggatccaagtttgtgctcggctctacaattgcccgcaaggactttgtcgagcagcatcctcaggccgtggcggacttcctccagaagcatcaggagtcagtgcagaagtgcaatgacgacccggacggcaccgcagatctggtcgtccaggcgggcatcatcgcaaagaaaccgatcgcgcaagccgcgatccccaagtgcaatgtggtgtgcatcacgggcgatgagatggaggatgcccaacgcggcttcctgcaggtgatgagcgatgcgaatccggactccatcggtggtgccctccccggcgaggatttttactacaagggatagggatagatgcggagagcttcgcagaaatcgcatataaaaacagtactggctgcactcatctggattggtgtgtggcagttggcaagcatggcagtgggaaaccatctgctgctcgcaagtccagttgataccgcggtgacactggcgtcacagatcgtgacgccagtgttttggactactgtcctgcattccttctgtcatatcgcggtggggtttctgatcggcttcgccttggcagtggtgctcgggtttgccgcctaccgcctcccttggctgcgacggctcttggagcctgccatggacgcgctgaagtccatcccggtagtctgcttcataatgctgctgctcatgtgggtcggacccaaacgggtgagcattatcaccgtggtgatcctcatctttccggcgctctatttttcggtgctggaggggctggactcacaggatcatgaggtgatcgacgagctcaaagtgatgggcgtcaagccccatgtacgcttccaggtggatacctaccagcaattgttgcctttcctggtcgcgacttgccacaatatgtgcggaatggcgtggaaggcaggcgtggctgccgaggtattggcttccccacggggcacaatcggggagggggtctaccaagcgcggctcttgctcaacactgcgggcctcttctcttggaccatcacgatcgtcctactttcctgggtgtgtgagcgactctttctgaaggcgcttactgctacgggtccctgggcactcaagcgtgccttgcgcaaccagaaccgactgcggccacagacctcgaaggtccccggtaccatacgttttgtgcataccgtgctgggttatccggcaacctcagaccatgcggcaccggtcacggtctctaaggaattgacgggggagttagagggaggctcctggatccttcaggacgcttcaggttcggggaagaccacctgcctcatgaccatctgtgggcttctgagacctctccagggcaggatcgaggccccggtagatatcgctctagtgtgccaggaaccgcgcctggtaagcgcgctcactgcctcagagaatgttcaattgacctcggtactgactgaacagggggctaaggaactcctgtgtgaactgttgtccgaagacgctttgtcccgtccggtctcagagctctccgggggacagaagcggcgtgtcgagttggtacgggccctcgcacatccctcagcgctggtgttgctcgatgagccctttgcttcgctcgacgtgcagagccactatgctgcggcagcctttatcagaaaacatctgcaggggagaacactgatcgtctcctcgcatgtgcctggagatcaggagctgttgcacgcgcaactgctcaatatcttgaagcactgatttactcgaagcaggcttgctcaatgtagtgggcaagggtgtcgatgccctgtttcttttcagcagaggtgaccacacaggcgaggggatcgagtccgaaggcattcgagagcttcgtgaggttcgcctgctgcttagcgtggcttttcaacttgtcggccttggttaaggcgacgatgaagggtagctcagtgctcttgagatagtcgatcatccgtacatcgagcgtctgcggatcgagacggatatcgatcagggaaatgactaagttgcgggagcgctcgctttcaaagtaggcagagatcagctctgcccaacgctgcctgtcctgcttactgcgatgggcaaagccatagcccggcagatcgacgaaatggatcccactcgcttcgaagaagttgatcgtttgggtcttgccgggttttccggagacctttgcaagcgcctttctgccgagcagtgcattgatcagtgaagacttgcccacattggagcgcccgacgaaggagacctccggctctgtcgagggtggcaactgttccacagtgccgaacgaggcgacaaattgagcgttcttgaaggggttggccatctacaggttctctttctcaacgggggagccttcgagcatcgaggtgggcttaccttggctcaccagcactactttgtgcatcgcacggctgatcgcggtatagaggcgacgacgatatctcggcgtagcctcatagacacttgcctggacgtccggcacaatcaccgtgtcgaactccaaccctttcgccattgccaaatccattacgaccaccccggagagcgggaggatatctttgtcctccaggacgcgtactgatttgccaagctgcttgccgatccagtgtgcgcgggcgcggtcatcggtcacgattgcggtgagaccgttttcctcacgctgcccctcgacaagcttgcgcagcgtgtcgaggtaggtatcagcgtccttggttaccaagagcttggcggcgacacctttacactgcactgagtgggtctgaatggcttcgtcgcgctcgtagaggctcataaagaggttggtgatctccggggtggagcggtagctcgtgagcaatttcaggcgctttatgtcgacgtccttctttgtgatacctgcatccttgaggatttgctctaactggtcaaaggatgcggaaccttcgaagattgactggcgggcgtcacctaagagcataaagtgggcgttactgaagtatctcgccatcaccatgagttgagcgggtgagtaatcctgtacctcatcgaccataacgtaacgggcgttgcggtcaccggcgccggtgatcagggacctcaggtagaggtactctgcggcattgagctggtggccgagcaggcgctgtccgatgcggtcgattctgagccagcctgcggtttcaatcagatcgtggacgtctgaatacttgtggtccacgtagagcctggctaagcgagtggtgtctgcctcatcgacggggttgatcggttcaccgaagaccgcaatctggtcctcgatatcagctcccagcatctcttcgtggacgccttcgtcgcgtgagaggttggtgaggcgggtctcaaggcgttcgtgcagcacatccttcaccatcgcaatcagcctcggtcccaacggggtgcgcgggaacttcgcaaaggcgttctttacctgtgatgctttgatcagctgtacgtcacccacactgataccgcgcagatcatctggttcaagcgtgaggcctttgactgtggtttccatcttcttgagctctgcagggtcggtgtcccggccgttcgcacggtcagcgatgccttgcgactctataaagttgcgccaggtgaagctctgcgggttggactcacccaacgaggggagcaccgtgtcgatgtagctttggaatacgttgttcggcgtaaagaggtagacctggtccgccttcagtgtctcacgttgctggtagaagagataggcgatgcgctgcagcatcacggaggttttgccggagccggcgataccgtcaacgatcaaggccggaatgtcgctgtggcgcacgaccgcattctgctctttctgaattgtggcggtgatcgcctgcagcttctcggtgtgatgggacttgagtgccttgagcagaagggcatcttcaattgcgaccgtcgtgtcgaagtacatattgagcttgtcttcggtgagatcgaactgtcggcgcagtagcagctccacatcgtggcgcttcccgttgacctcatagctcgtcttgccgttttcctggttgtagtaggtctccgcaaccggtgagcgccagtcgacgatcagcggacgggagtccttgtccatcacgccggcgaccccgatgtagatgtcgcgtgggggatggtcgggatgcatcttgagtgtgaccttcgcaaagtagggctgacgcaagagcaccatcacgcggcgcagcttctcgacatcgaaatcgtgagcctggttgtaggagtcgataacagagttcaaagtctcgattgcggccaaggtctccatcgtctcatcgtctgaaccgtagtcttgggtgatttcctcagacatatcgtgtaggtcctgggcagcctctttgtgggtcacctcaaggcggtggttcaactcatccctgagctccagcagcttcttgtaggtttcggagagcttctcctgttccttccggaataccgaatcattttgcaacgctttctgctgcttgtttgttagggcctcgctcatgaatatcttttatatccttccgcggtgcactgaatttatcagtgcatgaatatacaaactcaaaaacgcacagtattatattgtgccccaaagccgtcaacctattgcacggcaatgcgtcaacggtacagtcctctgaatctgtgcatttaattgtgcagatgacttgtaaattagcccataagcaaccgccgcctacaacccatcacgaatcaagcctcatctgccgctgcgcgcgggctatctctgcgagcgcctccttcttcctctcatagctcctcgaccgccgacaggcaagtactgcttgctcttcaccatccatctgtcgttctcctcgataaggtaggcccccacgagcttgatgagtaagccctcgctcgggaatatagcgatgagcttctgggagcgcttcacctcagtgttgagcctctccaggcagtttgaggtcctggtgcacctgcacctgcgggagggccatgacttccaattgtgtccttaaacccggcgtccaggcactccagtgccttggggcacccccgcggcgggcctgtgacctgtatcattttttcggacagtgcggcttgaggaattatgaggctcctcttaactgcaagacaagccgaccgaaaggactacaggtaacaaacaatcccgctaccaaatacagcgatgagtagcgcctgaaaacagctgagtgtgctatctccaccggcaagcctaaaagccaccttaccaccgagttagggctaaagtcccaaaacactaaagccgctgggtaaaagatcgtagagataggctatcaggtgcttaagcgcagcgaggctaaagaggaaaagctcaaaagccttatgctaagcgcagcagagagcttgagatggaacatgccttcttaaaggcagctgttaagccttctttacaaaggatctaagcgcaatagattgttacaagtgggtgcttgaggagaaggaaaacttcccgatcaagatacaggctttaatccttaaggtattacgctcaagcttttattcatgggtgttccaagggagcaccagaaaacaggtgaggtgagcttaaagaggctatcaggcgcttgtgggcggactttgacagaggttttggggctaggtttacacccactgctatctagctgatgagttttcccacactaccctctacagggtaggaaaatgcatgcgcgagcttaagaataaagggctcatcccctttacagaggtggattagcattctgagtgcaacaggatggcccgctgaatgcaggcgtggcacactccggaaggctacgatgttggttgtctcaatcaacgtcgaaagctaaaaggaatgtgccactacaagcatcgtaagcctacaggagagggactgcatagccgagctgtgtggcacaagggaagctccattgcctatatcgcggcagagatcggcaaggacagctccagcgtctgccacaagctcaagaggaacgcacggcacagccactatggagcctgtactgcccaaaaggagggcggaagagcgccgcaggagatgcagggcgaaaaggcggctttcagaccctgcgcttacgcagaaggtgcgcttactcatcatggacagacactggtccctggaggagatagacaacatctcaggctcgagggtggcggcaggtgcaccgttgagcctgccgactattctaccgtgaggtccatagccgccaccctcgagctgccggaagccggcccgcaaggccaggtgcggcgccacctgcgcagaaaggggaagaggatccgcaggaagaggcctaagatcaggggcaagatcgagatcttacacaccgtggatgagaggcccaagaggccgatgagaggtttcgcctcggagagtgggtagacgacacactcgtgacagcgggccccgtgtgcctgcttatgcttgccgacagggcattcaggctgcttgccgcgagaagatgccaccacgacagcgggagtgtctttaaggccgaggtcgggctgctgcaggaacgtcccctcgagacgctcacttccggataggagcaagcagttcgcagggcatgcagggctcacagatgccctttgaggcgtgcagttctacttctgcgacccccaccatctatggcagaagctaacagttaagaacaccaacgggatcctgcgggagttcttcccctaagggcagcgacttcagcaaggtcacaaacgaggaggtgcagcatgcggtggagctgatcaacgacaggccaaggaaggtcctgaaatacaggacagccaacgaggtctttagggagatgttgcactcagcttgacaatctgccaccttaaatcctaaggtcttaggagaaagacccggcgagaggcattcctggagcggatgaatgcgatcgttgtgtgggatagctggattacactggtagatatcagctaccactgcagctaccactgacaggctcttgtcaggcatgtgcgcggtgcggagacgatgctttaggatgtagcctgctttaggtaatgtttgctctcttaagacgagagaacctaaggatgctatcctggattcccggtccatgcagcgtttcatgcacatagacctcatgcaagcgcaggtgccagatacaacgacacttgcgaagaggcgccatagccttcaagcgagaggagttcggcaaggcttgtgctttgcgcctggacttaggagctcgagaaggcagggattacggggcggggcggctccatggtgggcgtgaccttcacctgggccctaaagcttaacgaagaacaaggatcatgcgcgcgacccttaaggcgcaccagtccaagaaagggaaggagtggcgtatctgatacaaggcgcatatcggcgtggatgccgcaggtggccttgtgcatgccgtagagacgaccgcttagaatgtatccgacatatcctgtggcacacacactcgtaagggaagatgacaggttctgctatgcagactttaggctatataggtatagcgaagcgcccttaaggacgcataaagacccacacctctcatctatgcgctaaagtgtcgctaagaaagccttcgaccatagagggccttgcctgtgcactctttaccgagaagggcatcgagtccaggaaggcatccggccgcttaaaggtagagcatccctttccttatcgtgaagcggcgcttcaaacacttaaggaagcgctactaggggatagagaagacctcctgtatgctcgagtctctctcgcccttgcaaaccttacccatgtgcatcttttgccggcaggctgcacctcccggctcccagcgtcgcttgatccgtcttggagccttcttgcggtacatggggcaggacaaatgtaaggatggcggctcctgtacgtgctggatgagtatccttccctgcctttcccgtatgccggcctagaaaggctgtgtggtcggtcccctctggcacatcaaagggcattaatcatcgtttccctaggacgtcaagaatgtaaagccgctcacggtcggaaaggggccgctcggggaagtcccgagcggccccgattccctcccgccacggccgcagccaaaccctcccgcggccgccctccccgccgtcaggaacacctaacgacggcggagaaggaaatgaagttcgtcgtttctcgcaaggaagttcgtacgctcgtagttgcctcagaaaaccaacatccattgttaccatcctactgatgctcacgctcgattttcaagaatccctggtagaaggcatctggaaatgcgaatgtcctgtcacgtcctccaagcctgatgacgatgcgggttccctcgatgcttttgatcctgccgtttccgaaagccttgctgccgataacgtccccagcgccaagcgagtcgatcttcgccccgaggttccggcgggcttcctcccgcgcctttcgctgggcacgttcccgttcggccttctcactctccgtctcgacgggactcgcggggaccgaggagaccgccaacgtcacctttgaaggttccccttcctttgaggagcgctcctcggtgatgctctgcacaacgtaagtgtcagctcctccagtcggcctcgccttgccgtcggaaccgaggcgctcgtcctggaaccgcatctgctggtagtccgtctgggtcagctcggtgtcaaagaggcccaccttccggtcgtagcggtgacgctcgatgcctgtgtaggagagactcgcgtcctcgtatctgcgaaacttgtacaccgcatcgttcatgagtccgtcgttgaagacgccgagggagaccaggagctcgaagtcctttacctcgagtcccgtgaccttcttgaacaggccgggctcgagctgcgtgatcacgtccttcaggcactgctcgcggaaatcggtgaggtacatgaagaccggaattctcgtggcgaacttgatgagcttctcctggacctcgcggcgcttggtcttgtactccttctcctcgtcggagagctccttcttctgcttcgtggtgagctcgccgccctcacgcttcgccttcttcacggcttccgacttattgatgatggtcttgatgtcgtcgttgaggctcctgaacccctcgatgctcatgagggccctcatcgcgtcctcgttggcgaggagccttcggagcgtgtcattgtcaacgttgacgaggagggcactctcccagcgacgtgcgaggagcgtcgccgacgtgccggccatcgccatgtcgaggatgtcggcggcgtcgacctcgcgcatcgcgctgccgtcgtaggcgagcacgggcaggaagttgatgaactcgcccaccttctgctcggggctctcgtcgttcacagacaggcggcagctgtagtcgcacaccatggtgagcgcccggtcgagagcgaagtcgaagacgtaacactcctccttgaggtcctgaacgtgtccctcgtcgtccctggtggtccaggggctctggacgcggaacgcggtttggaagtacgtctcggggctcctgaggttgcgcagcatgagcactccggaccaggggcggaccgtgacgcctgtagtgagcttgccgcatgagagcgtgatggtctttgtgcgaagcgggtcacccatggcctcgcggaccggttctaccgcctcgacgcccatgccggcaccaggtccggccgcgacgattacctcgtagtcgtggaagaaagtgttctgcctctgggcaagcaggttggccatcgcctcgcacgaggagacgttcggaaggaaccacagggtgtgtgtaagcgtcgagagcagcctcgtgtcgctgaacggcatgggcggcttctcgacgccgagcctaaggtcgtctaccgccgtctcctgcgacgacccacggatcaggtcgagccacttctggacgtactcctcgtagatgaagcgtgcctcgctgccatgccccttggcagagaagaacagattgaggtcgaactcgttgaactgcccctgacgggctatccgggtgatggagtccggtaccttgtaggtcataagcaccatgcgcgggagattagcgtaggggttgtgcggccccctccagtccctctttgcctcctgctcgtcggagtaggtccagttgaacacctgttcctcgatgaactccccggagttgagcgcacggaacggggttcccgataggtagaggtagaagcgagactggattggcagccaggtctcgtcgagctggttgcccgacgacgcctcccgtgccgccttcgagtcgtcgtcagcagatgggacatagtcgtcgaagtcgtctcccgtatctttagcgctctcgaagagccgcttggcggagtccttccaggcgccgaagtgatactcgtcgaacacgacgaggtcccagtcctccaggtgaacccactcgttcctcggcttgattccgccatcattgcccggctgtaggaagtcctggaaggagccgaagcagacaatgggcctggaggggtcgcagtcctcgtaccgaccagcgtttctcgcgacgaactgccatccctcaaagtcgacatggctctccaggtcatcctgccaggcgtcctccaccgcgggcttgaaggtgaggacgagaaccctcttcatgcccatgctcttcgcgagctcgtaggtggcgaaggtctttccaaacctcatcttcgcgttccagaggaaccgcgggactctctgggacccctcctgctcgcagcgctcgaagtagcctcgcgtcatgtcgaccgcgcgcctctgctcggggcgcatcttgaagtcctcggtcctctgcgactcgtagtccttgcggtcccttacctctagccatgcgttgcgcacgtcgtcgacggtgcattcgtaccactcgccgccgacgcagcggaagccgtttcgctcgaggcggcggtggacgtcatgatccatgaaggtgctgccgtcgtccctcacagcgctctcgttgaagacaatcgtatagggcttccccttccccggctgtatcacggggtgctgctcggcgacgcgctcctcggcggtgcgcgtcgtgtagccgacctttagaaagcccttgtaatcaggattactgtctctgtatgcgtagattgcgggatgtgaaggagggcgcaccgggaactgaacattagtcattgctgctgtcctccatagaaatctcgatgatagaggactcgaccgcatctcgttctgatgcatttaatccatagcgctcataaagcgtcttgtcactccattcgacgcctacatccggaattgggcacaacgcgaaagtactcttagtcaaatgctgccccgtggacatctgggcaatcaaataccgaggcaacttgcaagagaggtagcgctggagattaagggcttcttcttcggtgtcataggagccataaaccaaatatgtttccgtgcatattgtgcctggaggaaggatgcgcatcactgacagcaccttgcgcttgccatctttgttggctctccccgcatggtcaaacgagacatatgatgcgaccactttccatttatcaatcatgtcgaaaccggcggttacgtgacttctgctgaatggcccctctccgccgatgaaacgcagggtaatatctcctgacttttcaggctttacattcgtcgcaagtccaaacggtttacgcgaggacacctgagtgtccattgtcgcctcatgaagcttctgcactttatgcacaattgacaatgcacgtgagtcacgaatgaatactgggtattcgtctaaatcacgagcggcttcgattgtctgattccccgagatcgtctcaacagcacaaagtcccacatttctatctcgctctcgaaggaaatagcagacaccgcccgcaatatctactcccgggaagcagtcctttgaatcagggaagtcaacaaggcgcgtaatgtgattgtcacttagcatctcctgacggaaggagtccagtccttttcctcccgtataccagcgcgctggaataatcattacaagatatcgtggtgcaagcttctttgcctgccgcacaaatagctgatacagcggagaagcactagccttattgccgccgtcactcaactggtacggcgggttgcctactatcacatcaaacttcatcttgaagatgtcctctggtctcttggtatggatgaactcatacgcatgactctctaggtccgctgagcgccggtactccttctccgatgccccacagtagacgcacttgccatccttccaggtgtgtcggatgccgcggaaccggacgttaccttcttcatggtcgaatagggagaccgagaacctgccgtttgcatacttggagcaatagaggctcctcctgctcatgagggaagtcatctcggtgattgcgattccgaagagctgctcgtgcattatgtggtcgactcgctcctggaggtccgggtagataggcgcgagcccctctatgaaccttttcgccgcctcccggagaaacacgcccgacttgcagcacggatcgagaatccggacgttagggtcctcccacaactccttcgggagcatgtcgaggacacggttcgcgagctccggtggggtgaacacctcgtcgttgctgaggttggcgagacacgttaggacatcggggttatatgtcctctcgagaaggctagccattcttcgaaacttccctgtagtcaacaggcggatactctcgaatcgaggcggggatgagcccgtcaatctcagagtcgtactcccatccggtttgaaaaaggccgagctggtcgccctgcttcgtgtcaccgccagccattagctcgtcgagccgatagtccttcctcttcacgaggtccccggtcaccatcgaccactctgagaagataattggagagccgtcgtcctgcaccatcgtgagggcgtccccgcacaggacgttcttctcgaggacgtaacgggcggcgtcaaggaacgcctgctccacctgcttgccaatcgcgtccctggcggcagcctcgacgatgcgtaagagcctctgccgacactccgccacgttgtcggtcatgatgtcaacaccatagatgctcgagaccgcaacgaacgcgtagcgcatgtactcctgggggctccgtgagtatcgctttgccacgaccgcaagcttccgccttagcacctcggcgaggaagttaccctcaccgcaagccggctcgaggaaccgggagtcgatgcgctcggtctcttgcttcaccaggtcgagcatggcgttgacctcgcgctcgttggtgaagacctcgccgtgttcctgtacacgctcgcgcgactttacctgccctgccacgttagcgcctcccggaggtgagctcgttgataacgcacgagcgcaggaaggccgagaagcttaccccacgtagacgcgccgtctcagtcgccgcctccttgaggttcttgggcacacgaaaggtgacggcggtctggtcgccctcggctaagaaaccctgaatctgggtctcgctagccccgccctcgacaagctcggagtaattcatctgtctccccagggtacaatcaacaaaatgcaataattatgcagtaatcataccacgagcgacaagcgcgtcgctcacgaggtgtcatcggctggcccagagagagggacgacttggtaaagaccgcgcaaatggacaaaaaaagatcgagaaagccgccgtgaaccgcgtgtgcgaccttatccagcagtgtgatactatcgatgacaagctaaaagagggtgataagaacatcctcatagacggtttccttgatctgtacagctcaccggagcagagggtcgagaacctgcatgcggagattcccgttcaggtcaaaggtacgatggggaagctgaagcccaacaagcacggtgtggtgaagttcatggcacgcaccgaggcgctcaaacactacagggacgtgtactacggcgtacttcttttcgttgttggcgtgaacaagaactcccgtcttggcgaggatgtcttcttcgcgcagctcttgctctacaacatcaaccgtgcgctgtcaaagacatgcccagatcaggagaagacgtcggtacctatcaagccattcccgacaaacccgaaagagatgacaaggatcatcacggcgctcaacgccaaccggaaaaagcagatgaaggctaaggtcgtcgcatacgacttcgacggagatacaaaaccctgccagaagacatcaactctatatcagtctcgacccagttgtacaaaggcgaacgtgtgacaacgatagccggtttggaaaacgcctacgtctacggcaaggacatggagggccagctcgtcgtgctcgggaagatcgaggacgtaacaatgttcgccagaggtacggaagtcaatgttgcgtccggggacttcgaactgacgacgctgctgatgctgggcgaccatcgtgagggcacctacattgagttcgagggcgtgagcatgatcctgcgcgatgaccacagggtcacgctgagcttcgacatcaagggcccgatccgcaggaggtacaacacggcccggttcgtccgcgagttcatgcgcacgggcgaactaagggtcgaagggaagacgttactgcggaccaagatcgagagtgacccggatctcgagatgcgcctggacgaggacgtgcgtgcatgcggcgagtttgtcgagacgctggacgcgctcggtatcgccgtcgactgggattctgctgacatgacgacaaaggagctaaacgatctcgccctcatgcacagcctgctggtggaaggaaagccatgggccggccaagatatagagttgccgattgttcacttcgacatccagggatgcagggtctatgcgctcgttcggaaacgtggggatggcagctacgccttcatgggcctcgactccgaccagctgtgcttctccttctcttcgccagatgagaaggagccggaggtgagggggccgttcgagccggttcccgctgcgatggtgcttggcaaggacgaccttcagaaggctgtgaacctagacccggggaagctcgatgcgcagttcgaccgtttcccggtgactgtgggcaaccagacgccgctcaaccagaagctcctggacatgctcacggcctatgacgagggtgccaggcagccgcagggcctgctcgcgtgcgcggcggtactagtgcgaagactgcacgagttcgaccagaaaagccagacctacctgctcaacctgttgcagacgatagggcgcaagcgtgagttcaacgaggaggagaagtccgcgctagaggacattactctcgaagcccccgagctatacacgaaagctgcggcctatgcgctcatgggctattcggaaatggcgcaggcttgcctcagtcgatgctcggaagcctggcgcaggcagatagagggctatccgatctcgcggttcttcgtgagcgaaaggccacggaactagctaaccgtttgggaaccttttccaacccactcgccactgctccgctccgggcttttgccggaccgggtcttgccacggggctacacgcgccctggaagtcaacctgggcaggcggggtccgcccccttctcaacggcaaggcgatacgtgacgaacatgtgaagagacccgacagtcaaaatgcgcaaaaagtgtgtaccaaaatcgcgtaccaaaagaaaacaggccaccaactatgctgatgacctggtcttttatggtgggcgttagaagatttgaacttctgacctcttccgtgtcagggaagcgctctccccctgagctaaacgcccatctccattgtgctacacctgcgtagcaggtaatagattacgtgaacagcggcaaaattacaagtagaaaattgaaagtgttttaattacatatattgagcaggcattttgaaagaagcggtagatttctgtcccccgtgcactaccatagcccggctattctgactcctcgcactatattgcactgagtcttgcgtcaactaaggtatcttcacagctgtagctataaagacacggttgagacctatagcttacaagtacgaaaagcacaagcgatacgacagattgagccttgcgaaaagaagctccattgagcatgggctagattcaaaaacactctatctgttccatcgcaaaagactttgagagagtaccctctacagcgggtagagaggctaggcaccacgtggtctacatagcgcctaagggagagcccggagagccaaaagacaaagactgtcaaagagacgcttgtgacagtcaccgcagtgttgctgcgggtgcatgagatacacagcagaggtatgccactaccgcatccgtgtagcctatgtggtgaaatacgcacaaacgcttgcagatgaaatacggcatcgatatgagcgaagaggatgcagcgcacacagttgcccacatacaagataagctcgcttgcgggctttcccctaagcagatagcaactgcctctcctgttccagtatctgtcttcactatctatcgctgggtccacagacggtatggcgattatgtctgccgtggactttaaggcgatctgtgggctataggtcctaacaacacgcctttgtgccccgtataaccacccgtccgagcgcttatagtcgtttctgtccttaggagagcctgcgctggtgcctgggagataaatacagcagaaggtcttcaatctgacagtgaatgtatccttacacctttgtacagactatcgaagtttcggtcgcatccgtaaagtagtgtaaaaggcgggcgtgccagaggcccgccgccaagctgggatcgcagtcaccaaacaacgaggacacccaagaggacggacatggctcgaatcaatcttacactggaccaggacttggtgctggggctgcttaccgacggggacagggacaccttcaggctgctgctccaggagacgctcaaccggggtactgagggagaagtcagccgagcagctgtgcgcctagtcctacgagcaaacgcagaagcgcaccgacagccacaacgagacgaaggtaaggcccctcacgaccagggtcgccaccatcgagctgaaggtgtcaaggcagcgcaacaccccgtttgagacccttgtgaccgagatggtcgtcgcgggcgtctttacagtgaaggtgggcagggtcatagaggaggtctgcgaaaggtcgttctccaagcgctccgtcttctgaggcctgcgccgagctggaccccgctatcagagcattttgcgattggccccttaagggcgagtagccgttcgtgatggcaaacgccacctgcctcaaggtcagggtcgaccaccgcgtgaggtacaaggcgcagctaagtcatcgggatctcgcttgccgagtcgcacacgggacgctcctgggcgaacttcctgcgctccctcgtggacgccagagaggggctcgtggcggccgttaagggaggtgctgcccggtgccgcctggcagcgctgccaggcccacttctcgtacaacgtgtgtaaggccgcccccaagggcgtgcgcgccggccttaagggggggagctggtcgagaggctcaactgccaagcgcaccggaggagaggcgcacacgtgacgagatactggcgcacttgcgcgacgtcaccttaagggcggcgaaggtgctgatcgccgcgatgcgcctgtacatgagggtgtctaactacctggagaggctgaacagggagatagagaggcacgcctgctccgtcggggtctttccgagtaaggcgtcggcgatcaggctgatcgggtcggtccttaccgaggagaacgagtgcagctcgacgcagaggaagagctactacggataggacttacgcgcagctcctgcaggtggaagacaagctcgcaaagatagcgcgcaaccaaagggacatggcgaaggcgtaaggcagggaacgcggcagcgattttacacacggattcggacttgaccgaagtttcagctcatatctttgaggggccacaaagactgcgacaacaccaagtgaacacttgagacgctctttgagtctgtcggagagccgagttctcagatgaagaggtgccaggacaccttttcgaaggagagactcaagcaatcaggctctactgctgcgaccctagggaaacgatgattaactcggctcgatgaggtcagtggagccacacgctgtatgacatcggcttaaaatgtctcgaaccacgcagtgcccatacccacatagatgcctatctgtcttctggatatggtatagctacatccacgtattccagcatatccaaaaggaagatatggacagatagatgagcttttaggaccttaaatcctaaggtcttgggaagaagaccaggcgagaggcattcctggagtggatggatgcaatcgttgtgtgggatagctggattgcactggtagataccagctaccactgacaggctcttgtcaggcatgtgcgcgctgcaaagacaaagctttaggatgtagcctgctttaggtcatgtttgctctcttaagacgagggaacttaaagatgctatcctggattgccactcctggcagcgcttctgtgcacgtagacctcatgtttgcgcaggtgcaagatgcaacgacgagtgcgaaatttcgccatagcctcgagcggcagggactcggcaaggcttgtgctttacgcctgaacttagaagcttgaaaaggcagggatcacggcgcggggtggctccatggtggatgcgatcttcacctgggtcctaaagcttcacgaagaacaaggatcacgcacgcgaccctgaaactcatctggctgcccatatcttccttttgggtatgctggaatacgttgctgtaattataatatatccgcaggcagataggcatctatgtgggtatgggtactgtgtggttcgagacattttgagccgatgtcatacagcgtgtggccccaacagcctcatcgaggcgaattaatcatcgtttccttagatgagttggtttcaagacttattgcaacaccgaaaaggacgataggttcctgcgcaaacactaagaaccgactgtttccatcaaagatctgttgtcgagaagtcttgcgttgagtgcgaatacactttctagctgctagatattgcgctaacttcaagaatcaactacttcgaagaaagcgaatttcgttgggacctgtatagattaaatggataggtccattacttacagatgctgtcggcgagcttctgtccgcacatgtcacaggcgagaccaagcaagacaccgataacaagtgaagggatgatcatcggattgccgcctgcggcaaaggtagagaaggagccgaagaaggtacccggcacgtaagagaggtacttgaagtgggcatctgcacacatgaagtaggtcgtcacgcatgtcatcaccaacgacactgcctgcgagactctcggatcgaggaagaggcctcccacaaagagtgagataaaggcaaaggcactgccgcacagaacacagcacaagattatcggtaaggccttgggaccgcttttggggtacgcaaaataagaagtgcagccgacgaatcctgcccaaccaattaagcccgcagcgggtccgagaagcatccagatggtgcagagaacagcggtgacgagggaggtaacaacaagacgggatttcacttcggaggtcctttctatggttgctatcaccaagaaagtgatagaggatcggtgacgcatttatggtaccatctgcttcaattgttgatgctgctctgaaagttaattatcgttttggggctgagacatgacggggtggcataaaaagcgtgaccagcccatataagagttggtcacgcgcgctcaaggtatcaacgtgatgtttgattatacgtggtcgtggcaagtgcgggcgaggacatcgagctgctgctcacgggtgaggtcgataaacttcaccgcatagcctgagacacggatcgtgaagttggcatactcaggcttctcggggtgctccattgcgtcacggagcttctcagtgccgaagacgttgacattgaggtggtgggcgccctgcttgaagtatccgtcgaggacgtggacgaggttctcttgacgctgatgcaagtcattgcccagagcgaagggattgatcgtctgcgtgttggagataccgtctaaggcgtactcgtaggggagcttggcgactgagttgagtgaagcaagcaggccgtttttctctgcgccgtaggagggattggcacccggggcaaatggtgtgaaggcttttctgccgtcagggagtgcgccagtcgctttgccgtacaccacgttcgaggtgatggtcaggatggatgtcgtaggcttagaattgcggtaggtgtggtgctttttcacctttgtcatgaacgtcttcaagagccacacggcgatatcgtcagctctgtcatcgtcgttgccgtagcgcgggaagtccccctcgactttgtagtcgacgaccgcgccgctctcatcgcggattgtcttcacgtgggcgtacttgatggcagatagggagtctacgacatgggagaagccggcgatgccggtagcgaaggtacggcggacgtttgtgtcgatcagcgccatctctgcagactcgtagtagtacttgtcgtgcatatactgaatgaggttcaaggtattgacatagaggtcgaccaaccagtccatcatcagatcgaacttgtgcatgacctcatcgtagtctagatactctgaggtgatcggggcatactcggggccgacctgcaggtggttgccgttcttatcgtcgaacttgacgtccttgccgccgttgatcgcatagttgaggcacttggcgaggttggcgcgggcgccgaagaactgcatctctttgccggtctctgtggcggagacgcagcagcagatgctgtagtcgtcgccccagaccggacgcatgacatcgtcgttttcatactggatcgaggaggtttggatcgaaattttagcagcgtacttgcggaaggcgatgggtagccggtcagagtaaaggaccgtgaggttgggctccggggcaggccccatgttctcaagggtgtgcaggaacctgaagtcggtcttggtaacctgggagcggccgtcctgacccatgccggcaacctccagggtggcccagacggggtcgccggagaagagctcattgtaggaggggatgcgagcgaacttcaccattctaaacttcatggtcagatggtcgattagctcctgggcatctgcctcactgatgcggccggccttgaggtcacggtcgagatagatatcgaggaaggttgagattctgccgacggacatggcggcgccgttctgagtcttgatcgcggcgaggtacccgaagtagagccactgcactgcttcctgggcgttggtagcgggcttggagatatcgaagccgtagatctttgccatctccttcatgcccttgagggcgcggatctgctcggcgatctcctcacgcaagcggatcacgtcgtccgtcattgttccgtccccgcagttcgcaaggtcgtgctgtttctgggagatgaggaaatcgataccgtagagggcgacgcgtcgatagtcaccgacgatacggccacggccatacgtgtcggggagtccagtgattacgtgggagtgacgggccaaacgcatttcgggggtataggcgtcaaagactgcctggttgtgggtcttgcggtactcgttgaagatcttgtggtacttctcgttgatcttatagccgtaggatttagcagcttcctcagccattctgataccgccgtagggcataaaggcacgcttcagaggtttgtcggtttggaggccgacgatgcgctcgaggtccttggccttaggatctatgtagcccgggccgtaggcggtgaggccgctcacgacttcagtctcgcagtcgaggacaccactgcgtttgcgctcctctttctgcagatcctgtaccttgttccacagggtcatcgtcgcctcagtcgggcctgcgaggaaactctcatcgccgtcatacggcgtatagttcctctggatgaagtcgcggacattgacctcgtcggtccaaagccccggggcaaagcccttccatgctgctgtttccattgctaatcctcctcgatagtggatggtttatcggataagatgcgctgcgcccgctcaacccgttgcggggagggaggtttcacgtcgcgtaaggtataggggatatggagcgcatcccacttgtagatgccgagggtgtgataggggagcacttcgacgcgtttcacattgtgcagggtggcgataaagtcacgggtacgctcaaggtacttatcgacgtccgtgatacccgggaccaagacctgacggatccagaccggtacgtcgtggtcagagagccaccgcagtgcttcaagaatgtttgtgttgggatgtccggtaagcttttggtgctcaatcggatcgatatgtttgatatctgcgaggaccagatcggttgagtgcatcaggttctggaactcgctgtagaacggctccttggtggtaaagggagcaagtgaagtgtcgaggcaggtattaatgccgagtacacgggccttctcaaagagctcacggacaaagctgacctgtgagagggcttcgccgcctgagacagtgatgccgccttccggtccccaataggcacggtaacgtttagctttatcgagcagctcatcggcgctcatatcggtaccaccggtgaagttccagatgtccggattgtggcagtagcggcaacgcatgggacagccctgcagaaagatcaggtaccggaccccggggccatcggccgaaccaaacgattcaacggaatgtatatgaccgatcatttacactccccacatctacgtattcattacacctttaaggctacgaagaaggggaagtgcgttccatgattaaaatcaagtaacgaaaaattattctttgctgacttgggctaaggcagctcggttgatcactttcagatgcccgcgtccgatgcgtttgactaacccatccttctcaaaggcggagaggatacgggagacggtctcagggcgtaggttgactgaggcagcgatctcatcgagcctcagatggatctcctggtggagacaacggtcatttctgtggagcagatagcgcgctaggcggctcttgggggagtggatgcttaagatcgtgatcttttcctccgcatcgtcgagctcggtgctcagcgtctcgacgaggtgcatcgcgacctcgggatgtgcggagatgaatgactcaaagtccgttctgcggatgctgcacacactgacctcagtcaggcaggcagcgctgtagtggtaggtgtgatcctgtaaaaacattccgtgccatagagcctgtccgtcgtgtaggatatcgaggatgtattcttcgccgtcttcgcttaggcggtaggtcttgatgcggccctttcggatgatgaagatcgactcgatcggatcgctctcatgcacgatcacggagcctttggggtagtcgctctggtgggcgcagcgcatcagctcacgcttagctccgctgtccagatgggagaaaagtcggatgtggttcatgcaacagtcaccggtggcacggtacgagcaggactggtagggacaaaggggagttcccatactcgtgtgtcgctctgccatcgtactcctttccccctgtgccggtgtggtgtagataccccactttgctttctctgtaccctcaattgtagagttgtatgtcgcacccctggaaaccagtctgcctcagcgcttcgtagagcacgattgcggcagagttggagaggttgagggacgtgacgacactcgctcggggatctacgaagttgcctgcgatatcacgttggagatcagggtggagattgtcgaaggtctcatgccacgtatccgcattcttgagcgcatcgtccccacgcattgggatgcgctcacacagggagggatgcgctgaaagcaagtctctcgaaagcccggcactctctttaccgaagatcaggtagtccccctcgtgataggtggaagaggaatacacacgcttgcccgccttagtcagtaagtggacatgtatatcctcaacatcctgcgcagtagtggcggtattctcctgcagtgcctgttccacgactgggttcttctgtacgaattcatcccagtcattatagacggccagatccaagctttcccagtaggcgaggccggcacgccgcagcgctttttcttgaagggaaaagcctaaaggtccagccaggtggagtcgtgcacctgctaaaacacaggtacggccgatattccccgtattagcggggatctccggttctacgagcacaacgttgaacatggctatcctttcaagccctctatactgaaggacggatgattaaaagacactgttcttcagtatagggttctcattggataggaggcggacccaaaaagttggagaatctaggtcgctagacccagtgacaggcggtattccaaaggactcatccggctgagtgattcctttggtctttcgttgcaatactacgtgatgtagccactaaactgattcataaattcgttgcgtatggtgtggctccaatccaggcagtaaaagaattcatgcttgagtctaccgaagatatcatctaatgcaccacatgcgattatgcgctgaacgggcgccggacagcaggcaaaggggcatgtccatgctctaatgagcgcataacgctgtaacgtcttccctgtcgggactgcatcctcaggaatacctgttatttaaagtcaaggggtaaacccaagattttcgataggaaccttgagaagtgaatatgggataaagagtagacatgctgacgcgcgccccgctgggagcgcaagcgcgattcagatgtagaaaaggctacttgccgccctcctgaagatgttcgggttgatggtgcctagaaggcgtggtctcccaggggcgggctagacacacgcccatgagcttgcgagcaacacctgcgagggctaggcagtggtgctttttgtcttcgccttccctgttggcgtagtagtcgccgaagtacgggtcgtatctgcgcacacagtctgtagtctgcatgagggcccacctgagatctgccgcagcgcgcttggacatgcttttacccgatgccacactctcaccggacttacttttggtagggtccatgccaacataggccatgagctgatgggcaccatcgaagcgctgagcgtctccaatctcgcctgcgataattgaggccagcgcgattcagatgccagggacgctgagcagccacctaccgcttgccttgttgagcaagcgggtaagttcaaattccacctcgtcgatctggctgcagacgagctcagactcctcatggaagagtttgagctcgaaggtgagcgtctttgaaccgaagccgactccaaccgacgctttcgtggcggccttcagctcctcggccttcttttggccgcagttggagcagaaagcttccttcagtgtgcactcgagcgtgtacatgtcgcttgagtgtgtctgctgcggcgtggcacaatgtttgagcagcgagcgggcgctgggtgggcctaaacgagccgctgaacaggtcgtcgaggatggctgtggcgcggtttttgagcatggtcgagctcttcggcaagcgacgcgcggtagcgcgcccaagtgcgagcagctccccgctcgcctcgtcgctcagcgcgcagggctcatagcgcttgtagcgcataaggtctgcgatcatggctgcgttgatcgcatcactgtgtcatagccataagcggccatgaagttaaacagggcaacccagtagtgccctgtggcctcaatactagacaggctgccctctggaccgataccggccttcttcagccgatcgagcagctttttgaagcctgccggcggtgttggcaaatctgagcgactcgatgagggtccctccatccttacccacggctgacagcacatagaagcgcttagcgatgtctatgccgatatagaccatgcagctacctcctacctcttacttgactgaggggctaaggttttcctctggtctttgcaggcgcaacctcatggggacatccatcgcctaacgacatcttgcctaattcgcgtccagctgtgggccaaaggcgccagccgtctgcaagagccaaactccagcagaacacgccaagtgccctgcgtcccatgcacgccctttatcccatactcgcgtctacaggaaaagagcgcggccactgcgtgagaagtggcagaaagaatatatgaggaggatgcgctggcgaagggccttgccgcagccggcaggaatccggatgcagacgctacagagcgcagggggggggggaatatcctcgacttccttgaatccctgtagagaaacacgttatgtgctggacgccggatggtcaaacttccctgcctgctgtccggcgcccgttcagcacataatcgcattcgacacattagagggctttttcggtacgcccaagggcggcttcttttccggtatggattggacggacagcacgttcgaggagttcaagagctgtcttgacagctacattgagtggtattgtttgaccaagctcaagcgtgccttgtgggtggaggacgctcagggagcacaggaggggccttagctgcgcatatgcagcctagatccggaaaaatgtccggggttccctatgggtattggggagagcgcctgcactggcctgccacattgaccttattgtcgatctgccatcacaagaatattcaaaggctgtgtggccgtttgcaaggaagtatggcactccccttatcgtctgcctctttggggaaatcagagcggatgggaagttcatccaaaaggcaaccgaagcgaaggctgccctcggaaccttcgtgtggtggtgcgcagagaatcagattgaggatctaaaagagtttatcaattttactgagcgtggttatgcgatcgaccattggcgctcaatgcagcatctgttgatctttagccgtctgtcaaaatgacaggtcattgtgtatgagctgagcttttgtggtaacggaggataatagagccagctcagaagaatctgggttgaagggaagctagaaggatagttgtcatggtcacggtggattagcattctgagtgcaacaggatagcccactgaatacaagcgtggcacactccggaaggctacgatgttagttgtccacatcaacgtcgaaagctggaaggaatgtgccactacacacatcttagccctcaggagagggactgcatagccacgctgcatgcagagggaaggccaatcggctatatcgcggcagagatcggcagggacagctccagcgtctgccacaagctcaagaggaacggccggcacgggcgctttagggcatgtactgctcaaaaggagggcggatgagcgccgcaggagatgcaggccgaaaaggcggctttcagaccctgcgcttacgcagaaggtgtgccctctcatcatggacagacactggtccctggaggagatagatgacatttcaggctcgagggtagcggcaggtgcgtcgttgagcctgccgactattctatcgggaggtctgtagccgccacgctcgacctgccgggatccggacgcgttaggcaagatgcggcgccacctgcgcaggaaggggaagcagatccgcagcaagaggcctaagacgaggggcaagatcgagatcttacacagcgtggatgagaggcccaagaggccgatgagaggtctcgtctcggagagtgggtagacgacacgctcgtggcagcgggacccgtgtgcctgctcgtgcttgccgacagggcagtgaggctgcttgccgcgagaagatgccaccacgacagcgggagcgtctctaaggccgaggtcgggctgctacagggacgccctctcgagacactcactcctaagtggggcaagcagctcgcagggcatgcagatgtcacaaaggccctttgaggcgtgcagttctacttctgcgacccccaccatctatggcagaagctaacagttaagaacaccaacgggctcctgcgaaagttcttcccctaagggcagcgactttggtaaggtcacaaacgaggaggtccggcatgcggtggagctgatctgtgacaggccgaggaaggtcctgaaatacaggacagccaacgaggtctttagggagatgttgcactcagcttgacaatctgcccactgaaaagatcagcggcaaggcatacttgtaatattctatagcgagggagagtgactcacatggatgaacccataccgaagcgtcgactctttatcgcgttgcgttttcctgagacgacaaggcagaccttggttaaggcggaagataccgtcgtagcttttgcggacaaagcccgtccgatgcttccacagaatctgcatctgacgcttgccttcttggggatgcaggatgagcagggatataaccgggcatgtgagg

SEQ ID NO: 102 - DNA, 27338 bp, Unknown
  Metagenome-assembled genome
agtccttcggatacttgtagaagccctcccctgccgccatgcccagcttgccggcgtcgatgtagctcttgagtaccttctccatgcccttgaagttgtagggaagcatcatcttcttgaggagcggggtcgcgatgccgggcaccttctgatactgctcgacaatgttgtaggccgtcgtgaggccgacggtatcgaagacctggaaggggcctttcggggcgcacgtgccagacgtccaggcaaggtcgatggaagcagggtcggagatgccattggccagaaggtccaggcccgaaagcatccaagggatgagcatggagttcaggaggtatcccgccttctccttgttcaccggaagcgggatcatgcgaatggcctttgcaaaatcgaagaccgcatcgaaggactcggtgctcgtcttctcctggaccatgacctcgcagacattgtgcttccagatcgtattggcaaagtggagcgcaagatagcggtcgggtctgcccacgtccttcgtgaactgcgaaggcagaagactcgaggagttcgtgacgacaatcgtcttctcaggcatcaagggagcgagcttcttgaagaaggcagccttttggtctgcgacctctgccatggactcaatcacgagatcggcatcggctaccgccttgccgagatcgagctcaagcgtgagcgacgcataggcctcatcgacgcgctttgcgcaggcattcgcatcgaagctgccgaagtctgcgatgcccgggcaccaggcaggatctgccgcgctcttggcactcttcatgccctcgattgcctcatggtagctcttgtgcagagcatcgagcttcggctggcagcgcccgatggagccttcgcttctgagccagatggtcacgttgtgtcccgtataagcgcactggaatgcaatctgcgaccccaggacgccgcctccggcaaccacgacattcttgatttcagccatgtagaacctcctgtcatcgcaggggcatatgcccctgcatggggctggaattcctgcatactgccatcaagtatatgagacccgcaaagccgccatccagcagaaagcggcgaggggcacctatcggccctcccgccgcggcagagcatggggcaaagccctctgtccctggagcctcttcaggcacttcataagggtgcttgccgaatcctgcgacaagacagggtccccgccatcgaatccgacccatccctcgtgcgcctgagatccgtctgcgcgaactcgttccctcttcccgccgcagtcttcctcaaagatgcactggcgtgcctgtgcatcctctgcttgtgcatccggagaacccctgcgaagcagaggccgctcctaagctccatcctgccctcgctatcgaggctcccatagaagctctggaagagatgcctgagaccgcccattacagtcagagatggcccctggggacctctccgagctgtagggttttcaacaatgccatgtccttgatttccccaaccttgtagatggcccctctccggcgccgctggccgacctcctccggacggccctcttgccctgcctccgagaaggtccggggggctgccggaggatggtgccccgcaagggaaacgactgatagggatgtgccgcacggcatgccgtgcggcagggcaatgtgggtgtcgccctgacagggacggtggccagccgacctatgaggcggctaccaccatgaagcgcaggcaggaagactggttcggaccccacgagctgcatctcggcgtggatgtcgggaaatccttccactgggctgtcgggttcgaccaggagggcgagatccggatcagccggcgggtggagaaccgtctggacgatgtcgaagcgctgctcgaggaggcaggcgacgccgccctggtcgtcgtggaccagaagaacaacatcggctcctgagctgtaatcttaagacagcacgcgtggccggatccggaatggcatctgcggcatccccgatctgtcctggctcatagcacaggcacagcagaggaaaaaggccctgcgcttccctatccttcagcctcctgcattcccagacagccttcccgctcccctgcggacggattcattgccacatctgaaagttttttcaactaacatacatatatcatagctttcagtcctctttcatggatattggaataaatgcctgctctgaagagcgtgcggcagcagggcagattcccctcccttctctgtccgtgcatccggcacaggaagacgcccggcagcacggaggcactgctgcctcgagccttgtccgacgctcccatcccggctgccgccctccctctgccgtttctggagctcttctggaacaggcagggcagcccacgcttttggggcacaattaattactgctgaattcacgctgtgccgtccgcacggctccaaggaggtccacatgccagacatccagataccggaagagttcgcagacgatcctgtcttcaggcaggaacaggagcatctctgcgaaacctaccagaagctcacagagctcagagacgagctcacccataggctcgaagtcacccacaaggcagcagcgcaggatctgcgcgacatgtccgaagaggtcacccaggacttcggcggcgaagacgaggcaatggagacccttgccgccatcgagaccctgaactccgtcatcgatgcctacaaccaggcacatgacttcgacgtagagaagctgcgccgcgtgcttgttcttctgaaccagccctactttgcaaaggtctccctgcgcatgcgtccgaacaggccaccaagagacatctatatcggcgtctccggcgtgatggacagagattcccatcctgtcgtgatcgactggcgaagccctgtcgccgagacctactacaaccaggagatgggcaagacctcctatgaggtgaacggcaagaagcgcgaggtggagctgctgctgagacggcagttcgaccttcagggcgagcgcctcaggatgtatttcgatacgacggtcgctatccaggactcgcttctgctcaatgccctgaagcagcaccactcggagaagctccaggccatcaccgccacgatccagaaggagcagaatgccgtcgtcaggcatgaggacataccggtgctcctcgtgaacggcattgccggctctggcaagacctccgtcatgctccagcgcatcgcctatctcttctatcagcagagagagaccttgaatccccaccaggtctatctcttcacgccgaacgccgtcttccagcgctacatcgatacagtgctcccctccttgggagagtccaatccccagaccttcacctggcgcggcttccttgtgcacgaaggcatccaggaccgtgcagacggcacaaagaccgatcccgaagagcttctcaggatggagaaggcaatagaaggactcgagctcgaagaggacgatatccgtggcatcggtatcggcgacacccagctcatcaaggcatcccaggtgaagaatgcctttgccaagttcccgcggacccctctgggaccccgtctggtagcgctcgtgaaggatgtgctccatgagaggctgaaccagaggcttgctgccttggcaaaggacgacgatgtccacgaagagatgctgggcatagacctcgacgagcaggtgcagatcttcggcgagcccatcaatcccctcgacgaggaggatacggtccgtcttgccaagaagtacgtggaagcacgctatgcgagcgcccatgacacgatcgaggcagcaggctggctcaggatcgaccgcatcggtcagaggcttctggggcaccagctcaatgctgtggaatacctctacctgtgctccctcatcaccggtgccggcgaccgccaggcccgctatgtgatggtcgatgaggtccaggactataccgcagcgcagctcatggtgatggcacgctacttctcaggtgcccacttcatgcttctgggagatgagcaccaggccatccgggaaggcacggccaccttccaggatatgaaggacgtcttcgtccatgccggcttcggcgaggaaggcaaggatatccaggagctcaggctcctcacgtcctaccgctccacccctgagatcacctccctcttcatggggctctacgagaaggacgagaacatccacgccacttcggtccagcgcgaaggcacgaaggcgcagatcttcgaggcaaaggataccgagagctatcttgccaagctcaaggagcttgtggatgaagcgcacgatgcagatggcctcacggcccttgtctgcgatacgtcagcttgtgccaactggctcggaaagcagctcggaagctctgtccgcgtcatggagcccgatgatatccttcctctcaagggtgtcgtcgtcctcgacctctcccttgcgaagggactggaattcgatgctgtcatcatccccgatgcacaggcagaggtctatccggcaacgccgcttgcgagacggcgcctctataccgccctctcccgcgccatgcacaaggtcactatcgtcagccagggaaccatctccgagcttcttgctccgtatgctccccagatacaggaggtctgatccatgggaatccgctatgaacaggtccgctaccttgcctcgtatggcacggtcgagcagctgccgcagtcgaaggcccccgaagtctccttcgtcggccgctccaatgtgggaaagtcttccctcatcaacaagctcttcaacaggaagtcccttgccaaggtctcaggaaagccgggcaagaccgcaaacatcaacttcttcgaggccgacggcatccacttcgtagaccttcctggctatggcttcgcacagcgttcccaggcagagaagcagcgctgggccgacctcatcgatgcctacttcacaagcgagcgctcacacaatctcgtgatcgccctggtggacatcaggcttgatgcccaggcactcgaccttcagatgatcgactacttgaagggagcaggccttcccttcatcattgccctcacgaaggcagacaagctctcacgccagaagcagcaggcacagctgagaaagcttgctgctgccttcgacgtcgacgagatggcctgtgtcatcacctcggcacagactggcctcggcatcgataccctgaagcgcttcatcgagcaggcctgctagaaacagacacccaaagctcaagcaaggaggctctcccggatgtccggaagagcctccttcttgttggctacatattgaatgaaagactacttctcgttcctgcgcctgccgaagcgcatgcaggcggcaatgccgatgaaggcgatgcccagagcagagagcccctggatcgtggtgacagactgacctggaccccgcattccgcacacccgattcggaattgcgaaacagctcgattccgcccggcagcgggccacggacggaacggggctccatatatggtcgatggcaggctcacgaaggaagagcgcgcctgtctcatcccactggatgcggcgaacgagaccaggatgggccacaggaaggcgcagcgcatcatggggaagtccggcatcgtgcgggagaggaggcgcaggaggccccgcggcccaatcggccaggacggagagcccggaatccggcagtccatgtcccggcggacctgctgccgggacgatgcatgcatcgggagcttctggggacggatgaaggagcagatgggagacacggcgcatctccctccgaggaggccatagcacctgccggcaggcacactggctgctgcagcgatcacaggggggcaggagcgtccaggatggctgacccccatggagcatgcaggaaggctcgctgcctggcagtgtgcggagattggggtccacctcaacagcaagactctgcttgctgctgtctagcggccgaaaagctcgagcacctcagcagctacaagctcccggtctctctgtgcatgggaggcaacgatgagcgtgcggccttccagatgtctcaggatgaaggcggcagcctccttatgtgttctttcgtcgagcgaggcaaacggctcatcgagaagcacaagccctgatgcatgggccagggcgcggacaagctcgacgcgccgtctctggcctcccgaaagctcgctcacaggacgtcccaggcagcttttcggcaagagctcgagaagaaggcttcttgcctcattctctgtgagcgcagcgacaagctccacattctcttctgcggtataggcctccaccagacgtgcttcctgacacatgagggaaagagcagaagcggaatcgatcgacccagcaaggggctttctgagtcctgctgcgcaggcgatgaacgtggtctttccggtacctgatgcatccgtcaggatccacctcgtgcccgcatcgagcgtgaaggagagcttctctgcaaggacggtcttcccgctctcccctgtctcgtagcccaatgtcaaatcatgtgctttcacagaagcaggagcaatgcgctccgttgatgcatgccttcctctgagcgcaagcttcaaagcacaaaagtcgctcttctcaagcagcgccagaaagagccgttcgcaggcccaggatgctgccacaatcgctatggtccaggcaaagaggtctgctgtctcgagcaggagcttcgactgatagaccgcctcgcctatcgtgttccgtggcgtgcctatgacctcagctgccacgccagccttccatgccattccgcagacattcctcgcggtccccagaaggaagggcagaagctgctgccaggtatcggcgagaaatatcctcatgcccgatgtccgcatggcatgaaggagctctcggagcttcgggtcctgggcatcgagcccttcgagcacgctgaagtagacagccgggaaaaccgccagaaacactgctagggcagagaccttcttcgagccaacccagagaagcagaagcacgatgatgcagaccaggggaatcgatttcagggcatcaaagagcggtgccagaagttccctcgcaggtcggaacctgtgggaaagaaaacccagcacgagcgcagctgcaaagcctccgatgaagcccaaaaagatctgccagaaggagagcgcaagcgttccccagaaggcaggatcgggcaggaacgaggcaaggcgcaaaagcgtatcgacgggtcccgccagaaggatggggcttccgacgaaaaggctcgctgcctcccagacaagaatccagaaggcagcgatagccacacgtctcagccagccagcatgtcttggttcagcagctggattaggcattgtagtagaagtcatcctcaggaagcgtgccgcccacagagcttgcatccgcatcatagagcacctggagatagcccgagaggccatccttcatctcgtctccggtcatgcagacgatgttgcactcaggaatggccttctctgcgataggctccttcgcgacgatgccggcctggacaacaagcgctgccgtgcctgccacatcgtctgcgcacttctggacagatgcggcatgacgagagaggaagtcggccacggcctgaggatgctcttctgcgaactcggagcgcacgatcgtggcacccataacatagagtgagccggtgtctcctgcgtacttctcccacacatcggtaaggtcgacaggcgctgagagcgaggagttctgtgcgagcgtcgctgtcgtgaagggctgcggaagcacacccacagccgaaggatccgaagcaagcaccgatgccacctcggtgtgctcgctctgccactccatggtcacggtatcagcgatgcctgcctgctcgaggaggtagttcatcacatactcaggagaggagcccttgccggagatgtagatggtcttgccagcaaggtcttcgaactgctgaatggaggagtcgcccgtgacgacagagaggacgcccagggtattaaggtcgatgacctggaccttgcccttcgtctttgcatagagaacggcagctgcattggaaggcacgagcgcgatatcggctgtgccctggattacgagcggcagcacctcgtcaggagcagaggacatctggtaggcataggtgatgccagaaccttcctcagcctcccctgcctgggagagatctcctccgtcagcaggaatgcctgccgtatcgttcatcatgttcacaaggccgatggtcgtggggcccttgagagatgcgacacggacgacaacgtcgtccgtcttctcttcggtctgtgccgtggtcgtagaggtctgggaagagctcccgcatgctccgaggaatccggtaaggccaagaccagccagtgccgcaagagcctcgcggcgtgtcatgttctgcatatgcaatgccttcctgtcatgcagcaccgctcgtgctgccttccaaaatcgggtacatatgagtataacgccgcatggaagactcagtccaagcggacatgaagcccgactgaaagaaggcaccctttgaagacccgtgtcgccgttatcggcatcatcgtggaagaccccaactctgtcagtgccctgaacgaccttctgcatgaatatgcaccctacatcattggccgcatgggcatcccctaccgtgcccatcatctgaacgttatcagcgtcgccgtgggacggagacacgatttcagccctcgcaggacgtctcggtgccttactggcatctctgacgaaggctgcctattcgaatgcctataccgacgaagaggagtagccatgggagccaaatgggagatatcaggaacgagcttgatgactatcttgctgccccgattgccggtatggttttttccttctttttttttttttttttttctttttttttgtttttcccttttttttttttttttttttttttttttttttttttttttttttttttccttggcctctggggacgacgtgacctgcacgcagagcgacccagatggcatgggcaacattctcaatgtctctcttgcaaacaagcggacacgtctggagcgaagctcgccggcatagagcgcacgcaaagacaagcagcgacgcatccagcaaaggctggttggggcgctttaatgtcgcgggcaaatagcgcttcacaaaagaaccgagaccggagcctttcggttccggttccttcgaggctccatccagctctggagtgcgtcgactatgcgtcggcgtacatctcttgagcttgacaggtgagcgtacgctccatagcagctttctcgtctcagcgaagagctcctttgcgcgctccgggaaggaggggtcagggaagagtagcgcgactcgttcataggaagtcctgatagcacccttcggccattggagtcgaaggcgtgaacttcttgccttccggtggcagcggggttgaagcggaagaaggttccagtagccgccagtccacgcacgattcatctattcctggcagtgcattcatccgccatttcttgatggagtgatctcgcaggggctgtagcgatgacccagcgacgcagtccgtcgtagggcctcaggcctcggcaatggccttgagggttgagccaattggcgccctggcaacctgtgccacgagacgtagccgttagtcattcgatctcggcaagggactcttttcgtggtcgtgccgtcagcagcgaaactgcgcgacctggccgaggtggaagccttggatgctggccacccgtgttggcgtagactcggtatcgaagacgaagggacatgacattgcggccagaggcgaggaatgtcgagtccgcgaagccgatatcgtatgcccagcgtcgcgcgaagatccagaaggacttcttgggacaggaaggacttgccgcgagaatctccttggcgcatcggagccgttggtcctcgagatgtgcgatgagcgtcagcagcagcacgggacttccggaatcatgcggttctcgagccatggggcagcgtccttgaaggagtcagagagggccctctgttcgagcagcttctcagttggctgcgaccagacggttctgatctgcctcgtagccaacctcgagtcccagccgtgctcgcattgtcatgaagagcgaggtgttccaagccgggcaatggacgcaagcgttgacgtgtacgcgaggttgctgccgggttgccccagatcgaggagcagccggtggcgttcggagatgaaacatgcgggtcgccgaagagctgggttggacaaggcgtgcataggacgtctcggccgcagccagcgcaggagccggagaactcgagcagggcttgtggtaactgagatgccttcggggtcgtgcattggcgaagcctcggacttatcggagaccttgtgacggcgtaaatcccagacctctgcctgagcagcttcatcctcctgaggaaccatggtgagggcgccgccctccttcacatgcgggactcgggcagagtacaggcagttgtagcagccatgcagtcgagcggggagacagcgatcgtgaactgtcgcggtgcccttcggaacttgagagagtcggttcattgcatctgagcaggtgcagcagcagcctcctgcggcgtcatgcaccggacggatggtgcgtgcgggcagcgaaggcgcagctgttgcacggatgcacttcgaggaatcccagcgaggaaccatgacagcggtgccgcgcttctcgtaggcagaagcgccaaggctcccactggacatcgggttctgcttgaaggccagagaccggcagggagtcgcccgtccacaggtgtcggggtgaggatccttgaccatgcttgacgatagcctcgcggccagagcgtcagggtctgtcggtgaacctggagcatctgcaagtctgcaggccacctcggaacttgtggaatgcgggtgcacggacggcatcattgtccttcagttggcctcgcaatggctgggccctacttggaaatagattctcagcaagcatccttcatgtactggagagcatacgctgcaaggcaggaccttggcgagaggcgaagaaacgcgactgaaggaccgtgttcgtgcgcttgaccatgccgacctggtgccaagtcgatagcgtagatcaggtaaacgtgagatggtgttcttcgcgatgtagcgcttttgcctcggaaccccccccccccccccccccccccctggaagatgtatcggcgaactcttcgtcagacactcggaagtcacgaggaggtccacccggctgacattcgcggaccatttgaagcccgtgatgatgtaggaggggttgtggcaggcgacgaagtcggccttcgtgacctagtacggcgagcggatcggggaaacgccgaagcgaaggtgggagatgtcacagacgccggtcttctggagtcatatggaagatgcctggacataattgtcggtctggtcgccatgatctttgatggagttcttgttcgcgacgaccgttgccgtagcgccggaggaccccagaactttgcactcgagggtgccaggagcagcggtgttcgcggagcatcggatccatcgggagcgagaggttcgtgacatagtcggacgatgccgattgtggaactcgcgcttgggctggtccttcttgagctcctcgtagacggagaatgctgccgcaggcgctcgtcatcgaagccaggccatagcggccgccggtcacgacgaggtcagaagcggcctgcctcgtagagagcagcgacgacatatcgtcgagcggctcgacgatggagcccggctaccttgtgcggtcgaaggaaagctatcttctggacgtctcggagccagcacgaaggactcgatgtcgaacgacgtacagcggaccttcccgaggccgactttcgccgtgggcgttgaggtgtcgagtgacctctcgcgcgtatcgaagaggaagcacatgcagacgacgacgcggtctgcgtcctcggcgccatagtagtcgaacaggtgatagctcgtgccgagcttcgcgttgattcttgtccagtctgactggacgatctcaggaagcttgtgtaggtcgcgtgcaggccctcacgatgctggaagaagagatcgccgttctcgtgcgcgccacgggctgcggatgatcagggtggagtgcgtggtcacggaagcgctggacagcgtccatgtcgagatgtcttgaggtcgttcgaaagtccacatagcgcccttcgggatctagtgggacgtgcggaagccgtcgaagaagtgcagggaacggcacgcgccctcgatgcggcaaaggtgtgccacagagcgaggtccatcgccctcctgggacattgccctagcgagcatggcaaagccggtctggcgcaagccatgacatcagagtgatcgccgaagatgttcagagccatgggtcgcgaccgtacgggcgctgacgtggaagacgaaggcagtccctcagcagcgatcttgtacatgttgggatcatgggagcaggcatgagatgccgtgtaggtggtcgtcagcgcaccagcaaccaagggaaccggcacggtgatgaagcacctgacctcagcgactccatatcgacaaaccttgaaggcgtgcgaagatgttattaaggccatgggctgccccactgatcggacgtggttgcccttgggctggacggggtgatggggtgatgcccccacccggtgaacgcattacagacacacagcagcggcctcgttgccgcccccccaccaatccacgacttgaactttattgcccataatcctctccttcgaagcgatacgggccgccttgcggcggctgtgcaaacgtgcggccgccaggacaagtctgcagcactttacgcgccccaaacaggtactcccaatacggatgaacccatacggcatctatgaatacgcattagaaacgcgctcggcacgcaattcggacttcccttcggatgtgggctaccagcgcatacacctcctcgagttccagtcaatgcggcgtatacccaagaggtgtgctctagtcagcagggaaaaggctgcacaaggaaactggctgctgcaggaaaaactgtcgatagcccatcggacgccttatggcgcaaacaacagctgagaacgttcaccagcgtattcttcactcacaaaaaattatgttgacaaatgcagattgagtttaatacatcattctggataatcgccaccccgtcaagaccccatccagatccagtgcagattgcccagatggcttagtattctaaaaacctaggacagaagggagccatcaaagccagcgcaatcagctgcccatacgtcgcagcacggcaagagtctatggctttgttgtacaacaattttctcagctctgtataagtcgcgaatagaatcgttcacgcccatggaaagcagagcaccttaaaggccatgctggacggagatggctcatcgagaggagactcagatgctctatctgatggacgatgacgatcaaggcatgttgttgagaagaaattcgctgattgggcatgaaggaaagcgacgtcgaagactcctcagcaagcaaattaattggtagtgatgatgaagaggtggggcggggggagggcgcgaggggggagtgggggggggtgggtgcgagggggtggggggggggtgggggggcggagaggagtggggaggcggggggggggaggggggggtgggcggtgggggggggggttggggggggtgggggggggtgggggggggggggggggggggtggggaaaaaaaaacaaccccccccccccaccccccccacatgctcgtcatggcgaacaggttgtgaatgaggaaaaggcccagaagcgatcgtactgctctggatgggggaggcaacattcgtccttattgaaatccagagagaaccagccgattcaaaaaagatgcgtgctgaaggggggggggctttcgaattccaggcaatcgatatgcagccactgtgcttaggcatcacaacaattgatgattctgtttttttgttctcctttttttttgtctgccaccccccacccaacacacgcgtcatggccgctacgtcgaacagccacaagggcgaattcactgattaccgacaagctcacgtcaaaacagaagttgctacacgcaagctcaaaccagtttcatcgacgacaatgatattcagactttcaatgcgcaacagcgccattcatttcttgttgcctctgattgacgaccagactatcgctgctgttgcctggctccgatgcaaacaatggtcgattgctcctgcacgtctgaaaccccttatcaggtcggagataatacgatgatcactccaccaaagattctgccgattggctcctataaagacctctatgttggcgtctcgcacacacctcccaaacaagcaatttgcaagaagggtgagcggacgcacaaggaagagcaagccaaaatcagcagctaattgaagctggagttcgtagacgtagggggcggacctttatgcaagaatcgaagatcagcgcgtaatctactgcaggatggaaaagtaaagctcgcttctggcaatgtcatcagtctcaatcgtggcttcaaggtgtatatgatggagctcagtagacgtatagagtgggcatcgatgaaaagaccacaagacattgatgagctcagagaaacgcatggctcatccccaaagcgaaggccgacgctcagaggaatcagacgcgcagacagaagaaaatacgtccacagcagagtaagtcctctgtattccccggcagattgtcaagctggcgttgaaccaatatccctgtagacccgttggctgtcctgtattcaggacagccaacggtctacaggagatgtgcactacagctttacaatcttgccggggggaatacaagaggacttacctctgcggtgacgtaattttcttctgtctgcgctctgattcctcttgagcttcgctcttcgcttggcgatgagccatgcgttttctgctgagctcatcaaggtccttggggtcttttcatcgatggcccactcagatacgtctatgagctccatcctatacaccttgaagccacgcttgagactgatgacattgccagaagcgagctttacttttccatcctgcagtagagttacggcgctgatcttcatgattcttggaataaagggtcgcgcctacgtctacgactccagttcaatgagctgcttgattctggcttgctcttccttgtgcgttccgctcacccttcttgatttgcttttgggaggtggtgtgcggagaacgccaacatagaggtcttgataggaagccaacggcaaagaatctttgtggagtgaatcagcgtattatctccacctgataggggtcagaacgatagcaggagatatcgacattgtttgcacgagccaggcaacagcagagatagtctggtcgtcaaaatcagaggcaacaagaatgagcgcgatgttgcgcattgaagggtctgaatatcattgtcgtcgatgaactggttgagcttgcttgttgtagcaacttcgttgacgtgagcttgtcggtatcagtgaattcgcccttgtgctgttcgaccgtagcggccatagacatattggacaagctacaattgttgtgatgctagcaaggtggctgctatcaattgcctgggaattcgaaagcctcagccacgcatcttgatatcggctgggtctctcttgatttcaataaggacgatgttgccatccccatccagagcagtaagatcggcttctggccttttcctcatcacaacctgttcgccaatgaacgagcatgttctttcatcatcacataccaattcaatgtgttgcggaggaggtcttcgagccgtcgctttcttcatgcccaattcagcgaatgtcttactcaacaacattgccttgatctctcatcgtccatcagatagagcatctgagtctcctctcgatgatgccatctccgtccagcatggcctttaagtgctctgcgttgccgatggggcttgaacgctattcgcgactttatacagagctgaaagaaaattgttgtacaacaaaccagagactcttgcctgcggcgaacggtatggcagcatgattgcgctggctttgatggctcctctgtcctatgtttttagaatactagcatctgggcaatctgcactggaatgctggatgggtctgacggggtgagattatccagaagaatggattacatcatatgcatattgtcaagcaatttttgtgagtggaagaataagctggtgaaagttcttcaggctgttgtttgcgtgcataggcgtccgaatggggctatcttgaaagtttttctgcagagccagtttccttgtgcaagccttttacctgctgaaatagagcacacatcttgggtatacgccgcattgactggaactcggaggaaggtgatgcgctggtagcagcacagtccgagagggaggccgaattgcgtgccggcgcgtttctatgcggtatcatagatgccgtatgggttcaatccgtattgggaagtaccggtttgggcgcgtaaagtgctgcaggacttgtctgcggccgcacgttgcacagccgcgcaaggcggaccgtacgcttcgaaggagaggatatggcagaaagtttcaagtcgatggacggaacgaggccgctgcgtgggtctcgtatgcgttcaccgaggtggcgggcatctacccgatcaccccgtccagcccatggcagaccacgtcgatcagggcagcccagggcctgaagacatcttcggcacgcctgtcaaggttgtcgagatggagtctgaggcaggtgcttcaggcaccgtgcacggttccttggtgctggtgctctgacgaccacctacacggcatctcagggcctgctcctcatgatcccgaacatgtacaagatcgctgctgagggatgcctgcatcttccacgtcagcgcccgtacggtcgcgacccatgctctgaacatcttcggcgatcactctgatgtcatggcttgccgccagaccggctttgccatgctcgctgagggcaagtccaggaggtcatggacctcgctcctgtggcacaccttgccgctatcgagggcggcgtgccgttcctgaacttcttcgacggcttccgcacgtcccacgagatccagaaggtcgctatgtgggacttcgacgacctcaaggacatgctcgacatggacgtgtccagcgcttccgtgaccacgcactccaccctgagcatccgcatgccgtggcgcgcacgagaacggcgatatcttttccagcatcgtgaggcctgcaacgcgacctacgacaagcttcctgagatcgtccaggcatacatggacaagatcaaagcgaagctcggcacgagctacacctgttcgactactatggcgccgaggacgcagaccgcgtcgtcgtctgcatgggctccttctgcgatacgctcgaggaggtccgactacctcaacgcccacggcgagaaggtcggctcgtgaaggtccgctgtaccgtccgttcgacatcgagtcttcgtggctgcgctgcgaagaccgtcaagaagagcgtgtcctcgaccgcaccaaggagccgggctccatggcgagccgctctacgaggatgtcgtcgctgctctacgaggcaggccgctctgacctcgtcgtgaccggcggccgctatggcctgggctcgaaggacgagccgcctgcggcagcattctccgtctacgaggagctcaagaaggaccagcccaagcgcgagttcacaatcggcatcgtcgacgatgtcacgaacctctcgctcccgatggatccggatgctccgaacaccgctgctcctggcaccatcgagtgcagttctggggtctcggcggcgacggcacggtcggcgcgaacaagaactccatcaagatcatctcgggaccataccgacaagtatgtccaggcatacttccagtatgactccaagaagaccggcggcgtgacgatctcccacctgcgcttcggcgattccccgatccgctcgccgtacatgtcagaaggccgacttcgtcgctgccacaaccctcctacatcatcaagggcttcaagatggtccgcgatgtcaagccgggtggcaacttcctcgtgaactgccagtggtctgacgaagagttcgccgagaaagcttcctgccgaggcaaagcgcacatcgcgaagaaacaacatctccgtttacctgatcgacgctatcgaccttgcagccaaggtcggcatgggcaagcgcacgaacacggtccttcagtccgcgttcttcgctctcgccaaggtctgcctgcagaggatgctctccagtacatgaaggatgctgctgagaagtcctatgccaagaagggcaggccatgtcgaggccaaccggaaggcaatcgatgccggcgcaaccgcattccacaagttcgaggtgcctgcagactgggcagatgctaggatgcaccgaagaccctgacgctcgagggccgcgaggctatcgtcaagcaggtcaaggtctcctcaccccgatcaacctgatggacggcgactccctgccggtctctgccttcaagcagaacccggatggccagtgggagcttggcgcttctgcctacgagaagcgcggccccgctgtcatggttcctcgctgggattcctcgaagtgcatccagtgcaacagctgcgccttcgtctgcccgcacgcaaccatccgtccggttgtcatgaacgccgaggaggctgtgctgcacctgctcatcagatgcagatgaccgacctcaaggtcccgaagggcaccggctcaagttcacgatcgctgtctccccgctcgactgcatgggctgctacaaatgcctgtacgtctgcccgaagtcgatgtgaaggagggcggcgcctcaccatggttcctcaggaggaggaagctgctcaggcagaggtctgggattacgccgtcaacaaggtctccgagaagtccgagttgccaatgacaagaccccgaaggcatctcagtacacaagccgctgctcgagttctccggctcctgcgctggctgcgccgagacgtcctatgcacgccttgtccccagctcttcggcgaccgcatgttcatctccaacgccaccggctgctcctcgatctggggcaacccggcagaacctcgccgtacacggtcaacgcttgcggccatggcccggcttggaacaactcgctcttcgaggacaatgctgagcacggcatgggactcgaggttggctacgaggcagagcagaaccgtcttgtcgcagcaactgagaagctgctcgagaacgagggccttctgactccttcaaggacgctgcaaccgcatggctcgagaaccgcaatgattccctgaagtcccgtgctgctgctgacgcctacatcgcacagctcgaggacaacggctcgctgctgccaaggagattctcgcggacaagtccttcctgtccaagaagtccttctggatcttcggcggcgacggctgggcatacgatatcggcttcggcggactcgaccatgtcctcgcctctggccgcaatgtcaatgtcttcgtcttcgataccgaggtttactccaacacgggtggccaggcatccaaggcttccaacctcggccaggtcgcgcagttcgtgctgccggcaagaccacgaagaagaagtcccttgccgagatcgagatgagctacggtacgtctacgtggcacaggttgccatgggcgccaatatggtcagaccctcaaggccattgccgaggctgaggcctacgacggaccgtcgctggtcatcggctacagcccctgcgagatgcactccatcaagaagggcggcatgatgcactgccaggaagagatgaagcgtgccgtggactgcggctactggaacctcttccgctcaaccccgctgcaccggaaggcaagaagttcacgctcgactccaaggagccgaagggtggctatcaggactcctgatgaacgaggcgcgtacgcttccctgacccgctccttcccggagcgcgcaaaggagctcttcggctgagaacgaggaagctgctatggagcgctacgcgcacctgctcaagctcaaggatatgtacgccgacgcataaggcataagcactcagagcttgatgtaagctcgaaggacggaaccgaaaggctccggtcctttttgtgaagctgctatttgcccgcgacatgaaagcgccccaaccagcctgtgcggatgcggcgtgctgtctttgcgtgcgcttctatgccggcgcgtagcttcgtccagaagtgtccgcacttgttgcagagatagacattgataatgttgccaggccatctgggtcgctctgcgtgcaggtcagtcgtcagagccgcagaccgggcagtcggggcaggcaagataggcatcaagctcgtctcctgatatctcatgtgctcccatggctaatctctttcgggtataggcattcgaataggcagccttcgcagagatgccaggaagggcaccgagacgtcctgcgagggctgaaatcgtgtcatccgtcgcatccacggcgacgctgataacgttcagatgatgggcacggtaggggatgcccatgcggccaatgatgtagggtgcatattcatgcagaaggtcgttcagggcactgacagagttggggtcttccacgatgatgccgataacggcgacacgggtcttcaaagggtgccttctttcagtcgggcttcatgtcgcgtggactgagtcttccatgcggcgttatactcatatgtacccgattttggaaggcagcacgagcggtgctgcatgacaggaaggcattgcatatgcagaacagacacgccgcgaggctcttgggcactggctggtcttggccttacacggattctcggagcatgcgggagctcttccagacctctacgaccacggcaccgaccgaagagaagacggacgacgttgtcgtccgtgtcgcatctctcaagggccccacgacatcgggcttgtgaacatgatgaacgatacggcaggcattctgctgacggaggagatctctcccaggcaggaggggaggctgaggaaggttctggcatcacctatgcctaccagatgtccttgctcctgacgaggtgctgccgctcgtaatccagggacagccgatatcgcgctcgtgccttccaatgcagctgccgttctctatgcaaagacgagggcaaggtccaggtcatcgaccttaataccctgggcgtcctctctgtcgtcacgggcgactcctccattcagcagttcgaagaccttgctggcaagaccatctacatctccggcaagggtcctctcctgagtatgtgatgaactacctctcgagcaggcaggcatcgctgataccgtgaccatggagtggcagagcgagcaaaccgaggtggcatcggtgcttgcttcggaccttcgggtggggtgtgcttccgcagcccttcacgaccgcgcagctcgcacagaactcctcgctctcagcgcctgtcgaccttaccgatgtgtgggagaagtacgcaggagacaccggctcactatgttatgggtgccacgatctgcgctccgagttcgcagaagagcatctcaggccgtggccgacttcctcttcgtcatgccgcatctgtccagaagtgcgcagacgatgtggcaggcacggcagcgcttgttgtccaggccggcatcgtcgcgaaggagcctatcgcagagaaggccattcctgagtgcaacatcgtctgcatgacggagacgagatgaaggatggctctcgggctatctccaggtgctctatgatgcggatgcaagcttgtgggcggcacgcttcctgaggagacttctactacaatgcctaatccagctgctgaaccaagacctgtggctggtgagacgtgtggctatcgctgccttctggattcttgttgggaggcagcgagccttttcgtcggaacccatccttctggggggacccgtcgatacgcttttgcgccttgcctcgttcctcccgatcctgccttctggggaacgcttgcgctctccttctggcagatctttttgggctcatcggaggctttgcagctgcgctcgtgctgggttttctttcccacaggttcgacctgcgagggaacttctggcaccgctctttgatgccctgaaatcgattcccctggtctgcatcatcgtgcttctgcttctctgggttggctcgaagaaggtctctgccctagcagtgtttctggcggttttcccggctgtctacttcagcgtgctcgaagggctcgatgcccaggaccgaagctccgagagctccttatgccatgcggacacgggcatgaggatatttctcgccgatacctggcagcagcttctgcccttcttctggggacgcgaggaatgtctgcggaatggcatggaaggctggcgtggcagctgaggtcataggcacgccacggaacacgataggcgaggcggttatcagtcgaagctcctggcgagacagcagaatctttgcctggaccatagcgattgtggcagcatcctgggcctgcgaacggctcttctggcgctgcttgagaagagcgacttttgtgctttgaagcttgcgctcagaggaaggcatgcatcaacggagcgcattgctcctgcttctgtgaaagcacatgatttgacattgggctacgagacaggggagaggaggggaagaccgtcttgcagagaagctctccttcacgctcgatgcgggcacgaggtggatcctgacggatgcatcaggtaccggaaagaccacggtcatcgctgcgcagcaggactcagaaagccccttgctgggtcgatcgattcgtctctgctctttccctcatgtgtcaggaagcacgttggtggaggcctataccgcagaagagaatgtggagcttgtcgctgcgctcacagagaatgaggcaagaagccttcttctcgcgatcttgccgaaaagctgcctgggacgtcctgtgagcgagcttcgggaggccagagacggcgcgtcgagcttgtccgcgcctggcccatgcatcagggttgtgcttctcgatgagccgtttgcctcgctcgacgaaagaacacataaggaggctgccgccttcatcctgagacatctggaaggccgcacgctcatcgttgcctcccatgcacagagagaccgggagcttgtagctgctgaggtgctcgagcttttcggccgctagacacgcagcaagcagagtcttgctgttgaggtggaccccaatctccgcacactgccaggcagcgagccttcctgcatgctccatgggggtcagccatcctggacgctctgcccccctgtgatcgctgcagcagccagtgtgcctgccggcaggtgctatggcctcctcggagggagatgcgccgtgtgctcccatctgctccttcatccgtccccagaagctcccgatgcagcatcgtcccggagcaggtccgccggacatggactgccggattccgggctctccgtcctggccgattgggccgcggggcctcctgcgcctcctctccgcacgatgccggacttccccatgatgcgctgcgccttcctgtggcccatcctggtctcgttccgcatccagtgggatgagacaggcgcgctcttcttcgtgagcctgccatcgaccatatatggagcccgttccgtccgtggcccgctgccgggcggaatcgagctgtttcgcaattccgaatgggtgggcggaatgcggggtccaggtcagtctgtcaccacgatccaggggctctctgctctgggcatcgctcatcggcattgcgcctgcatgcgcttcggcaggcgcaggaacgagaagtagtctttcattcaatgtagccaacaagaaggaggctcttccggacatcgggagagcctccttgcttgagctgtggtgttgtttctagcaggcctgctcgatgaagcgcttcagggtatcgatgccgagggcagtctgtgccgaggtgatgacacaggccatctcgtcgacgtcgaaggcagcagcaagtttctcagctgtgcctgctgcttctggcgtgagagcttgtctgccttcgtgagggcaatgatgaagggaaggcctgctcccttcaagtagtcgacatctgaaggtcgagtgcctgggcatcaagcctgattccaccagggcgatcacgagattgtgtgagcgctcgcttgtgaagtaggcatcgatgaggtcggcccagcgctgcttctctgcctgggaacgctgtgcgaagccatagccaggaaggtctacgaagtggatgccgtcggcctcgaagaagttgatgtgcggtctgcccggctttcctgagacttggcaagggacttctgttgaagagcttgttgatgagggaagactttcccacattggagcggccgacgaaggagacttcgggggcttcgactgcggcagtgctcgaccgtgcatacgaggcaaggtagcggaagttcatagcggattcccatggatcagacctcctgtatctggggagcatacggagcaagaagctcggagatggttccctggctgacgatagtgaccttgtgcatggcgcgggagagggcggtatagggcgccgtctcgcaagcggcgtgccggatagacctctgcctgtgcatcggggatgatgacagcatcgaattccagtcccttcgcaagggagaggtcgaggacgacgacacccttgagaggaaggatatcatcgggctccatgacgcggacagagttccgagctgctttccgagccagttggcacaagctgacgtatcgcagacaagggccgtgaggccatcgcatcgtgcgcttcatccacaagctcctgagcttggcaagatagctctcggtaacctttgcctcgaagatctgcgccttcgtgccttcgcgctggaccgaagtggcgtggatgtttcgtccttctcgtagagccccatgaagagggaggtgatctcaggggtggagcggtaggacgtgaggagcctgagctcctggatatccttgcctctgccgaagccggcatggacgaagacgtccttcatatcctggaaggtggccgtgcttcggatggcctggtgctcatctcccagaagcatgaagtgggcacctgagaagtagcgtgccatcaccatgagctgcgctgcggtatagtcctggaactcatcgaccatacatagcgggcctggcggtcgcgcggcaccgggatgagggagacaggtgaggtattccacagcattgaggtggtgccccagaagcctctgaccgatgcggtcgatcctgagccagcctgctgcctcgatcgtgtatgggcgctcgcatagcgtgcttccacgtacttcttggcaagacggaccgtatcctctcgtcgaggggattgatgggctcgccgaagatctgcaacatgctcgtcgaggtctatgcccagcatctcttcgtggatcgtcgtcctttgccaaggcagcaagcctctggttcagcctctcatggagcacatccttcacgagcgctaccagacgggggtcccagaggggtccgcgggaacttggcaaaggattcttacctgggatgcctgatgagctgggtgtcgccgataccgatgccaggatatcgtcctcttcgagctcgagtccttctattgccttcccatcctgagaagctcttcgggatcggtctttgtgccgtctgcccggtcctggatgctcgtgcacaaggaagccgcgccaggtgaaggtctggggattggactctcccaaggaggggagcactgtatcgatgttgtagcgtggaagacggcgttcggcgtgaagagatagacctggtggggattcaaggttctctcttgctgatagaagagataggcgatgcgctggagcatgaaggggtcttgccagagccggcaatgccgttcacgaggagcaaccggtatgtcctcatgcctgacgacggcatctgctcttctggatcgtggcggtgatggcctggagcttctccgagtggtgctgcttcagggcattgagcaagagcgagtcctggatagcgaccgtcgtatcgaaataaatcctgaggcgctcgcctgaaggtcgaactgccgtctcagcagcagctccacctcgcgctttgccgttccctcataggaggtcttgcccatctcggtttagtaggtctcggcgacagggcttgccagtcgatcacaaggatgggaatctctgtccatcacgccggagacgccgatatagatgtctcttggtggcctgttcggagcatgcgcagggagacctttgcaaagtagggctggtcagaagaacaagcacgcggcgcagcttctctacgtcgaagtcatgtgcctggttgtaggcatcgatgacggagttcagggtctcgatggcggcaagggtctccatttctcgtcttcgccgccgaagtccgggtgacctctttcggacagtcgcgcagatcctgcgctgcgcgcttgtgggtgacttcgagccatgggtgagctcgtctctgagctctgtgagcttctggtaggtttcgcagagatgctccgttactgctgaagacaggatcgttgcgaactcttcggtatctggagtctggcatgtggacctcttggaccgttgcggacggcaacagcgtgaattcagcagtaattaattgtgcccaaaaagcgtgggatgccctgggttccagaagagctccagaaacggcgcagagggagggcggagccgggatgggaggtcggaaaaggctcgaggagcagtgcctcagtgctgccgggcgtcttcctgtgccggatgcacggacagagaagggaggggaatctgcctgctgccgcacgctcttcagagcaggcatttaccaatatccatgaaagaggactgaaagctatgatatatgtatgttagttgaaaaaaaactttcagagttgggaatgaatccgtccgcaggggagcgggaaggctgtctgggaagcaggaggctgaaggatagggaagcgcagggttttcctctgctgtgcctgtgctatgagccaggacagatcggggatgccgcagatgccatccggatccggccacgtggctgtcttaagattacagctcaggagccgatgttgttcttctggtccacgacgaccagggcggcgtagtgcctcctcgagccgcttcgacaatcgtccagacggttctccaccgccggctgatccggatctcgcccctggtcgaaccc

SEQ ID NO: 103 - DNA, 3179 bp, Unknown
  Metagenome-assembled genome
tatggctcctacaaccgggcgcaggtgtccaccctttatgccgcatgcctggacctccaagtttgccgcagagctcaagtaggtcgtccacatcccggccatatcttccaatagtatcgatgacctgccgacggcagagtctctggtcgagtgtggtatgtgcgactctgccggtatgagtcgctgttctttggctgccctggatatgccacgtaagggtatggaaggtcgcttcgatgagattcgtccgtgcgctgcgtgcagggctgcaccggctccatcatcaagcagatcccgatgtactgcaccgtcaacccggaactcggtcacgagtatgagtacaccttcgcagataaggtgtcctcattatcggcggtggctcggacggcatggaggctgcgatggtagctgtgcgccgcggccacgatgtgacgctgtgggacaagaaccaaaaactcggcggtgaactcttggctgctatctcccctccgggcaagggtgagttcgcgacttttgccgcctgccttacgaccagatggatctcttaggggtccacgttgagctcagccatgaggcagcagcggagggaatccgcaacttcggcgccgacaaagtcattatcgcgaccgggtcgatgctgaactgtctgaagagcgtcttaggtatcaattgtccgaacctcgtcttcgcgcgtgatgctcttatgggcaacacccaggtcgaaggcaatatcgtcgtcgcctgcgcgcagggcgccttttgcgagcatgccgcgccctccataatgaactccgatcaggggttggtctttggctccaacgcctacgtctcgcttctcgtctccaaccgcgtgacacagagcatggacggtcgcgcctcaccagtcgctgggctgaggcacgccgtaaagctggtactacacgggaatcaattagagggtggcgcaggaggatacaggagggctaggatggggacaccatcggacgcgagctcggcagcaagagccaatccatgtcgaacagactcagccagttcattgtaaaggcaaccggtggtttcttcgcgcaagctccccgtttgatgcggatacatgcattgccatcctcggctccatgcacttgagggacgcttggattgatgtcttcggttctgaagaggaacgattatttgagtgtggtgacggaatcactgtgatgatgccctttatggttggatcaggacaatacgatctgctcgaatagaatggagccatcacgctggggaagcgactgacctcaagggcacagatggtgattgcaatgccaaaggaaacactgtcgcttgaagactacatcacaagtggacaagcctgggctgatcttacagcgtatgcatcgggcaccttctctgttcaacggggcagatgcaaagtctatatgccgcctatgagcatcactacggaaggtgttgatctcaacgaactcctgcagcatctgggaatcgagaacgtctttgagaactcacaggactttgatccgttaataaaggatgcagttggtatctcacaggtgattcagagtattcggctcgatgtaggaaagaaggggattgagggtgcttcgtatatggcgatgacgtaggttgcgggattccttcatggtctatgaattcatcttgagaaatcgtgttcgatagaccgtttatcgtttcgatcttctcgtctaacaggcttccgctctttgtcggttactatgtgaagcagaaaaggtccaatcatgtaacaatggctaatgagtatacgtaccgaagctctcctatcagttccacatgagaggacacccatatgagcaagaaacaggacatcgataaaccgactggcgaagacatggtcgacctcctcgtcgcggcggggattgaccctgatgaaattgccgatgccttcggagaagaagggattggggattgggacgaggaagaagaggatgaggattatctggatgaaatcgataccgataaaatgatccgggcgatcagcacgacagccctgagggaaggcccagatgatttctgtgagttcgtgtccgcaaacttcgatgaaattgtcgaaggcaataagatggatgagcgtgtcggcgacatcctcctcatcgggtacaaaattgggttagcccaggaaaacggacgctctgccaacgatctaggcgttctgttttacatgggtcaaatctttaagcaggattacagacaggcgaccaggctctacaagaaagcctacaggtggggacactatcaggggctcatcaatctgggctacgtctatgaatacggtcgaaccggcgagaaagactatgcaaaagcctatcagtgttattcggttgctgcggcgttgaccgaaaactatgaggccatctataagctcggtgacgtctatgcccgaggctatctcggcaaaccggatatggatacggccatggagctctgggagaagagctatgacattgcacagaggccaccccagaccgcacagcctgcgttccgtatagcgcagcagtatttgaaaccgggcaagtactttgacccagaattcgatccgctccacgcgctgcggctcttccaggaagctgagaccggcctgcgcatcagtgtcgctcttgggcacccgtactataaggaacgtctgcaagaggcaatcgagggacaacggcaggcacgcaaggtgctcgacagcacgtcaaaatagttgtgatactggcatcaaacatgtggcaatgatgagtgtcatgaggaaacaggagctaaacgttacttgaagagaagataggaccgttcggcacagcatatggatgagcagaacagtgagctgaatgacatagcgcagacatggtcaaaacgcatcggggcacgggctacctggtttgtgggcgccggcgcaattcagcagctccatgagatgttaggcgataaggggatctatatcgaaagcctcggcggcgtgccgatcacggtgacagacatcaaggccgcggcccagaagaaggatcctgacgcctgtctcgtatgcgacaatacgctcgcaacctcatttgggtgccctgctgcacagctgggtgccaccctcaccatcgagccgctcgatgcggttgtgagttggccgggatgtggcttctttgctgtcagcgtggggcgtgcactccctgaga

SEQ ID NO: 104 - DNA, 17888 bp, Unknown
  Metagenome-assembled genome
ttgtcgggattctggcccaaggcagccggcgtctcttcgcttgcggtttctgctgtctgagatgtgccctccgagcaggccgtgagggcaagaaggccagcgcctgcccctgccgcgaacgtccttctgctcatgctctgtgctgcatggatgtttcgctccgtctcgctcctcatgatcggctcctcgagattgtgcgcgtcgcgccaagatgaatccggcaatggcacgttcttgcgagtaggctctgcccgcgcttggctctaagtatctcccggcagagcaggcattttcagtttcgggagcggaggcgcagaaggggcacaagcattgaggtaactgaaaagaaaggtccgcgaaaactgaaagctgctagcgcacaggtggctcgaggatcttctggtagatgcgggctgcttcgaggatggcagcgacataggcatcgaccgagacaggatggcggacagagcggcagtagcgcgagtattcgaacgcaagctccgtataggcccaggcttctgttgccggatcctgctcgagcatgcctgcctgggagaggatgcccagggcatcctccatgatctggcggacatggtcctcgacgcttgtgccttcgaagatatagctcttgagcggaatcaggatgccaagcgcctcatcggccctgccgctgtcttctgtcgcctttccggctgcgaggctgcgtatcgcccccatggcctcttcctcgaactcggcaaggccgcgcctggccaggctgtctgccacttcctgcttgtcgtggtagtgcctgtagaacgtgcctctgttcacgagcgcctcgtcgcagatgtcctcgaccgtgatcttctcgagcgggcgcttggacagaagcgtgagcagggcatgctcgatggcgcgtctcgtgcgcaggattctccggtctgtggaattttctcgattcatgggacctctttcaggacaggaagcgctgcagctgtatgcatagcagcaagaaacagatacagagtgtattgatagcagtatttagagtgcttatttacacatacataatagccagattcggggatactgagcgcagagattcattcctcatcgaaggagcggcaatgcagacgaagatcgtgcatgcggcagagcgcaaggcgttctctgccgtgatcgaccagatcatcaaagcgggatctggcgaggatagggaaaagaacatccagcacctggtggacatggcaacgaagcttctgaaggactctgtgccaggagctgccaagggcatccatacggccctctatccggggtccaagtgggagcagtggatcttccgcgtgattgacgagaccgacccgaatgtcctgaagacgtccgtgctcaatggcgcctatgaggcagcattccgcggctaccgcgacacaatcgcgaatgccgagaagctgcagtgcaatgtgccctggatcgttatcttcgacccgacctctgcctgcaacaagcactgcatcggctgctgggcggcagactacgagaagacgctcaacctcacgttcgatgagatgaaccgtctcgtgacagaggccaaggcgctcggcacgcacctcttcatgctcacaggcggagagccgcttgtccgcaagaaggacgtgctgaagcttgcggagaagcactcggactgtctcttcaacatcttcacgaatgcgtcgctcatcgaccagccgttctgcgacgaggtcaagcgtctcggcaacatcgtcttctccgtctcgctcgagggcacgcctgcctcgaacgatggaaggcgtggcaagggctcctaccaggaggtcatggatgcctttgacctcatgcacaaaaatggcctgctctacggcacttcgacggcctatacccgtctcaataccgaagaggtcacctcggacgagtacttcgacacgatcattgcgaagggctgccgctgggcctggtatttccactacatgccggtcggtgagggtgccaatgccgacctcatgccgacgattgagcagcgcaagtacatgatcgaccgcatcaggaaggtgcgtggctacgaaggtggcaagcagatcttcgctatggacttccagaatgacggcgaatatgtcggcggctgcatcgcaggaggccgcatcttctgccatgtgaatgcccgcggcgatgtggagccctgcgtcttcatccactactcgaatgcgaacatcaagaacatgagctggcaggagtgcctgcaccagccgatcttccaggcgtatcgcgagaactatccatggaacaagaacatgctccgtccttgcccgatgctcgagaatccggctgtgctgccgaggatcgtgcatgaggcagatgcccattcgaccgagtatgtggcaccggaggatgtggaccatctctgcgcaaggacgacgccgtatgcaaaggcatgggcgcctgtcggcaacgagatctggctcgagcagcatccgaccggacagaaggaatacggaaacgatgtctccggcaagagcccgaaggagcgtgccgagcgcatcgagcgtgacgacgagaagaacgctgccgtgctcgactagagcacgaaccgtatagctgtttccttgcacgccctcctggcatcctgccgggagggcgtctttttgggccaatccggagctttcgagatttatggctacggggcctgcgttcgggtaggtcttatatgtgcgtgaaaggagagagaagagatggacagcatcgaggaatggaaagggcgtccgagcgcagagcttccgctcgagatcgtgggtgcccttgcaaatccgcatatcacgcttgtgggcgagggacaggcagacgagcttgcagaggacgccgctctggcccaggagacaggatacaggctcgacgaagacggtgtatggcaggttgccatctcctgcaaccttcccggcgtcacgcctgacatgctccgctggttcatctggtggtgtccgaaggcagatgagcgctacagcgcgctctatcccgaatcgcacgagaccatccagttccgtgaagccgatgctgcctatttcgagcgtccggaacgtccgcatttcgagaacaacatggtctatgtgacagagcgtgtcggtggcgaggggacggcctcgaccatccgcttcgtgaagcctgaggagtgtgcgctcgatccgaagaagctccatgcaaagggcgttccgtatgcgctctgcgcagagatcggcacgaaccacggtgcgctcatgcgcacgcgcttcatcggcctcttccatacgacaggggaagggctccatctcacgggccgtttctggctcgggtccatgcttccctggaagtggatgaggaagaggatgttcacggaagacagcgcccgcgcagtctgcgagcatgcctccatcgaggcccagaatctggccgagcgcctgccttcgctctatgaggcatatggaccgggagatgctcgctacaaggtcgcagctaagcccaagaagcagaagaagcaccggaagcgctgagatatgaaggaaggccaggagattcaagctcctggccttcctcatgttctggcaatctcgtgcctgcctacttctgctctggcttgtcttccttcacggactggatgaaggcgacggggtcgatagcgggcaggatgaagccgttcagggctgtctgggccgtgagcgtcacgaagttcgagcgcatgtgcgaatagagggccatgacgccctgggtgcggagcacctgtgccgggtcgctgtcctttccgagggcagatttcggcacggcgacaacggtgtggccttcgagcgtcgaacgggcatagaccttgtcgcgattgccggtctcggtgagggcaagcttcacggtcagaggcacatcgatgcgccagagctcttcgccgtcctccgtggcctcttcgagcggctggggaatggtcgtgagcgtgaagctcgcatcataggtatcgggaatctcctcttccgccgtgaattcgacgcgggtcaggcagaggacctcgatgcggagcggtgagagaaagttcttgctcattgagcggatccttccaagcgtgcggggcccgaaggccaatccggaatcattcagacttcgatggtaacgcaaatctgctgcccaaacttggcacatctgcgagcgcaggaaacgggacaggggagctgcaaggtgaccgtatggcttttcaggtctggcaggccctgtcggctatcatggggtgacgcagaggagtatggaaggggatgcgatggcagtgaagaagggcacagcccagcatgcagcaaagcatgtgacgaagggcaagaaggcatcttccaagagctcgagcactgccaagagcgcctcttccaagaagaccgctgccaagcatgcgaagagcgcaaaaggcggtaagagcaggaagaagctcacgaagaagcaggagctcgtccgccaccgcgtgaagcttgtggcaatcattgccgctatcgtctgcgccgtcgctgtcggcatccgcctcttcgtcttcgagccgacggtttcaggcacgttccatggggcgcagctgcccagtgccgaggctgtcgagacgagcccctacgactggaacttcctcctccgcggcgtcgatggaaggctccactatgtggtctctggcacggaggagagcaggtccggcatcgatgtgtcggcccatcagggagatatcgactggcacaaggtacgcgcagatggcatctcgttcgcaatcatccgcctcggctaccgtggtaccgagtccggcacgatacagctcgacgaacgcttcaggcagaaccttctcggcgcccagatggcaggcctcaacatcggcgtctacttctattcgcaggcaacgaccgtggccgaggccgaggaggaggcagacttcgtgctctcagagctagggagcacgcagctcgtgtatcctgtcgtcttcgacttcgagccgacaggatctgatggcgcacgcatctctggcatgagcgcagacgagatgtacgccgtcgccaaggccttctgcgacaggatcgctgcctcgggcaggactgccatgctctacggcaactactacgatctccaggatatggaatacacggggctctggcagtacggctactggcttgcatcctatacggacctgccatcggctgctatcccgtttgcgatctggcagtactcggcagaaggtacggtctcggggatcgacgggtacgtcgatctcgatatcgacctctcgaagacgcttcaggcctcgtttgcctagaccttaccaggggatgctgtcgtcgaaatcgcagttgtagggaccggcatcctctgccgctccatcgtcttcgccttgggcaaaagcgtccatgccttccggatctccgtagaactctgcctctgtcacctcgtgccaggagtcatcggtccagtccacgacctcgtcttcggcgcgcggtcggttcatgaaggccgtgaaggcggcctgggcctcctcggagcgctcctcctcgatccagcggctgcgctcggagacgagcgtcaccgcctcatctgctgcctcctcgaaggaatggggacggcagcggcgcaggtactctgccatgcgcagcatcgtcttggggccacgcacatactgtgcgagcgccaggccgaactccttcggatagccgatctcctgcgcagcagagacaaggtcctggagcgcttgaccatattcgtccatcgtgggcttcctttctcagtcatgcctacgtgcaagcatagccgtcgcggctgccgttgcagcagcaagaacggagagcgcgcctcctacgaggccgagcatgctaaggcccgaggcagtgacgacggcgccgcccaccgcggtgccgaaggagatgccgacattgaaggacatgggctcgagggagcttgcaagcgtcagcgccttcggatgcctcgtgcgagcggcatgcatgaagagggagacgcaggggaccgaggccagatacatgagaagggcgagagcaaagatcaggaccagggcggaaaccttggcgctgcccacagcccagaggccgatgaggacggccgcctgcgcgaggaaggtgacgatcaaggcacgcacgccgaagcgggagtcgatccagccacccagaaggttcgagatgaaggtcaccgcgccataggccatgagcgtcgtggaggcggcaatcgtgtccatgccgaggacggtctcgagatagggcgtcacgtagccatagaacgtatagacggagccctcgccgaagacgaagatcagcatcgcagcaatgacctggggctcgcagaacagctttgcctgctccctgaacgtggcaggctcgtcggtcgcaccctggcgcggaaggaaccagaggcagagcgcgcaggaaaggatcgcaaggaccagcacgccgtacatgaagacatgccagtttgcgacatcggctatgaacttgccggcagaggttgcgacgaccattgcgacggagtaggacgcatagacaagcgagagggcccaggagctcttctcaggtgtcgtgagctccgggatgaacgtgaggcccacggccagaagcgcgcccgagacggagccgacaaggatacgggagaccagaaggacagagaagctggtggcaagggcggagatgatgttgccggcacagaagatgaggctataggcgagaagcaggctgtatctcttgaagcgtccgcaggagagcgccagcactggtgtcatgaccgcataggggagggcaaagagactgatgagctggcctgccgtggcaaggctcacattgaggtcggctgccaggtcggactcgatgccgatgacggagaactcggagcagccgagggaaaatcccagaaggacgaggagcgccaggcagatacgggcgcggacaggggagacggaagcttggacagtgctggacaagagatgtgcctcacttttctgatcggatgagccctgtcagcctagcatgcctggcaggagccaaaaccatcttcacagcggcgccatctgctgtgctgccttgatgctgttctgcagctggcatgtcagtacaccttcctgtctgccatgctgtttgggtcttcaggaactgcaagaaaggtgatttccagtggcagaggaacagacagggacagaggctccgctcaagcgccgccagatgctcgcgctcataggcctcgtcgtggcagcattcgtcttcaatacatctgagttcatgccggttggccttctctccgatatcgcggcaacttcgctctcaccgatgcccagggcttcatgatctcggtctatgctgcagttgtcgcggtgctgtccttgccgctcatggcatgggcatcgcgcttcggcttcaaggagctcctgctctccgtcgtcctcatctttgcggcagacaggtgctctcggccctggcaccgacctatgccttcctgatctgtgcccgtctcgtcgtcgccgtggcccatgccatcttctggtcgattgtcatatctgtgcctcgaaggtggcaggtcctgcccacgaagcccggccatgagcatcgtggcgacgggttcctcgattgcacagattgtcggcatgccgctgggacgtgcggtcggcctcgctgtgggctggaggatgaccttcgggctcgtaggcgtgtggctctcatcgaccttgccttcctcttccgtgtcttcccttcgcttcccaaggtagagcgcttcacgctttcccgcctccgcatctggcaacgtgtgcgcccctcatcgtgctcttctgcgtaccgtgcttcttgcgggaggacactatgtcgcctatggatatatcgagccgtacctcagggacgtggcagccttctcggcctcagcatcacgggcgcctcatcctcttcggcgttgccggccttcttgcctcggtctcttcggaaagttctatgacggacacaggagaagctatcttgcgtctcgacagcagcgtcgcgcttgcgctcctgctgctccttccggcatcctcatctgtcatcggtgaggcagcggacccgtggtctggagcctcggccttacctctttcgtatcgccttccaggcactcatcatcgagattgcagacccagaagatgcctctgtcgctatggctgcctactcaggcctctacaatctcggcatcggcgcgggcacagccttgggcggggtggcactcgatggactcggtgcggcatcgctcggctttgtcggaggaggccttgtgcttgcaggcgcccttgccgttgacttcctgttccttccgctctatatgcggttcagagacggcgtacgcaaggctgcgtagagtgcgggacaaaaacagacaggtgtccatacatctgcatccgtctgcaaacaggctttcgtgtgttctgaagccataagagcggggttgagcgcctcatgtttcgcgttgggctcaaaaaatgtgcccggccgctcttccggaaagaagttcgcaccccacttcacccttccattctccagccgaatggcatggggaagagtcgcccggaaagcctgagatcgtccggttccttgggaaacgatggggaaggagcgcttctccttcgtgtgcgcggagattgtgcgccttgtacgggcgggctccgcatcgaaaagagcaatgcagagccacagaggccgaaggaggccctgcctcccggacaaacgcctccctgcgtcaggaacccgagatgaaaagggcccagaaggagcagcactcaagagcctcaagagggccgaggatgtcgcaggcatgctcatcgaaggctgtccgattcggcttcacaaaagaagacgagaagctcttctcccgctacgagcgctctctgccgtctcgctgtcgctcgaggactatcgagggatcttcgcgcctaagagaatggaggcggagaccgaggccttgctcttcggcaaccataggtgctcgatttcaaggaacgggagaaagcaaaagaccggccaggtgctctcccagtcgggcggcatcgagggcaagaagggtgtcctgtggtgggacatctaccgttcctcaaggtgcagctcgccatggatagggacaatgcacactactgtctcttcgagaatgtggacaggctgctcaagagccctgcatcgcggcgtggtcgtgacttcgcgatcattctgagctgccttgcatctcttggatacatgtcgagtggcgtgtcgtgaacagcgccgcctatggattccccgcacgcgaagcgcatctacatctatgcagagaggaatgcctcctgggatctcgaaacgagggtcgatgacggaatcatggcaagggcattcccgatgcgtgaagcgtcaagcgcagcctattctcataccggaagatccttatgatgccacgcacacttcaacgaggcaggctccaagatgtctccttttatggaagctggtgtcatggtcggacccgaggtagtcacctgcaagcccgaagaaatgtatgcggcaaacatgccacactcgcgagtgtacttgttccggagagcgaagtgccggaagagttctacatcccggacaagcgcttcccaggtggggtacctcaggtgccaagccgaccccgtcgacaagaagaccggacatgaatacttctacagcgaaggggccatggcatttccagaccttccgacaatccgtcgaggaccatcttgacgggagagggaggcaagggtccctctcgtttcaagcacatcatccagaccgaagatggacgatatcgtcgtcttgtcccggaagagctggaacacttcaggcttcccaaggggtggacgaacaccggcatgactgacggaaacagggccttctgcatgggcaatgcgcttgttgttggcatcccacatctcatcgcatggagctggccaaaaaaatcggcaagtctgaagactgagacatgcctggctgaacgggcagacaagcagtggtctgtccgtcatcatcgtgccggtacgtcatgagtctctatgcatgctgcaccatggaatagcagatatatttcattgcagctaatgtctgacgctcggcgacgcctataaaacaggattcagacaatcggcgtgacgctgcctcgaaaccctgaaggttcgtggcgactgggactttagatatcattccctaatagcttcccggagcttcttctcgagccttggagtgcggacgaggatcataacgattatgtagtgaatgacagcgacgaagatgaagggctcgaaggcaggtaggtgagtgcctgcacgactcggcagcgcgcatcatgtcggcaagccctatcgtcgcgacgagagacgagctcttggcaacgtgatgacctcgttcacaagggcaggagccacggacgcaaactcgggcaatatgatcttcaccatccttcccatacgaaggcccagtgcccgtgcggcatcgtactgcccctggtcgactccctggatgccaccgcgcagggtttcggataccgtggcagatccgttgaggccaagcgtcaggacagaggtgcaacattgtgatcttgtcccgtgagctgaggcgtcgcgaagtaggcgatgaagagaaggacgatcagggggatgccgcggaagatcgaggtatagaagtcgaggagagcccgaagccatctgatcggcaggaccttgagaagcgctatcacggcgcccaatgcaaaggcaagaacaagggcggcccctgtcacctcgacggtggtcagaaggccgctccagaacaggggcatatagggattgaggacagagaagttcatgcctgcgtccgggtgctattcgccggtgctgtctccgacggtagaggtgccggcagcagcgaagccgccatcgccccagacgaagtcaggaccgacatattggctgatgtaggtatcgatcgtaccatcctcgagcatgtcgccgatgcagctgtcgagtgccgagacaaaaggagcatccttctgcgccatgaggcggtagacgccgacatagctttcggtctcggagcgatcgagcagtcccagaacgaggcccgggtttgcatcgaccatggactgaccctctgcgccgtcgcagacgtaggcatcgatcctgccggcaaggacttcctgcaggcactggtctccgtcatcatatgtgtgcacatcggcatcaggcagcacggcggtcacgaacttgttctggaccgtgccggtcgtgcaggcaatgctcttgtttttaagtccgtcgatatcttcgaccttgtcgcccatcgtgaggacgccgacacggggctcatagtagccacgcgtgaagtcgtaggtctcgagcctctccgagtttgcgctcattgccatcgtgaatgacgtatcggagctctggatcgtggcaagcgtcgcggcaaactcctgcggctcgaagtcatacgtgaagccaagcctcgatgccatctcgtctgcgatagcgatatcgaggcccacggtcttcgaggagccgtcggactgcatctcgatgtagcggtagggggcaaacgcgttgtcgcccacgaacgtgaggttcttgccggagatgttgtagctcgagctgtcggaagatgcactggaagatgcggtattggtctgtccgcaggcagtaagcgctgccggggccattgctgccatgcctgccgccagggccaggaagctgcggcggcccatcggtgcgctgaagttgcggtgctctgcattgctgttcatgaaactgcctcccgtcgaacagattggtttaaacattgtagcctctataaaatcccattgagtagctaggaaataaacgatatggaatggaaacgaaaatggcaccgaggcagcatctggaagtccctgttgcatacggcaaccccgctgcctgcaccggaacaaactctgtctgcatacgaacatactgtttccgttatgtcccaagacgttacggcttggtaacatgaggaaaatccttcaacaatcctggataaatattaggcatttaagatgcgtagctgaaggtcagggagtccttcagtgccttgcgcatcaggtttctgtttttcgttctgcacaaagcataaggaaatgtttgtctgggaggtagggtatgtcgtattcaatgtctcgccgtcagttcgtcggtatcgcctcgggcgcacttgcagccacgggtcttgctcttgctgggtgcggtggctcccagtcgagctccagctcctccagctcgagctctgattcttcgtctggcttctcgaagagctcctatacggttgcaacggatacgacgtttgcccccttcgagttcactgatgcttcgggcaactttgtcggtatcgatgtcgatatccttgccaaggcagcagagcttaccggcttcaagtatgagctgaactcgctgggcttcgatgcagcggtcgcagcccttgaatccaaccaggcagatgctgtcatcgccggcatgtcaatcacggatgcccgcaagcagaagtacgacttctctgacccgtactatgactcctacgtctgcatggccgtgaagtccggctcctcgatttcgggatacgaggacctgaacggcaagaccgtcgctgccaagaccggcacgatgggcgcgacctgcgcagagtccttggctccgaagtatggcttcacgctcacctacttcgatgattcctcgatcatgtaccaggatgtcctgaccggcaactctgttgcctgcttcgaggactacccggtcatgtcctacggcatcacccagggcaatggcctccagatcgtgacggaggagaaggacgactattccacgccctatggcttcgctgtcatgaagggcaagaaccaggaccttctgtctgccttcaacgagggtctctccaagatgaaggattccggagactacgacgcgattgtgaacaagtacctgaagggctagtgcgtgccgcttcgggcagccaagagatgacatcgtgggtgcccgccttcgcgcgggtgcccctttgctgtcttgagccacagggtacagggaggaagctttatgggttttgaatctctcgccgcaacattcggcgatgtctggccgatgctgatgtcgggcctggcaacgacgctgcaggtgaccgtcatctcgctcgtcattgccatgttcgtcggcatcctcgtctgcctcatgcacatctcgcacgtgaaggtgctgagaggcatcgcaaagttctatatctggatcatccgcggcacgccgatgctcgtgcaggccttctatctctacttcgctatgccgcagctgatccagtatatgggctactccgacttcaggatcgacgtcgtcacggcatccatcctgacgctcacgctcaatgcgggcgcctatatctcggagatcttcagaggctcgatcgaggcagttcctgcaggccagatggaggcatcgcgttctctcggtgtctcctatgccacctcgatgcataagatcatcctgccgcaggcagtgcgcatctgcctgccgacgctcgtgaaccagtgcatcatcacgctcaaggactccacgatcctctatgcaatcggcctgggcgagatcatgtaccaggcacgcatctatgtcgggcgtaccatggaatcattcgcgacctacacatgggtcgctgtggtattcctgctcatcacgagcgttctcatgctcgtctcccacaccatcgagaaaaggatgcatgtctgatgtctgaacccaagatcaaagtcacgcagctcaagaaggcattcggggacaatctggtcctcaacggcatcgacctcgaggtcgagccaggcgaggtcgtctgcatcatcggtccctccggttccggcaagtccacgttcctgcgctgcatcaacaggctcgaggagcctaccggcggtgacatctcgattgacggcgagtccatcacggccaagggcgccaatgtcgacctcatccgccgccatgtcggcatggtcttccagcagttcaacctcttcccgcactactcggtgaagagaaatgtcacgttcgctccggtcgagctcaagctcaagacccaggaagaggcagacaaggatgcagagcggctgctcacgcgtgtcggcctcgcagacaagatcgacgcaatgccgaaaagcctttccggtggtcagcagcagcgtgtcgccattgctcgtgcccttgcgatggatcctgacatcatgctcttcgacgagccgaccagcgctctcgaccccgagatggtgcatgaggtcttggacgtcatgcgcgagcttgccgattcgggaatgacgatgcttgtggtcacgcacgagatgggctttgcccacgacgtggccgaccgtgtcatcttcatcgacggcggcgtgatcgtcgaggagggcacgcctgaagaggtcatggaccatccccagaacgagcgcacgaagagcttcctctcgaaggtgctgtaataagcgtccttcatagagtgaaatgctatcagggcggagctgccagccagctccgcccattttcttggaaactgccagtttctgagctatcaaagacgtggttgcctctggcggtgtcttcgaaaatcaaacaattatctatctgattccaaacatatgcatctaacagtagaattcagaaatagatattgaacatcgttttgcaatcacagggcattccctgtcaagatggatagaccagcgatgtccggatgcgggcggcgcctcgatctttgaggacgaacttcatctgctcttgaggaatccttgaagtccttcagccctcgtgctcgtggagggcctcatccaatccacactcgacctcgtcgaggaggtgaggagacgaaagaaggagcataagcattgaacggatagtgcagagacgaaacggcccggttgcatccggccgtctagtcagttagtactgcgccgcccgcagacctttttcaccgaagatacgggcatcgctggtactgattgaagtataccccaggcgtgcgactgcctgcacagggtacggggaaattctggaggcgtgccggctgctctgcacagcatgctcaaccccatgccatatctgacggatggggcagctgcgcatgaagcaagttttctgtgctggcagatgtctctgccgtgtacaactgaccataccgtgagaaggtctatctacatcaggattgtacgagttcctgaagcatacggcaccgacctatatgcttgcgacatgatgagaagggaaacccgagggtgcgtcccttcggcacggcagacctcttcgaaggcaggctctatatccgaccggcaagaagaaggaagtctacaagcagattgttgcccatcctgaagtggagatctgtgcctggaaggggccgactggtggcgcatagggagagctggtgccggacgagcgtatcgaggcgaaaaagcacatgccgatgcctatcccgactcaggaagatgtacgacgagaacgacgacaacacgatcgtgctctacttcaatcatgcgactgccacattcacctcgcttgccggcaagccatccgagaccgtgagctggtaagcggaaggcgcataggcagtgcagcagagccgccctcgggcggctcttttcgtctagaggatgccttctgccataaataagacgacgaggaagcatctatcgcaaggaagagccagagaccccagcagaagtaggccctccttgtcttgtgatggaaaagatgcatgcccagaagggcgccggtgcctccgcaaggcccgctcccagaaggactgcttcagggatgcgcgagccggcatgcacacctggcgcttgtcgatagcgaaaagggcaaaggctgcgaggcttgcagcaaggagatagatggcaagcggcgtgtggccacgtgcaagcgatgcgaagaaggcatctgccgtgaaggagacagtgcctgatacaaggagcaggatgaggcccaggagatggagaaggcaaggccgcagaagaagcgcgcaaccgttgccttcgctatgtgcgtgcgggtcacgagaaaggcagcaagcgtgccgaaggcgcctcctgcggcagagactgcagcccagagcggccagggaagagggtctttgcccctctggtcacgtccgagatcgcaaagcatgatggcgaaggcaatgaggctcacagcaaggatataggcaggcaggacaagctcgtgcggcatggtggcccttggattggatcatcccatgatacaggcacacaggaggctccggattcggctcatcctccgatgccctcatctgaacggaaatactgctttctcgcatccaatgcgctgcacgcctgaaagcatgctgaagactgtcttgccatatcgcatggaagcaatatatgcctcatcttttccagggagcgatgtcagatgccatccctctcagtaggggcagcggtagccttcgaggccataggtaccgtgctgggcacaggcgcgggcggtctcttctgctctgcgcgtgtttgcatagcgctgcttcgagaggcaggccttcatgaggcgggcttcctccttctggtctgccgcttcgcgctgatgtgctcttctgcggcaaggcatcatccatgcccgccaagctcgagaggaacctcctcccgctctctcgccacgtgccgagtgcttcctgctgcccatggtcttcctcctgctcctcttcagagactattgccgaagagtcctgctctatgcaaacgtaggaccgattcctcctagctcccacaagaagggcatgtctgcctgatatgtctggcatctatggcagaaacgtatttgggcatggatgtcctgatgaccgaaggtagaaagagaccgatgcaaggctgtcccggctgggtgccgggatgcagaggaggaatgatggaaattccgggaaacaagtcggtctgacaccagaagcgtctatatcatcgctacctacgacagaacggtgtgccgaatgcgatgaatgctgcctggggcgtgcagtgcggagaaggggattgccttcttcctgggcacgcacaagacacagagaacctcaaggccacaggtgccttcacggtctcattcggaacggcagataccgtcgagatatctgactattcggcattgccacaggcagcaaggtgacaagatcgagcaggctggcgtccatgtccataagcgcccatgtcgatgctcctgtgatcgaggaatatccgctcacgctcgaatgcacggtcgagctcttcgacgaggagcatggcctgcttatcggcaaggtcgtctcggaacaggcagatgaaagcatccttacggatggccatgtcgatctcggcaagcttcgtcccatcatcttcgacccttccgtcaacggctaccgtgtgatcggcgaacaggtcggcacggcttggcatgacgggctgggactcataagaagtagctggaggccggcaaagaaaatgggggctgccatattgctgtggcagccccccatcgctctgcagctggatctgtctgagcagacctaatggggcggcggagctctttggcaggtgcaggggctaacctattgcctccggaggagctcttccatatagaggccgacgcctcccttgtctttgctctgggcggtatggtctgctgcggcaaggcattcgggccgtgcattcgctacagccacaccgtctcctgctgccttgagcattgcgattcgttgctcgagccgccgaaggccacggtctcctccacaggcacgcccaggtggtctgccagccagaggagcctcgcccccttgtctgcgctgttcttcgtgacttctacgttgcagggctgcgaagaggccctatgaggtcggaaaacgagtccacggcctcccagaccctgtctctagtgtcgttgt

SEQ ID NO: 105 - DNA, 9268 bp, Unknown
  Metagenome-assembled genome
cactctcgacaggggcaggagttctcggatgcagagggcctccaggagcgctgggagcgccggtctacttctgccatccccaccatccatggagcgggcaccaacgagaacaccaatgccttctcagggactggttcccgaagggcgagagcctcgacgatgtcacgacagcgaggtgcaggaggcatgcgattcaccaaccggagaccacgcaagctctcaagtggaagtgccctgggaggtctaccaccaccagtcttttgcacttgctctgaggattcgccgatgccaccgcccacgcactcgagaccacgatagatgaccgcactctgccccggcgccacggtgcgcaccggctctgcgaacgagaccgtagcgctctttccgtcctcggagacagagagccgagcttcgcaaagaggacctgtgtgcctcgtgcggacgagacactcccctgcttcaggcgccgtgccagcaatccagtggcaatcttcgagcgtgtgctctttcgtccaaagtcccgggcacatcttgtctgccgtcacatagacgacattttccttcgtatcggttgccaccacatagcgggcagggccgcctccgagatcgagtcctttcctctgtcctactgtgaagaggaatgccccctcatggtgtccaagcaccttgccagtctcccactcgacgatgtcacctgccctcttctcgagcgtatcgagcaggaaggtacggatgccgacaggaccgatgaagcagatgccatcggagtccggcttggtctcgatgccgagatggcgctctgcgcaggcagcacgaacgtctgtcttcgaggagtagccgccgaccgggaagagaacgcgattgaacgtcgtaccgggcacgcgccagaggaagtaggtctggtccttgtgctcatcagcagagcgaaggagcctggcaggtcctccttccgtgagtgccggagccgtccttgcatagtgccctgttgcgatgagatcggcgccttccttgaaggcacgctcggcaaacgtgccgaacttcaccgtctggttgcacatcacatcaggattcggcgtatagccatgggcataggcatcgacaagatagtctgcgaccgtctccttgtactccttctcgcagtcccagacttcaagatccacgccgagtttcaccgctacgcgctccgcatcggccaggtcctctgcccaggggcacttgaagccaggcaagtccttcgaccagttcctcatatagacagccgtgacatcgaagccctgctctacgaggagcgcgcaggacaaggccgagtccacgcctccgctcatgccgaggaataccttcttgcccatcatgccgcctttcccgtacgcggatcgaggccacgccttcttgcctcttcctcgacggcgtttccgatcctggctgccgcctcttcaatgtcctcttctgtcacaggagccccgagcgtgatcctcaagcttccatctgccacagcaggtgcagctcctatcgcttcgagcacatggctctcccgcatccggcttgccgcacaggcagagcctgtgccgacagagacccctctgtcctcgagcaggatcacgagcctccttgcttcgaggcccgggaaggagatgtgcagaaggccgggaaggcggagctttgccttcttcggaccctcgacctcggcccagggaaagcgctccaaaagctctttctggagcctgtcccgaagattctgctcccgctttgcctcctgggcccggtgtgccgtggcctcttcgagcgcacaggcaaagccgacagctcctgccacattctctgtgccggaacggacgccgccctcctggccaccaccttggagcagcggctttattgcgatgccgtcctcggcccagagaaggccgacctgctttggcccgtagatcttcgcggcagagagcgtgagcatgtccacatggagcgatgccacattgatagcaagggcattgacagcctgcgaggcatccgtatggagccagagcggcatcttttcccctgctgcaagccttgactgccgcctctctgcgacaagcttagcaatgtcacggatgggctggatcgtcccgatttcgccgttcgcaagagagatggagataagccccacttcaggcgtgaggagcttctcgagcgtctccatgtccacccgtccatcccgatgcaccggaatcagcgcatggtctttcgcctctgctgccgcaaggacgctctcatgctctgttgcaagcaccagcaccctgccttcggcagagttgatggcaaggttgttcgcctcggtcgcgccggcacagatgatgaggttgtcaggcttggcgctaatctcatgggcaagccgggaccgggcctcttcgtagtctgccttcgccttccttgcaagccgatacggggcagaagggttgtagaacatatcggacatatagggaagcatcgcccgaagcacggaaggtgctaccggcgttgccgctgcatagtcgagatatatctcttttgttgcatccatagagggacatccgctcgaagaatcgtgaccgcagagggcagtgatgcctggctctgcgaagtgtgccaagatacaaggcagcacaaaggtgtgctgcatgcgcaccccatactaccaaatgcgcaggaaggcggcctctatgccagagctcctccatctcgatgcaaccgatgtcctcgtcgtagggacaggccttgcaggcatctcagcagcggtctctgccgcagaggcaggagcgaagatcacgcttgcatctgccggtcctgtcttctccggctcctccttctcctctgccacctggggcctcggcatggtcgcacctgagtcggcagcagacgaggaagaccttgtccagaccattctcgcggtaggttcaggtgcggcagaccccgcactcgtcagaagctttgtctcgggcatctatcctgccatgcaatggctcgaagaccacgacgttgcgctcagagcgcccgatcacccagaggagcgcgagtacatcccctgcttcgaccacaaagcacgcctctggcgagggctaggcacggccgagttcagagatgccatggcagcacgtctccaagacctggacgtccatctcatcgagcatgcatctcttgcacgcttgaggaaggcagacgatggcaacatccagggtgccatcttcttcgacgagacatcctcttccttcatcgacgttcccgcttcatccacaatccttgccaccggaggcacggcaggcctcttcggcaggcatataggtgctgacgaggacacaggcatttcccatgcccttgcaaaggatgccggcgctcatctcgtgaacctcgagttcatccagctcatgccggcaatcctcaccgagatgggccctgtcatcttcaacgagaagacgttccgctatcttgcgttcgaagacggagcagcttcctcgatatccagaaatctcttcgagctcaggagcacccatggacctgcaacaacacggttgggagatgctgcaatcgatcttgcgatagcggaagcaggcgaaaaaggtgcccctgcacgctatgagaatctgcccgaccccctgcccgagctcgaccgcacctacttctcctggctcgaaaagcgccttggccatcctctcgaccagagcttccgcatcgcgctcttcgcccatgcaagcaatggcggaatcaggatcgaccgcaacggctggaccggcgtccccggactctttgccgcaggagaggcgacaggcggcatgcatggtgcagaccggctcggcggcctttcaagcgcaaactgcatcgtattcggtatcaggaccggagaagcggctgcaaagacagcagaaggcgtctcagcacctcttaaaggcatggctggacttcccagcacatgctctcctctcgccgccaaagcccttccggcaatacgccttgccctcgacagcgcctgtctcgctccccgatgcgagcatgacctcgtggcggcccagagctcccttcacctgatcgatgaggcgattgcgcgcaccgcacttcccacgcaggatgccagagccatcttccagacgctcgaagccaaagccgctcttgccacggcacaggagatgatcgaggccatgaggagaagaagggagagcgccggcagccatatcagatcggatgccgactgaggataggagcatttcgtttcgtcccgcacagcaggcctaaaaaatcttgccaaaaaaagttcttgcacgcacggccgctttcacatatagtatttcccgcacgcgggcttagcgcagttggtagcgcgccaccttgccaaggtggaggccgcgggttcgaatcccgtagcccgctccattgatcatccggccgtcctgcgaatcctcgtatgtcggcctttttcataacggcgagatggccaagtggtaaggcgcgggcctgcaaagcccttacccccggttcgaatccgggtctcgcctccagaaaagctcggggaccgcatctgcggtccccttttttgcagctcttctgatgaattggtgttccttcgttatcattcctcccgctcagcccctctctcaaggtttctgtcggctgcttgtgccacaatgctcgagttggctcaagaatatgaaggaggtatgcgcatgccgcacaagatcggccaggcccgcatcgccgtcctcagagaggcagaagaggattcaggcgtcgtggcaagaaaccttgccggcacgaccggtgtcctcgaagtctgggagtctgaccacaagttccccggaaggcagggcgctgtcttctactatcccctcaccttcgatcatgaaggcaacggctccacggcacgattcttccgcaccgcctacaactaccacttgaccgatgacggcaagaccgccatcttcgacaagggcggcaggagcggcacgaatcgctttgtctttgatatccagggcggcttcaagaacgaggaagcagaagccgaaagggcgcatgctgccgtgcatcccggcgagacatcttccttcgatgtagaaggatccagggaccgctagcacgtgcatctgctccggcgagaaggaagagcttctcgccggagctttctttctagcgccttcttctcttcggcttcatgaggtcgaagagggaaaaggtcgtgcgccgatagatggcgcctctgacagcacgcttcggatcgtgcacgaaccccatgccgcgcttcccgtagaaggggtctagtgcccgcttcatgcggcgcttgtactttcccgtcgtcctcgcggcaagcgacttcttccatgagggacgcctcatgccaaacttcatgggaaaccatctcctcgagccttcagctccctgctccccttttcagcttccgttatacgcctgtccggcgacgcatcccggggtttcttgagcccccgcatccacgctttccccacacattgaagatttcttcttgcgctcccggcgatattcgcgtatattattaacccgcacgcgggcttagcgcagttggtagcgcgccaccttgccaaggtggaggccgcgggttcgaatcccgtagcccgctccattgatcatccggccgtcctgcgaatcctcgtatgtcggcctttttcataacggcgagatggccaagtggtaaggcgcgggcctgcaaagcccttacccccggttcgaatccgggtctcgcctccagaaaagctcggggaccgcatctgcggtcccctttttcatgccgggattgctcatatgcctgaatcttgtaccggagctactgctgtgcgctctccggtgcctggtcgagcatcttcacgagcctcacctgcgtgcccttgcccgacgacttgagagagatcgtgacctcatctgcgagaagccgcatgagcttgatgccacgtccacgctcgagcgtggagccagatgtcgtcttcggctcctcccccgccttcagctggtagcccttgccggtatcggtgatatcgagcgtcacccggtcgggatagcagctcacggtcacgagcgtatagcgcgaatcggtgtggtcgaacgcattgccgagcgcctcgccgcatgcgagcgtcatatcgaacgcctcatcggccgtaagcatcgtattctcgagaagatgttcgacccgctgccttgtctcatgcatgtggtccgcatcggagcagaggacccgtcgccagagcggctcgacacgtgggtcgagctcaggcacctgccgcgtcgtgtcagccggaatcacgggcgcgaaatcgacgacacgcacgcgtctcagcgaccggtaggcaggcttcgagacgttgatgagggaaaggaggcctccggcggcacgcatcttccggatctcgagcagtatcgttgccatgcccgcagaatcgatataggtcgcctttcccatgatcaggatgatgcgcttgcatcccccgtcgatgagggcgtcgaggtcatgccgaagacgcggtgctgtcagcacggtcagatcggattccacaggcagaacgactatgtcagaggtatgctccatgccttttctattcccgaacacgggaattcatacacggagggtggcagaatgcgctggctattctgcagatggcgcagcttcaggcccatcctgcgtcctgagcccgtcgtagcgcacggcgaccattgcgacatcgtcgtcgaggtttctggccgtgaaggcatcaagggtcgccagaagccggtccaggattccatcgaagcccttggggatctgctgcatgatcgcatccttgagcccgtcctcgccgaagaaggctcccacagggttcctggcctcggtcgtgccatccgtatagagcagaaggaagtctccaggatctgctgtggtctctccgtcgatataggtcatgtcctcgaaggcgccgacgacacccgactgcacatcgagcgtctcgagctcgcttctctttgcgcggtagaggattgcaggcggatgccctgcgctgcagtaggagatcttgccgctctcgatatcgatgagccctatgaagagcgtcgcgaacgtctcgatgcgtgagaagccgaggaggaagtcattcaggctcctcaccatgcgagctggtgcgagcccttcccaggcgtaggcgccgagggccgtcttcacagcggctgagaccgaggctgcctcgacgcccttgcccgagacatcgcccatgatgacagcagcgcggcgctggggcagacggatgaggtcgtagaagtcgccgccgacgaaggcatcggccgtggcagacgaatagatgccagaggccgtgaggccttctacctcctggagctcgtttctcatgccgagctgcagggcctgcgagatcctcttgtcctgcatgcggcgggctgtgcctgccatgagctcgcagaagtcgtctgtgcacttgtggatgaacgagagctcgtcggtatcgagcggctctgcatcctgcgggcgcagcaccatgaaggcgaccttctggtccatgaccttgccggcatcgacgaaggcaccgatcgagcactcgccgaggctggaaagccagtcggagagccgagagcccgcatcgatccgtgcaagcgcaacctcgtttccgagcttcgagccgacgatatcctctgcctccatcggaagggcgcgcatgccattgttcggcagatacgcgaccgctgtcgggccatagtcgttctcctcgacccggcagaagatgcagccgatgccttctgccatctggctgaagaaggaaagcccgtcttcaggcgagggctcccccgctgcatagagcttctccctgaggtctgaatggagggcttcgaggcgtgccgcatgctcggtgcgcatctgcgtgaaggcacccatgagctggaccgagaggtagcttgcgactgcatcgaggaggcgtccgtcctccttcgtcgtcggatggagcctctcccagccgacctcgatgacggcgatgacatggccaccgaaccagaccggcacggcgatgaagctggcaaacggcggcacgagctttgccggcagcttgtgcgtctcgtgcgtctcctcatctatgacctcacggcgggacgtgtgtccggccctgagatcggatgtcgtcggtgccaggacacggaggcgcagcgcatgctctgagcgcaggagcgcccgagacatgccgtttctgtaggagaggaagggaggcagcgccgagtctgcaagcgaggcggtatggcccctcagatggaagccatccggctctgcgagatagacgagcgtacccgtcgcttccatcgtctctgcgatctcttcgagcgtccttgagaagagctggctcatatcgtcgttgtcgagggtgtccagaacgattctgagcgtccctgagagccttctgttggcacgggtaaggtcttttaccatccgctcctgttcgcggctctgagcgacgctctcgtccgcgtcatgggcgcagagcacgtaggtatcggatgccgcagacgtcttttcgcacctgacgcggagctcgagcggcatatcgccctcgcgcggcaggctcacaagcaccgaggagccgtcggaaggaaatggcagctgccagaagatgctgttctctccggccttggcaagcgcggagatggcgggacgctcggctgcgccatagggcttcgcgaagagctcctggatctggtgtccgaagagcatcgtctccttcgccccgaagagctggcgtgcctgctcgtttgccatgatgatccggcccatgccatcgaaggcgatgaccgcatcggtcgtaagctccaggacagagcccaaggtctgcggaatcgtggctgctcccagcccgtccaaggaaaccttcttctctgccatggcgctcctctcttctgccttcccccactatacccgagaggccaagatgcacacgcagcttgtggttcctgcctacgaaaaagggagccccgaagggctccctctgcaagttctggtgtcggaggcgggacttgaacccgcacaaccttttagtcagttactagcacctcaagctagcgcgtctgccaattccgccactccgacatgggttagtgcggtagctatattagcacgcactcattcccgactgcaagaacaattttagaaaatggctgagtacctccggcatagttaggctccctgaactgtaaacggcttaggcaagctcgcaggaagcttcggctggaccgtggccgtggctgcgatgccggagagcgggacatgcatgag

SEQ ID NO: 106 - DNA, 12950 bp, Unknown
  Metagenome-assembled genome
gatgagaggcgcagaagtgtggccttgtgcgaaagctccgggaattgaacggtcggctgagatctcatcccaggactcgtcggatctccgtagaacccacatggcctttgcaggcgtcgataggcgaccaccaccgattgcgacgatccagtcaggctggaattcgcgcatcgcacaagcgcccttctcgacggtctcgacggaaggatcggactcgacgccctcgaacagcttcacttcgaagccagcgtcctcgaggtcttctggacatcctgcaggaagccgccacggcgctgctgtggccgccggaaacgatgattgaccttcttgcctctgaggttcttgacctcttggcgagcgccctctccgaagtagacatccacgcggattggtaaaacgacccatcctatccatcctttcgtctgccgcggcagtcagagcagcgggatacatgctgtagacgtccttccctggcgtcccttgcatggacatgcaccgaaaccgattgccaatgctctgccaattcaggttcgtccaatagagccgttatatccaatctattcatctaatccgcgaatggatgctatagctcggcgacgtgacttgacatattgggtcaaacgtttcccgcatacgcttgctgcataaactgcgcccatcccgtgagggacaggcgcatcagctagttcatctgctggagacgattaggcagtgacctgcttcttcgcatccatgaccggggtcttcttgcctcttcaagtgcttgcggcaactcgctccaccgggctcctcgtcggggatggagcctgccttcttggtgaagaactctttgaggcagttgtaggagacgatgacgccgaggacgacgagcaggactgcgaacacaagcggaaccaaggtcagaagcacggaagctcccttcgcggtcgtgccgagcaggccatactggcgattgcggcagggcagcccatgatggactgaacgaggtgaacgtgcagcagagcaggaaatcgagacggactagagcatccagcccttcggccagtgaccttgcagaacacagcgattgtgatcatcgtcatgccgccgaggagctggttggaagcgccgaagagcggccagatgttgaggtagccgccaaaggtaagggacaggccgcagaccaaggtgacgatggttgcgaaccaggggttgccgacaaccttcatgacgccgccttctcgcgctcgacagcgagagcgtctttggacttgcaagaactcctggaaggagaggcgtgcgatacgagcgacagcgtcaaggaggtaagagcaagagcgctcacgcacatcgtcatgaacacgtggagacggtctggttcaggccgcacatggtcatgccctttgcgatgcctgcagcgaagatctggaacggggtggcagcggcagcaccgttgacgcctgcgtgtttcatgtcctatacatgatggcagcgatgacgatggcaatcatgccgacaaaggactcgagccatgcgctctagccgccagggagagcgtcggtctcattggagacctgcttgagaagtgccggtggacacgactgtggaagccggagagtgcgccgcaggcgacggagacgaagaggcccggagagaactggccggaagcgttggtgaagccgacgaaggcaggagcggtcatctcgccctggccgtggcacccatgacgaagatgccgagacagctgcgacgatcatgacgaccacatgatggtgtgaggtagtccgcggctgcttcagggtctggatcggcatggcggctgcgaacacgaggttgccatggttacaagcgatccagccattctcgtcgaggtagagcggaagctgcatgccgacagcgaacatgaggacgcagcacgacacgcgcagacgagttccttccaccgaggtcgaacttgcggcaggcccagccgaagaggatggcacgaaggtgaagagcagggagatggtgcaagcagcaccaccgtagtaggacttgcatagtcgacagcaccgccgtcagccacggtcatcttgaaggtgcctgcaaccatggaggtgaaggcggcgatgacgatgaggcagaagagccagctgaagagcaggaacaggcacggccggtcttgccgatgtactctctcgataggctggcaagcgacttgccgttgttcttcatggaagcatagagagcgccgaatcaggacacgccgaagaatgccaccgacgaggacccaagcatgaccgggacccagccgatgccatgcgacgatggtgcccgtgacagggccagcgccgcagatggaagagaactgatgggcaaaaacggtaaagcgggaagcgggcgagaagttcttgccgtcctccatgcgcactgcaggagtcagagcatccttgtcgacgccccactgattcgctagccgcgtccatatccgaggtagccaatatgaggaccaccgcgctaactaagatgatcgtgataccgttcatgtcttcttacctccttagcttggacgccgcgtagcaggccgttcccgtacttcgacgtgtgtgacgctgtgacatgatttcaaaagcctgttttcagtgctgtgagcgtcttgtttgcctccacacttccagaatttcgcaatgcatgaattttatgcactatatctattatttctctcctatattcatttgtgcaacaattttgcaatcaaatgtacatccggagcttattcatcgcgtaactgacagttcatctttaagcaacatttggaccagatcgctccattttaggcataaaaaagtaccgttcaccgagatacgggctccattcatcccgtattgcctttcctcatgaataccctgaactgtcgaaacggctaccggaggcagccgctcccccgcctccccaaactccgtgccatacggtaccatatattcagggaaccttgacggagggagggatatggcattcgatccgcagcaggaagactatgagcgcatggtcctgcgcttctaccagagcatttcggcagacgaagcaaagagcgcaagccggcgcttcgcctcgttcgggagcgcttcgcgcacaggagggacacccttccccagacggacaccgaccgcgccttccaccttgtctccgaagccgcaatacttatcactcacaccgcctccccttcgcacagagtctgctgcaaactcgctctccagaaagcacagaaggagctcggcgaggcgctcacactcgaccctggcagcaccgatgcgagccgcatgatggagcaccgagctctcctcctatgaaggctacttccgctatcttgcaacacgcagaagcgcttgatgaggcagaccgtgcccgcgcccgccttgtgcgcgacggcgcccccgaagaggagcacagcttgcccagcatcttgcctatgcgccgtaccttcgctggcttgccgcgaggcaggacgtgcgcttgtctgcggccactaccgcttctgccttgaggtcgcaggccgcgcgcttgcgctcgaccctcaggacaggcaggcgtcctcgatacggctgcctacgcctacgcaaagctcgaagacgatgaaggctttgctcattaagcgtcgcatggcagaggggacgtgccgagagcgcctggacacgcatggcagcgctctcgcttgccttctccgcccatgacctcgatcgctcccgcgacatcctgcgcgagatcctcgccagctatcccgaggcaggcgatatcctcgtcgcccagcacgagcttcccgacgcgcgtctatgcccgccttgccgtggagcctggaagcgaagacgagctcatcctcgctttctctgaaagcgatcctctgcaggaggcagggactctgcagagcggggcacgctttccacctgggtctcccaggaagtgccgcgccttgtggcgaggcacccccccgccatatcggggccaaggcccggaagggcggtctccgatgaatgcggcagaagagcttgaggaaagatgcccctcacccgctcgcgcaagcttggcggcctcacgccggcaggcttcaagagctcagcgcgatgtccacgagaacctttccgacttcatagagaccgacgaccagagggccctgaatatcctcaaaggcgcccttgcccgcttaaaacgactccgtgaaggacgacgacctgcgaggcgacgacgagttcatggcagagcgcagaagcgcctctctcccttgtggcagctgcccacaggcacagggagaagatccctcctgcctcatgctgcgcttatcgagacccttgcccgcgacctcgatccgcaccgctctccttgatgcgcttctgcgcttggaggggaccgaggagaagcgctcaggcaagctccagagctcggcacaaaggagacggatctctgggacgaggtctatctgaggccgcgcctgcgcctgcgtgctgccaaccgtgaggacctgcgtcgatacccgcccactaccgcatggcagccccttggccgcgaggcgctcgatgtggcaccgacggacgccctgggcatccgctcagcctggccctggtacgccgcctcgaggacgagcctgcctcaacgagctcgaagccgaggccggacaccatggcaacgcatggtggccacctgcccgtgtgcttctgctcttcaagctcaaccgcatgccggcagccacccgtgccctcaagggctacatgcgtcttgtgcacggcggctcctatgccctgcttcgcccgttctcgtcgagctctgcatccctgacaggcctgccttgcccgaacagcttcgaggaagccatgctcgccgtgcatgaggcagacccgatcgtggccgatacgcccgatttcatcaactggtgcgaagaccagagctggcttgtccaggacgcgatgaagttctgcgatgcggaagcctcgactggaacgccaggtgaattttccgtcgtgggaaatgcgtggagtcccgatttgcagaaagcgcgtgtacgcccgcgtgccctctggtaatcagctcctgccgtcccatcgtctagcggttaggacatcgccctttcaagcgcgacacgagttcgagtctcgttggggcaccatggaatgagagaagcgctctgccggaaggcagggcgctttttctgtgcacgctatttcccagacgctggagcacggtctcggcgattgcctcagacgtgagccctgcgcgcttcctcaggtgcgcctgcgtatctgcctcgagataggcgtcaaggagccgcgactgggacaggccggcgcctcttggccagaggcgccagatattctgccaagtcctccaaagccgccgataacgcgtatgctcctcgacatagacccagatgggcgcccaggaactgctcgcagaacgctgtatcgagcggctttatcgtcgcaagctcgcaagagcgcagagatgccctgcgtgcgagcgtctcctgtggcttctgctgccgcgcgcacccgaggcggcctatgtgcgcataacacgggcacgttcctggagccacatatgccggtgtggattcaggatcggcacaggccgcttctggcagtccagaagagccgagtcgtgctcaatagcgacaggaagcctcctgcgctgcggcctcagacgcacaggagacgctcgccacgcagggcatctcctgcgctgctttgccgagtgcgagataaagccacgccgatacatcgtttctggagcagttcctgggcgcccatctctggggtctctgtcgaggagcatacgcgtatcggcggcttggcagctgcctttttcagaagtctggcgcctctggccaagaggccgccgcttgtcccaggcgcggctccttacgcctatcgcgaggcagataccaggcgcacctgaggaagcgccgcagggctcacgtctgaggcaatcgccgagaccgtgctccacttcgtcgggattagcgtggccacagaaaagcgcactgccttctcggaagagcgcttccgctcattccatggtgcccccaacggatactcgaactcgtgtcgccgccttgaaagggcgatgtccgaaccgctatactatttgggacggcagagtgtattataccataggcaccggcgtacacgctgctttctgcaaatctggactccacgcatttcccccgacggaaaattccctatgcgttccaagtcaggccttcccatcgcagaactcatcgcgtcctggacagcccagctcggtcttcgcaccagttgatgaaatcgggcgtatcggcacgatcgggtctgcctcatgcacgggcgggtgtctgtggcgatggcttcctcgaagctagtttcggggaaaggcaggccggttccagggatgccgatctcgacgagaccgggcgaagccagcataggagccgccgtgcacaagaactcatgtagcccccttgaggcaacgggtggctgccggccggcggtttgagctttgaagagcagaagcacacgggccaggtgccacccatgcgtgccatgggtccgggcccttcggcttcgagctcgtttgaaggcatgctcggcctcgaggcgggcgtattccagggccaggctcgagcggatgcccagggctccgtcctgttgcacatcgagcgccctcgcggccaagagagtctgccatgggcggtagttgggcggtatcgacgcatgtcctcacggtggcatcaacgcaggcgcaggcgcggccctcaatagcatcgtccccaggatccgtccctcctttttgcgagcgccgggactggccttgatcgcttctcctcggtcccctccaagccgaagcggcatcaggagagcttcggattcgaggtcgcgggcagggtctcgataagcgcagcatcgaggcatgagggatcttctccctgtgcctgctggggcagctgccacaagggcatagatggcgcttctttgggctctgccatgaactcgtcgtcgcctcgcaggtcgtcgtccttcacggagtcgttatagcgggcaagggcgcctttgaggatattcagggccctctggtcgtcggtctctatgaagtcggaaaggttctcgtggacatcgcgcctgagctcttcgaagcctgccggcgtgaggccgccaagcttgcgcgagcgggtgagggcgcatctttcctcaagctcttctgccgcattcatcggagaccgcccttccgggccttggccccgatatggcggggacgggtgccctctgccacaaggcgcggcacttcctgggagacccaggtggaaagcgtgccccgctctgcagagtccctgccttcctgcagaaggatcgctccttcagagacagcgaggatgagctcgtcttcgcttccaggctccacggcaaggcgggcatagacgccgtcgggaagctcgtgctgggcgacgaggatatcgcctgcctcgggatagctggcgaggatctcgcgcaggatgtcgcgggagcgatcgaggtcatgggcggagaaggcaagcgagagcgctgccatgcgtgtccaggcgctctcggcacgtcctgcctctgccatgcgacgcttcaatgcagcaaagccttcatcgtcttcgagctttgcgtaggcgtaggcagccgtatcgaggacgcctgcctcgtcctgagggtcgagcgcaagcgcgcggcctgcgacctcaaggcagaagcggtagtggccgcagacaagcgcacgtcctgcctcggcggcaagccagcgaaggtacggcgcataggcaagatgctgggcaagctgctgctcctcttcgggggcgccgtcgcgcacaaggcgggcgcgggcacggtctgcctcatcaagcgccttctgctcgttgtctgcaagatagcggaagtagccttcataggaggagagctcggctgcctccatcatgcggctcgcatcggtgctgccagggtcgagtgtgagcgcctcgccgagctccttctgtgctttctggatgagcgagtttgcagcagactctgctgcgaaggggaggcggtagtcgataagtattgcggcttcggagacaaggtggaaggcgcggtcggtgtccgtctggggaagggtgtccctcctgtgcgcgaagcgctccccgaacgaggcgaagcgccggcttgcgctctttgcttcgtctgccgacatgctctggtagaagcgcaggaccatgcgctcatagtcttcctgctgcggatcgaatgccatatccctccctccgtcaaggttccctgaatatatggtacccgtatggtaccggagtttggggaggcgggggagcgcctgcctccttggtagccgtttcgacacagttcagggtattcatgaggaaaggcaatacgggatgaatggagcccgtatctcggtgaacggtactttttatgcctaaaaatggagcgaatctggtccaaatgttgcttaaagatgaactgtcagttacgcgatgaataagctccggatgtacatttgattgcaaaattgttgcacaaatgaatataggaagataaataatagatatagtgcataaatattcattgcattgcgaaattctggaagtgtggaggcaacaagacgctcacagcactgaaaacaggcttttgaaatcagtgtaatgtccagcgtcaccacacgtcgaagtacgggaacggcctgctacgcggcgtccaagctaaggaggtaagaagacatgaacggtatcacgatcatcttagttagcgcggtggtcctcattattggctacctcggatatggacgctggctagcgaatcagtggggcgtcgacaagaatgctctgactcctgcagtgcgcatggaggacggcaagaacttctcgcccgcttcccgctttaccgtttttgcccatcagttctcttccatctgcggcgctggccctgtcacgggcaccatcgtcgccatggcattcggctgggtcccggtcatgctctgggtcctcgtcggtggcatcttcttcggcgctgtccatgacttcggcgctctctatgcttccatgaagaacaacggcaagtcgcttgcccagctcatcgagaagtacatcggcaagaccggccgtcgcctgttcctgctcttcagctggctcttctgcctcatcgtcatcgccgccttcacctccatggttgcaggcaccttcaagatgaccgtggctgacggcggtgctgtcgactatgccaagtcctactacggtggtgctgctggcaccatctccctgctcttcaccttcgtcgccatcctcttcggctgggcctgccgcaagttcgacctcaagggctggaaggaactcgtctgcgctgtcgtgctgctcgtcctcatgttcgctgtcggcatgcagcttccgctctacctcgacgagaatggctggatcgctgtaaccatggcatacctcgtgttcgcagccgccatgccgatccagaccctgaagcagccgcgtgactacctcaccaccatcatgatggtcgtcatgatcgtcgcagctgtcctcggcatcttcgtcatgggtgccaacggccagggcgagatgaccgctcctgccttcgtcggcttcaccaacgcttccggccagttcctcttcccggtcctcttcgtctccgtcgcctgcggcgcactctccggcttccacagcctcgtgtccaccggcacttcctccaagcaggtctccaatgagaccgacgctctccctgtcggctacggcgccatggtcctcgagtcctttgtcggcatgattgccatcgtcatcgctgccatcatgtataaggacatgaacaccgcaggcgtcaacggtgctgccgctgccaccccgttccagatcttcgctgcaggcatcgcaaagggcatgaccatgtgcggcctgaaccagaccgtctccaccgtgttcatgacgatgtgcgtgagcgctcttgctcttacctcccttgacgctgtcgctcgtatcgcacgcctctccttccaggagttcttcgccaagtccaacgacgctctcgctgtcgagcgcgagaaggccggcgtcatgaaggttgtcggcaacccctggttcgcaaccatcgtcaccttggtctgcggcctgtcccttacctttggcggctacctcaacatctggccgctcttcggcgcttccaaccagctcctcggcggcatgacgatgatcacaatcgctgtgttctgcaaggtcactggccgcaagggctggatgctctatgtccccgtcgtcttcctgctctgctgcacgttcacctcgctcgtccagtccatcatgggctgcactgccgcaatcgccacgtatggcctgctcggcacgaccgcgaagggagcttccgtgcttctgacctctggtctccagcttgtgttcgcagtcctgctcgtcgtcctcggcgtcatcgtctcctacaactgcctcaaagagttcttcaccaagaaggcaggctccatccccgacgaggagcccgagtggagcgagcttggccgcaagcactatgaagaggccaagaagaccccggtcatggatgcgaagaagcaggtcactgcctaatcgtctccagcagatgaactagctgatgcgcctgtccctcacgggatgggcgcattgctttatgcagcaagcgtatgcggaaaacgtttgacccaatatgtcaagtcacgtcgccgagctatagcatccattcgcggattagatgaatagatgtgaatataacggctctatctggatacgaacctgaattggcagagcattggcaatcggtttcggtgcatgtccatgcaagggacgccagggaaggacgtctacagcatgtatccgctgctctgactggcagcggcagacgaaaggatggatagaatgggtcgttttaccaatccgcgtgatgtctacttcggagagggcgctcgccacgaggtcaagaacctcaagggcaagaaggcaatcatcgtttccggcggccacagcatgcgccgtggcggcttcctgcaggatgtccagaaggacctcgaggacgctggcttcgaagtgaagctgttcgagggcgtcgagtccgatccttccgtcgagaccgtcgagaagggcgctgctgcgatgcgcgagttccagcctgactggatcgtcgcaatcggtggtggctcgcctatcgacgctgcaaaggccatgtgggtcttctacgagtatcctgacgagtcctgggatgagatcatcaagccgttcaacttcccggagcttcgccacaaggcacacttctgcgccatctcctcgacgtccggcaccggcaccgaggtcaccgcattctccgtcatcaccaactatcagcagggcatcaagtacccgctcgctgacttcaacatcacgccggatgtcgcaattgtcgaccctgagctcacctacagcatgcctgcaaagctctgcgcacacaccggcatggacgctctgacgcactgcctcgaggcctacgtctcgactgcagcctccatgttcactgatgccaacgctctccacggcatccgtgagatcaccgagtggctgccgaagtcctatacgggcgaccatgaggctcgtgcccatatgcatgaggcacagtgcatcgccggcatcgccttctcctcgggccttctcggcatcgtccactccatggcacacaagaccggtgctgccttcgagggtggccacatcatccacggctgcgcaaatgcaatgtatctcggcaaggccatcgagtggaacgcacgcgattcccgtgctaacgagcgctacgcctacgtcgcaaaggagatcctgcatctcccgggcgagacgaacgatcagctcgtctccaacctcgttcagtacatccgtggcatgaacgacaagctgaacatcccgcagtccatcaacaactatgctgtgggcggcatcaaggccgacgacaacaaccagccggtcatggtctccgagaaggagttcctcgagaagctcccgaaggtcgctgcaaatgccgctctcgacgcctgcacgccggagaacccgcgcgagacgaagcctgaggacttcgagaagatcctgaagtgctgctactacgacgagccggtcaacttctagtaccgcttggcatagaaagccagaagggagcccctcggggctcccttttttcatcatggctttagcctgtgtcgcacgtagtgcggcacaaaaatccacccgctcagcgggtggatggcactgatgctacgcaacaaaactccctcccctctaggacggtgattgttcaggtcgccggccgcgagaggaaggagaacaccatggcacagaaggcgaacagccttgcgcacaccaaatggatgtgcaagtaccacatcgtgttttgcccaaagtatagaagaaaggccatctacaaccaataccgcgaggacctcgggcagatcctcaggcagctatgccaatggaagggggtcgagataatagaggggcacctgatgccagaccacgtgcacatgctggtgagcatcccgcccaagatcagcgtatcgagctttatgggatacctgaaggggaagagctctctcctcatgttcgacaagcatgccaacctgaaatacaagttcgggaacaggaagttctgggcggaaggctactacgtgtccactgtcggcctgaacgaggccacgatcgcgaagtacatccgggagcaggagcaggcggacatcgccctggatcggctgagcgtcaaggaatatgaggatccgttcaagaaatagcctggaggagcccgtttgacgggcacgccacgagtcaagcggccatcgggcctgaacgaagtgaaggccagggacttgagtccctggccggttatttagggttaaatggctgagtacctccggcatagttaggctccctgaactgtaaacggcttaggcaagctcgcaggaagcttcggctggaccgtggccgtggctgc

SEQ ID NO: 107 - DNA, 20119 bp, Unknown
  Metagenome-assembled genome
aagaaggcgcctgccaagaaggaggcaccgaagaaagcttctgccaaggcagctcccgccgagaaggcggcggagcctcaaaccccagcaactccgaagaagcggacaacccgctcttcgaagcgatagttgaataggaggcctctcggggccccaagatggaaggtacgtatgtcagtacagccacagcttttcaaggacaagaacgacttcaaggagcagttggaggccatgtgcctctccgagcgctccaagaccttcgaagagtgcacggacagggagcgcttcctgtgcctcgcacgtctcattgcccagaaggcacgccgcatcgaggtcgagtgccacccgaaggacgagaagcaggtctactacttctccctcgagttcctgctcggtccccttctggacaactacctcctgaacttcggcatccgcgacttcgtcgaggagtgcctcaaggacatgggttcagaccttgagaccctctgcgccaaggaagccgacccgggtctcggcaacggcggtctcggccgtcttgcggcctgcttcctcgactccatggcagctctcggcatcgccggcaacggcaatggcatgcgctaccgctatggcctcttccgccaggagatcgagggcggacgtcaggtcgagaagacggacaactggctccgctatggcttcccgtgggagatccgcaagctcgagagcaccgtcacagtgcgcttcggcggcgaggtcgtgcgccacgagggcgaggctggcagctactggttcacctgggaaggcggcgagaaggtagacgccgttccgtacgatgtgcctatcgtcggcttcggcggcacctgcgtgaacaagctccgcatctggggcgcaaagccgcatacgcctgacttcgatctcgatgccttcaatgctggcgactatgccaaggcattcaagttccgctccgatgtcgaggccatctccacgatcctctacccgaacgatgcgggcgagcatggacgtcttctgcgcctcaagcaggagtacctcttcgtctctgcaggcctgcagtcgatccttcacacctatgagcgcaacttcggccccgatgcctgggaagacctcccgaagcatgtctgcatccacacgaacgatacgcacccggcgctctgcggccccgagctcatgcgcatcctcgtcgatgagaagggccttgactgggatacggcctggaagaccgtgacggcgactgtctcctacacgaaccacacgatcatgccggaagccctagagaagtggccgattccgatgctccgcgcccagcttccgcgcacctacatgttcatcgacgagatcgaccgccgctaccgcgagtccttcccgcatgatgcggagaactggatggaccagctccagaagactgcaatcctctgggatggccagtgccgcatggcaaacctctccgtcatctgctcgcactccgtgaacggcgtctctgccctccatacggacatcctcgagaagtcgacgctcaaggacttctacgacctcacgccggagaagttcaacaacaagacgaacggcgtctcgcatcgccgcttcctcgcagaggccaaccctgcctatgcaaagctcatcaccaatgcaatcggcgatggctggctcaaggatgcctatgagctcgagaagctcatcccgtatgagaaggacgagtcgttcctgaaggatgtccatgctgccaagcagacggagaaggagcgtcttgcccgctacatcaaggacacgacgggcgtcgagctcgatccgaccacgatcttcgatgtccaggtcaagcgcttccatgcctacaagcgccagctcctgaacgtcttcaagatcctcgacatctacaaccgtctcctcgcagatccttccttcaagccgcagccgacgtccttcatcttctccggcaaggctgcccagagctatgacttcgcaaaggaagtcatccgcctcatcaactccgtcgccgacgtgatcaacaacgacgaccgtgtgaaccagacgatcaaggtcgccttcgtcccgaacttcgctgtctcgaatgcccagctcatctatccggcatccgatatctccgagcagatctccacggcaggcaccgaggcctccggcacgtcgaacatgaagctcatgtacaacggagccctgaccctcggcacctacgacggcgcaaacgtcgagatctgcaagctcgtgggcgacgagaacatcaagatcttcggccttcggaccgaagaggtcgacgagctcaaggcatccggccgctactacgcctgggatgagtacaatgccgatcgcgaccgccttggacgtgtcgtggacgagcttgcggatggcacgttctcgcgcctttccggcaacttcgagagcatccatgactacctcatggtcaacaacgatccggaccttgtgttcaaggacttccgtgcttacgttcaggcatgggaagagctcacgaacgactatcctgacacgatcaagtggaaccgcgcggcgcttcacaacaccgctaaggccggatacttctcttccgaccgaacaatccgcgagtatgcccgcgatatatggcatatagataagtaaatcctttgcttatccggaagctgaaaggggagaatcggtatgagcaagaaagagtgcctcgcaatgctgcttgcaggcggacagggcagcaggctcaaggcgctgacgagcgaggtggcgaagcctgccgtctcgtttggcggcaagttccgcatcatcgacttcgcgctgtccaactgcgcgaactcgggcatcacgactgtcggcgtcctgacccagtaccgtccgtatctgctccattcctacatcggctcgggcgaggcgtggaacctcgacgagcgttcgggcggtgtctccatccttccgccgttcgagacgcagtctggcggtgcctggtatgagggcacggccgacgccgtgacgcagaaccttggctacatcgagcagaacgatcctgattatgtgctgatcctttcgggcgaccagctctaccgcatggactacaacgacatgctcgagaaccacaagcgccacaacgccgatctgaccatcgccgtcatgccggtcccctgggaggaagcgccgcgcttcggcatcctcaccacggacgacgacgagcgcattctcaagttcaccgagaagcctgcgcatcccgattcgaacctcgcttccatgggcatctatatcttcaacgccgaccttctggtcgagacgctgaaggaggacgccaaggacccgaactccgagcatgacttcggcaagaacatcatcccgaagctgcttgatgctggcaagcgcctctacacgtaccgcttcgagggcttctggcgcgatgtcggtaccatcgcctcttaccacgagacgaacatggagctcctgggctccaagccggcgttcgacctctacgaccaggaatccccgatcatgagcaacaccgtgccgatgccgccgcactatgtcggccctgacgcctccatcgatgactgcctcgtcgacaatggctgcaggattctgggccaggtcaggcattcggtcatttccgccggtgtctatgtcggcccccacaccatcgtcgaggattccgtgcttctgccgggtgcccgtgtgatggaaggctgccgcgtcgtcaatgccatcctcggcgagcgcgctgtcgtcgagaagaatgtcgactttggcagcaaggatgcggatacggcagtggcaggcaatgacgccgtgattacgaagggagaggagtagccgtggcaaaggtcgtaggactcatcaccaccaattattccacgcaccatccaagccagttcgtcgaaggcgtgcgcccggtcgcggcaacgccggttctcggccgctaccgcatgatcgacttcacgctctccaatatggtcaatgcaggccttagcaccatcggtctcatcatgccggacaactaccgtccggtcatcgatcatgtcggcgccggcaaggactggggtcttgaccgcaagaacggcggcctcttcccgcttccgggatcctcgttcggcatgagccgcgtcggcggccgcttcctcatccgcgacttcgaggcgaaccgcgacttcctgcgccgctcgaagtccgactatgtgatcgtctccggctgcaacttcctctacacgaccgatctcaagaagatcgtcgatgcccacatcgcgtccggcgacgatatcaccgtcgtcacctaccgtgcgaatgaggactccgaggacgtcaatgctgtcgtgaaggacgacaagggcgcattcgccggcatcaagacaggctctgccttcggcgacgccgccttcatggacctcttcgttatcggcacgcagaagctcgaagagctcctgggctggtatcgcgatgtcgaccacctcgatctcttcgatgccctcaaggaggatctcgacgaggtccgcgtcggcacctatgactacgagggctatgtggcgccgatcttctcgaaggaggcctacttcaagcgctcgatggagctcctcgatccggcgcttcaggagcagctcttcacgaacgacctgccggtcatgacaaaggctcacgacacgacgcctgccaagtacgagccgggcgcacatgtggcgaactcgctcgtctcctccggcacgaagatctacggcacggtgaagaactccatcatcggccgtgcctgcgtgatcgagccgggtgccaccgtcacgaacgcgattctcgtccgttcggtcacggtcaaggccggcgcccacatcgagaacgcgatcatcgaccgcaacaatgagattgctgctggcacggtccttcgtggcacgtccgacgcagtgctggtccttcccaagggcaacgactagcgccgagaaagcgggagcatccatggctgtcagaagaaagctcaacatcctcttcgccgcgtccgaggttgtgccgttcgtgaagacgggcggcctggccgacgtcgcaggatcgctcccgcgtgcactcaagcacgcaggagcccatgtcgccgtcatccttccgaagtactcgaagatctctgatgggtacaaggcgcagatgcagcacatctgcgagttctacgtgccgctctcctggcgcaatgtctggtgcggcatcgacaagctcacgctcaatgacctcgacttctacttcgtggacaacgaggcctacttcaagcgtgatgggatctacggctactacgacgatggagagcgcttcgccttcttctcgaaggccatcctggaatgcctccagcatgtgccggagctcggcgacatcgacgtgctgcactgcaatgactggcagtgcgccctggcgcctgtgttcctgcgcgagttctaccgggacatccccctctacgacaacatcaagacggtcttcaccgtccataatgcgaagttccaggggcagttctcggacaagatgctgaacgacgtcctgggcctggcaggcatccctgccgcacgcgaccagctggccgcaggcccaggaggcatcaactacatgaagggcgccctctgctattcggatgccctcaccacggtctcgccgacctacgccgacgagctccagatgccgttctacggcgagaacctcgacggtatcttccgccgccgccagaacgtgctctcgggcatcctcaacggcatcgatgtgaatgcctggaacccgaagacagaccccgagattgcggctgcctactccgaggaagacatgtccggcaaggctgcctgcaagaaggcgctccaggaggagctgggtcttgctgtcgaccccgacaagcctcttgtcgctatggtcggccgcctcacggagcagaagggcatcggccttgtccgctatgcgatggactacctcatgagccgcggcatccagatggccgtgctcggcaccggcgacaaggacctcgaagatgccttcaaatacttcgactggaagtacaacgaccagcttgctgcctgcatcacgttcgactctgcgctgtcgcaccgcatgtacgcgggtgcggatctcttcctcatgccgtcagagttcgagccctgcggcctttcccagatgattgccatgcgctatggcacgcttccggtcgtgcgagagacgggcggcctcaaggataccgtcatcccctacaaccgcttcacgggcgagggaacgggcttcagcttcgcgaacatcaatgccgacgagatgaccaatgcgcttctcacgggctgcgaagtgtactggacggacaaggacgtgtgggcacagctccagcgtcaggcaatgtcgcaagatttcagctggaagagggcagcgaacgactacctggacctgtatcatagtcttcaccctgaggtccagcgctacaacaagcgtcgcgattaggcagggtagagagacaggttaccttgcgcgcattgcatataagttcggatccgacgtatcggagtccttttggtgccgccccttgtggcggcactgtcgtgctcagcctcgatgtctgggacgactttggtgcctcagccgatatccgcacctgggtggatggcaaaggcgagtacatctatcacatggaccgcgaggaggcaggagaccacctgcacttcaccggctccttcgaggtgccggaccccgagatcctgtggtactacttcaaggtctatggctccgatggctccgtctgctggtatggcacgaaggacggcgccacgtcgggcgaaggcgagcttgtgtggtatgagccttcgagctggcagatctctgtctacctcacgaggaagacgcttcctctgtggtacacgaaaggcatcgtctaccagatcttcccggaccgcttcgcacgcggcgccgactggcgcgagcgtgtcgatgcggcactctcggtcaagaggaatggccctggacgccgccttgtcgaggactggaacaccgagccccgctaccagaaggatgcctcaggcgatatcgtggcctgggacttctacggcggcacgctttccggcatcgcagagaagctcgactatctcgaggcgctcggcgtcactgtgctctatctgaatccgatcttcgaggctgcctcgaaccaccgctatgacacggccgactacatgaaggtcgacccgatgctcggcgacacggaggccttccgggagctctgccgcgctgcggaggcgcatggcatggcaataatgctcgacggcgtcttcaaccatacgggctgcgattcgcgctacttcaacaagtacggcaactatcccgaggttggcgccttccagagcaaggactctccgtaccgctcctggtacgagatcgacgactcgggcgagtatgcctcctggtggggcgtgggcgacctgcctgacgtccgcgaagaggacccgggctaccacgagttcatctgcggcaaggacggcgtcgtccgccattggctgcgccttggtgcccgtggctggaggctcgatgtggcagatgagcttcccgaagatttcatccgtgatatctcgagcgccgcacgtaccgagcgtgccgatgccgctgtcatcggcgaggtctgggaagatgcctcgaacaaggttgcctacggcgagccgaggcactaccttctgggcggcgagctcgactctgcgatgaactatcccttcaggggagccgtgctcgacttcctcctgaacaaggtcgatgcctacgagacggcagcacgcttcgagcagctctatgagaactatccgcacgatgcgttctattcggccctgaaccttctgggctcccatgacaggagccgcatcctcacgcttctgggcggcgctcccgacccggatacgatggacgacaaccagcgtgccgcctacaggctctcccgcgaccagatgggcttggccaaaggcaggctctgggatgcagcgctcctgcagatgaccatgccgggcgtaccctccatctactacggcgacgaggcaggcctccagggcatgacagacccgtacaacagggcgcctttcccgtgggggcatgaggacaaggactgcttcaacatctaccgcaatgcgattgctatcaggaagtccctgccggtgattgtggacggcgacttccatccgtttgccgtgaaccaggatgtcttcggcttcacgcgttccgcaggtgatgagtctgtcatggtcctcgtgaatggcggcctttcccagcgccatgagttcgaggtgccgatgcggggcgaggccgtggacgatatcgtgtcgggccaggacctcgaggtgcatgacggaaaggtccatgtcggcctctggcctctgggaacggcggtcctctacttccacaaggcacagatgctcgaccgtccgctcgagccgggcatgggcatcctctgccatatcacgtcgcttccgaatggcggccgtcctggcaccatgggcaagcctgcccgtgacttcatcgactacctggctgcaggcggccagcgctactggcagatcctgcccgtgaacccctgcgaccgccatggcagcccgtacgccggcctttctgcctttgccggcaatactgccctcatcgaaggcacgaaggaagacctcgagaagaaggctgccgccatcaaggattcagaccctgccttcaaggcattctgcaggaaggaagaggcctggcttcttccctatgccaccttccgtgccatcaagcacttcgagggcgagcgtgcctggcagacgtggccagccaagtacaagaagtactcggacaagcttctgcatgatccttcgcttgcgaaggagatctcctaccacgagaagcggcagttcatctttgcccagggctggtctgagctcaaggagtacgcgcactcgaagggcatctcgcttgtcggcgacatgccgatgtatgtctctgccggctcctccgatgtctggagccaccccgatctcttctcgatcgacaaggacggcaacgcaacctcgattgcaggctgcccgcccgatcagttcagcgaggatggccaggtctggggcaacccgacctaccagtggaagcgcatggcagagaccggctacgagtggtggatgcagcgctttgcacgtgcgtgcgagctctatgactatgtgaggctcgaccacttcctcggcttctcgtcctacttctctatcccggcaggacattccgccaaggatggcatgtggcgcttcgggccgggacgtgcgctcttcgagcaggcggaaaagaagctcggacccctgcccttcattgcagaggatctgggctccatcacgccggccgtgcatgccctctccgcttcatgcggcttcccgggactcgacgtcgtgcagttctccgaccaggatgtgcgccagtcgtatgtgccgatccaccacaaggtggcctgctcgggcacgcacgacacgcagacgctccttggctgggccaagagccgcttcggcgaggaaggcacgccggagtttgcagaaaggctcctggaacgggtgctggcaacggatgcgaaggtcgctatcgtgccgctccaggatgtgctcggcctggacgacacggcacgcatgaacgtgccgggcaaggctgacggcaactggtgctggcaggcagatgccgaggatatcaaggcatcgcttccgcacttgaaagagcttgcagagaagagcggcagggctgccaagtagcagatatgtgagctgaaaaacagcgattttgcggcgggagcctctctcgatgagggaggctcccgccctctgctatcgtgggacttccagatatgaatctgccggattgtgccggcagaagagatatgaggtcttgcatctatgttcataaaccgtgtgggcgcccgtctcctttcggcgcccgagatggcagaagccctgcatgagtaccatgaaggacacgacctgacgctcgcggtcgcccagagcgcacgcccgcttgtgctggcagcgctctgggcagagcatccccgtccgtgccttctggtcgtggcaggcgaggaggcggcagacaggaccgcgcgtacccttgctgtctggctcggcatgccatcggtctcacgctatccggcaagaaaggactatccctggtccgatgcaggctacgacgatgctgtcgtcggcgcccgctgccatgcgatagcacgccttgcggcaggggagccctgcatcgtcgtggcatctgctgccgcgctcctgcgccgcgtgccgcccaagggctctggctacttcgcgccgagcacgttttcgtgtggcgatgaggtgcccttcgaggatgtccctgcccttcttgtcggcatgggctatagccccaagggcgcagcggatgcaccgggtgccttctgggtgcatggagacgcggtcgatgtgttccccgcacaggccacaagcccggtgaggatcgagttcttcggcgacgagatcgaccggatccgccgcatggtgccttcgaccggccagacgatcggcgagcttgagagcgtgacggtggggccctgccgcgagatggcgctctctcctgagggcatcatccgtgccaagaaggccctcttcaagccggcacaggagagcacgaagatcgctgaggacctggagcttatcggccagggcgcagatgcgccgcatctcgagaagtatctgccggtgctctacggcagcacggcatcgcccttggagcacatctcgtctgagaccctcgtcgtgcttgcagagccgagggcgctcttcgatgactgccagcgtgcgacagatgacatctcatctgcagcgcagaatgcgcgcgagaagacggaaggtctctataccgacccgaagaagctcgatttcgggcggcagcagcgcctctcgtttgcaagcatcatgcgccaggggacgcgtgtgacggcagagctcaaggtgaggcagccgaatatcgcaggttccgatacgaagcttctgggaagcgtccgccagatgatctctgaccgcatggccgtgatcttcgctgtgccggacagaggtgcccgcgaggccttggagcttaccttcaacgacgaggccatcccctttgtcgagtctctgggctcgtcccccgagaacaggatcccggtagacgatcctgaggcggaaaagagcatcgtgcccctcgagaaggggaaggtcacgttcttcgatgcaccggtccctgctggcatcatcgtgccgacggcaggcctgggcgtcctttcggtgtcagatctcacggctcgcatggcaaagcatgcgaagcgggtcaagaagatcgatcccacctcggtcacgttcccgttcaagccgggagactatgtcgtgcacgcaacgcacggcatcgccctcttctcccagatcgtgcgccaggaagtggcaggacgccagcgtgactacttcctcctcgaatatgcaggcggcgacaagctctacgtgccgcttgagcaggtggacaggatcacccgctatatcggcccggatggtgcggctccgcgcctcacgcgcctcaacacggcagactggtcgcgtgcgaccggcaaggcccggaagagcgcaaagaagcttgccttcgaccttgtggacctctatacgaggcgcgcaagcgtcgcgggctatgccttcccgccggatacccctgagcaggaggagatggaggcaagcttcccctatcctctgacgcctgaccagaagtctgcgattgcagacatcaaggccgatatggagtcgccgaagcctatggacaggctcctctgcggcgatgtgggcttcggcaagaccgaggtggccctgcgtgcggccttcaagtgctgctgctcctcccgccaggtcatggtgctctgccccacgacgatcctcgccgagcagcactaccagacgttctatgagcggttcacgcccttcggcctcaacgtccaggtgctctcccgcttcgtcacgccggccaggcagaagaaggtcttgaagggctttgctgagggcacggtcgatgtcctcatcggcacgcaccgcctgctctcgaacgatgtgaacccccacgaccttggccttgtcatcatcgacgaggagcagcgcttcggcgtccagcacaaggagcagctcaagaacatgcgcgagcaggtcgatgtgctgaccctttctgctacgccgattccgcgcacgatgcagatggccgtaagcggcgtccgcgacatgtcgctcatcatgacagcacctccgggaaggctgcccgtgaaggtgacggtgggcgagtgggatccggatgtcgtgagcgccgccatccgcttagagcttgcccgcaagggacaggtctactacgtgagcaatcgcgtcaagacgatcgacgatgcggtcatgcgcgtccaggaggcagcgcccgaagcaagaatcggcgtcgcgcatggcaagatgagcccgcgcgaggtcgaggacatgatgatgaagttccaggagcatgagatcgatgtgctcgtggcaacgacgatcatcgagtccggcatcgacaacccccatacgaataccttgatcatcgaggactctcagcgcctgggtctggcccagctctaccagctcaagggccgcgtcggacgtggccgcatccaggcctatgcctacttcatgttcccgggagagcagccgctcacgcctgaggcaacggaccgtcttaccgctatcaatgagtaccaggacctcggatccggcatgcgcatcgcaatgcgcgacctcgagatcagaggcgccggctcgcttgtgggagcagagcagcatggcaacctctcgagcgtcggcttcgacctcttcacgcagatgctcggcgaggcggtaagcgaagccaggggcgagatggcgcagacagagcagcccgaggtcacgatcaacctctcggcagacttctatctcgcagaggagtacctgcctgaggtggacaagcgcgttcttgtctaccgccagcttgcctctgcctcagagctctctgatgtggaccgcattcagaaggactgcgaggagcgctatggggcgctgccgcttgcgggcaggaacctcttcgacagggcccgtatccgcatccgctgccagcgcatgggcatcacctcggtctccctcatccagggacgcttcgtctatcagggcatcgaggtgccgaggaagcttgcgctcaagttcaaggagcgccacgccttctactatccgaagacgaagcagctcaagtatcccttccacaagggggcagaggagatcgtgcctgctgcgctcggcgtcctcgaagaggtcggcggggacgacgaggaagacgaataggtgcacagcagatggcgcaggggcagaagagatctgtccctgcgcctttctgaattgaagccgcgtttgcctcagcctgctgatgcggctcttttggcatctgtacagggcttgccatggtggatcttgcctgcatgccctgaccaggtgccttcctcatatcttctgccatcgcatgaagaaggccgtctacgagctctgtcccgttgcacgcagtcccccagcaggccttcttctccgtctccgggctgcccggctgttttgctgatgccatgtcgggcatggattctccttgccttctgcaatcattctggctcttggttcggactccagccggagaaatgggccgatgtggcctcgtggccggaccattgccagcagtgcccagtaatggaaactgtgcacaggccaggatggcaggcgccgtggcatggtataaaagagacagaagggctggctggtccttctgtcttcttcaggctgtatctatacttcaaacgaaacaggcagctatgggtctcgatggggaaacgcacgcaatgagaatgcctagatctttcggcaggagcacgggcgatgccggcaagaccgggtcgcttccgcgtcttcgggtacacgagacgggaaacaccagccaggccagctggcgtcctgctgtctttgtcggtccgaactcgcgtggcgtgaggctctcaggcgacggcgatgcgttcaggaaagtcggcaatgaccggctgcataggcgtacctctcgcagcgctgcatatgctgtcccggcccaggcacctgtccagacaacgcaggcagcagatcctcagaatctcacggtccaggagcgccaggaagcacgcaggcgcagaagagagggcatctcttctcctgctgcagatgcggagcgcggccgtggctccgacaagccgatgagcatcctcggctcccacaagggcctcgtgatccttgcggtcatagctgctgtcatcctttccctctatggtcccatccgcagctggtatgtggctcagaggaggacccaggacctccaggcacagtatgcgcagctgaactctgccaactcggtcctccagggcgaggtgagctcgctccagacgcaggaaggcatcgaggacgaggccagaaagcatggctacgtcgaagagggcgagacgccggtcacgatcacgggcgaaggctccgaagtggccgaggactcttccgatggctctgattccacctcggatacgatctctggcacgagcacagcgacggccgatacagacgacctcacgaagttcctggatgggtttttccagtacaagttcgaggagtagtcatggcgaggattgcagtcatcgatatcggcacgatcacggctcgtcttgcggtctccgaaaaggagcaggggagcgcgctcacccagctcaagaagatctcgacgatctgcagcatgggcgaaggcacggcagagacaggaaggctctcctctgccgctatcgagcgtgtgctcgcctgcgtcaggggctatgtggatgaagcccgtgccatgggagcatctgcctgcgcctgcacgcttacgagcgccgcgcgcgatgccgaaaactcatcggagcttctggagcctctggccaagctcggccttgttccttctgtcattccgggcacgactgaaggctctctggcccttctgggcgtcgcccaggactttccggacgaagaggtgcttgtcgcagattctggcggcggctcgacggagctgagccagggaaagctggcagatggacgcctgcgtgtcgaccatgtgcgctcggtcaatgtgggcgcacgccgcctcacggacctcttcctgaagaagcaggacccgcctgcggcagctgatatcgaggcggcacgtgccttctgcgatggccccttcgaggaggcggtggcagagctcgatgagcttcctgaggcagctgcccgtctcgtgcttgtcggaggcacggcgacctcgcttgtcgcaatggatgcagagctcgacccttacgattctgcctacgtgcatctgcacgagctcgagcgcacggcagtcgagcgcctggctgcacggctcgcgagcctcacggtcgaggagagggcacatatgaagggccttcaggccaagcgagcgcctgtcatcctcggcggcacccttgccatctctgaggccatgaagtgcaccgggttcgacgtggcgaccgtaagcgagcacgacctcctctcgggcctctcgcttgccatggcagcagcctggctcggcgaggaagcgccgcttccctggacgcctgcgctttcgacgctctgatcttgtcctcaatgcgctactcttgaaggatacttgggggcgtggcgaaattggcagacgcagcagacttaaaatctgccgccgcaaggcttgcgggttcgagccccgccgcccctaccagaactatcttggccggaacatagcgctccggcctttttcgtagtgcggcgcacttccagcagggcatcgtccctcacagagatattgcggactctgccgttgtcagatgatggacttcccctgtgcactatgatgggctacgctcagttgtccataacctgtcctgtcttctagttgtccttcaggaaagcagggcccacgaggaagtgtccacccatggcagagatagcagagaagcgtgcacagaggagctttccggtgccgcagcttgttgcgcgtgaggccgagaagacgtctggcgcggatgctgcccctcgtccagaggcagcagtccctctgagggaggcaggcacagggcagctcctgcacgagctgctggcaaagctgctgcgtggccgcatcatctcaggcgagtggccggcaggttcgagaatcatgagcgagcatgccctgatggagcgctacggcgtctcccgcggcaccgtccgccgtgccatcggcatgcttgtggatgaaggcctcctggtccagcgcaagggcaaggggacgttcgtgacccgctccggcgtggcacatccgggaggcgcgcgtccgctctcgtttgcccatgccctgaaggagcagggacttgccttcaagacccaggtgctcgcaaaggaagcgctgccggcacctgccgaggtcgcacaggagctgggactcgagacgggagagcctgtcctcttcatgcgccgggtccgcacggtcgaaggccgagccatcgtctgccaggaatcatgggagaaccttggtgcctgcccggggctggctgattccgacttcacgaaggagtcgctcttcgacgctgtcgagcgctgctcgggccatgagatcgccctctcgaacatgaggagctcggcgacctgcgctggcaaggagcatggaggatacctggcgcttcctgccgaggcaccggtgcttctgctcgagcagacgatcagcctcgacaaccatgtcccgatcgagtggagcctgacctggctgcgctcagaccagagcctcatgggtgtggcgctgcaggatgagatgaagcgtcctcaagcccttgcggcctctccgcgcgatgcagagatgctcccgaagcaggagcgccgccgtctcgaccttctggcctgcgatatccgcgagggcgtcatcaaaacggctgagcgctatccggacatgcccttccatatcggaggcgcgttctcggcggcagagatctacgccgtcctctttggtgccgtcctgcatactggcaaggacggcacgccctgggaggagcgcgaccgcttcgtgctctcgaaggcacatgctgccgtcggcctttacccggcacttctcaaggctggcctcatctctcaggaagatatggacaaggggctcttcgggccggatgcggtgctcttcaagcaccccaagcgcgaccccgcgcgtggcctcgagacctcgggagggtctctcggcatgggcctcggctatgcggcaggcctggcgctggcgttgagacgcaagaagctctcctcgcgcgtcttctgcctcgtgggcgacggcgagtgcaatgagggaagcacgtgggaggcagcggcctttgccggccacaacagtctttcccatctcacggtgattgtcgatgcgaatggcatgcagctcgacggaccgaccgcagagatcctcgatacagcacctcttgcgcagaaatttgctgccttcgggttcgagaccgtggaagtggacggccacgacgtcggtgcgctctggcaggcgctctcgtctgcccacgatgccccccgtgccatcattgcccacaccgtgaagggcaagggcctctcattcgcggcgggtgtggcggcctggcatgaccatgggctcgacagagagctctgggataaagctgaagtggagcttgcagcagcgagggaggcagcagcccatgagtgagatgcgtcatatggatgccggagtggcacgtgcactcgatgcaaaggattccaaggaggtcttcggcgtgacgatggcacggctcgcagatgcctatccgctgctctccgtcgttgtctccgactatggccggaggctttcgctcgacgatctcaaggcacgtcatcccgatgccttcgtgcagtgcggcatcgcagagcagaaccagattgaggtggccgcagcccttgcaaatgagggaggccctgtctttgctgtctcctacgcgcccttcatcacggcacgcgtgctcgaccagatccgtgtgaacctcggcatgatggaaagccccgtaatcttggtgggcctgggagcgggctacgctgtaggggagctcggtgcgagccatatggggctcgaggacattgcagacatgcgtgcgattccgaacctcacggtcgtatctccgagggacaacgccgagctggcacttgccctggaggagcttgcagcgcacccgaggccggcctatgtgcgcataacaacgggcacgttcctggagcccacagatgccggtgtggacttcaggatcggcacaggcacgcttctggcaggtccagaagatgccgaggtcgtgctcatagcgacaggaagcctctgcgctgcggcagcagacgcacaggagacgctcgccacgcagggcatctcctgcgctcttgccgagcttgcgacgataaagccgctcgatacagcgtttctggagcagttcctgggcgcccatctctgggtctctgtcgaggagcatacgcgtatcggcggctttggcagcgccttggcagaatatctggcgcctctggccaagaggccgccgcttgtcccagtcgcggctcctgacgcctatctcgaggcagatacgcaggcgcacctgaggaagcgcgcagggctcacgtctgaggcaatcgccgagaccgtgctccagcgtctcgggaaatagcgtggcacagaaaaagcgccctgccttccggcagagcgcttctctcattccatggtgcccccaacgagactcgaactcgtgtcgccgccttgaaagggcgatgtcctaaccgctagacgatggggacggcaggagctgattataccagagggcacgcgggcgtacacgctgctttctgcaaaatcgggactccacgcatttcccacgacggaaaattcacctaggcgttccagtcgaggccttccgcatcgcagaacttcatcgcgtcctggacaagccagctctggtcttcgcaccagttgatgaaatcgggcgtatcggccacgatcgggtctgcctcatgcacggcgagcatggcttcctcgaagctgttcggggcataggcaggcctgtcagggatgcagagctcgacgaagaccgggcgaagcagggcataggagccgccgtgcacaagacgcatgtagcccttgagggcacgggtggctgccggcatgcggttgagcttgaagagcagaagcacacgggcaaggtgccaccatgcgttgccatggtgtccggcctcggcttcgagctcgttgaaggcaggctcgtcctcgaggcgggcgtaggccagggccaggctcgagcggatgcccagggcgtccgtcggtgccacatcgagcgcctcgcggccaagagaggctgccatgcggtagtgggcggtatcgacgcaggtcctcacggtggcagcacgcaggcgcaggcgcggcctcagatagacatcgtcccagagatccgtctcctttgtgccgagctcctggagcttgcctgagcgcttctcctcggtcccctccaagcgcagaagcgcatcaaggagagcttcgggatcgaggtcgcgggcaagggtctcgataagcgcagcatcgaggcaggagggatcttctccctgtgcctgctgggcagctgccacaagggcagagaggcgcttcttgcgctctgccatgaactcgtcgtcgcctcgcaggtcgtcgtccttcacggagtcgttatagcgggcaagggcgcctttgaggatattcagggccctctggtcgtcggtctctatgaagtcggaaaggttctcgtggacatcgcgcctgagctcgctaatccccgaggcaggcgatatcctcgtcgcccacacgagcttcccgacggcgtctatgcccgccttgccgtggagcctggaagcgaagacgactcatcctcgctgtctctgaagagcgatccttctgcaggaagcagggactcgcagagcgggcacgctttccacctgggtctcccaggaagtgcccgccttgtggcagagggcacccgtccccgccatatcgggccaaggcccggaaggggggtctccgatgaatgcggcagaagagcttgaggaaagatgcgccctcacccgctcgcgcaagcttggcggcctcacgccggcaggcttcgaagagctca

SEQ ID NO: 108 - DNA, 4769 bp, Unknown
  Metagenome-assembled genome
tgttcgtccgttcttgttctttaaaattttctaacagtctagataccgggtgatagtatacctacgtcgagctgcggaggcttgcatcgaccatcaccatatggcgaaccacccttgcagcttcaggtcacctatcgcgggcttggttgacctggaagaggtagacctaccagttgaggtagcttttgcatgttgaccgtggatatgcctgtgaggtgccagatctacccgttatctagactgttaggaaaagggttcaatcctaaaagctgtgggcagatgcccgtgacttgatgctcaaagagacagaaatgcggccatcctctagaatcttgcatcgcaacatgtagactccgaacaaggatggagcgcgatgacaagtatagcgtccacggcagcccagctgtccgccatttcccataccggagaagactctgtcttcttctggatcccctcccatctcgagggcttcgtgcagacgggagagcctaaggagagcacacgcactaaggagttcggcacgtcgaccaaaagatgcaggaaggcggtgcagatcctcacggtttcgggcaggccggcagtgtcggatgcaccatgctgcccctgctgcggaagggcaatagagaaaaacgggaaggctcccattgcgtttcggcacctccctctggggatgggaagggcgaagatagaggtcttgcggccaagatgggcatgcagggagtgcgggggcaccctcacagaagaggtgcccttcagggccccaggccagcgcatcacgctgttgctgcttgccttcgtgtgtgacctgcttgccctgggccagacgctcaaggcagtgtccctcatgacagggctccacaagaatgtggtcaaggctatcgaccgggcaaggctctctggactctacacggagaagggcgaggacggcgagaccagactccggaagcccaagcggcaggcacgctatctgggcgcagatacgttcaagctttacggcgggcacagatatgccaccgtgatcatcgaccttaagacagggcatgccctgtggcttgtccattccaagaggaggcaggtcgtgcttgatttctgcgacttcgtgggcagcgagtggatgtcccatgtggaggcaatcgcctgcgacatgaacgccgacttcgagcgcgcattcctcgagaggttcccgcacctggacatcgtctacgactgcttccatatcgtgaagaacttcaacgagaaggtcatctgtaaggtcaggaaggacgagcaggcaaggcttaaggaggaaggcgacaccgaggccgcgcgtgccccttaagcactccacatacatccttaagtcctgtgccgacaccaggaagaggaaggagcgcggtgcacgcgccggcaaggtggtcttaagaggaagcgccctcttcggcaagcaggaggccctgcagaagggaggggccaggaagcgctataaggagctcatatcccaaaacgagctgcccttcgcctgcgacatcgtagatgagatgctcacgcaggcctattcgtgcaccgatgcggatgcgatacgcgctgccatggagaggatcgtggacacgtgccgtggcacgaaagacaggcatttcgccagggttgcctgcctcgtggagagccacatggagggaatagtcgcgcatgccagacaccagatatcctcgaggaaggtggaaggcaccaaccaaatgatcaagacgctcaggagggcaggctagggataccctaacgacgagtacttcttcctcaagatattcgattgccagcaggcgctactcgaaggcagctggggctgcttcgtgatgggtctgcacacaggtttcaggactgaactacaaatttgacgtctcttttcaatccgctgggggatcgatgtataaacgcgtatactgtgcatgctagaatcaatatatggtaattatttccagcgtgttacaggtctcggcggacctgaagtgaaaggaatggcaatgaggacaaggaaggttgttatcattggtgcagggcatgtgggctcccactgtgcgctctgcctgatgtttggccatctggtcaaccagattgtattggtcgatgtcaatcgtgagcgtgccgaagcagaggcaatggatttgaacgatttggcatccggcttaggcgatggttttgagattcgtgcgggctcctatgctgattgcaaggacgcccattttattatcatgaccgcaggtaaggggcgccgtccgggccagtctcgcctcgatcttctgggcggtaccctaagaattctggatggcatcgttcccgagatcaagaagtcagggttccatggtatcctgatctccgtctccaacccctccgatatcgtgaccgagtacctctatcgcggcctcgatctgccgcgtggccacgtgtttggcactggcactgcactggactccgcgcgtctgcgccgcgtcctgggcaaggagctcaaggttgacgcccgtcaggtcgacgcaatcgtgatgggcgagcacggtgactcctcctttatcccgacttcccatatctcgatcaacggcatcccgctgcgtgagtatatgaagctcgccggcagaggcagagagggtatcgacttcactgaggtgaagaagaaggttcgcgaggccggcagccgcatcattgcgggcaagaacgtcaccgagtttggtatcgcctccgtcgtcgttgagattgtcacttcaatcctgcacaacgagcgcacgatcctgccgctctccgtgcacctggatggggagtacggcgagaaggacctctccattggcgtgcccgcaatcttaagcgagcagggcgtcgaaaaggtcctcgagtacgatctgaacaacagcgagattcaggcgttccacgcctcctgtgacgtcgtgcgccagaagctcgacgctgcaacaccgctgacttcagtgttccagcgtggcaaagatatcgctgacaacatcagccagaacattcggcgctaactgagtatcagcttgtctgtttggggctgcggttgacgattatgataccgaggctgatgagaatcagcgcgatcacggtattgacgccgacctcagccccttctgctcccagcgtgagaagtgagatgagcactccgaagatcgggatgaagaattgatacggcgcgatacgggagatatcgttgtcacgcagcagtaaactccagattgaaaaggccgccgctgatacaaagacgagccaggcgagtatccccgcggcagcccaggagttgagcgtgaaggctcctccgaggagcaagccggtgaggactaggccgatcccgcccagcacaaactgccagccggtgagctgaataggattcaagtgctgcgacttctgccgcatcaacgctgtcgctatcgtcgagcagatggtgccggacaacatgagggcttcaccccagccgaactgggttgaggcaccgatccccattgagatgatcaagccaagaaaaccgagcacaccgccgaggactttgcacacggtcattttttccaacctaaagacaaaacaagagaacaaagacatcgcgaagacgccgacgccctggatgagggagccggtgactccagtcgcatgtgcgaggccgatgtagtagagcacgtattgcccataggtctgaaaggctccgagctctaaggcattgaggataaagtgggagcccaggcgcggggcgtgggtgtgcgcttgaaagacgatcagtactgcgagacctgcaaagaagaaacggctgcccgcgaagatgagctgcgagcccacatcggaggagctgatcgcaaagagctgatagcccagcctgaccccggggaccgcagagccccacagggcacagcacagggtcgcaagtgtcgcgacggcaagtgtgtttgtcaggggtttacgttgagacgatatggtggccataggtcacgcaatcacctgcttcgcaaaggtcagtacctcatctacattcgattcggtggttgcccagctggtcacaaaccggatgacctgtctgccgcccttcagggtgtagaaggtctcacagccacaggcttctgcggacgcttcggcttgtttcgacgtcacgacaaagaactgctggttgaagttggagtcaccgtagggcttgtaaccttcttcgatcaggctttcacgcatttttatggcgcagtcatttgcctggcaggtataggggaaccagagcggctcggtatcttcgggcataaacgtgcgctcaaactgcacaccgagtagtcttccctttgccagaaatttgtcccgctccttgatcaggtaggggaaggcttctttaagcttagggtcgttaattactaaagcctcaccgcagagcatcccgtttttggtgccacctaggtagaaggcggtgcagcgcttggcgatatggggaagagtgaggtcattggaaggtgcggccgacgcgctcgccaaacgtgcctcatcgaggaagactggcagctgatgctcgtcggcccagtcacagattgcgtcaaaacgctgcttggtccagacgccgccgagctcggtggtgttgatgatatagaccgcgccgggtttggccatgcgctgatcggtcgaagtttggaagtgagagacccgctctgcttcctcggggctcaggaatccgtctttgtcgtgggtgggaaggacggttctgcctaccgcgacgagtgctccggtttcgtggacagcgatgtggacatccggggtgcagatgatgccttccc

SEQ ID NO: 109 - DNA, 16658 bp, Unknown
  Metagenome-assembled genome
ccggcaagacaacggtcctgaacatgttggcggcatggatgcggtcacggatggcaagatatgggtcgcagggaccgaggtatcgggcatgggggagcgcgacctcacgttctaccgccgctacgatatcggttcgtcttccagttctacaacctcgccagaacctcacggcgcttgagaacgtcgagctggcaacgcagatctcgaaagtcgttgatccggcgacggtgcttcgcgaggtcggtctcagcgagcggatggacaacttcccggcacagctctccggcggcgagcagcagcgcgtctccatagcccgcgccctcgcaaagaatccgaagctcctgctctgcgatgagccgacaggagccctcgactatgcgacgggcaagtcgatcctgcatcttctgcaggcaagctcgcatgcacacggcaagaccgttgtcgtgatcacccacaatgccgccttcacggctatcgcagaccgcgtgattcgcatccatgggggacacgctgtggcaaacgaggtcaacgagcatcctctcgatgccgataccctggtctggtagtgccatgaaaggcgcattcagaaagagcctgcttcgcaagatctcagggtcgtggggacgcttcctcgcaatcctcggtattgtcgcgctcggctgcggcttctttgccggcctcaacatggtcggccgcgacatgcgcttggcaggggatgcctactacgatgattctgcgctctacgatatccgccttgtctcgacgctcggcttcactgaccgccagatggacaagatacgggataccgagggcgtcgaggatgtgatgcccttcttctcctgcgatgcgatggtctcgctcaacaatgatgaatacacggtgaggatctcctccctgccggaaggtgccgcggagggcacctcctccatgaacaaggcagagcttgtgagcggtgcgtggcctgaggcagacgatgaatgcgtgatgagcgccgatgtgtcgatgcgggagaatctctcgatcggcgataccgtgacagtcctctatgggacaggcgatatcgactccgtgctcacgcagaagacattccgcgtcacggggcttgtgcgctcggccgactatgtggatacctcgcttcttggcacgacaaccttgggctcaggcaagatcgagcagtacctcttcgtgcctgatggagcctttgcagacaatcttccctatacgcaggtctatgtcacggtcacaggagcacgcgcaaaagatgccttctcggacgagtacacagacatcgtcgatagtgtcgagacgaggctcgaggacgaggcggatgaccttgcccaggaccgtctggctgaagtgaagaatgcagcgcaggagaaggtcgacgagagcagggcgacctacgagagcgagaaggcagacgcagagagccatatagctcaggcacagtcgcagctcgacgatgccctggcgacgcttgaggagaacaggcaggcactcgaagagggcaaggagaaggctgcagacggctggaacacgtactggaaagagaggcgccaggccgaagcacagcttgcctcggccaaggcccagctcgaagcgagccagtctcagctagatgatgcggaagcacagctcgggatgacggaggcggatatcgatgcggcacgccagaagctcgaggagggcaagagcgagctcgaggctggcaaggagacatgggaagagaagcgctcagagcttgtccaggcggcatctgacatggacacgatccagggcgtcctcacgacgctcgatacgtgggcacagcgcacggacgagccgaccgaggaggagatttctgccctcgcagacgaggtaaagggcggcatcgaggctgcaaaggaccttgcctcctcagaccttgtggacttcggcgacgaggagacgaaggcgcgtcttgaagctcttgccgacgaggtgatctccgagttcgacggcatcgacctcgacgacgatccggaagctgtcctggatcagatacgcgctgccgctcctgctgcgatagcagatgtccaggaggcctgcaccgaggctgagacccagattgcatccggcatagacgaaggcgatacgaagattgcagacgccgagcgcgagcttgccgacaacgaggcgaagctcgacgaggcgcagagcgcccgcacccagatagatgcgggcaggcagcagctggaagaaggctgggcgcgttactttgagagcaagaaagatgccgaagcgcagcttgcttcggcgtaccagcagctcgtggacgcagacagccagattgcctcaggcgagagccagctcgaggatggctatgcgcagtacgaggagggcgtctcggagcttgtcagcaagaaggcagaggccgagagcaggtttgccgatgctgcccagcagctccaagctgcgcaggatgcggtcgacggcatcgccgagcctttggtctatgtgcttgatcgcacgaagggcgtaggacaggtcagctacggaaacgatgcctcccgcatcgatgcgattgcccaggtcttcccgctcttcttcttcctcgtggcggcccttgtggcactcacgagcatgaccagaatggtcgaggacgaccgtatcgagatcggcacgtacaaggcgcttggctgctcggcggggcagattgcgcagaagtatctcttctatgccggggctgcctcgcttctgggtgccgtgctcggcacgctcttcctctcgcagcttctgcctgcaatcgtgacgcgtgcctacgggacgatgtatgtcgtgccgtcgcttccgttcccactgccgatcgatgtgccgacggcgcttcttgcctgtctggcaggagccagtgcgacctttgctgcaacatttgctgccgtatgggcagagatgcgcgaagtgcccgcagccctcatgctgccgaaggtgcctcctgccggaaagaggatcctgctcgagtacatccgtccggtctggcaccatatgagcttcctctggaaggtcacgttcaggaatctcttccgctacaagcgccgcctcgtgatgaccctgatcggcattgctggctgctgcgccctgctgcttacgggccttggtgtccgtgatgcgatatccgatatcgtcgacaagcagtacggcgatatctggcacagcaacgtggaggtctcgcccgacgaggacgcgacggaggaggacaaggaggcggtcgagagctatcttgcggatgccggggcagagacatctggtgcctggaccgagaacctcaacatgcaggcagggtctgagacggcttctcctctttcctgcatcctcatcgtgcctgaggaccctgagagcttctctggcatggtgacgctcagggagcgcacgtccggggcatcggtgccgctcgacgaggactcggtgctcgtgagcgagaagcttgcctccgagcttggactatctgtcggcgatacgatcgagatctacgaccaggacgatatcggcaatgcggcaggagaaccccatgcgcttgcgatcacgggcatcttcgagaactatctctcctactacgtgattgcagggcagaatgcctatacgtctgcctttggcgcagagcccaaagccagccgcctctatgcctcggcaccagggacggctcaggagcaccgcagcatggcagaggagatgcgggacctctcaggcgtctctgccgtctccttcaacgacgacacgatctcgtcctaccgtgcgatgcttgcgacggtcgattccgtcatggtcgtgctcgtcgtcgcagcagccctccttgccttcatcgtgctctacaaccttacgaacatcaacatccaggagcgtatccgcgagattgcaagcctgaaggtcctgggcttcacccgccacgaggtcgcatcctacgtgttccgcgagatcatcctgctctctgctctgggtgccgccatcggccttgctgccggcgtcttcctcgagcagttcgttatcgtcacggccgaggtcgacttcgtgatgtttggccgcgatatccatccggcaagctttgcgattgcattcgggatgaccatggtgttcacgctgattgtaatggcggccctctcgccgaagcttgcccacatcgatatggtggaaagcctcaagtcggtcgattaagataggtaaggacaaaactggaaagcactccgggaagatgttccggggaaggaaggcaagccatggcagaagcgaagttctaccttatgacagactctccctgcgacttcacgcagcagatggtggatgatgcgaatatcggcatgttccatttcacgtatacggaggccggcaaggaggatggcggcttccacggcgtggatgacctcttcgtgtcccgtacgccacacgagttctatgaggcaatcaggcacggagcgatgccgatgacatcgcagccggcacagatggagttcgagaaggcgttccgcgagcgtgccgatgcagatctgccgacggtctatcttgcgttctcatcgggcatctcgggctgctatgagggcgcctgcacggcgctcgaccgcgtgaaggacgagctgggcagacccgaccttccgatttacatcgtggactgcaagatcggctccacgtcccagtatctcttcatggtcgaagcaatacgtcagagggacaagggcctcacggcgaccgagatggtcgaatgggccaaggaggcacgctacttcgtccagaccatcttcatggtcgacgacctcgatgccctgcataggggaggacgcgttcccaagagcgtcgctgtcgtcggtggcgccctcgatgtgaagccgctgctgaccttcgacctcgatggcgcgctctctgtcgtcggtgtcacgcgtggccgcaagaagggcctccggaagatggcatcgttctacgagagaacgcacaacacggacatgttctcttcggtcgtcgcaatcggcaatgccgactgcccgaaggatgccgagcgcttggccgacatgattcacaagacggatgagacggcggtgacgatgatctcgacgatcggcccgaccatcggctgccatgtggggccgggcatggtgtcatgctgcttctggggtcccgacaggaggaagggcatgtcggtctccgaccgcatcgcccagagcgtgcgcggcaagaactagaagagatacctatagacatgaacgaagggtccggattgcttcggacccttcgctgtgaatgccgcgctttgattcctgtgcctactgggcgttttcggcaagctcggtcgcgagcttcctccaggtcttgatcgtctctgccatgacaaaggacttgaagggcttgagatcgccctggcggttgaaggcctcgagagcctcgtaataggcggggcggtcggtcgcgaagatgaccgcaggtgggttgccgcccatgatgagggtgtagttcatgaggaggcggccagagatgccattgccgtcagcgaatgggtggattgtctcgtagctggcgtgaaagaagcttgctgccgtgaggacacgcttcggcgttgcgtcgccgagggcgtcgctcacctggtcgcagaggtcgtccacaaggcccgggacctctgcgggatctgctccgatctccgtcgagtcggggatgatgcagtcaccgagacggaacgtgccagggcgctcgccgtctgcgaagttgcgctcggagtaggtggcagcgcagagcgtctggtgcagatcgagcacgagcgaggtatcgatcgggcgctcctcggagaggtactgcgttgcacgcatccaggcgcgcttctggttgaagacctggacgagcggcttgagctcgccggtgtagttctccacggcgtccttgtcgaagatctggcgtgccacttcgtgagaggtgtgttccttctcgatgcgtgccgagttgagcgagaacgagagcgcaaagtcatcgagcgctgcctgcttcgtcgtctcgtcgagatctttccaccagccgcagattccgagatacatgccttcgaggttcatcgtgtgcctccctatgagagcggccttgtgccgcattggtatcagaaccatcgtatcccaattgctgccgtctcagcacaggggcgccagacgatgcggccaatgggggaggaggcagcatctgcgcaggtcatgcgcgttccgtctgcatatcttggggagatgttctggagacgtctccataagcctagaagctatatacaaagcaaaacctaataacatagcgtagtgcacagcagtatgcaatggaaaatcggctatgatttgaaaaattttgaaaatcatgctaaactagtcccaattcgtcagaaaggggcacgtgcatgtacaaagtcggcgagtatgtggttcatccaggccagggcgtctgcaaggtagaggagattacggacgatgcggctccctcctacaagctgatgccagtggggcagaggaacccgatgctgatcagcttcccggtcgcatccgagggacggctgcgtccgattctctcgcgcgaggaagcgcgtgccatcatccgcgagtatccgaccatggcagtggagaaattcacggacaggagccgtgcgcttgaggaggagcacttcaagaaggagatcaagaacggctcctgccaggactctgtccgcatcgtgaagacgttccgcaagcgcattgccgatgtccaggcaaagaacaagaagccgcctgtggtcttccagcgcatcttgaaggaagcgagcgagcggtcgctgcgcgagatgtctgttgctctcgatatgagctcagaggatgtcgcggcgctcttcgagtcgtctgtggcagcttccgagaactagcacaagagggggctgcatgaatctcagacagctcgagtatttcatggcaatagccgaggagcaccagatcacggcagctgcccggcgcctgcatatcacccagccgcctctgtcctatgagctttcatcgctcgagcgcgagctcggcgtcaagctcatagagcgcgggccccgctctgcggagctgaccgaggcaggccagctcctctatgcgcgtgccgagcgcatcctctcgctcacgagcgcagcgacccgcgaggtcaagagcttcggacaggggacgagcggcacgctctctgtcggcatcatctcctcttcgggcgggttcatgccgacaccttcgatgcagcgtctgtgccgcaactatccgcagctcaggctcgagctccacgagggaaatacgtatgaggtcctcgatatgctgaagcgtggcgaggtggatgtcggtgtcgtgaggacgccgtttccgcttgatggactcaatgtcacctatgcctcgaccgagcgcatgcttgccctcatcccgaaaggcatacgctgcggcaagagccccgatacgatcacgctcgaagagctttcaggccagccgctcgtgatctataggcgcttcgagcacctgctcgaggatctcttcaacgagcgccagctcacattcttcccggcctgcgtcgcagacgatgcccgcacggcctgcgtgtggtcgacccgcggcatggggataggccttgtgcctgagtcgttcctggcgacgatgaagcatggcgggacgacgaacaagatcgtcgactgtcccgagctcgtgacccagatggcagcggtctggcggaagggaagctatctgccgcctctggccgagcgcttcatcaagatgttcgagaacgactgtgctgaagaggcaagggcaaaagaggcccagaaggcgcaggaggaagcagaagacccagaagatgcatctgagtgagcaatatgccagagcatgaagaaagccccggagccgagcgctccggggctttctgatgtctgccctgaggaagggagaaagagggcagatgacggggatatcacttaggcgtctgcgtcctcgtcagaggatgcgctctcctggatctttgcagtctggacctgggaatcggggttgtcttcctccatgccctccttcacgttgtggatcgtcttgccgatagcgctgccgagcttcggcagattcttcggcccgaagatcacgagggcaacgatgaggataacgagcatttcaggtgcgccaagaccgccaagcatagtgtgcctccaaagctaggtgcccagcgcatctgcgctggctcttcttgtagctcacatgctaggacgcggctttgcgcatgtataatacacggaactcactttcctatatagggattctatggcaggctttctgcctgcgcagatgcaggcgatcgatgtgtcagtgaatgaagcatcgatttgggctcgatgcatagaaaagctgtatctgggctaccagaatcgatctctatggattaagatacgcgtgagccggcttgtgccggctgcatcgtattggctcatcgaaggaagtgcacgtggaagcgcaggattctcaggacggacagacttcgtcggacagcacagcctccgccttgcctgaaggcttggtcaaggctcctgtgtctggcagggtggtcccgctcgaggaagtgcccgatccggtcttcaattccggcatgcttggccagggctgcggcatctggccggaggagaactatctgagggcgcccttcgacggcgtcgtctcctcgatcagccatacgaatcacggcatcgtcctcacgtccgatacgggtgtccagtgcatcgtgcatgtcggcatcgatacctgcgagatgcagggaaagggctttgcccgcctcgtcgagaagggccagcatttctcggaaggcgatccgctcatgcgcttctcgatagatgcaatcaggaagtcgggctaccgcgagattgtcgtctgcgtggtcctgaattcggagcagtaccagaagatcgatcttgtgcctgccgagggacatgttgcagcaggggagcccctgctgcaggccgaggctgctgcctaggcgctggccagcactgcggaatctgcgacaggatgtactgaaaaagggtgggactgttcatgcgagcagtcccacccttcgttcttgctgctgttcagcgtctagcgctcgctgcggtatccgccacggtcgccacggtcgttgcggtcggagccgctacgatagccgccgccacggttctggctgccgtagccggagttgaagtccctgccgccacgatagccgccatcgcgcctgttgccgccacgatagccgccacggtctccgccacgggagaagccgccacggccaccacggtcgccgccacgggagaagccgctacggccgccacggtcgccgccgcggaagccgccacggtcgccgccgcgggagaagccattgcgtccgccgcgctcgtcacgtccgccacggcggtcgtcgtccctgcggggcttggtcggtgcatcgggatcgtcgccgagggcaaggagcttctccttgagggagtcgctcacggtatcgacggccgcctcgaaggcagccttcgtctctgcatcgaggacgccgaagacctcctcgtccgggtcgagctcgtcgaggtcgggcacagctgccttgccctcgtcggtgagcttcacgagcgtgacgcggccgtcctcttcgctcttctggcgctcgacgaagcccttctcctcgagcttgctcagaagctcggagagggactgctggcgcatgccaagaaggaagcagagctccttctgcgtggtctcaggctttgcctggagcatggcaaggacgcggccctggccctgcaggggatcgccgatgccgccgtgagcctcggtgttgagcttgatgtagcggtgcatgaggcgtgccatcctgcccgccttctcgacgagcgacatgtcctcaggcgttgctgcgggctcaggcgtctcttcggcagcctcgatctcgacgttcttctcttcgtccattccaacctcttccatagttgtgcatctgctgtgcagcagatatctgtctgggggatttgccatacatgacaatactcgcaggagagagtcctatctgcgggaatgggctttatcggcccatctacacgtgacgtccataaaaacaggtacctgtacaattatttcacagtgccacgcccatgaaaggtatgctgggaaggcacagaacgtgacgaccaggacggtgcatcgatgctgaccatcaaccatgcgatactgcatgcctatgacttcgagacaagttcgaactatgagagcacacgcgagctcgatgtgagcgagaaggccattcgctcctatgtgacgaggctcgtgcgcaagaccctttcctcttccgagagcaagcacgggatgttcagccctgagagcaatttccacgaggagctcaggcgctaccgtgcctcagagctcgatttcgtggccctctcgaaggaggtaggggacttcttcttcgaagagctcatgaagtcggatgacaagctgccctatgacctgcttgtcgccgatgtgacggatacagagaaggcgcctgctccccagaccgacgaggaggtggatgcctccttcgaaggaaatgcgcgcgaggtctttgcgatcgtgctgcttgccagaaagcagggctatgtgcatgatgtgcgtgaggacatgcatctcaccgatatcgtgaagaccgatgcgctcctgccgctgccgacgcagaaggtggactcctatgcggcgatcgatctcggcacaggcgagatcgacttctcggacaaggcgcgcacgattgcgggacaggagtccttcatcatccctgatggcctcctccaatgcacccaggaagcctcgacccgcgaggtcatccagagcgtgacgcttgccgtccaggatgtggcagaagagtatggcctcacgccggcagtcgaggtgagccgtgccaaggcctatgtgacggagcaggcagacgaggcagaggcaatcgagccgcgcgaggtcggcaagaagatctttgcagacaggcccgaagcccaggcgcgctacgaggagaagatgcgcgaatcggcaagtgccgcctccatccccgaggaggtgccggtgaggccgtctgttgcccaccgcatcgcgaagaaccaccgcatccgtaccgataccggcatcgagataacgttcccgagcgagtattcgtcaaacgatgacttcatcgagttcacgaccttgccggatgggcacatctcgatcacgatcaagggtgtcgagcacatagagaacaggtagaagcgagccccggcacctgtccggggctcatctgtcacgtattgtctccggcgtcttctgtgccctcatcgcccttctccggcaccggcgcatcttcgagcgtcaggctgaagtcgcagcacgggtctccatcggcaaggcacatcgtgcgctcgagcttgatgcctgcaagctctgcccagacatcgggcatgcggcaggcggcgcgcatgagctctggcaccccgagctcatggtagagcctcaagatgccgcagctccggtacgtcaccatgtagtctctgtcggaccccgtggtatagatatagcgccagccatagtctgcgcaccgcatctgcgtgagcagggcacttctctggatgtcgcgctggccctggatgctgaagtcgtcgcggagcttcgctgcgattttcaggcaggcgctgctgcgggcgcagacatcggcaaagagtccggcgcactcctcgggggtcggcgcgacgtcggggtcctgggcgcgcgcggcgatatagacgcttgccagaaggcccgcctgaaggagcgaccagaaatagcgcctgccctggcgcgggtcttcgatgccgccgacgatctcgcggaaccgtatctgcgcattcttcatgatggcggaagcatcttcctgcccgtagcgacgggtcagctccgccctcaggtccctttcgagaatatgccacacgagacgtggcgtcattccatactgcatgtcgagaagatgctccttgctggcaaacggtcccagacaagaggatactatgacggaaaacatttggggagtagcttggccgtaagcgaggtttcatgagttcgcctttcgtatcctttgccttgatcatggcagtagcggcagcagcgccgtatatcgcaagtctcgttccgggacgcgccgtgccggaagtggtctttctcgtctttgccggtgcccttctggggccgaacatggcaggtttcctctcgacgtcgtcttttgccatctcgttcctgtctgatctgggcgtcgccttcctctttctcaatgcgggctatgagatagatccgaaagaccttggcggacggatgggtctccatgccattcttgcctgggcggtatcgctcctgcttgccatcctgctcacgacgaccttgatggcagaccgctttacgggacaggcgggtgtcgcctttgccatctgcctcacgacgactgccttcggcacgcttgcgccgatcatgcgcgactgccatctcatggggacgcccgtggggcgtgcggtgagcgtctatggtgcctacggcgagctcctgccgatcctggcaatggcgcttctgatgtcgacgaggagcacgcgcgcaacgattgcgacgcttctgatctttgtcgctatctgccttgcgatccttgccttcccggcactgctgccccgtgtgcgcgagaggatcgactcctggctgaaggagagcgcttggtcgggctcgcggcctctcctgcgcctctcgatcctccttctctctgtccttgtcatggcctgcgaggtgctcgatctcgagcccgtgcttggctccttcatcgccggcttcatcctcggcgcctttgcaccgcatgaccatgtgctcgaggagaagctgcaggatatcggaaacggctttctcgtgcctgcctatttcgtgatctcgggggctggcgtgagcctgccggcagcctttgaaagcgtcggccttctcttcggcttcatcggccttctcgtccttatccgcggcggcattgtcaccgtctccctcaacatcaacaaggagacacgcggcatgcgcaagcgcgagaagtatgccgtttccgcctactgcacgatggcgctgccgcttgtcgtggcggtgacggatgtggcggtcgaatctggcgccatgggcacgaataccgcatcgattctcgtttcggcaggagcgatcacggtgctcctcattcctatcgcgacaagcttcgtgcgtgtcggtgccgagtccgatgtcttttccgctgtgcatgaggtggcagcagagaagctgccgatccagaaggtctggaagaagcaccgggcactccttcaggccgacgagaagcgctttgccgcagctgtcgaggagcagaaagagcacggccacaagctcgactccttcgaatatctcgtgaccggcgcgcgcttctccgacaaagagctggaaggaagatcctcaggagaaaacggaatagaaggccagataggccagatgaggaagggagccggcagtgccggctcccttctgcttccacgcttcttgctatccgatccggtgcacccgggcaggatcgaagcggccaggacctgtgggagagaggggctttgcgggatgtccgaccgcaacgattgcgaagggggcaaggcctgcatcgtcggggattcccaggacctgtgcagtggcatgcacgcgctcctccatggggtagatgcctgcagacagcacccaggccgagctctgccgcctcgacgaggatgttctcgattgcggcgcccatatcctgctctgccatatcggggcaggggaggccttctgtcttcaggcagggaacgatgcaagcgcagcatgagcgcaaggcttcgcatacggggaggcagaagcgagcgcctcgagctggaccttgccttcgaaaacccagaattcccagggtcttggttcatggcagaaggtgctgccatggcagcccgcagaagccgctccacctgctcctctgcgactgcttcgtctgtgtatgccctcacgctcgtggggcaaaaccggatcctgtgtttccatgtcggtcctttctcgtgaatcttctccgactcttcccgaagctggccgatgatatgctaggaagtccgaaaggggtctaggaacaatgacgctcgtgcagctgcgctatgcgatagagattgccgaagcaggatccatctctgtgcggcagcgcgcctgtttgtcgcgcagccgtcgctctcgaaggcgatctctgagctcggcatgagatgggcatccagatctcgagcgctcgcgcagaggcgtcgaggtgaggaggaagggacacgcttcctctcctatgcaaggcaggtcgtcgagcaggcagagctcctcgagagccactacctcggcgataccttggcgtgcgccgtgtcttcggcgtctctgcccagcactatgcctttgtcgtcaatgccttcgccgagctcgtgcgcgaatatgggcaggaccgctatgagtttccctgcgcgagggaacgacgttcggcacgattgaggatgtgcgcctgcagcgctcggagctcggcgtgctcttccgcaacagcttcaaccgcgaagtgatcacgaatgtattgcgcgatgccgacctcaggttctgtccgctcttcgaggcgaaggagcagtgttcctcgccaagggacatcccttcgcaggacgtacgagcgtgaagctcgagatctggcaccctatcccaggctctcctatgaccagggcatgaagaattccttcttcttctccgaggagccctatccgacagaggcagtggacaaggcaatcgtcgtgacagaccgggcgaccctcttaatctcctgatcggcctcgatggctacacgatctcgtgggcatcctttcggccgacctcaacggtacggatatcgtggcggtgccgtcgagcccgccggcacgatggagatcggcttattcagccaggtccacgtccgctctcggctcttgccaagagctatctcgaccatctcgaatcgtatgtcaggcgtactttcggattcggatatatagcgcgaagctataggtaacgatagataactcgtagtttcatatggcaccgattgatgggatgatgcatccatcagacagcagaccctgatggaggcagccatgagcatgcatatgacaggaagaccccgcaccgcttcgacgtcgtcggaagcttcctgcggccagagaggctccacgacgcgcactttgcctggaaggcaggaaagattccgcggaagagctcaaggccatagaagacgagtgcatacgagaccttgtcgcgaagggaagaaggcaggcctcgggtgatcacagacggcgagttccgccgccagacctggcatctcgacttcatgtgggcctttgacggcatcgcccacaagcctgccgaggcaggccttccgttaccgacgaggcagcaaagatcgacgatacgtaccttgtgggcaagatcgcctacaaaggcacccatcccttatcgaccacttccgcttcgtcatgcgcttgaggacgagcgtaccgttgcaaagcttacgattccggcacctgcccagttcctggagcagttcgcgatgccgttcaacaaggagacgacggacaaggtctatgcaagccatgcagagcttgcagacgatatcgtggcgggatatgctgcctatccaggacctctatgcagcaggctgccgcaatctccagcttgatgactgctcgtggggcatggtcgtggatccgcatgcagggcagttcttggcgtcgatgaggcgggcctcgagcaggtgaaggaagcgctcctcgaggtgaacaaccgcgtgctcgctcctgtcccgaagaccttacggtcaatacgcatatctgccgtggcaacttcattcgacctgggcctgcgagggcggctacgacggcgtggccgacttcctgcttgcccgcgagaatgtgcatgccttcttcctcgagtacgacgatgcacgctccgcagcttcgagccgcttgccaaggtgcccgaagacaagcttgtcgtgcttggcctcgtgacgacgaagcgccccgagctcgaggaccgcgagaccgtgattgcacgcatccatgaggcagcgaagtatgtgcccctggagcgactctgcctctctccccagtgcggtttgcctcctgcgactgcggcaacaagctcaccgaggaagagcagtgggcaaaggttgccctgtggctccattgcagaagaggtctggggctaggatcttcccatgcaaagcaggcgggccccgcatccttatgggtgcagggcgccgcgcttgtctctaggaagtctgcctagtcgagctcggcgaagtccggctcgaagatggtcgggcagtgaaggtagggcgccttcgtcgtaggcgaatgtgaagatggagcagttcttgatgccgggatggtacggacgacgttcggtccttccaggagcggatgaagttcggcgaggctgctccgtggctcacggccagagcgcaggacacatccgggcggggacatgatctcttcggtcgccttccgcatgcgtgcgacgagcgtctcctgggagtcccgccatacggcacgaagaaatcgccgaagggaggggcaggattcaggaaattgtcttccccctcgtaggcgccgaagttcattccttgaggcacggagcgct

SEQ ID NO: 110 - DNA, 23856 bp, Unknown
  Metagenome-assembled genome
accggcttcaggccatcgcgcacatcagggagggcgcgggccacgatgacggacatggagtactcgaggaaggaggccttcatctcttctgccatgtcgtcgggcttgagcgcaccgccgtggatgtcggagaggtcgaggcgggtgcctgcctcatccgaaatcgtgtgggagaggttggcaccggcgaggttcagattctcctcgcctgtatcctcttcctcatctccgtattcatcttcatcgtcgtcgccgtcgaggtcatcgtcgtcagacccatccaggtcttccgtgtcctcgtcggtatcatccaggtcgtcttcgaactcatcgccgcgctcgggggtctcattgtcgtccccgtcgcctgcgaaaagatcatctcctggatgcttgttgttgtcgtcagccacgtatcacctttcgctagatgtcgaggaaccgcacgtccttggcatggttctggatgaagtccttgcgcttctctacctgggtgcccatgaggtcttcgacggcacgctctgctgccatcgcgtcgtcgatcgtgaccttgagcatgatgcggttcttcgggtccatggtcgtcgtccagagctgctcaggatccatctcgccgagacccttgtagcgctgcacggtgtacttcgtcggatcctcgtacttcttggcctcgagggcgagctcctcatccgtatagagatacttgccatgcttcttgcccttgggcttcagctggtagagagggggctgcgccacgtagatgtagcctgcctcgatcatgggcttcatgaagcggaagaagaacgtcagaaggaggatcctgatgtgggcgccgtcgacatcggcatccgtcatgatcacgatcttgtgatagcgggccttctcgatgttgaactcctcgcccacacccgtgccgatggccgtgatcagggactggatcgtgtcggaggagagggccctgtgctcctggacgcgctcgacattcaggatctttccgcgaagcggaagcaccgcctggatggaacggtcgcgtgccatctttgcagagccgcctgcggagtcgccctcaacgatgaagagctcggtcatggctgcctcgcgcacggagcagtcggcaagcttgccaggaagggacgccgtctcgaggaggccgcgccttctcgttgcctggcgtgccttctgggcggcaaggcgtccgcgtgctgcctgggaggccttcttgaagatctccttcgcctggttcggatgctcttcgaggtagtcggaaagcccctgggagacgatgcggttcgtgagcgtgcgcatgtaggagctgccgagctttgccttcgtctggccctcgaactgggggtcggagagcttgacggagacgatggcgcagaggccctcgcggatatcgtcgcccgtgaggttggcatccttctccttcaggaggttgtggctcctcgcatagtcgttcatgaccttcgtcagagcggtgcggaagccctcgatgtgcatgccgccctcttcggtgtagatgtcattggcaaagcccatgacattctccgaatagccggcattccactgcatggcaacctcgacctcgcccttcttctcgagcggggtgtcggggtcggtcttgccctcgatgtagatgggcttggagcagccaggcaggatctccttctcattgttcaggaacttgacgaagtcgatgatgccgccctgatagcagaactcgtcgacgcgcggcgtgagctcgcgctcgtccgtgaggatgatcttgaggcccttgttcaggaaggccgtctcctgcaggcggtcatgcagcgtgtcgtagttgtagaccgtcgtctcgaagatctcgtcgtccggccagaatgtgacggtcgtgccggtcgccttcgaggtgccgatctgctccatcttcttcacggtcttgccgcgtgcgaactccatctggtagattccgccatcgcgcttgaccgtgacgaccaggcgcttggaaagggcattgacgacagagacgccgacgccgtgaaggccgccagagaccttgtaggcattgttgtcgaacttgccgcctgcatggagcaccgtgagaacgacctcgagggtcgggatcttcttctgcgggtgtttggctaccgggatgccacggccattgtcctcgaccgtgatggagttgtcgggatgcaccgtcaccttgatcttggtgcagaagccagcaagcgcctcatcgacggagttgtcgacaacctcccagaccagatggtgcaggcctgtggcgctcgtggagccgatatacatgccaggacgcttgcggaccggctcaaggccttcgaggaccttgatgctgctcgcgccgtattcttctttcttgggcacgctcatcctctcttcgaaatgcacgtgtacagactgctctatggtatgacgtgcagagcagaatagctttctgccaagagaaataacgcaggcttcgcacaaacgattttcccgttagaggcactgagagccgatttcagcccattttgcagatttgcgcatacattaaccctgtttgagacgattgctgtctgaaatccgtcagatgagcttcagcgggaaggacactccagccacatccggacataaaaaatagggcgggaacgctcttcacaatcccgtccctcagacatatgctccatgtgcgctgcaatacccatatcagtcatcttgcgttgcagatataggacatgatccgcatgcatgaaatcccgccgtctccaaaatctcttgcaccttgcagagccggggcaagcgccaggcatacatacgatatgaatggtcggatatcacattctggcgcatctgttgacgagataggaccagcttccgctctcgcctatgcggtccccaaaagcttgtcagtaaatgcatcgcgagcgaaggcactcggcgtcgttccttcatcctttgcagcacgctcgattgctgccttcatcccgatgggaatcttcaccgagaaagtgacagtgccttcctgcgagagcggcggtcttccatggacaacgcctccaacggtatgctcaccctcaggaaactcacctttctcataggatgcattccaacgattgatcatttcttcggtgatttcctgaccgtccggcgtgtaatgcttcttctgagtcatcttgtcctcctctcggtatcgcgtatttctttcgcaaatttcttccggactggtgtgttggcatgaatgataagccaaccgcctacctgttcgactgcaataatctcgacagatacgcaattcggaagccaaccgacgaataccagcgtggcggttactcatcgcttgcacgcatgatcgatttagtcacgactgccacgccgccaacaaatcatccctgctcaatgcttaagcgcattgggatgaattctacatctggtctcatgcgcctcctccgtccactgcttttagtatacccattcgtagacgtaattaaactgcggcgccccttgtggcgatagacgaatccttgtgactacccgaaatcagatctgaatttaatggtctccagctagccatgcaaggcaggtcatggattgccgccatcagcatcaggcttcatgagcctgtccgctctgctcactttgctccgtcgagcatgagcttgagtgcctgggctgctgcccctttgaggccatccggcagctctgcgcagcctgcatctatcgccgcagacgtcccctcgtcaagcggtgcagggaagaagccggctttacgggctttgcctgcctgcgcgtgccctgagggagaaagcggcttctttctccctttcctcgagagctggaacttgatgtcggatgccgcaaagcctctgtttgcaagacgggcgagatagagctccttgttcgtcgtgaagtcctggagaagcgccgaagtgtctatgtagacatagagcaccggggccttcgtcttgaattccttcacgtagatgccctgggtatgtctgtgctcgaggtcgccgtttgcctgccaccaggcggcagaggccctggcctgcatgctcatgccccgcttcatggaccccgacatgtagccgcgcaggagcgtatccaccttcgtgacacgcttcatcgagacctcgcccgaaccttccgagatgcggtagaactcctcgcgggaggttgcgtccgtgcctgtcggctcgaaggcaggatagccttccgtatccttatcctcgctcaccgatctcgaccacctttgcacgctccaggagcccatcagggaaataccccagattcgtcgtcgttatgacggtctgcatctcttcctgcatgaaggaggtcaaggcccgccttctcccctcatcgagctcgctcatcacatcgtcgaggagaagcagaggaaatgctccaaggatctgtctcgatacctcgacctctgccatcttccacgcaaggacgatcgtgcgctgctgtccctgcgaggcaaagcttctcgcatcgcgtccgtcgagcgcgaaggcgatatcgtccctgtgggggccgacgcagctcatctggcgcctgagatcgagctccctgccctttgccagagcatctgacatgagcaagaccagatcctcgcgcgtggcgtcctccggcaagggccccagagagcttctgtaggcgcaggagaggtcctcctgggcaatctgtccatagatgtcatgtgcggccacagaaagcctcctgaagagcgcaaggcggtgcacgagaagcgttgccgctccaagcgcgacgcttgcatcccaggcatcgagaaggcccatatcgaaagaaggctccttcaagagcctgttccgctgctcgattccccttgtataggtgcggagcacctttgcatagcccctgttcacctgggcgccgaaggcatcgagctcatctcgcctgaagcttgcggacctcttcacgagggagaggtcgtccggcgtgaagaggacgctcatgaggttgccggaaagatcgtgcgcatggcagggcttgccgcaccagaagaagcggcgctttccctccttgagcgtgagtgccgcatcgacctcgcggccatcccctctgagagagaggtcggcacgtcctgcctttgccccttcgcgcaggagctcttgcgccgtcggctttctgaacgaggacccagctgtcaggagctggagcgcctcgacggtgttcgtcttcccgacggcattgggacctgcgatgattgtcatcttctcgtcgaaggagatcgtcttctcagcaaagctccggaagttccagagcgagagcgtctcgaccttgaggcccacgcgctacatcctgaccggcatgaggagatagaggtagttcaccttcgcatagctcttgaagatgcccggctgcatcgcactctggagctcgagcgtgatctcgtcctggtcggacacggcattcatgcagtcgttcacatagtggtagttgagggcaatcgagagatcttcgccttcggcgtcgatgttcacatactccgttgcatcgccctggtcgggagaggtggcagagagcctcataagcttcgcgtcgcactcgatatcgaagcggaccgacgggttcgcaagggcaatgacagagacacggcgcagggccgaggcaagatctgcgacattgaccgtgaccttcgttgtgcaggacttcggcaggagctgcttgtagttcgggaagttgccttcgatctttcgggcaatgaaggtggtgttgccgaactggaagacgacctgggagggcgtgatgccgatcaagatcttctccgtcatgcccggaagccccagcacctcatggaacacggaacccggaaggatggcacggaaggcctctgcgttcgaggtatcgacattcgtgtcgcagaccgcaagcctgtaggagtctgtcgcgacaaggcggatcgtattgtcctcgacggtcgtcaggatgcccgaaaggataggacgggagttgtccttgtaggtcaccttgtagaccttgtccaccatcgtctggagcacatcggaatcgagctcgaccgaattctcgaactcatactccgggaaggacgggaagtcctcgggagagagggcgttgaggcggaatgaggacttgccggaggcgatcatcacattgtggtcgtcgccctcgacagagatcggggcatcagcaaggttcttcacgatgctcatcagaatcttgcccgaaagcaccgtctctcccgcctcatccacattggcagggatggaatggcggatgaagatcgtcgtatccgtcgtctggagctcgagcgttccgttctctgcaatgagatggacgcctgagatgatgggctgggaagcgttcgatcccatgcccttcgatacgattgcaagtgcctgtgcaagtgaagactggctcacggtgaacttcataggtccttgcccctttcttatttatatagatatataagatacaaagaaatagcagtcatagtaaggcctgttgaaaagtcgaaatcctggcatattccctgttggaagcctgtttcatacgtggttgaaaactgatcggtcctgaacactttcacctttcatcaatcccttgacaatctctttcaccacgatatgccgagttgctgacaggtttcgacagcttctctgcaagatttgtgacagacgcctgcctactccgtgatctcctccgagatcgtgtcgaccttctgcaggaagatgcggttctccttgcgaagggcatccacccacttcaggctgtgcatgacggtagcatgggagcggccgccgaacttctttccgatatcggcaagcgtgttgtcggtaagctcgcgggagagccagatggcgacatgccttggctccatgagctccttgttcctcttggagcctatgaggtcggtatgctggacgccgtagtaggcctccactgccttctgtatctgctcgatcgtcacgatcttctgccctgtcggccatttgaggcttgcctgggctatgacatcatcgcgcgtgagctcctcgcccttgagctccttcctgtgcgccatcatgagacaggactggacaaagcctgagatcacgcggatgttcgtgcctgacttctctgccatgagctcgaggttctcgtccgagatctcgcctgtcgtatcctctatgtgctcgtctatcgcgtcctggcgcatgcgctcatagaacgtcttcacgagcttcagcttgagctcatagcttggctgctcgatgccgatggtgaagcctgagtcgatgcgggaggtcacgcgctcgtcgaggccatctgtgcccatgccaagctgcatgggagagcggtctgctgcaagcacgatctgctttccatggtcgcgcaggtagttgaacgtgttgaagaagaagttgatcgtgccttcgcgccccaccatctgctggatatcgtcgatgatgaggacatcgattgcacggtagtggcgctcgagcgcgcttctggccgttgcatccttttccgtcatggcctggacatagtcgctcacgaactctgtgccggtacggtagacgcaggcacgctgcggctgggtctgcacgatgtagttctgtatggccttgagcagatgcgtcttgccaagaccgctcttgccgtagatgaaaagcgggttgtagctcttgttctcgccgtctgcgacctgctttgctgcctggagggcgatctggttctcctcgccttcgacaaagcggtcgaatgtgagcttcgagtcgttctcggggatggcttcgatgagggggttgtcctgaggaagaggtgccttcttctggggagcgctcggagctggtgcggcaggtgaaaaggcaggtgccggcacttcttctggctgctcctgctgacggcggaagccgtcgagctcttcctgcgtgacctcggagttcgtatgcacgacgaccttctttgcatcgccgaggtcgcagacaagcgcgagatcctcgaaagctgcttccttcagcgcctcctcgatgaggggccggttctcgtcgaccttgagcttcacgaagcgcgtcgttgtcgagatgtggaactcgccctcccccatccgctccggtgtgcagctcttgagcatggcaaggacagcaggagcgagctcctttgccttgagaagatccaggacatcatcccagaggatgcgtgcctcttcgtttgcggatacctccatgcctgctccttgggagtgtggtgccaatttgtcgaaaactcattgtagaacaagcgaaggcatgttgaaaactataaattgctgcattttgagctaatgggagccaaggaagaggtttccgacctcggtcagatagtatttctgcccatccttcttgatgaggcccatgccctcgagctccttgagctcgcgcgaccaggtaggctgggaccctccatatgccttcacaaggttcgaggggcctaccgcctcgtggctgctgagatattggagcgccgactgcccgcgcttcgagatatggagccccgagaaggaattctgggaagccggagcctgctgcgtgccaggcaggggctgtgcctgctgctgcgggaagccgtcctgctggccctgagccatctggtcctgctgccacatctgctggccaggatatggtcccgcctgaggctggcctatctgctgcatcggctgctggggcacgccctgctgcatgttctgggcagtccctggataggcctgctgccaaggctgctgatattgctgctggtagggctggtactgcacatatccctgctgtggctgcatgccatacgggttctgtccccatgtctgctgatagggattggcctgctgaggcatctgctgccaggaagcggcctgctgcgcatagccctgttgctgctgcatctgctggggatatggctgctgtgcagggtatgcgcctacctgcttgtgggagggctgtgcctgcatggattgctgagaggcaggagcgctttccatggcggcacttttcttcatggatatggtcacgattgtgccatgtcctatgttgtctgcaatcgtgagggtgccgcccttgtcggccatgtactgctgggcatagggaaggcccgagccgacgcctctgatatagcggcgcatctcttctgtagcagagcttgtgccgtactcgagggcgcgccccttctgctggatccctggcccctgatcggagaaccttatcgtcattccgtggtccaggatcgagaccgtgggctccatgaagtaggcatggatgaagttctcgacaatctctcgtatcaccatgaacgggatcgtgcctccctgttcatgggaaaggcgcgtgacctcgcttgtgatctcctcgagataggcgcggacatccttgggctccacgacgacgacccgcggcgctgcagctgcatcgtcgtagaccgcgatgcgcgcggcatagtggacttcgagtgcaggatggtctcctgccgaccccggattctcgacgaacgggtagaaatcttctgccatcccgcacctccctatctcgtgaaatatgccttcctagcttactacggcgcagaaattttcatcgcttggatgaaagaacgcgaaaggttttcttccatggctgaacaattgaagaaaactttcatggagaaagaaaactggatgaaagttttcggccattgtgaaaacagcgtcgaaaagaccatcgtaagttttcaacatgtgacgaatgaaagatgaaaactcagacgaatattcgcggctttggcaggaaactttcatcaccggatggaaagttgtcgaaacacgctgaatctttcagcgagatgccggtgaggaaggcagaagatgcagagaaaaggaattgcggagaacttttcaaaaaattgacatcatcgcaggaagactcttacaatcttagggctattgcacctatgcctttggtacttctaacaggaggaaacgatatgaagcgcacttatcagccgaacaagcgccgccgtgccaagacccacggcttccgtgcacgcatggcaaccaagaatggccgcaaggtcctcgcacgccgccgcgcaaagggccgcaagaggctcacggtctaggtgcatcaatggagaccatcaaatccagacaggattttgagcgggtcttctcgcgtggccgcaggtacacaaaccggcttgtccgcatgacagtagccgtggcagacgaaggcaatccgggcaggattgccttcgtcgcgcctaaaaggctcggaaatgcggtcttccgcaaccgctgcaagagggttctgcgcgaggctgcccgcacgacggggatgcctctggagaagcatgacatcatcctcttcgcgacccgcgacacgcatgatgcaaagccggacgaagtgggcgccgcccttcagaagcttctgaagaaggcgggcgttcgatgatgctggaggcagaaaacgagcagtccacagcagcgcgtattcttacctctcttgtcagggggtaccgtcgttacatctctccccttctgccagattcctgcatctatgagccgacatgttccgaatatgctctagaagccatccggaagtacggagctgcaaaggggtcgtggcttgcgttcaggcgcatcctgcgctgcaatccgttccatcgtggtggctatgacccggttccctgatatctggctacggaggaaagatgtgggattggtttattaactggatgaccagcatccttgctggcatcgaaagcttctgcggcgactggggtctcgccgtgatcatcctgacggtcattatccgtcttctgatcatgccgctcatgacgaagagcacggcatcgtctgcaaagatgcaggcgctccagcccaagatgcaggagatccaggagaagtatcaggacgacccgcagcgcatgcaggaggagatgcagaagttctattccgagaacaagttcaatcctctcggtggctgcctccctatcatcatccagatgcctgtcttcttcgcactcttcacggtcgcgaagaacgtgccttacgatgcaagcttctacggcatcctcccttccatctcgatctctccttcgcaggcagtcgctgactacggctggcttggcggaggtctcccctatgtgctcttcgttgcagcattcggcgtgctcacactccttccgatgctcatgaacgcgaagaacatgcctgaggagcagcgcagccagaacctcatcatggctattgtcatggccgtcatgatggtctggttcggctggactgtgccggcagccgtccttctctactacgatgcttctgccatctggcaggtggcccagcagaagttcgtgactcagaaggtcatggacaaggtcaaggccgagcaggccgccaagctggaggcgcagggccgcgtcatcgaggtcgagcgccgcgagcagaagaagcgccagcacaagaagaactagcattcacgcagcagggcacatgccctgctgcactttttctatccaggaggtgttacatggaggaagaaatcgaggccgaggctcaggcggacgctgccgaagccacgtccgatatggctgccacgatcaaggagaagtacgaggcaggccaggagctcaccgacgacgagctcgatttcgtcgccgatgcagccatccgctcgatcaaggacatcctttcctacttcggtgagaccggcatcagcatcgatgagtacgacggagacaacggcgagctcatcctcgatatcaatggcggagaccttgctgtgctcattggccgtcatggccgcacgctcgatgcgctccagatggtcgtatcctcgctcctgagcagcacgctcggcttccattatccgattgtcgtggacatcgagggctacaagagccgccgcaagaacaaggtgcagtctctcgcccgttctgctgcagcacgtgcaaagaagcagcacggctcggtgagcctgccgccgctggatactacgagcgccgtctcgtgcatctggcacttgtggacgatgaagcgtcgtcacgcattccgaaggcgtagagccgatgcgccacgttgttgtgacgccgtgaacaagtagttccaggtcacaaacgcatggataaggcgagactgcttcggcagtctcgcttcttatgcgacaatggagacgatgaaggaggatgcatgttcgaggaaagagaatcgtacggcagcaattgcatcaagagttgaaccaaatttgtatcgatgccgatgaaggcaggaacctccgcttaggcatctcgacctcgtcgtaggatgaaacatgaatgctaacgaggatcacggacccgagcgctgtgacgctccatgtggtggactcgtgacgcttctcccctctttcttggagagccagaagaagacgcatctccccatctcgatcttggcaccgggggtttcctggcatccctctggctatcatgagccaatctcagggtctcctatcgattcgacccagaagaagatcgctgccgtctcggacttcctcgtgaagctggtttgaggacaggatcgaagctgatgcagtcagagccgaagagcttgcgctgataaaaaagcgacagtttggaccgttgtcgctcgcgctgtcgctcccctctctgtcttatcgaatacgctcttcctcttctttgccgccatggctcccttgttgtgagcaagggccagctctcggatgaagagtacgacgacagttgtatgtgccgagctctgcggcatggattggtttcacgtgaaacaatcgagcttccccatgatatgggccatcgtgagtcctggtctatacacgtgaaaggaatcgcgcatcaagcttccccgcccgcccggatggctcaacaccctctctccatgagaaagtagagctttcaaacaagcagcatgttgggtggtgaaggaagcaatcaaagtttttgatcgagcagagctggagcacatcaatcggtgcttcggctctattcttaagtaagagccgtatttcctcatgctgcccagaaacgctctccgaagacggcagatgaatgtcatgcctcagaatatgcagctgcaccacgaaccaaactgattatgctgcttggatgtacgcgaatccctataccgcctctttctccttgtgcatacgaaatcagctgaagcagcttcgatatatacaggtatcttgttagatttaatagcatctttccttgtgaggctttatggactgctccgactctcgaatcggatttgcttctttagccagagctggaataggaacctgtcttttgctgtggtagcagtggcagatgaacaacgtctgccagaagagatagcatctatgcgacttgaatatgaacaagtctggaacctattggaagcaagaatagccaactcgacagctagaaatctccactcgacatacatatgttctagacccagtgatttgttgatgatgaacatgcacctgtgtattcctcttgaatatctgcagagtgatacagctgtcgacatgaagtctgcaagcagaaaatattcattgtaaggtcttgagatctgattgccatcaatgagtcacagttctgtctggctacgatggcctgcaagatagttggagcctaacgaacttgcaggtaactctatcaactcgacatacaatgttctggtttgaatggcatgagttgatatgtttcacgtgaacaggtgaaggaatccatgaggcggctctgctagcccaatgttttctatatgacggattagtcaaaagacctaaagcaagtcaggtgttgctgtaattaggataatggctgagtacctccggcatagttaggctccctgaactgtaaaggcttaggcaagctgcaggaagcttcggctggaccgtggccgtggctgcgatgcggagagcgggacatgcgagggcacatctcgtggaggagctccatgcaggcatcggaggagctcctgtggctgtatctccagctgtaggagtccgcatatgactgcaggtgcttcttggagaggccgtggaaggctccctccagtatgccttgaagttggagatgaccctgtggaccatggggagcgaggcatcgcgtccgagctgtcgtatccttctgctcgaggccgggaaggacgagagcccggcagctatggctgccatccgcctatcctcgatgcatggcagaggtggtcgtgcccgaactggcgcatgagttccgagcagtctgcgcgcaccggatgggcaggagcccctcggaggggcctgtgacggcggcaagcatcggctgctgcttcgctgccttcccctcgtggctcggccctcgcgctatatagaagtcgtccgcctcgatgcagtcagcagcgaggacgtgaaggcactccgatctggccatcgcgcagcggatgcgcgcaaggacgctgcgtcttgtagctgcagcctatctggcgctgcaggagcatgcgctgatgctgccttctggctcgacatgagccagatcgcacgaaccacttcctgagctcgagtgggtcccttccatcatcgtgcctgcggtgacgctgaactggtgggagcacctggtgcactgccatttgtgggcatgccgtgcaccttggagcaggtgcggtttccgcatgcggggcagacgaagcctcgggatgcttctcctcgaggagcctcctctccacgactcctcgtcaggaatctccaggaactccaggagcgtgcccctgctctcgcattcttcctgctagtccgcctgcatggcctcgccattgcttcctgctcttccggatgcatcagccgtatcaatagatgtgagcggagcggcgacaggaattcctgcggttgcggagtcctcagccattattaggatttcttctgtggtcacgttgctgccttctcatagatatacgcactaaattccactgttgcattttcagaggaaaagtgtcgatacttgaacatacaggcagctgttatatctatcgaaagacctgcaaagcgttcgatggcagatcttgctgaactcgacaggtgagttgtcaactcgacatcctcatcaaggaactcgacaggctggttacacgcgatagacagtattggataagtttcacatgaaacattttggtgagctgctgtctctcatttgcggatcctacgtatgtcaatctatgggtacatgatgttctctgtttcagtggaacatgcaagaagatcagcagcacattcaattgtatcgaagcacatcatgagagatggattagataatgtttcacgtgaaacatgatagacagcatcttgagatctgcaattggtgaaagagcggcatcgctaaatgtttggagaacatacatgtttcacgtgaaacagaaaatctctgcagcgagaggggaggccttgctggccttctgagaaggtaatagtccatgtcggcaagcgaatgccgacgaaatggagccgacttgggatatcaggacaagagcgcttcaacaaagagaagcctacgtatgtcatcgcaatcatcaatcagaaaggcggagtagggaagtcgaccactgccatcaacctctctgcagcacttggcgagaacaagcgcaaggtattggttgtcgacttcgacccgcagggcaatacgacatctggctatgggattgacaaggaagagctcgaatacgatatctatgacgcacttctgaatgatcagcctatcgattccatgattcaggatacctgcgagccgaatgtctttgtcgttccggctaccgttcagctctctggtgctgaaatcgagcttgtgaataccgacaagcgcgagtactgcctgaagaacctgctcgaccagatcaaggatgaattcgacttcgtctttattgactgcccgccttcgctcggcctgctttccataaatgcgcttgtggcagcagactccatactgattcctatccagtgcgagtactatgcactggagggtgtctccaagctcatggagtccatgcatatggtccaggagcatctgaatccagagctcgacgtctttggcgtccttatgactatgtatgactcgaggacgacgctctcgaagcaggttgtcgacgaggtgcgcaagttctttggcaacaaggtcttcaagaatatgattccgcgttccgtgaagattgcagaggctccatcgtacggtcttcctatcacgatgtattcgcgtgtgaacaagggttctcttgcatatatgaagcttgccaaggaggtgacacgtcgtggctaggaaaggactgggccgtggcatcgaaagcctcatgggagaggccaacgctgaagtaggtcccgcaaaggctgatgcaacgctgccaatctccaagatcgagccgaatcccgaccagccccgcaaggagttcgatgaggagaagctccaggagcttgctgattccatcaagcagcacggcgtgctgcagccgattcttgtacacaagacgggcagcacataccagattgtggcaggggagagacgctatcaggcatcgaagcttgctgggctcaaggagattcctgccgtcatccgcgatatctcggatgaggatgtcttccagcttgctctgatcgagaacctccagcgtgccgacctcaatccggtcgaagaagcgcagggcctccgccagctcgttgaccagaaaggctggacgcaggagaaggtggcacaggtcctctccaagtcccgttctgcggtggccaatacgctccgtcttctcgatcttccggaagaggtgcaggactatctggcaagaggagagatcactccagggcatgcccgtgccatccttgcagtgcctgacgaagaaggccgcatcgcccttgccgagcgtgtcgtaaaggagaatctgacggttcgtcagacagaaaaccttgcttcgctgatttctgtcagcaaagaacccaaagctcccaagccgccgacaccgcagagctacaagcaggctgcgcgagagctcagggagattctcgacacgaaggtgcgtgtgaaagatggccgtggcgggaagcataagatagagatcgagttcggagatgaagacgatctggcacgcatcatcgaagcattccagcgtgccgcaggatcggagatgggggaatgatgggcaagttccgtcgtaccgttgtcgagtctgccatcctcgtggcaggcggcatctatatctaccgcaatgtcctgacgcctgaaacgaaggcaaagctttcaagcatgaaggatgcggtatcgggagcagtcaataagatccaggatatggtggctgcaagcaagccggcagatccgactgctgaagagaatgaggcaaaccgcgaagcggtcgaacggcagtgggaaagcctcggatactgagcgggtccaacagctaatgagaaggggtactagaacaaatgttctagtaccccttcacctatctgcagattctttactgaagctggcggtagtagttctgagagagctggccgcaggccgcatcgatatcggcgccacgggagttcctgatcgttgcctcgacaccgacacgtccgagctgctgcacgaactgctctgcacgctcctgggtagcgggcttgaatggagagccaggaacatcgttcagctggatgatgttcacatgggcaagcgtgccgcgcgtgaagtcgcagagggcaccaagctcgtcgtcgttgtcgttgatgccgtcgataagagcatactcataggtcggtcggcgtccggtcttgtcgacatattcgcccatcacctcatagaggtggacaagcgagtatttcttgacgcccggcatgagcttgttgcgggtgctctggtttgcagagtggaggctcacagcaagcgtgaactgctccggctcgttcgcgaagcgcatgatgccaggaatgacgccacaggtggagacggtgaggtggcgggcaccgatgccagcgccctcagggtcgttcaggcgcctgagcgctgcaagcgtgttgtcgtagttcatgaaaggctcgccctggcccatgaagacgacgctcgtcacgcgggtctggaagtcgtctgcgacatgcatgacctgctggtagatttcggaggacgtgagcgagcgggtgagtcccgccttgcctgtcgcgcagaaggcacagcccatagcgcagcctgcctgcgtcgaggcacagacagcaagcctgttctttgtcggcatgccgacgcactctgccgtcgtgccatcagggaactggagcaggtacttgcggctgccgtcagcagagatctggcgtgcaagctcgacagcgttgcccatggagaggcgctcttcaagctttgccctcagtgccttcgacaggtttgtcatctcgtcgaagctctgggcattcttctcccagacccaggactcgatctgtttcacgcgaaacgctggctctccgagctcctcgatgacctccgcgagctgcttgtgcgaaagcgtatggatatcgggacgtgcggcaggactctctcctgacgtaggacttttctggtttgaaaccatatggttctctcttctccgtttggtggctgaggagatgtatcctctagtaactcagtacattgtttcacatcttcgccctgctgctcatcagagcgtgagggctcaaaggagttcacatgacgagggatgaaatcaagcagctccgtgtcgcagtgctggctggcggctggtcggacgagcgcgatatctcgatggattccggaaggaactgcatgcacgccctcgaggaggcaggctttgcccacctcgagctcatgaatgttgcagatcccgacttcatctccaagatctcgtccggcagctatgatgttgccttccttgctatgcatggacgctacggcgaggatggctgcatccagggcctgctcgagatcctgcatattccgtatacgttctccggcgtccttgcctctgctctcggcacgaacaaggatgctgccaaggagatctaccgcgcagccggcatcccggtgcctgacggcacggtcgtcgaggcttccgccgcagacgatcctgccctctgccatgagcttgtcgagcgcttcggccttccgctcttcgtgaagccgtctgccaatggctcctccttcggcatctcccgcgtcgcagccgaggaagagcttgctcctgccatcaggcttgcgtcctccgagggcgacaacgtgcttgtcgagtcctgcatcgagggcaccgagatcacggtccctgtcattggcaacaaggagcttcaggcactcccgatcatcgagattgcctacgacgccgagttctacgacgtccaggtcaagtatgagccgggctcgctccaccacatcatgcctgcccgcctcacgcctgaggctaccgctatggcacaggagttcgcaaagcgtgcgcaccgcgcccttggctgccgcgatgcttcccgctgcgacttcatcgtccagaaggacggcatgccggtcctgctcgagatcaatacgattccgggcatgacggagagaagcctccttcctgatgccgcccgtgctgcgggcatcccgttctccgagctctgcacccgcttcgtggagtgggcactcgaggagcgttgatgtctggtaccgacgatacgtccgtcacgctcgaaagcctgctcctgccgaacacgcctccgagcatcaggaagaactatctgacccttgcccagcgcgcacaggaaaaggatttcggacctcttgaggaagacctggtggtgctcgataccgagaccaccggtctttccttcaagaactgcgagctcctggagattgcctgtgcccgcctctctggcaagaaggttgtcgaccgctaccataccttcgtgcgtcccaaaggcctgattcctcccgagatcgtggccctgaccggcatccatcagtccgatgtggccgatgcgccgtcgcccgccgatgccgtggcgggtcttgccgagttcgtcgggggagacctcgtccttgcgcacaatgcgaccttcgaccgcacgttcgtggagtccgtgccgggaggatcttctgtctccgacaattggatcgatacgcttgcgctctcgcgaattgcgctgccgagcctctcgacccataggctctctgccatggcccaggccttcggctgcgattctgtgacccaccgcgctatggacgatgtagatgcactctcaggcatgtggcccatcatcctctgcgggctcactgatatgccgaagggcctccttgccttcttcgcagacctccatccggatgccacctgggcataccgccccatcttctcctatctctcgggtacggacgatgcgacggcattcaacctgaagcaggtccgccgcaacctcctttccgaggtcacggtcgaagatcgtgccgatgcgaaggagatcgacggtccgctcacggccccttcggaggaagagatcaaggcagacttcgcacccgatggtccgatagctgccatgtacgggagctatgaggcacggcctgagcagcttgctatggcagaagaggtcagaagcgcgcttgcgacctcgacccatcgtgccatcgaggcaggcaccggtgtcggcaagtcgcttgcctaccttctgccggagatcctctttgcacagaggaacaatgtcacgatcggcgttgctaccaagacgaatgccctgaccgatcagctcatagcacacgagctgccggcgctcgaccaggcactgccggaaggcgtctccttccatgcactcaaaggctatgagcactatccgtgcctgcaccgcatgcagcgctcggcagaagaggatctgcctctcgatatggtgctcgacacgaatcctggacgcaccgccacgggcattgcttccgatatgctgacagctctggctgtggcctatgcctctgtcgcgcagtcgccggaaggcgatctcgacgccctcggcatccgctggagatgcgtgccgagaagcatgctgacgacgacctcgaacgagtgcctgcgcacccgctgcccgttcttcccacaggaatgtgtcgtctatgcagcaaggaggcttgctgcttcgggcgacgtggtcgtgacgaaccattcgctcctgctccgtgatgtggcttcggaaggcaggatcttgccccccatacgccattgggtcattgacgaggcccatgccttcgagtctgaggcacgccgccagtgggcagtcgaggtatcctccgatgatacgcgtgctgccttcgagcttctcggcggcgcaaagtcaggcgccatccacaatgcgatgatcaaggtcgcggcacagcctggctcgaccctggccctggggctcatcacgaaggcatctgctgcggtgcagcgtgcttctgtcgtgacctccgagctctttgctgcgattcatgacctgcaccatcttgtgaagggttctgcctacgaagggtcgaccctctggatcgacgagaaggtgcgcgcctccaaggagtggcaggccattgccgctgcggcaaaggatgcccatgagcggctcgaccaggcaggaaaggctctgtccgaagcccagacgacggtctccctgacctccgcccaggcaggaaacgagctcggcgaatccggcaggttcctgcaggatctctccgagagcatccgcctcatctgcctggagccagattcggcctatgtctattccgcccagctccagagcaggaagcgccaggggtcttcggagaagctcgtggccgagaagatcgatatcggccaggacctctccaaaaactggctgccggatacgatgagtgccgtcttcacgtcggcgacgatagcagtggggaagagctttgcccacttcaaccatgctgtcggcttcgaccggcttcctgagtctgcctaccgcgatgtgcagctctcgtcgagcttcgactacgacagcaatatggcagtcgtcgtggcaaaggacctgccgcagccgtccgatccgggctatctcccggcgctcgaggatgtgctcttcgatatccacaaggcgatggatggctcggtcttgacgctcttcacgaaccgccgcgagatggagaaggtcttcgaaggcctccagccccgtcttgcggagatcgggctcgatcttgtgtgccaggagaagaggtcatctccccgccagctccgtgagcgcttcatcagcgagaagtcgttctcgctctttgcgctcaagagcttctgggaaggcttcgatgctgcaggcgatacgctgcgctgcgttgtcgtgccgaagctgccgtttgcaagcccgcaggatccgctggtccaggagcgggaggtgcgcgagcagcgtgcctggtggcgctaccagctgcccgaggccgtgcttgccgtaaagcaggcagcaggacgcctgatccgtacctcgacagatacgggcgtgcttgtgctctgcgactcgcgtcttgtgcagaagcgctatggccgcgacttcattaactccatgccttcgaagacacggacgcagctcgagtgcgaacatatcggccgctatctcgaaatgtggcgctcctcgcacgagaagcagtagccctacatatatataagaagaagccagaagggctcttccccagctaggaaagctggtgaaggagcccttctgcatagctgtgcatcttctctgcgacctcttcgtcctggcagacgaccttgccggcgcatcctgcaagctggcgcggaagccacatggtgccgaagtaggggatgcgtccctgcacaggcttggcattcttcgagatcttgagccctggccaggcgaaaagcgaaaggtagtgctcgtccaggaaggtgagcttcaccatgcgtgctggctctgcctctgtcttggcaggggcgctgacaagattctcgggcacctcttcaggctccgcttcatccatgcgctcgatcttgaagcagcgctcttcctgcctgtcgagatcgaaggcgtcgagataccaggcgtcatccttctgggagagctcctggggaagggcatgacggtgtcttggtgcatcatccttcgtcccctgatagaggaaggagagcgcatgtccgtggatcatggccttcgagatggaggtgagaacgtcgtgctcctccggcgaggcaaggggctcgagctggcgctcgatcgtggcaggcgtgacattggcacggccgaagcctgcggcaatcttctggcgcagctcatcgtcttccggcacgccgcaggcattgagggctgcaagcaccgcatgggtctctgcaagcgtgaggcggagcggccttcccttgatgccgccatcgaaggcgagcgtgacttcgctttcatcatccggaatgcagagggagagataggttccttctgcatctcctgctgtgagcagcagcttgagataatgctcggcctctgcgtgcgagatgcccatgcgtgccgctatcgcatcggcggtgatcgtgtcgcctgcctgggtgagggctcctgcaagcgcgacaagctcgcgtatctcctggatgttgcttgtacgtccgctaggcatgggcaatcgctccttcaaggcaggctttcgcagcagagatcagctcttctggcttctgggggatgagtccctgcgctatgccccaggagtgcagaagagaaaggcagcaagctcgagggacccaggacctaccggatcgaccgcatggaaaagccgaagatcctctccggcagaagctatacggtgccggacagcttcgagatcgaggactgcgggctctccccttcagatgggaccagcggtcggaacggcagtctttgctgctcggcatccacagccagacctcatctccctcatgaaggcgcatggcacgctcgaggaagaagaggatgggagctccatctggcatgttcccgccgctcctgggaagcagcagcc

SEQ ID NO: 111 - DNA, 36711 bp, Unknown
  Metagenome-assembled genome
gctaaagcgcctgtcgctttcctcccatatctagcagatggcttccttgaggggaccccataggtcctcaccgcctttggccttgagccatctgtagaagtgagccctgctcacctccagtacgcgcgccatcatcgagacgctgtaggttgccctcttggccagcatgagctaaaacctgtccttcaacagaggcttccggcgaagaaggctgccactttttaggaacttattctcgctttcgagctcgtgcatgcgcctgttcactgcgtcgagctgcttgtgctcgtcggtcctttcctgggtcacccttttggtctttgagtgcttgatgatccagtcgtttaaggtcttgtcgttggcctcaagcttcgcggcgcatcctctgatgctcttcttcgggttggccttacgtgccttcctgtagtagtcgatggcctcaaggcaatacttcttcagtgtagtgtttgggtgtttccggcttcgtgcgggactttgccttctctatctcgcttgcgctcactgacatctcatctcttcaatctgttggtgttggtaggtgggtatctggacagagcatatctgctgccagtccctgaatcccactgtccaccaaaagattacagctcaatagaccttaagatggggcatgtcctgtggctcgcatactccaagaagaagcaagtcgtatacgacttgtgcgacttcgtcggggaggaatggatgtcgaaggtggaggccatcgcctgcgacatgaacgccgacttcgagcgggcattcctggagaggttcccgcatctctcggtcgtctacgacaggttccacctcgtgaagaacttcaacgagaaggtcatctgtaaggtcaggaaggataagcaggcaaggcttaaggacgaaggcgatgccgatgcggcgcgtgccctcaagcattccacatacatcctcatgtccagtgaggacaccagcaagaggaaggaccaggatgcacgtgccggcaaggtcgtcttaaggggaagcgccctcttcggaaagcaggaggccacccagaagggcgacagccaccagaggtacaaggacctcatagcccaaaacgagctgcttgttgcctgcgacatcgcgggtgagatgctctccagggcctacggctacagacagcagaagcgcatgcgcgatgcgatggagcagatagtggaggtctgccggggaacgaaagacaggcacttcgctaaggttcgccaggctcgtggagtcgcacatggacggcatcgtggcgcacgccaggcactggatcatctcaggcaaggtggaaggcacgaaccagatgatcaagacgctcaggagggcaggctagggataccctaacgacgagtacttcttcctcaagatcttcgataccagcaggcgctactcggagccttccggagccggtgcatgatggggctgcccacaggaattaggactgaaccggcattaatcatcgtttccctagtacagtttctggacagatgggcatccatctgccgtatgcttgtcaggaagatgagtagaagctgcgagaaggggagcccatggacttcgtatccgacgatcagatattgctcggcagggaagcggaaagccgccatgagctgctccgtatgctctgtgcataggccgaggccctgggcatcgttaaggatgacgaggaagcatatcaggccttccttgtaagggaagagctcggtacgaccggtctcatcgaaggctttgccgtgccccatgcaaaggcaaagacgatctagaggccttctgccatggtatggaagaacaagaccgccgtcccttggccttcgttcgatgagaagccggtcgatatcgcggttgcccccttcctgccggaagcagacagggaagagcatatccgcctgctctcgaagaccgctgtccttctgatggatccagccttccgcaagctgctccgggatagcgatgacgcccatgcaatctcctctgcaatctcggaggtgctggcacaggaatagctgactgctcagtgcctcatctgagcgatatgctgcagatgaggcacttcgttagatcaatgacgtggacgctgcggagtcggacgggacggcagagcaacagctgtatcaccagctggcgatgcaagccttctttcataaccggtgaatgcatcgacgatttctcgtgcgacgaaaaggctgttcttgcgattctttgaattctggtacaggattcctgcctcgctgagtgtggctattgcattccttgctgcttcagtgcttctgccgcacagccttgcggcagaagtgatgctgatgacgggatttcctatgagcttgggaagaagcagatctgctgctgagtttgctcggggatgcactctttctcgccagcctaagagtattgattcaagcgtgtcgttgaaatcatgtgcacgcttgcatgcaaggctgcaggaacgtgcaaaatactcgatccaatcgctttcgcacaatatccttgtgcgtggttcttcggcgttctcatcccatcggtatgctgcaagattatctatatagcgtgctttgtcggttgcaagaatcagagagatgggtggaacgacattctgagcaaggccggatctgcgcagaattacttgaacgagcgtacgccctgttctcccgttaccatcagcgaaggggtggatggtttcaagttgtgcatgcgcaattgcggcaagggcgataccgggcatctgcgcagtcgaaatgaattcagcgagatcctcgatgtaatccggcaccagttccgggcgtggagggacatagggtgcaccgattggattgacgttgttgccgccaatccaattctgctgtgtgcgtattacccctccgtaatctgcgagatcggtatgctccagcagttttttgttgatggaacagatgtcgcctatatcgaaagagggcttcatggagagcgtatcgatgctttcctccatggatgagatattgccgaggactgccgcctcagtgctgtctatatggtgcgatacaccgagttcgtccaatgcttcatattcgagcagctttcctgcacttatttggagaccttcgattttcgaggacgctacagcttcggcccggagaatgagccgagctattggctcggtatttgtcaagtgaggcgtcgtgagatcgagcctctgtatatctgcctgagcttgggcggcggcttctgatgcttcgggcgtcagcagatggtcggtttcactgagcttgtcgggaataaaaggatgataggctcccgactggcgttcgcgcctgttggcgccccacgtgtcgcttaaccagaatcgcgtctcatagtatcccatgccggctcctcacggtatatcaacaaagaacctgagcagttcgggccgcttgcaataaccttggactcgaaccttccaaaaacaaggttaatacaataaccttgcttataagagctttgtaaacaagatcatcagataaccttgttctcccatcaacctcagccaaggttattgcgcagctccgcagcaggacttgactcaggagatgaagttcgtggccgcagagccagtgcgctctgcagtagtgtggccttctccccagaccgtcgcgaaatctacatcctggacatccggattctcctcgagcatgagcgcgagatcgagctcggtcgtgagcgaggtatcgccctgctcgatgccggtgcggatataccagtgcgggcagacggtcgaggcgccgtagccgtcgaggctctttgccgcaaagtagagcgggttgtacatgttctggcgatctgcgctcacggtaccgagatcgtcgggttatgtttcaaaaagtgtgtccggattgattattcaccgcctgtaattcgtgggcatgtggaactcgctccatactatccccgtgccgtattcttcgggcgcgccgtcgtcgtgtttcttgtccgatgatgctgtcgcgaacaggccgtcgacctcgtcatcagttggcatgacgtggatgatatccgccggcggaagcgggctttccgtgtgcatgtagcaccaccaaaagatcgccttgacacggtgcaggagcaaaaagcccgcggtggtgcctgaacacgtcttggagcctggcgttcacgctctcgaccgcgttgttggtcgaagaccactcgccgccgtattcctgctgcatctcgacgaacgtgaacagcgtcccatccttgacgagcttgttcaggatccttctcgcctcgcgcaggcgctcgtgggtgtagaccctcctgccgtccttgacggtgaactccttcagaaacgtcgcccatttagtgcaccatgcgctgtactccaggagccacaccgtggcgaagccggcgtccttgaggctgttggcgatgcccagcagctcgacccccacctcgagcttgggcttcagggtcgtgcagcgcttgacctggtcggccacgtggaaggtgcatcgctgcacgttcgtgccgggccacacctcccttaccgccgcgaagagcggcgagatgccgcagatcgccgtcctgggagcggagatgcacagcatcagcgccgcccaggcgggtccgcactcgcttcgcgccaggtgccccagccgacgatatggccgcccgctacggcgaccagcacggcgaccttcctgcgaagccatatgccgtccaggaaggcgacgttgtgaatctcgccgctgccagacactatcggccatatcctccaggcccacactgtcttgtgccaaaacgtcgatctgctggtcttcagatccgctatcgcgtcctttgagagcagccacctcaagaaggccgcgagctactccgtggccttatcgtgcctgcgcacgaacgaggcaccgcagccgctgcggcgccatctctgcgtgcccgccttcgtcgccttgttcttcttcatcttggctttgcacgaggggcattttggattgctcacggcccgctcccgtctctagggaaacgatgattaatgtcccataacgtgttagaggggaccgaccacacgacttttctaggccggtatgcgggaaaggcagggaaggatgctcacccagcacgtgcagaagccaccatccttacacctgtcctgcaccaacgccgcaagaaggctccaagacggatcaagcgactctgggagccgggaggtgcagcctgccggcaaaagatgcacatgggtaaggtttgcaagggcgaagcagactcgagcatacaggaggtcttctctatcccctagtagcgcttccttaaggggtcgaagcgccgcttcacgataaggaagggatgcttctgcctttaagcggccggatgccttcttggactcgatacccttctcggatgcgagcgcacaggcaaggccttctatggtcgaaggcttccttagcaacgctttagcgcatagatgagaggtgtgggtctgctgtgaccttaagggcgcttcgctataccggtatagccggaatctgcatagcagaacctgtcatcttcccttacgagtgcatgtgccacaggatatgtcggatacattctaagcgatcgtctctacagcatgcacaaggccacctgcggcatccacgccgatatgcgccttgtatcagatacgccaggctccccctttcttggactggtgcgctttaagggtcgcgcgcatggtcgtggttcttcgtgaagctttagggcccaggtgaaggtcgcatccaccatggagccgccttgcaccgtgatccctgccttcttaagttctaagttcaggcgcaaagcatagccttaccgaactcctcttgctttaaggctatggcgcatcttcgcaagtgtcgttgcatctggcacccgcgcttgcatgaggtctgcgtgcacagaagcgctgctaggagtgacaatccaggatagcatccttaagttccctcgtcttaagagagcaaacatgacctgcagcagatacattctaagctttgtctttgcagcgcgcacatgcctgacaagaacctgtcagtggtagctggtatctaccagtgcaatccagctgtcccacacaacgattgtatccatccgctccaggaatgcctctcgccgggtctttctcctcagaccttaggatttaaggtcctaaaagctcatctatctgtctatatcttccttttggatattgctggaatgtgtggatgtagctataccatatccagaaagacagataggcatctatgcgggtatgggcactgcgtggttcgagacattttaagctggcggcatacagcgtgcagctccagcgatctcatcgagccgaattaatcatcgtttccctaaaggaaaatcaggaggcatctggataccatcgtcgccaccttggagagcggcctgtccaacgcacgcgtggaggccatcaacaacaagatcaagctgaccgtgaggatggcctatagctttcgcagcctcgacaacctcttcgcgatggtgatgctcatatgctcggggcttcagatgccgctgccggggagagcctagcactcacatatcggttcacacattgtgcagatgactcttaaatattcgctcgtctattccggcaaagctcccgttttgactgaggatgacattttccgggcgcacgtctatctgcctgagcctcatgaggagaaggggagatctcacgatgaggtcattaccctgttgcttgatgcctatggctatgtaacgacttctatcgttgcagctgcggcatctgtctctgagaaaacggcacgtcggcatattgcccagatagtatcagatggagacatctttgcagaaagcggcgggaaaaaccgtaggtatgtaaaacaaaggtagccttcttgctatcacttcgtgctgcctttgtctgccgaatgggcagtaaagcatggcaatgtgtccagacgcgctagcgctgtcctttgtccttccagggatgtgatgtcaaatgccatcccttgcagtatggacagcggtagacttcgaggccatacgttccatgttgtgcacagagtgcagcaatctcttccgcttcttgacgggtggcatagcgctgcttcgagaggcaggccttcatgaggcgtgcttcttccttctcgtctcccgctttgcgctggtgtgcctcttctttggtaaagacatcgtccatgctgccaaggcttgaaagaaatttttccctctcctttgcacgtgcggagcgcttcctgctacccatgatacctcccatcttttctgagggacttgttgccgaaggcggacactctatgcatgaaacagggctgattcctccaagcgcccacaagaagaggtcagcttgcctgatatgcagagttcctatagtaaggaagcattgtggagcattgatactccaagggtgtatcgggtggatagagggcaatagaaaacctggcagtgtgctgggacatgaaggaaataggagaacaccctggcacagaaggccaacagcctggcgcatacgaaatgggtgtgcaggtaccacatcgtgttttgtccaaagtataggagaaaggccatctacaaccaataccgcaaggaccagatcttcaggaacctctgccagtagaaggcggaggagataatagaggggcacctgatgcccgactacgtgcacatgctggtgagcatcccgcccaagatcagcgtctcgagctttgtggggtatccgaagagcaaaagctcgctgctcatgttcgacaagcatgcaagcctcaagtacaagttcggaaacaggaagttctgggcagagggctactgtgtctcgaccgtcgggctgaatgaggccacgatcgcgaagtacataagagagcagcaagccgccgacatcgcccccgacaagctgagcgtcaaggagtacgaggacccgttcggcaggaagtaggccggcacatgcccgttttgacgggctggccacgagtcaagcggccatgcggcctgaacgaagcgaaggccagggacttgagttcctgaccggcatttatagggctatacccttagagcaaactactcgctacgcaggtggtcatgattttatccgagagtaggggagcgtgtggataggatccctcacctgtaaccctgtggtgctaccattggcgttgccaagcatagatttgcccaagtggctatctggccctatgtttggcgatattcctgagcggatggccgcctgcgtggataggaaatccgccatggttgctatcaaactcctacaagggcacggtgtcgtccttcggcgctgcggttgtagaacgcagatgtcgcaagacggataggcgcagaaacgctcgaagaggcgaccgagttgtggcggcctcatcctgtttgccacatttgtaggtttgccaaaagctggaaagacaagcagacactgccggggcatcaaagatacacagccccactcttagcgctgaaatacgctgagaaggaacttttgagctggaagtgccccatcacctgtatgtgctacactacatccttcgacctcatctttgagatgtgtgacctcacccacacgagtgccttcgtgtggcaccacagcggcgctgccaccaccgacggctactagaaccggctcgtgttgtgcggccacatctggacagacaagccctacctcaccgactccgacattgtgcagaagagcgggccctccaagaacaagatctgcgctacggcaggcatcgatgcactcaagagcgtcagtgtgatcttagggcatggaaagccttcttccaagcgaatcgaagacacactgctttcgtatagagcagaaggttcaatagtcgtgcacacataggtctcatctctcacttgtgaaggcaaccgaatgcactgacgaggcctatagggtagacatcgccgatctgacatacctgcacaaggccatggggcttgcaaacaagctgtgctgctctacctattcaggttcccagacacaaagaaatccagcctccagtcttgcctgaataggttcgtgtcgctgttctgtgtctgtcaggacgcaaagaggtagcccaaagctgcgagggtgcttcgccatttgcgactgtcgcacatttccgcaactggcggacctatctttatccacacgcttttctacgtttgggattttattaccaaactttgatcgcgcgccgctgagctgccggctcgatcgtgagcttgccggttttcgcctcagtgaaggtggaatcaaccggctcagcgtcgacggcgttcgctaaggttttgacacacaggcttggctggttattctcctcagataagtgcagggcgaccacgtagcgcgtgtcatcgctgacgaggttgaccagggcgtcggcggcctggtcattggagaggtgtccatagttgccgccgatccgcttcttgaggatcgcggggtaggggccgtgggtgagcatccccttgtcgtggttggattcaaggcataagatgcggcagcctgaaagcgcctgctcagccggtggggtgaggtagccggtatcgctgcaccaacccaaggcatcctcgacagtatccgcaccgtctctgacctcgaagcggaagccgataggatccaccacatcgtgcgagatcgggaagcactggacatgcatcccacagagatcaagtccctcgcggttattcaggatctggattggcaactccgagaggacttcgcttgcgcgtgaggtccgcttcgtcgcatagaaggggcctggaaaatggtgtgacagaaccctgaggcctttggtgtggtcggtgtgctcgtgggtgatcagtaccgctttcaaatcagagagcggggcttgcacctcgtgggcccgctgtttcagtgctttgaaggagataccgtcgtcgactaaaacggagccttcgggaccctgtaccagcgcggagttccctttggagccgctcgcgaagacaaaaaggtgtattaacggagtcaatgcattaccagatctctcagatacgttttagaattgttgtgtgttactaactttagcgtacacaatatatagatgatacagattatatacagatacgtaagtgaggaatggaatggcgagcgtaggcaagcgatttacagccggtgtgccaaatgaccttacggaggcgcagcgcagggcgccggttgtcctgatggtttcaggcggggcggactccacggcgctcatggtgctcgcagcaacctcaaagctggatatcaatgacggggcagggaccgcccgtatcgcacgggagcggctccacgtcctgcatgtgaaccatgaactgcgcggcattgacgcactggaggatgaggagttcgtccggggactcgcaaaacgctgcggcatcccctgcacggtgcgtcgcgtagatgttaaggctgaggccgcccaggaggacaagaacatcgagagcgctggccgtcggctgcgctatgcctatgcaaacgagcttgccaatcagctgtgcgctgagttcggggtaccccgttcaaccgcccgcatcgtgaccgcgcataccgccgacgatcgggcagagaccttctttatgaacgcgatcaaaggtagcggcccggcgggtctagcctcggtcccacgggtgcgtaaccggatcgtgcggccgcttctggacagaacccacgaaagcctctgtgacttcctgcggatgcgcgggattgtctggcgggaggacgagaccaacaatgacacgcactatctgagggcctttgtacgccatgaactcatgccccgcatcaaggagcgcaatccccgcgtcgtgagtaacctctcttcgacctgcgacattttgtccgacgaggacagtttcctcaccatggtcgctaaccggacctattgcgacctggtgcgccgggaagcggatggaatggtcaccctcgatgcagaccgtctcgaagccaccgatgtcgcaatcgcacgccgcgtgatccggatcgccttcttgcatgtagcaccggaagcccgccttgaggcgcgccacgtggagagaaccttggagctcatcgcccgcagaaagggctcgcagacgatccctttgagcatcgacgttaaagtcgaatacggcctgttgtttatcatgacgaaaagggcacaggagaaaggtttgagtggctggctgccagttccgggttccctcgatctgggcaggggtaagacgctgactgccaggctcagcccagtgccgcaggggtccgatccgatcgcgctggccaaagcgcacggccacgagtgggccggatcctcggtcctgctcgatgcggagacctgtggggttgccggtgccggtgccgagctttgggtcgagcccccacaggcgggagaggtcgtctgcccgctaggcatgcagggacgcttaaagaagctctctgacctgctctgtgatgctaagattccgactgctcagcgtaatcgtctcccaatcgtgcatctttctcccacaggtcctatcatctgggtaggagggttgcgcgcggatgagcgctaccgctgtacgcatgcgacaaaagtgctcttagagctccatattctctaggacgcacacgtaggttggctcacggcacagataggagttagcagccaatggaaaccatacatccggatgtcgagaaagtactcttgactgaagatcagattcacgagatagtgacgaagctcggcgatcagatcaccaaagactatgcgggcaaaaatcccctgatcgtctgtatcctgaggggggcgtttatcttcactgcggacctgatccgcgcgatcaaagtcccctgcgaggtggactttatggctgtctctagctatggctctgagtcccaaagctccggcgtcgtgcgtatcaccaaagacctctcgactaaaatcgaaggtcgcgacgtgatcatcaccgaggacatcctcgattccggcctcaccctctcctatctctacaatctcctgaaagcccgcaaccccaaatcgatccgcatctgcgtcttcgcagtcaaggacatcccgaacaagaaggctgcgatcaagccggattacctggggatcaccgtgccgaatgcctttatcgtgggctatggactcgattatgcagaaaaatatcgtaaccttctgtacctaggcgtcttgaagccggaggtttatagctcgcagaaggattaagtgctgatacgtcttctgtacctaggggtacctaggcgttttaaagccggaggtttatagttgatagcgcacgagtgacagatatctgacgccccggagcgtcccagaggagttattgagtgaaacataagaacagaccgagcggtacgcagggaccgcatcggtcaccccatgatcctgcctcgcggagggccacggttatctctgcaactatcttcattgcccttattgtcgtgattgtcctcagtgcttcaggtgccttttcagggcaccatgcgaagagcatcaccaccagtgagtttctgagcgcggtagaggaagaccgcgtcagctctgccacctattcgaccgcatccggggagctgaccggcgactactgggagtccaccgacgatgtcggggatcagagcaagcttgagcagtacaagtccacctacgtggggactgacaacctcgacaacctgatgcagacgcacaaggatatccagttcaatgtgaataccgattccaacgatatgctggtatctgccctcttcaacctgatcccgacgctgttgatcatcggcgtgatggtctactttatcaaccagatccaagggcagaacaaccaggcgatgtccttcagccacacagaggcgaagatgaccgaagcgcagcgcccgaatgtgacctttaaggatgtggcaggcatcgacgaagcggtcgaggagctcacggagatccgtgactttctgcgggatccggaccgctaccacaagatgggcgcgcgcatcccacgcggcgtcctgctcgtcggccctccgggaacaggcaagaccctgctggcaaaggctgtagccggcgaggctggtgtccccttcttctcgatctccggctctgactttgtggagatgttcgtcggtgtcggcgcgagccgtgtgcgcgatctcttcaaacaggccaaggaagccgctccctctatcatctttatcgacgagatcgatgcagtgggccgccagcgtggcgcaggcctcggcggcggacatgacgagcgcgagcagacgttgaaccagctcctcgttgagatggacggctttgaagagaacgaagcggttatcctgatcgcggcgaccaaccgtccggacattctggatccggcgctgctgcgtccgggccgttttgaccgccaagttaccgtcgagcgccccgatgtgaggggccgtgagaagattctcaaggtccacgcgcagggcaagccgctcgacaagacggtcatctttgcgagcctagcaaagatgaccccgggctttaccggtgcggacctcgcgaacctgatgaatgaagcggcgcttttggctgctcgtcgccataaggctgcgatcggtgaaggcgagatcgaagaggcgatggagcgcacgatcgcgggtcctgagcgcaagacgagggtcatgacggaacaggagcgcacgaccatcgcctaccacgagagcggccacgcgctcgtggggcatgtgcttgagcgctccgatccggtccacaagatctcaatcgtgagccgcggccaggcgctcggctatacgatgcagctgcctaccgaggaccactacctggagtccaagaacagcatgcttgaccagattgcggtgctcttgggaggccgtaccgccgaggagctctgctgcagcgacatcacgaccggtgcctcaaacgatctggagcgcgcgacaaagctcgcgcggcagatggtcacccgctacggtatgagcaccgagcttggagcacaggtcttcggcgaagcgcagcaccaggttttcctgggccgtgactatgcggatcaccaggactactccgcgcagaccgccaagcgcatcgacgacgaggtcgaacgcatcatgtgtgaagcgcacaagcgcgcccgcaaggtgctctccaggcgtaaggaccagctcgatctgatgaagaacgtgctgcttgagcgtgagaccgtgtccggagacgcgctggaagccctcctggataacaagtgggatgcataccttgaatctcatcccaaggaagccaagccggcgcttgagagcaatcagggtgaggatacggccgctgagcctgactcggctgggggcgagtaacagcatcgcatcaacgcatgagcctcaaggcgcctttcacggactgtgggaggtgccttttgcaaaggttgtattaacgttcgataatagtgtccagttgcgggctgtccttgccctatatacgatagaaaccaatgggttttccagtcgctaaagaaggaatcgaatatggacatcaatgaacaaagttacgcctatggcgcttcaaaatcgaccatccgtgagattgcggcctacggcgcggcacgcaaagccgaaatcggtgcagacaaggtctttgatttctcactcggtaacccttcggtaccggctcctgaagaggtacgtctctcgattgagaaggcgctgacacttccggcggtacagctccacgggtatacccctgccgcaggccttccggttgtccgcgacaccctggcaaagagcctcaacaggcgctacggtaccaactactcagctaatgacctctacatcacctgcggcgctgcagcagccctcactatctccttccacacgctgtgcaaccccggcgatgaggtgatcgttatcgccccatacttcccggagtacaaggtctttatcgaggctgctggcgcccattgcgtcgaggtactggcggatcagaagactttccagatcgatgtggaggcggtcgagaacgcgatcaccccgaagaccaaggccgtcgtaatcaacagcccgaacaacccggtcggctctgtctactctgagcagaacctcaaggatctggcagaggttttgaccaatgctgaccacaatatctgccttgtgaccgacgagccgtaccgtgaaatcgtctacggcgccaaggtgccttgggtcccgagcatctatccgaacacgatggtgacctacagctactcaaagagcctctcgcttccgggcgagcgtatcggctgggtgctggttccggacaccaacccgtttcacgataagctgatccccgctgtggcaggtgccggccgctccctcggctttgtctgtgcaccggcgctgttccagcgtgtcattgcagactgctgcgatgtgccgtcaaacgttgaggcgtatgcaaagaatcgcaaagccttgactgagggcttaagtaagctcggctactccttcatcgagccgcagggtgccttctatctgtgggtgaagtcactggagcctgatgcgaacgccttctttgagaaagcaaagcagtttgagctgctcccggtgccgtctgactccttcggctgcaagggctgggtccgtgtcggttactgcgtcaactatgagaccatcgggaactctatgccggcgtgggaaaagctcgccgagcagtactgatatggcgaacaagcatcaacgcagctgtgacacctgcatgttcggagtggagcgaagcggcgtcctgagaacgaaaactgtgtgcatgtccaaggatccgaaggtggatccaaagcacaacggggccgcctgcagcgtgtacctttcaaaactgcaggagcaaaacgccgagcgggttgtgaccgccgtcacgagttgggcgaagggcgaagcccccagcccccgcgctgtactcaggggtaccccgcagaaacagagagctgcagagcatccggactactcaaagctcagtcccgatgagcttgcggtgaaggcggcggaggccaaacttgaagccgcggaggcgaaggctgccgtagcggatgcaaaggccaagctcctcgagaaacagctgaaggctgcacgcgacagcgaaaacgatacgaagcaatagattttgaacagtgcctcctacggatcaagcgcggagacactgctgatgcctggcagttagggtggttgattccatggaacttgcatgtgacacgcatacccatacactcttttcccgccatgcctactcgacgatccaggagaatgtcgcagcggcgcatgaagcgggacttgagcttttaggctcggcggaccacttctctgcgatgttgttcaatgaggtgacattcaagaactaccagtactttatcaatctggacgcctggccccgggtatggacgcagtacaacgtaatcctgctcagagcctgcgaggccgacattgtggatctggacgggcatctcttcggttgggaagtgccgatcaccaaagggatcaatgggtcaaagcggaagccgacgaccctgaaggataggatcttccgcgggctcgactacgtggtcgcaagcgtccacaatgctgactttgcccgcggcgcaagcctagtccagaccacggatatgtacatccacgccctgcaggatccgaaggtcgcaattatcggccatccgggacgggcaggggtcccgtttgatcttgacgcagtgcttaccgccgcaaaggatctaggtaagatgatcgagatcaacgagcactcctttgaccacgcctcagagaagcggatccagcggtgcacaaaaattgccgagcgttgtgcagagctcagtgttaagatcgcggtcaacagcgatgctcatatctcctgtgagatcggtcagcttgacagaacaaagcggatgcttgagcagatccacttccccgaggagctgattgcaacccgttcagcgaaggcttttttggatacgttgcgggaagctcacgtggcggatattaccttataaggcgatatccagctcgatcgggcagtgatcgctgccgaagatctcgtcgtggatcgcggtgttgcacactgccttagctgcattgtcagagaccaggaagtagtcgattctccagccgatacccttctggcgtgcacgcatccggtagctccaccagctgtaggctccctcgagtgtgggatgggcctcacggaaggtgtcgtggaatcccgcgttcagaaggtcggtgaaatcggcgcgctcctggtcggagaagccggcgttttcgtggttggtgcctgggttcttcaggtcgatctcctcgtgggcgacattgaagtctccacaggtgacgaccggcttatccttcgccagcttggacaggaactcacggtagcacttgtcccagaccatccgctcatcgagtctggtcaagccctgcttggagttgggcgtatacacgtcgacaaaccaataagttgaaaactcgagtgcgcagaccctgccctcgtcctcggcgacaggggagccgatctcacggatcacctgcagcggctcttcttcggagaagactgcggtgccggagtagcccttgcgtgccgcatagctccaggtttgggtgtagccgggtagtttgaggtcgacctgcccctcctggcacttcgtctcctggattgcaaagatatccgcatcgaagtcactgaagatctccatgaagttcggactcttcttgaggacggcacgcaggccattgacgttccaggagatacattttttcaccgacggttcactatccatatggttcccctcgatcaggtaacgtgtatatatgtgtggtcccctacgcctcaaacagccatttttgccacgtgggccagtcgttgaggccctgtgtgtagcccttgatgtaggaatcctcgagcttttggcggttgttcgtcgtgttcttcacgggcatctcatccgggtagaccacgtaggcgatgccctgctcgacgagctctctcagtcggtcaagtgaggcgttgtagcgctcgttgcgggtgaccagtgcctgatagagtggctcgaagtcccgtgagactctggcgtagaggcgctttaaggcacggctgaccggcttcttgcggtagccaaagggacgggtcgccagaacaaagacccgctttacgccggtgtccctgaccatctgcagcggcaggccagctccggcaccgatcccaccgtcgaacatcgtgtggccgttgatcttgatcggattcatcatacccggcaaggtcgagcttgcccgtacgtgctccatcatcgaccgcaatgtcggcatatccttcttggtccacaccgcggacttgccggtatccgcctcgaagctttcgattgcgacgttcgccgggttttcgcagtaggctttccagtcaaagggcatgtagttatcctcgatgcagcccatatagtcgtagtccgcattgaagtagccgttgccatggaggaaagaacggatgccgcctgactgtggcttgcggtcggagagtgtgataaacgaatcatggatgcgcttgaggtcgcgtgagacgtagtcgaccgtatgggaggccccggcactcacgccgcacaccacgtcgaactgaaccttgtgctctaacagaacgcttgcaaatcccgcagtatagctcgctcggtagccgccgccttcaaagagcagggctgtatcgggaacatgggcgagatgggtttcggttggtatcatttgtctcatacctttcagaacaaccaaaagaggtactcagcgcagcttggtataagctagaggagcattatcaactgtaaaggaaaaggggagggaaaaccatgggtgactatataagcgatccaggcaaagcagcgcaaacgctgaaagggctcatcgataaagcgcacgatgtcgtcttctttggcggcgccggtgtctccacggccagtggtattcctgattttcgcagtcccaatggtctatataaccagcgcggctacaagtatccgcctgaagagatgctctcacacgaattttatatggaccaccgcgaagagttctttgatttctaccgccacgtgatgtgcgtcccgggtgccaaacccaaccagtgccacagaaagcttgcgcagctggagcagcaggggaaaatctcctgcgtgatcacccaaaacatcgacgggttgcaccaggcggcaggctccaagcacgtgatcgagttacacggctccacgcaccgcaatatctgccagacgtgtggggcggtctactctgaggagtggatcctttcaaccgagggcgtaccaaaatgcccgaagtgcggtggcgtcgtgaaaccggatgtggtcctctatggggagaacctgaaggaggagaacctcctcggggctgttaaagagatcgcggcctgcgacatgctgatcatcggcggcacttcgctcgtggtgtatccggcggccagtctagccaactacttcaacggtgacgagctggtgatctgcaatttgcaggcgaccccacaggatcgctcagcggatctggtctgcgcctgcgatatcgccaaaacgtttgatttctgaaagtttctgtaatgggcagttgtgtatacaaccattacaatcaaagtgctcaacgctttgtttttttatgttcaggaggatttgatgctcagagaagactatgccacatggacgtgtgcaggacacgagatttctctgactcgcccacgtattatgggcattctcaatattaccccggattccttcagtgatgggggatcctacgcgaatgtcgatgaagcgtttgaggctggcatgaagatgctcgacgacggggctgacctcatcgatgtcgggggagagtccacccgtcccggcgccgaggcggtggagccttcagaagagctcaggcgcgtccttccggtcgtgaagaaactggtcgcggcaggggcctgcgtctcggtggatacccgtcacgccagcgtggcggcggcggtcctggatgcgggcgcctcgatcatcaacgacgtcaccggcttcactgacccggcgatggtcgacgtcgtcgcagataccgactgtggcctgatcgtgatgtactggaacaagatggggctcgggacgcatgcgacccgtcagaccgtgcagctggatgtcgatcggccgaaccggccgatcgcccggcgcgtcccctcgatgcgccgcttcacgatgcctgaagaggccccgatcatgcgccaggttatgggttttctgggtgaccaggcccgcaagctgatgcgggtgggcatcagccacgaccgcatctgcatcgacccaggtcccggcttcgataagttcgccgacgaggacatcgtaattcagcgcgccacgagcaagatggtgagcatgggctacccctacctgtgtgccccctcgcgcaagcgcttcgtgggcgcggtctgcggcgtgagggacgccaaagcgcgcgacgccgcgacgatcggggtgtgcctggccgcaatcgaaggcggggcacgcttgctgcgcgtccacaatgtggcggtggtctcccaggcgatcaataccttctgggcggtgcgccacccggactcccgtcaggcctttatctcgctcggctccaatgtgggggacgctgagcaggagatggacacgatggcaaaggcgacccatatgatcgacgagttgccgatgacatgcgtggtgaatgtcagcaaagcctatgagacggagccagcctacgggatcgcaacgcccgtggcaaatgccgtggcagagatcaggacggagctgcatccactcgtgttggtcgataagctgcttgatatcgagaccaagctcggtcgcacccgtgtagagggcgcgaccaaacctggaccgcgcacgatcgatttggacctgtgctggtatgagggggaagagcacgccggtagaaagctgaccctacctctcaaagggttgggggagcgcgactatgtgctcgtgccgatggaagatctgatgcacgacccggtacggttcttaaagcacagcggcgtcgacgtggtggcgcctgagaagcgcgtgggccgcatgaaaggcgagctcggcgtcttaggttgggaggatctgaggtagcgatggcagatcttcaggagatgtccggcggcgtcgatacagctgagctgcagaatcgtgcctaccagggagccgacgagggaagcggcgcattctcacgggtccaggaccagggagatagtatcgagtcgcttgaggttgcctatatcctgcgccctcaggtggcgatgggataccttgaaggtcttccctacgtggtgagcctcggtatctgtgaagccctcgatagactctgtgcagatgagatgcgcatcggctggccctatgcggtagtgcacgacactagaccgctcgtgagccttgagacccatgcagggtatgggaaaggcgggatctttgcggtcgcgcagctgaccttgccgcttaaagcgctcgatgagggtacgcacgcctgcgccctactagaagagtgcagggtgcagagtgacctttcagaccgtgaacttgccgcaacgctcagagatgagatcctctccgcactgcgcggctgggaacagggattctcacagggcggtgccggaccgcttgctccggtattgaacgattactttgatgcgctcgacgcaatgggggagcgggtggagatccgctatccgaacggtcgcctcaaggctcagggacgcttcgcgggcgtcgatgtctggggcagagcctcagtggttgccgacgacggcagcgagatcagcttctctcacgaggaagcctcaatgcgccgggctcagcattagtcgctgtttacagcctcttgatcgtgccagatcgtatagatgccccgcagcgtcagcgaggggtcgacctcagtgaagaggtcggtggctctgctgatgacggtggagaggccgccggttgcgatcaccggtgcatcctggatggaaagctcgtctttgatgcggcttaccaggccttctatcatgcaggcggtgccgataacgagaccggactgcagcgcccctttggtgtcttcaccgagcgcctgctttggggcttcgatcgggattgaagcgagctgcgcggcacgctgaaagagcgcacttgccgagagcatgaggcccggcgcgatggcgcctccccgaaaggctcctttctgatccactacatcgatattggttgcagtgccgaagtccacgacgatgaccggcgccccgtaggtggtgcgggcggcgatagcgttacagatgcggtctgccccgatcgtctggggataggggatgctgagggggatggagtgctcctgcgatgctgaaaccgtcagcggctttttgccggtgatggtgaatagagccttgttccaggcggcattgagggcagggaccacgctggcgacgccggcgtggtcgatgtgggcagatccgtagccggcggtggtcagcagtgagtgaagcttgatcagaatatcatcggaggtgtcctcacggctcgttttgagccgccaacacttcctctgcgtcccttccgcatcgaagagccccagagtggtctgcgtgttacccacatcgactgcgatgagcatcggcgatctgtccttcggttaggtggtacaacgcctgtgtggcgcatatgaatagagtgaaggcacctatgcaccccatatcaagcttaacggattttcttgcaaagattggggaatatagcgtaaaatatgaaacttgcacgccctcttctccaggagagcatctcaacccctcgcctgttcggaaaccaggccatgataaggagtcagattatgaaaaaaggaattcacccaaagtatggcacctgtgttgtacactgcacctgcggtaacacctttaccacacgctccacgaagagcgagatccacgtcgatctgtgcgacaagtgccatccattctatacgggccagcagaaactcgtcgacaccggcggccgtgttcagcgcttctctgacaagttcggtggtgctgcacaggaacagctgaaggccgccaaagaggctaaggctgcaaaggctgccaaggccgctgaacttgctgctcagaagaaggctgagcacgaggctaaggctgccgctaaggcaaagcgtgctgctgaatacacgaagagggccgaggcccacgctaaggctggagaggctaagaaggccgctgaggctgcttctgcagaggcaaccgccgcacaggaagcacctgctgctgaggctgatgcaaagccggctaaggagaagtaaacttcaaccaatctcagtttgagagtatgagagtctgatgcgattcaagcgtcgggctctcttttcagctctatcggatcgattgctttgtttcacctatgatgccctcccgaggggacacctgagcagattgctggatatgagacagcagcgtgcctaaaaggcctgcttcgtatacctgtatgtggtgatcaggtaggtgtggcatctgttgtctttattcggggtactagtaaaggtggaccaactttaggtatcatcacatagatagtcactgacaaaaactaagaggtgtctcatgaaatgcagcaattgtggctatgagcttcggctgggtatgaagttctgcccccaatgcggcatgcgggtaccggaggtccagtcctcaaaccgcacgcaacagaccgcggatacagagacatctgcactctctgacgagacgcagacgagcgtgatgagccccgtcatgccggttcacgcgccgattatagatagcgagagaaaggctgcagcgcaatacatcgtctctgaagacgagaagaatgccgcacacgtaaaggaatccgtgctcgacgataccgctgtgaacgcgggtgagcacaaggagtccaagccctacgtgcacgtgcagcgtggccctacagtgcacgatatccgtatccacggcaaagaagaggttaccgaggagcaggaagctccccaggaaaactatgcaccggctgtcgagcagacggcgcggatcaaccgtcaggacctcagccccgacgctacgcacatgatgcataccgaggggatgcacgacgacgagcgatttgacgaggacctcgcccgggctgagaagggccggatcgatcagatcccgattgactcaaacgatctggatgagactgagatgcactctgcaccgctccgctcgcccatgcaccaaacggtcaaccgccgcaagcgtaagtactatcgcagtggggcgcagtaccacagtgttgagacgctgccggtgccgctggaagagccaccggtacagccgagtgaatccgctgccggccccgtggctgacttcagcgacgacgcaactcatgtaatcggcaacactgacgctgccaaaatgctctcagattccgacaagacaacgatgctgaacgaggacgaggcagcaaaggcagcagaagcgaccaacgatgctgatgcaactgccaccctgatccctcaagagcagcttcaggaacccgttacagagccgaaagagcccgcacctcaggagagtgtcgaggagcctgagtccgtggaccggccgatggtcactcagcctgaggagcctcaacctcaagaggctgtggtgcaaccggcacagtcggaagagcccaaaccgcaacggagcactgatacacatacccagcgttcccgcacaaagcggaagcttcaaaagaagcgtgagtggcagggggttcccgggtgggtggcactgcttgttgcctgcgtgctgatagcagtcgtcgcgtttgcctatgtccggcaggcgcccgagagcgctgagacggcgacgcagccggcgcaggaaagtgaaaaagccaccactgataccggtgatagttccagcgcacaaccggtgcttccaaaacaggtctcttcgttctcgcagtacagttggtcggacctcgcaggtatcgcgcaggcgatggagcagtctgggtcgcgtgatgcggcaatggcaatcgctgagcaatacaacttggcggatacagatggcaccctcaccgacgagaccaaagacatcaccttgaaggatggctcaactgtcaccctgcggatcgccgatatctatcacgatacgaaggcagatggcacaccggcaggcatcacgtttatcacctcagactccaacctcacccacgcgatgaactcttcgcgttcctctgaaggcggttgggaggattctgagatgcgccagtggctcaacaacgatgtgttgggtgagctcccggatgacctccagcagctgatcgttccggtgaataagatgacgaacaacgccggacgtaccagcgactcagaggaggtcaccgagacgcaggacagcctgtggatcccctcctatgtggaagtctttggcgtgaccaactggaactgggagtccagaaacacgagcggttacaaccgggtcctgaattccgagggtacacagtatgcgatgtttgccagcgtaagcccagaaggtaccgtcaacggtccgaatgttatcgcggctgcccacagcagcgcttcctccacctggtggacccgtaccccatcaccctcagtgtcgccgcacttccgtatcattgaacaggactccggtccacgctccgttgcagattccaatgaggatatgggtgttgtcgcaggcttctgcttgtagctaactgagtcgatgctttcgcagaagtacttcttggggagcgtcccctgaggggtacttttgtgcttgatagaccacacccaccaagggtatatctatgcatagaaaattatgccgccttgaggcggtgacgtgaggagcccacgatgtcgacgatgcaagataaattaaagaagctggtgtcagcctacagcgagcttgagcaaaaactgagcgatccggctgtcatttcaaatccgaaagaatacgcgcgtttggcaaaagagcattccgaccagcagtctctggccaccaaggcacatgagtaccttcagacgattgaggatatcaacgcggcgaaggagatgctcaaagagaccggcgaccccaaggacaaggagatgctgcaggaggatatctccgagaatgagcagaagctccctggcctcgaggacgaaattaaaggcatgctgatcccgggggatcctaacgacgagaagaatacgatcgtcgagatccgtgccggcgtcggcggggatgaggcagcaatattcgccggtgacctctaccagatgtacaagcgcttcgcagagtcccgtggctggaagaccgaggtgctctcttcaagccccggtgaagccggcggcttcaagaccatcgagttcaaggtcgcaggtgacaaggtgtactcgatcatgaagtatgagagcggcgtacaccgggtgcagcgcgttccgaaaactgagagccaaggccgtattcagacttcaactgcaaccgtcgcggtgttgcctgaagccgatgagatcgatatcgatatcaaggaggaggacctgcgcatcgatacctactgcgcttccggcccgggtggccagggcgtcaacacgacctattcggctgtgcgtatcacgcacctgccgacgaacacggttgtgcagtcacaggaccaacgctcgcagatccagaaccgtgcagtctgcatgcagatgttgagagcgcgcctgtacgagaagaaacttgaggaacagcaggccaaagagggtgcagcgcgcctcgcccagatcggccacggtgcgcgtgcggagaaggtccgtacctacaaccagccgcaggaccgcgtaaccgaccacaggatcggctacaatgcgagctataccggcgtccttgagggagaccaattaggccagatcatcgaagcgcttgcggcacaggacagagcagataagttagcagaagccgtctgatcctcacacagaggctgtgagtgtcaaggcatccttcttggaaggatgcctttttaacgaaaaggggtagccgggtggctgaaacagagtggaccgttgggaagatgctcaaatggacaacgggatatctcaccaagaaaggtgatgagcacccccgcctttcggcggagtggctgatcagcaatgcgaccgggctgacccgcgttgagatctatgtgagctttgataagctgctgactcctgaggaactcaaacgcatgcacaatggggttgtgcggcgcggccgtggggaaccgctccagtatgtgaccggggagatgcctttcaggcacattattgtgcgctgcgagaaaggcgttttgatcccgcgtccggagactgagatcttagtcgatgttgccttcaaggggattgacaccgcaaaagagcagggctgggtgtacgacgacgtagcccagcgtgtctgcaaacaactggaggatgaagcccaagcggagaacgagcgtctcaatgagctgaagcagaaggcgcgcgatcagggcatcgacgaggagacgattgaagctcagatggagcagatcaaggtgctacctcagaccgataagatccctgaaagtggcccacgcgtgttagaggtgggctgcggcaccggctgcattgccctctcgcttgcctcagagcggcccgggacgcacgtcgtgacgaccgatatttctgagcaggcgatcaatctcgccgagcggaatcgggatgcgctgaagctgcacgaggcggttgatatcgtgccgggagacctggcgagcggagtggaccctgcattggcggggaccttcgcggtgtttgtctcaaatcctccttatatcccgactgcacttttaccgaagctccctgaagaagtgatcgggttcgagccgtcgctcgccttggatggagggaaggacggattggacgtcttcagacggttgatcccggtagcagagcaggaattgagagatgggggactcttctgtgttgagctctttgaagggtctttggataccgctgcagaattactgaaagagcggggcagctgggatgagatcgggacccaggaagatctgacccaccgcccgcgcatcatccatgcgattaagagggaacaggtatgagcgttatggtgacatgtgaccagcagcagcctaaccgtcagattgtcaagcaggtggtacaggtactcgaaacagatggggtggccgtggtaccgaccgattcggtctatgggctgatctgctgggcgagcaaggacaatcctgcgcatcgacgcatctttgcgatcaaggagcgggatcttgcacagaccctgccgctctttttgggctcagaaaaagatcttgctacctatggccgtgaagtgccggcatgggcgcacaccttggcccaagtcttctggcccggtgccctcaccttggtggtgaaagctgctgcggaatggccccgcgaatatgtgtgccaggatacgcagacagttgcggtacgcgtgccggactcccgcctcattcaaaagctggttggagaggtaggaccccttgcgcagacgagcgcaaatctgcacggcaaaccctcgcctacctcggctgccgggctcgatcctgcagtcatgcaaaaggctgacattgtcgtcgattcaggtgtggtaccgcttgcccaggcctccacgattgtggattgtaccagggcgaaaccgaaagtattgcgccagggtgcgatcgatacagcgcagatagatagagccttgatgtgatacggtggtgcccgtagagcggactgatgcgcaatgaacatcagtatgagcaaggcagatataggtgtatctcaaggttgcttccatacgccaattgtgtgtgacgtatgtcgtgcaagcgccgctgagtgtaataatagagaaagcgaagaggttaacatgccgaaaggagcgcagaagatgcgtgttgctattgcttcagaccatggcgggttcgggttcaaagagcccctagcgcgctacattgagtcgcttggctatgaagtagaagactgcgggccagatagtttcgatcgggtggactatccggactatgcggacattgtggcccgtaaagtggcaaaccaggaagcggattacggtgttttgatctgcggcaccggtttgggcatggcaatcacggcagacaaggtagccggtgtgcgtgccgctacggtgaccagccatatgttcgcaaagctggcgcgtcagcacaacaatgccaacgtcctgtgcttatcggggcgcttcgtgagtctcgtcgataatatggattttgtccggaccttcttggggaccgcctttgaaggcgggcgtcacgagcgccgtatcaaaaagatcatgcgcgaggacgacccgaattttaccggtgttacaagcgatcgatagggagcaggagtagaacccatggagaccatttcagatcctcgtttcaaaatcattgaccacccgctggtacagcataagctctcgatcctgcgtgataagagcaccggcaccaagcaatttcgtgagctcgtagaggaactcgccgtcctcgagggctacgaagccatgcgcgacttcccgcttgaggacgtcgagatcgagaccccgttggagaagaccacctgcaaacgtatcgccggcaaaaaggtggcaatcatcccgatcctgcgtgccggcctcggcatggtcgacggcgttctgacgctggtgccatccgcgcgtgtcggccacgtcggcatgtaccgtgaccccaagacccatgagccgcatcagtactactgcaagttcccacctgacatcgacaagcgtacctgtctcgttgtcgacccgatgctcgccaccggtggctcactcactgcggcgatccatttcctgagagaggccaacgtcaaagatatccgctgtctgaccttggtgtccgccccggaaggtgtccgcgcggtgctcaactatgatcctaaggtgaggctctatacctgcgccttggatcgtgagctcaatagcgacgcctatatcctgcctggcctgggcgatgcaggggaccgtatctacggaacaaagtagggctcttccgcgtttttagtgggtagcacaggccagggatgtctgagctgagaagttcagcttttccagcctgaggaagatcatcgtcttgaaataggcgatgctcctgaagctactggcagcgctcctcgctgactggacaagggagttgagcccttcgagaaatgaattggtcaaactcctctcccatcagtttaagattccctcacgctccttcctaaggatacctgccactctcttcatcttagtcacggcagagtgcatcatctacaagcagaggcaatctgggtccttggctgtagattttctgtcggggcagccatagacgtcctgtattgcctctgccatctgacagacacgcgcctccctgagatgtgtcttcgcgggatcgagctcctccctcttcgcaagctggcactcctttcaggctctccccacacgtacgactccggaatagcctgctgatctctcacttccgatactgccttctcaagcagtctccatatgagcgtgggctgtctcgtgcagaggctatggctacaacgctcatgtcgaagagcgccatcacttatcgcttgggcctcaaagagtgccgtagagtgcgtcttcgggtgcacctcccagagcatccttgcggcatgcacgtcgtccttggggccctcaacaccgcgcagtgtacgatggtctcgtattgccagatgtcgagatgcctttaggtccccttgcgtctgccatagcgcctgtggcaggccgggctcaccactgcccgaccctggcgtgcgccaccttcatatggaactcgtcctgcgctcatctgcgcttctcgaaccagacaccgaagagctctattcgtccctaagccctatgggacctcttagagagcctcgccagcatacctgccttaagcatccatatcgcaccttaggatcgcatccgtcaccaaaatcttggctgtctgggtaccacgtgctcaaggatatgcaggagtgccatccaccataagtagcgaagagcctacagagaggcctgcgagaaggcaggcaaggagccctgcgcgctctccggctgctccgactcctactccgtcttcaaggtcatggcagcaggggacgagtgcgaacgctctgccatcccccagatgctcgagtatctgactcgcgctatggcacagctgtcctgtgcagtcgatcccgaggcgttcgtgatcggtggtggcgtcgtcggctcgtcagatgtcctcaaggacgagcttgccgagcgcttccaggagcactgctgcccaatctgtaggaacacaaagatcgtgccgacagacctcggcaaccaggctggcatgtatggtgcggctctctgtgctctctcggccgaagataagtagaaggcaccaaagtaccaaaacatgcagaagcggctgcagctccaaggggctgtggccgctttcttctgattgaagattgcttctacagaaggtcgcgtacgagtggcatgctcatgcaatgcgtgccgccacgtccacgcgagagttcgcctgacgggaaggtatggaccgtgatgcctgccttgtcgaggaggtcgagtgtgatcggcgtacgctcgtagcctatgacctcgcccggagctatcgccaggacattggcgccgaggttccagagctcccattccgtatccacggggttgtcgccgccgcaggggatgagacgcacatcggggtttcctgtcgcctgggcaagagctcggtgccagtccttgccgacgtagtcatagccgacgcctgcaggtgacgggaaaagacggtagatgtccgtcgtgccatcgatcaggggattgtagaggaatgtatctacgtcgaccatcgagagcgagatgtcgagatgcatcgaggagcggtgcatgccgatatcgaaggcatagacctcggtgtaaccacgctcgaagaggctgtgggcgatgtattcgatcgagacggggctcgtgcgctctgagcagccgatgataacagaatggttggaaaggacgagcacgtcaccgccttcgatgcgctgaggaaacgaaaggtcgtagaggtcttcctcctgctctccttggaaggccttcgcatgctggcgtacatagcggagcacaatcgcctcacgtttgcggacacgcttctccatatgggagtagatcacatcgtggccaagcgagatcgagttgtcgcgcatgaagtagatgttcgggagtgggcagacggcaaagactgcctctcgggtgctgaggttgccgaacgaggtcacatcggccaggcgtggatcgtcgctcttgatgccgcagagcacagtctcgacgagctcgtctaccggcatgtgcaggtagaggtcctcgagcctctccaagagtgccggagacatgatgtgggaggcctcgaggaactccgagacgaattcgtagcggaccttcggcgatttgaaggcggacttcatgagatcggtgaggtagaggacctcgacgccggcatctgttaggatcttggcaaaggcgtcatgttccctctgggctccggccagatatggtgtatcttcgaagagcatgccctggagctgcgagggaaggacctggcagaattcgcgtccaggcctgtgaagcatcacctttctgaggcgcccgatctccgaatacacctgtgtcattttgagcctcgcttccttctcctgtacaggatgcgccaaccaacgctgactagcctattacatacccatatagatatctaaaaccaaaaggcatccgaaacgtgacgctccgaaagtgtcgtgtttctggggggcctttccccctgtttcgcggggtccacatgagagcgggcgggagatgttctgacccggtatactttgggggaacgcagaggcgagggagcgcgcggatggatatggcattctttgatatcgacaatacgctaatatggcgggacccgaagaccggctggggaaacgaggccaccgaagtctcgaagcatgctatcaggcgtttctgcgagctcggtaatgtcgccctgctttctactggaagggcccctcagggcatccctgcctgccttaagaatttgccgttcagaggtatgctctgcttcgatggggctctggctctcctggatgggaagcgcgtctctgcgcatttcatcccggaatcagaccttgcggaagcgcttgccgaagcccttcaccacaagatggggatccttttcagcggacccgaggggagggccttcgcgggtgagcggcgcggcttcgagtggcatgcagagcaggtcgagagtatggaggatctgaagtctgttctgccctctcttgaggtggggaagctggccttccgctacttcgattttgggcactaccgcgagagcagtttcttccagacgcactttacctgttaccagtccgctcccgactactatgagcttgtgtgccccggtgtcggcaaggacgtggcggcacacgacctcgtccttgcactagaagaggagagcggacccgtcggacgcacgcttgccttcggcgattcggaaaacgatatcccactcctgcgtgcggccgatgtcgcagtagtcatgggcaacgcgtcttctacaacaaaagaagtggcaaccattgtgaccgacgatgtgcatcacgacggggtcgcccatgcactggcacatctgggctatgtctgagaggtatgagcagaaagaagatgcagtgaaagagattacacaggatggcagcgtgtacaagtgccgcctcatcctttccgatatggacagcacgatcctgcctaagggggcaaagaacgtgagcgcaaggacgcatgaggcattccggaaggcgctttctgcagggataccgataggcccctcttcaggcagggccagaagctggatcgcaccgatgttttcgggagatgaggcgtgctgtgccacagctgtggctacgaacggcctcgagatctatctcgaaggcacctgcatccatcatgaatacttcggtcacgaggtccttgcggaccttctggatgtgctcgagcatcatccgggatgcgggcttctttgcttcgaggacagaaagccctatatcgtgcgtgggacacgggaagagctttctgagtccttcccggcatatgccggggccgctgagatgaaagacacgctgcccgacggagcgattacgaaggtgaacatattccgtactggcattacgcgtcccgagacgcagaagcttgtcgatgctctgagtagggaagcggagggactcgatttcgatctggcatttcctggttatctcaatgtcatgcctgctggttggaacaaggggcgcggcatcgaggtgctctgcgaggctttgggctgcacgacagacgaggtcgtcgtcttcggcgatgcgaacaacgaccttacgatgttcgacgccgtagagaactctgtcgcggtctcgaatgcgactgatgaggctgcggcagctgcgacgtggcatatcggcgcctgtacggatgacgcggtcgctgctgcgatagagaagctgagctgtggcatctggccctttcggagataggttgtaatcagtggtaaaaacctctatcggctgacgctgcctgtctgtgcataaacaagagcactgtctctgcactacacttctcagacatatagctgctatattctttcgtggattctccggtagctttgagtctcaccacctgcttcagagcagaatgcaattgcttcttcactgtgtggcgcttcacaacacgaatagggggtgcataaaggtaacacggtatccagcacatcctcgaggtttttgctgcgactgagtgccattgcccacttcgaggccaacctgttgaaacattgttcacgattagagcttgccatcgaaaattccagggacttcgtctgccatctgagatagcgaccccatatcgacaacgaatagcacagtatgtacaaatgaataacgttctagcattcttgtcagcggtgcgaccaacgtcgcttatctgctgatcgtaatcatgtctattgcttcgaaaacatgtgttgtggcagcaatctgttcgctgcatccgcaatacttgtggcagtggcataccatgacagagaatgacccgaaggaatcagatacttcgtggatgtgctcagcgtctccatgacctcaaccaggaagtataaccggcgcacactcatcaagatccgctccgacgcagagcgtaatgcggagcgcaatctgatcggctattgtcgcagccatctgcgaatccgacgcagcgtagcaatcaggcgagcgagccactccggctcttgcgccttgcctgagcaagccttgtgacacccaaagttgtacagagagcccctgggccagcattcgcgctgtctttcgagtcagttcagatctgtgctactatttatttcttccaaatcgggccaagcacccgctcgtaagctgattacgtgcattggggcctgtccatcaaagcttagatagtcttctaggcatgcaccgtctccaagagagcatgctcaagctcatcagtgccaatctgtccagcttcaatgagctatataattcaacgattctctcgaaatatgccatgatgcgcttgctaaggttcggagacataggcttgcaccattgacaagctggtcatcatccgtttccgcttccgttcctccaaaagatgcagcggcaaattaaagaacgacgacaagtcggctatcctcacgattcagataggcacttgccacagcagttgcgatacatgattcagaccatcgatgttctcatcgaaatctgcttccacaacgtccggagcactcccggctaatcgaaatatccgcagcgcacgacgggcctcgacgcggaaataatgcatagccagagcagtacgctcgtcgacatcacgatccgcatagcgcggaagatgtaccgtaataggcaacatacggctcattgattgaatcctcgcattgtccacgaacacacagttgagagaatataacgagtcgtctgcatcgaacaatcgaactaccttcaaggattcggtgataatgagctcactaaccgccgcgacagatggtcgaaacggtttgaggtagacaatgccccctgcgcttctttgacggcgccagcatgacctctcgttccgaaatatctccttcgcggcgctatcgttttcctcaataacgcgagcaatctaccttatatatttggaatctgtgcaaatactcctgaattcacacccgtactcgtagctcaacgcgccagagtctccttgcctgttccatagtctcccaccaacaataccggcaaaccatgcggaggataggaaatggcgctcttgagctgttcgatacatactccaagctcatgtcgcaaccgatcagcgtttctcgaaatcggcctctgcgacgagccaacagttgtaaggagctcttcgacagaagcatattcagaattcttcagcggcttctggaggtatctttccagacccctccgatggagaagagccgaggtcgagcaccgaccttcacaacaaagccgtcccttacaagctcatgagatactggcttgcaggtttctgctgatatgacactctttgcatctgtgctgtcgtaaacgcagttgcgttgccaggagatagctctctggtcgcatggtccagatagcgcagaggtcgcctttggtatccgctgctgccatatccccactccttataagcaccgagcgtttctacattgcactgggcattccatcagatgcgttgcatcgtaatgcttgtcatt

SEQ ID NO: 112 - DNA, 13676 bp, Unknown
  Metagenome-assembled genome
ggctgaagacctactgtctcaaggcaagcgagctgcgcgacaggctctccagggcagccgggcgcgggtccgtccagcgggaggtggcggccctcgtcaagccgtcgtgcctcatcgtggacgagattggcaggtgcacattcgacagggcatgcaccgacatgttcttcgcgtcgagcgctgctacgagaaggatggcccgagcacgatgatactcaccagcaacatgtccccgagcgactggaagggctcattcacgggcgaggatgcgctgctgtgcgcccttgaccggctcttcgacgatgtctcggccttcatgatgcggggccctagctacaggggatacgggctcgacacctattccgtgggggcagtgaggcagaggggctccggcacgatgagcctctagcgcagaggcttcgaggccccttgcgcagtcatagatagcatttccggatgccggcacattggcgaatatcgtccggctggaaacagccagaatcgcccggcgctaggtggcgattatctcccagcgttaacaacgcctatgagtagaagagaactcatgggtcataggtgctacttcataaacttatgtcatgtttatcagtagctcgtggatccgcgtgtcttcatcgagttccggatggaaggagacgccgatttgattgccgtcacggaccgctacgatgtgattgttgacgcggacgagaacccttgctgttctatacacttcagtgatgaaaggtgcccgaatgaacgtcagcggtatctcatcattctttccatccttggagggtaaccctgcacagggtgccgtggtgtggaagcttcccaactggcgaccataggcgttgcgcctgacggttacagggagggtagcgagcgccccgggagcggtggctcccgatgtcacatgttcgctgtctccgggcaccggtatgccttcctccacgttctcagccaacaggatgagtcctgcgcaggtgccgagcactggcagaccttcctgtatgcgggaacgcaatgtgtcgagcattccgagctcacgcaacagtttcgattgtacggtgctttcaccaccgggcagcaccaaaaggtcgaacggttgattgagatcggcagcctgacggagttcgatgtaggcacagccgaggcgctctagcatatgctcgtgctcgataaaggctccctgcactgcaagtactgcggcggtcttttgccgctgtgccatggttatttccctcgttctgccatgagcagatcgatctcatctgcattgataccgaccatagcttctcccagatcctcagagagtttggcaataagctttgcgtcggcgtagtttgccgttgctttgacgatcgcctgggcacgcttggcgggattgcctgacttgaagatacctgagcctacaaaaacaccctcggctcccagctgcatcatcagggctgcatcagccggggtagcgatgccaccggcagcaaagttgaccactgggagccttccatgatcgtgtacgtagagcactaagtcatagggtgcctgtaatcgtttggcagcttcaaagagctcatcggtccgtaagctctgcactcttctgatctctgcgttcatggtgcgcatgtggtgcaccgcctgcactacatcaccggtacccggctctcctttggtgcggatcatcgtggcgccttccgcaatacggcgtagggcttctcctaagttccgtgctccacagacaaaggggacgtcgaacttcgtcttgtcaatgtgatatacgtcatcggccggggtcaacacctctgactcgtcgatatagtcgatatcgattgactgcagtacttgagcttcaacaaagtggccgatacgacacttagccatcaccgggatactcactgctgcctggatgctcttgatcatcttggggtcgctcatacgacttacgccgcctgcagcacggatgtcggcggggatccgttccaaggccattacggcgcaggcaccggcatcttctgcgatatgagcctgttcgggagtggtaacgtccataatgacaccgcctttaagcatctgtgccaactggcggttcagcttggcgcgctcggcgtgattctcagtggtttgtttatctggcatttttaattccttcctgtaactaggatatgagcgatagaatagggcaagtctggatatacgcctatagtcaaaaagagtttattttgtaaggtcagattgaagagttggcattctgaataatggttagggggagatcagcatgctcacctatgatatgactcagcgcggatcacatagcctctatgagtacctgtacctatgtatccgccatgatattgcccatggcaccattgctccccatgaaaaacttccctcaaagcgagccttggcagatcacttggggatcagtgtaatcacggttgaggctgcctacagtcagttggtggctgagggatacgtacttgcagaaccgcggcgtgggtactttgcctgtgaactcgcgccagcactgcaggcgaaagaggtgacacatcaagagtcgagatgtgctccagtgacagaaaaccatggtagagatgcgggtgagagtcgacagagaggaatacccctgctggcagatttcactatgcaggcaactgagaccgatctgtttccctatgatgcgtgggccaagataatgcgccgtacccttgcggaagaatcagcggcttcactggtaagcgaacaagcaccggcaggatcctggcggctgcggcgtgccattgcccactatctgcagggatcacggggtatggaggtggcgcctgaacgcatcgtggtaggtgcgggcactcaggcgctctattcctatatcgtgcgtctaataggacatgaccgaacttttgcggttgaggatcccgggtatccatatttggtgggtacgtatcgggcattgggcgtcacagtgaagcctgttccactcgataaagagggcatgaacatagaggcgttgcgtgtgagtggcgcagatatcgcacagctgatgccagcgcaccagtttcctaccggcatagtcacttctgcccaaaggagacgtgatcttctgaactgggcgcgtgaggataggactgatcgctacctgattgaggatgactacgacggaaagtttcgctttgctggatatcctatatcgacgctctataccatcgatgcggcagaccgtacgatctatattggtgcgcttgagaagggcctggcggcagccttctgtatcgggtatatggtattacctgtgaatcttgcggaccgctttgatcaggacgctgaagtctatgccaatacggtgagcccgttagaccaagtggcgcttgcatggttcctcgagacaggcgcatatgagcggtatatcaatcggctgagagtccacgcccgaaaagcccagcatgcgtttgtgaaagctcttcggaaaagcagggtgggttcccgtcttttctttgagggtcttgagggaggcatgcattttatgatgcgggtccattgcgatagcgattgcagagttgctcccgataaaagagagcgtgctattgccaatgaagcctgtcggcacggcgttgccttgatgcccttgagtgactgctatgtgtctcacgctcataccggtgattccgcctttgttatgaactacggcgctctggacctcactcgcctcgatgagatcgctgatgtcattgccgatgcgattgcatgtgttgtaggggagtcttgtagccagaagtgacgcagcgtttccttatagttttattgttggtcctcattgttggtagtgcctacaggtatagtgaaagtaactcaaaggatacttccttgataaaggtctttgtacgggggccgacgagctgtgaggggatcgcagcgaagatggaaataacgataatcgtatcaggtatggttatgctcgcgtattttcttcccctctatggtggagcaggtttatccaggatgattctaacagtctagataacgggtgaatctggcgcttcacgggcatgtccgtggccaacatgcaaaagctacctcaactggtaggtctacttcttccgggtcaaccaagctcgtgataggtgacctgaaactgcaagagtggttcgtcatatgatgaaggccaacgcaagtttccacagcttgacgtaggtacactatcacccgtaatctagactggtagatccaggataagcggtttttcacttcgacgtctcaagctattcttgcggtaatccctgataagaaagagtgatttcacggagatcaccttatcgggtgggtcatcatcgcttgtgcctgtctgttgtttgcagaaacaatcattttaagcatagcggatagcatatgcatgaagtttggctttcttcaattctttgtccagtttatgatcgtgctgtacagcatggagatctttgacattcagcgaatccacaccctaagtgcaacagctacctacgaggtagcgacccatgcgcgatctagggaaacgatgattaattcgcctcgatgaggccaatggtgctgcatgctgtatgtcgccggcttaaaatgtctcgaaccacgcaatgcccatacccacataaatgcctatctgcctgcggatacgttataattacagccacgtattccagcatatccaaaaggcagatatgggcagatagatgagcttttaggaccggcggattagcattctgagtgcaacaggatggcccgctgaatgcaagcgtggcacactccggaaggctacgatgttggttgtccacatcaacgtcgaaagctagaaggaatgtgccactacaagcatcgtaagcctacaggagagggactgcatagccacgctgcatgcagagggaaggtcaattgcctatatcgcaaaagagatcggtagggacagcttcagtgtctgccacaagctcaagaggaatggccgccacggacactatggagcctgtgctgcccaaaaggagggcggatgagcgccgcaggagatacagggcgaaaaggcggctttcagaccctgcgcttacgcagaaggtgcgcttactcatcatggacagacactggtccctggaggagatagacgacatctcaggctcgagggtggtggcaggtgcgtcgttgagcctgccgactattctgcagacagatccatagccatcgccctcgagctgccggaatcctgcccgcaaggccaggtgcggcaccacctgcgcaggaaggggaagcagatccgcaggaagaggcctaagaccaaaggcaagatcgagatcttacacagcgtaaaggagaggcccaagaggccgatgagaggtctcgtctcggagagggggcagacgacacgctcgtggcagcgggacccgtgtgcctgctcgtgcttgccgacagggcagtgaggctgcttgccgcggaaagagccaccacgacagcgaaagcatctctaaggccgaggtcgagctgctacagggacgtcccctcgagatgctcactcctaagtggggcaagcagttcgcagggcatacagggctcacagatgccctttgaggcgtgcagttctacttctgcgacccccaccatctatggcagaagctaacagttaagaacaccaacgggctcctgcgggagttcttctcctaagggcaccgacttcggcaaggtcacggacgaggaagtgcagcatgcggtagagctgatcaacgacagggcgaggaaggttctgaaatacaggacagccaacgaggtctttagggagatgttgcactcagcttgacaatctgccaccttaaatcctaaggtctgaggagaaaagactaggtaagaggcattcctggagcaaatggatgcaatcgttgtgtgggatagctggattgcactggtagataccagctaccacggacaggctcttgtcaggcatgtgcgcgctgtaaagacgatgctttaggatgtatcctgctttaggtaatgtttgctctcttaagacgaggaaacctaaggatgctatcctggattgccactccctggcagcgcttctgtgcacgtagacctcatgcaagcgcaggtaccagatgcaacgacacttgcgaagatgcgccatagcctcgagcggcagggactcggtaaggctatgcttcacgacctgaacttagaacttaagaaggcagggatcacggcgcggggtggctccatggtggacgcgacctttatcgaggccccgagctccacgaagaaccacgaccatgcgcgcgacccttaaagcgcaccagtccaagaaagggggagcctggcgtatctgatacaaggcgcatatcggcgtggatgccggcagcggccttgtgcatggcgtggagacgattgcctagaatgtatctgacatatcctatggcacatgcactcgtaagggaagatgataggttctgctatgcagactttaggctatataggtatagcgaagcgcccttaaggtcacagcagacccacacctctcatctatgcgctaaagtgtcgctaagagagccttcgaccatagaaggccttgcctgtgcactcttgtccgataagggcatcgagtccaggaaggcctccggccgcttaaaggtagagcatcccttccttatcgtgaagcggcgcttctgccccttaaggaagcgctactaggggatagagaaaacctcctgtatgctcgagtctgcctcgcccttgcaaaccttacccatgtgcatcttttgccggcaggctgcacctcccggctcccagcgtcgcttgatctgtcttggagccttcttgcggtatatgcggcaggacggatgtaaggatagcggctcctgcacgtgctggatgagcattcttccctgcctttcccgcatgccggccgcgaaaagtcgtgtggtcggtcctctctaacacgttatggggcattaatcatcgtttccctagcgggctgtggagtcgggctcactcggctgcgagcttgccgaccacctcaagactgcaaggctgcttaagcaccatggcaagcgcaggtgcaggaagggttttgaggagaggcagggtaaggtcaagatcacccacgtgctcgccgagcttttccttatgctcgacggcggagttgtgagaagtgccaccctggatcggggcatcaacgagaatactaacggactcctcagggactggctctccaagggcaaaagcctcgatgacgccacaggtgccgaggtccagaaggcctacgattcactcaaccgaaggcctcaagcgtctgggttggaagtgccttgggaggtccactaccacaagacgttgcacttgctctgaggattcgtcatggaaatggtagggaaaaccgttaccaccctcgtaagaggggattgaaacgcgcctttcggtaccatacgtatataatggaatggaaaaaaccagccaatcttgcgatcgactggtttcatattctatggagcggcgaacgggactcgaacccgcaacaattagcttggaaggctaaggctctaccaattgaactatcgccgcattcctggtcggggtgactggattcgaaccagcgacccactgctcccaaagcagttgcgctaccaagctgcgctacaccccgtgacgcgttgtttagtatagagaactacgcgctttcttgcaattgaaaactagaatgagtaagtatcttcaacaatctgagcgacttggttaaccgtatcagatggggcctcagcggcaacatagcggatcacgccgttgtcgtcttcaagtacccagcagatcacgcgggtaccgtcaccgtagttgatggtgagctgggtggcaggatggttgatgagcttggagctctcctggatgatgttgtcgtctgtcacatccagagatttggcatgtcggataacggcctttactgcatcgtcgaccgtaatcggtcctgactcttcggaagcgtttccgttgttgttttggttggcgttgttgtcagatgaggaagaggagctgttttgtgtactgttactactgttattgctgttgctatttgagtcagcgttggagttagaggagctctggccgttctgatctgatgtagaaggagcattagaggaactatttgaagcagcggcattctctgctgctttagagcttctgacgtcggaatcgtttgaatccatgatcttcatcgtaatgatctgggttgcagagagatcgcagaactcgacatccccgctgccgctcttggtagcaagagagatccagtcagaggggacggatacatagccgacaccggccttcccgacgcgcttcgtctgagactcattggaatcggtctgattggttgcctgagagttttcagatggggaatcatttgaatttgacgctgaacctgtttgagcctggcaagcaggtagggtagtaacaatgcatgctgcgacagcgagaggcataactagtttcgcgatagatttacgcattgcgtctccttgagcttcttgtataggtgtccggcgttacaggtatatatagtttatcgcagcgcagatacttctgggcattattacttattttacggcatatagaacacaaaagaattatccgagagtagggaagcgtgtggataggatctctcacctgtaaccccgtggtgctaccgttggcgttgccaagcatagatttgcccaagtggtcatgtggccctatgtttggcgacattcctgagcggatggccgcctgcgtggataggaaatccgccatggttgctatcaaacccctacaaggacacggtgtcgtccttcggcgctgcggttgtagaacgcagatgttgcaagacagataggcgcagaaacgctcaaagaggcagccgagctgtgatggttccatcctgtttgccacatttgtaggtttgccaaaagctggaaagacaagcagacactgccggggcatcaaaggtacacagcctagctcttagcgctgaaatacgctgagaaggaacttttgagctggaagtgccccatcacctgcatgtgctacaccacatccttcgacctcatctttgagatgtgtgacctcacccacacgagcgccttcgagtggcaccacagcggcgctgccaccaccgacggctactagaaccggctcgtgttgtgcgggcgcacctggccagacaagccctacctcaccgactccgacatcgtgcagaagagcgggcccgccaagaacaagatctgcactgtggcaggcatcgatgcactcaagagcgtcggcgtgatcttagggcatggaaagccctcttccaagcgaatcgaagacgcactgctttcgcatagagcagaaggttcaatagttgtgcacactatggggataggtctcatctctcactcgtgaaggcaaccaaatgcactgacgaggcctatagggcagacatcgccgatctgacatacctgcacaaggccatggggcttgtgaacaagctgtgctgctctacctattcaggttcccagacacgaagaaatctagcctccagtcttgcctgaataggttcgtgtcgctgttctgtgtctgtcagggcgagaagaggtagcccaaagctgtaagggtacttcgccatttacgactgacgcacatttccgcaactgacggacccatcttcatccacacgcttttctattctcggaaagaactatcgaagattgtctattccgcaatgcgatctgccatctcaagggatgtactgttgacgtcgggagattttcagccggcggattagcattctgagtgcaacaggatggcccgctgaatgcaagcgtggcacactccggaaggctacgatgttggttgtccacatcaacgtcgaaagctagaaggaatgtgccactacaagcatctcaagcctacaggagagggactgcatagccacgctgcatgcagagggaaggtcaattgcctatatcgcggcagagatcggcagggacagctccagtgtctgccacaagctcaagaggaacgcacggcacggacgctttagggcatgcgctgcccaaaaggagggcggatgagcgccgcaggggatgcagggcgaaaaggcggctttcagaccctgcacttacgcagaaggtgcgcttactcatcatggacagacactggtccctggaggagatagactatatctcaggctcgagggtggcgacaggtgcgtcgctgagcctctcgacgatctaccgtgaggtccatagccgccgccctcgagctgccgggatccggcccgcaaggccagatgcggcaccacctgcgcagcaagaggcctaagaccaaaggcaagatcgagatcttacacagcgtaaaggagaggcccaagaggccgatgagaggtctcgtctcggagagggggaaacgacacgctcgtggcagcgggacccgtgtgcctgctcgtgcttgccgacagggcagtgaggctgcttgccgcggaaagagccaccacgacagcgaaagcgtctctaaggccgccttcgggctgctacagggacgtcccctcgagatgctcactcctaagtggggcaagcagttcgcagggcatacagggctcacagatgccctttgaggcgtgcagttctacttctgcgacccccaccatctatggcagaagctaacagttaagaacaccaacgggctcctgcgcaagttcttcccctaagggcaccgacttcggcaaggtcacaaacgaggaagtgcagcatgcggtagagctgatcaacgacagggcgaggaaggtcctgaaatacaggacagccaacgaggtctttagggagatgttgcactcagcttaacaatctgccgccacaaatagtcgaaacacaatagccaatcgcagctggaagaaaatggccaccataccgctgcgtctctcctatgctggatgtgctaatgtgccggcgataggaggaatatagagaaagatggacagcagatacgatggcctacagaagattatagacgaggcgctctcggcaatggcggccgagggcaccgtctccaggatcgcatgctttgcgatggtctgtcaccactgtaccacgctctacatcgagttcttcccgagcgtgcggcaggagaacctctttctcggaatgctccacagcttcatggagctcggcatctcggacggggtgctgacggacaacatgaagtgaaatggacccaatctccgcacagctaggcaatgagccttgggggacttctcttccagtagttactttggctgatattacgggctatctgaggcttatttcgacactgtgaaacacaagtttaaacaagtttaacggggctttcagttaacttagagtatgtaagctgaaaaagaacatttgtgaacgaaaacgttacagctcgttttcttcttgtttgaggccttgcgtataaggatacagttattcatggttccagaagaaggaacaagaggcttacatcgatctagtgattccatagtgtccgatgcatgtggggtaggtcgatcgcagacaatttggcccgcataggaagcgatcgcacccgttctcttgtcatcctaacagatcgggtattgaagacgattcgcccgaacatctctccactcacgccgcaggaatacgtccctcgaaagaaaccacccctccatgcccgagagctaaatagcgaccttcaggatgtttgccatcatccaccaaggtcacaatcacacctttcgtcttcggcttggccctactagctataaaaaaaagcacgtctcgacattgcttttaccattttaaacattaagatttcacgcttttctccttaccagcatcaccgtatgctttatttaaggactttttataattagtgaatgagaaatataattaagagtaatcaaccttttgtccgtgaagattgtgtgaagagcccctagttgatcaaaagcatatgagagaagagatagcagtttgaaagttctcgtatctaaagtctagataatccggtaatgagtgtaccctacgtcgagcctgcggaggcttacagcgccatacgcatagcgaacactcttgcagtttcggtcacctatcacaagcttctgataccgcaaagaagaaggtagacctaccagtgaggtagctggtttgcaggttacctgaccatgcctttgaggtgccgggttcacccgttattaaactgttagattttggtatagaaatcctgctgctgcggatcaaccaccgcagccgagatcgattaacgatacaaagatagcaaactataacccagtactctaacagatgcctgagcatcattgcgttcgcaacttgaggaacgacgatgttaggacgcccgaagagccagagtcaaccctcatggcccaatactgcttagcagcatacccaagcgactgtagagttattcaatgatgtcataagctatcatcaacacttcctcgaagcctccaggagaggtgctctgttctgagcacatctcaaggcacagaggttgcacacgccgccgcacgttagctgccttgccggatgcgaagaacacgcacgttcttcttgcagatactcagttgccagtggtgtggtcggctgttgcgccctcaaactacgtacttggcgcgagttagcgacaagcttcctgaaacgtcagatcgagagctcgttctgggttgcgccggcattcgttttgtcgcacttcctcaccaggacgttcgtctccgtggtactgaccatctctgtggtccttgacatactcttgatgcgcgccacgcctcaactattgatcatgaatacgaagtgcgtcaaagcaacgtccgtcggatcgtaacaaactttgatctgaggacggtttccaacatgagcacacgagtttcctcagacttcttggaccgcatactgagcacgttgccggcaacggagattgcaatgtcttggccttatgtcctcattcgttctggtgaccatttgctccaggaagtagaccgcacaagccggttgcctcagttctggacaagagaaaccaccatgtacggagagacctttgcccggtgagtactgattgcgcacttgttcgtgaaaactttatagcaccggaaagtgagagacctctcagggcaccggttccgatatcaccggccaggaacatccgtgtccgcgtccgatgtgggcgcagctcaagccataaatgactggcaaaagcgaatgaccactcgctgctcggacttgccttctgcgtcgaagtcgataggacacccttcgcgccgcccatcggaagcgcctcgtaagaggtcttgagtgcgtctgctcaggccccaagaacttcaaattgcagaggttcaagacgatgcgacggatgcccgcttgtagtggtccaagcgcagagtgactgaaacacggtaaccacggtttgactgaccttgccttcatcgtcaactccacggcacggagatatgtgatcgcttcaggctcgaccaacgtttaaccaagcctgccctctcatatctgggtgacggtatcgagcgccggttgcaatctttgcttagaatctcacttgcggcctgaataaaattcggactcatccttataactccttgttgctagacgtttaatgactacgttgtgaatagttcatcattaagcttccgctcttgtaggaagtct

SEQ ID NO: 113 - DNA, 26185 bp, Unknown
  Metagenome-assembled genome
gcgccttccagagccctcttcagcatcccctcttttcagccgcctcagaacgactcgagcatgcccacgctcgacttgagcaggcatcgcgctcctttgccgtatgggcttctgcatagacctgacgtcggctcggtcctcgatggcctcaccatcgtccatgacccatcatcgaaggtcagcttgagcccgtcgccatgcgatacctgtgagggtgccttgccagccacgcttggcggattgaggccgggaagcaggaggcggaacgactctatcgccccatagtcgaggcgcacatcgcgcctgccgtagaagaaggagccgatattctggtcgagctcttccacaagctcgctcaggtgcttcctgcgtgcagcaacatattcgacaagaaggagcgcggccagaaggccatcgcgctccgggaaatgggatggcaggcagaccccgccatactcttcggtcgccaggagcacgtctccatcccacatctcgctgtagagacgtccgaatccgacgagcgtctctgtcatatcgagccccaggcgctctgcctgcgtcttgatgcttgccgagcacgagatagtggccacgatgcggcccgtctcatgccggtcacttgccagatggtccataaggagcggcacgaaggccttcggtgcgagcagcactcccctgtcatccaccgctgttgcgcggtctgcatccccgtcgaagacgaggccgaaatctgcgtgctgtgcgacgatgctgcgttcgcattcgtcgacccagggctctgtcggatcgggatggatgccgccgaagtcggtgctcggacctccgtggatctctgacacctcgcaccccatgccgcgcagaagctctgccatatagcctgaggctgccccatacatggggtccacgaggaccttgagatgggccgaggcgatgaggtcacagtcgaccttcgatgcgatgtcagccagataggcggtcatgaggtcggcatgctcgaacgtgccgcgctcgagaggtgcgacaggtgcgatgagctcctcgacctcatccatgaatatgcgggaggcagggcttccatctgccatgcgcagtatcactccgccgtagtcggcatcggcctcggaagccgtgatcatgatgccgcctacagccattgcgtcctgtgcaaggttccagccgagtgcaggcagaggacagggcctgtccgacaccttcacatgcaggcctgccgcagcaagaacgcccgccgcgacatctgcgagttcgcaggcatcgcggcgggtatcgtatccgaccagtatcgttgcgccggaacgcgtatccgaccagaggacggcaagcgcctctgcgatgcgggcgaccgacgaggcatcgaacccctcgccatagcgtgcccgccagccacgcgttccgaaccggatgattcccataaggctcctagagcttgacctccccgagcgcctccttgaaggcagtcgccaggctggggtcttcgagtgccatgcgtgcgttcgtggccgcccaggctgcaggagtgccggtatcgcagccctctgccggatcgaccaccagagcgtacatttcctcttcgtcgagcagcttcagcatcgaatcggtgagctgaatctctccgccggcgcccggcgtctgcgttgccaggagctccatgacgcgaggggtaaggagatagcggccgacgatgaagaggtgggacggtgcgtcctccttcttcggcttctcgaccatgcccgagagcttccagaccgcgccttcagactcgggatcggtgacatctgtgccgtcgagcatgccaacacactctccagcgacgatgccgtagcggctgacctggtcctcagggacgggcgccaccgcgatgacagagcagttgttgtgggccttcgagacctctgccatcctcacgcacatctggcggtcaggcacgaaatagtcgccgaggaggacaaagaacgggtctccgtccatcttgtctgctgcgcagtggatggcatgtccgagtcccagcggcttctcctggtagacgaaggagactggaagcgcgcttgctgctgcgaccttttctgccagcgcatccttcccatgggcatgcagatatgcctcgaactcctcgtcctttgcgaagtagtgctcgatctgcggcttcatgtgggagttcacgatcacgacctcgtcgactccctcaggctcgagcgcctcttccacgacgtactggatgaccggcttgtcgatgacgggaaggagctccttcggcgtgcacttcgtggccgggaggaagcgggttccgagtcctgcagcaggaatgatggctttcatggaattgacctttcagaagcattgttcagtcatttgcactatcagtcagcctgtccaggatagcgctcattgccttgtacatgccacccatcggcttgtgcggcccgacattgcgccgcagacggcgcaaatctgcctgtcttgcacggatgctccacaattggggccccgagtctccaccgctagagatcgagctggtcgaacgtgtctgccatgacgccagccatttcagggccggcacctttgcccgggccgacaaggcggatgtcagcacgtacaaggtcggctatagccgtcgccacggcgtgcatgctgtcgaggcgcgagcggtccgtccgggcgccgcgctctgtcgtgtcggcgatgcgcacgagcagagatacgcctgcctcagccgctgcctcggacagacggtccgaaagcgcgcaggcgctgaccgcatcgagcccttcgacaccgaacgtggcaagccccagctttcctgcttctgccaccgcatcgaagaccgaggccccgtctgcgagattgtgtccggagtcgagcacgacagagccgatgatcggacggtaagctcccagctcgcgggcgattgccgcatagcctgcaccctttgcagcagccctcaggtgcgccagatcaggcatcgaagccagcagcagcccatgcacgcccttcgagatgaggcagcgcgcctcatcctcataggccctcactgcttcatcttctgacgaggcatcgtccaggcagctcggaccgagcgcgcctacgacgaagggggaagcactcctgaaggcaagacgcacgccgcgcgcgcaggcatcctccatgcggatgcctgtgtcttcctttgcaagcgtcggcgccgagcagcgctccgtgaacgtcacggcgacatctgcacccacatcgtgatagattctgtgggcatgggccaccgtctcctgctcgaacatgagccattcagcgtcggtcacctcttcgcccgacgggaactccgacaggatgtagcggatatcccccgggaagacgagcgtgcccttcccatcaggcgccagaagctcgctcaggctctgcgccgcctcatcatctgcatcaagctcagccataggcccttacctctcgaatgtcacgccctgcttcttcatgtactcgatccagcgcttctgcgtatcgtgggagagtgcatgctccatgaggcaggcctcttcatctgccgtctcgggctcgacacccagatcgtttgtgaggaagctcctgagcacacggtggcagagccatacgtgtgcagcgtattctgtgccttccggcgtgagcgtgaccttgccatagcgggtctgctcgaccatgccggattccttgagcgtcgagagcgccttgttgacggaagccttcgagaccccgagctgttcagccacatcgaccgaacgcacgccgtccgtgtttaccgcctctttcgaaagccggtagatcgactcgaggtagtcctcgtttgccatcgtcaggctatgctccggcgcgatatcgtttcttgccatatgcttctccgcatccaaagttgctgtctgcgttctcttacccatcttgggcgcatctgcatgcagcccatcccagacgagcataccagaccctgcatccgcatgaaaaaagggcacagccttgaaagctgcgccctgaaacgttcaatgagttcctatcagaggaaatcctcgtcgtcggcctcgatcgtcttcctcacgacgtgggctccgagggactggagcttgtcgacgaagcgctcgtagccgcggtcgatatggtggattgccgatactgtcgtcgtgccttccgcaacaaggcctgccatcacaagggcagcgccgccacggagatcgggcgacttcacctgggcaccctgcagggtcttgacgccgtgcacgattgcgtggtgtccctcgatcttgatgtctgcccccatgcggttgagctcggaggcaaacatgaagcggttctcgaagatgttctccgtgatgatgcaggtgccttcggcaagcgcgagcacgcacatggtctgcgcctgcatatcggtcgggaatcccggatacggaagcgtctggatatcgacaggacgcaggcttcccgtgcgggatacggtgcagcagcggctgccgcgctcgaccttcatgcccatctcttcgtacttcctgagcacgagccccagatgctgcggctcgaagccgcggaccgtgatcggatccttcgtgagtcctgccatcgcgaggaaggtgcccgcctcgatgcggtcgccgacgaccgcatgctcgaccgggtggagctcacgcacgccttcgacttcgatgatcggagagcctgcacccttgatgctggcgcccatctcgttcagcatgttcgcgagatcgacgatctcaggctcgcgtgcggcgttgtcgatagtcgtcgtcccctttgcgaagacgcttgccatcatcaggttctctgtcgcgccgaccgaagcgaactcgagcgtcaccatggcgcccttgatgccatcaggtgccgacgcatggatgttgccgtggtcgatctcgaacttcacgcccagggcctcaaggcccaagatgtgcatatcgatcttgcgggcgccgatgttgcagccgccaggcatagcgacgatggccttgccgaagcgggcaagcaaggggccaagcactgccgtggaggcgcgcatctgggcaacgagctcatagggcgtctcccacttgtccacgttcgaggtatcgatcacgagggtatgggtgtccgtgacctcgattgtagcgccgaggcgcttcagcaccttccccatcacatggacatccgagatgttcgggacgttcgtgagcgtcgtcgtgccgggcgccatgatcgttgccgccatgagcttcagcgcggagttctttgcaccctcgaccgttacctcgcctgtgacgggatagccgccctctatctggataacttccatgtacttcctatctatgcggtctgcttggccgcagccgtcggcgcttccttcagaaggaggtcgcaccagtcgatcttgttctggtagtacgcacggcggtggtcgtcttccggcagggcgttctttgcattgaacgccttctgcttcgtctgctcgacgacgacaggatcgatatcgtcgatgtcgcgggcatggtcggccagcacgatgaccgtgttgttgtcgatctcggcatagccgccggaaatgacgatacggcgcaggtcgccgccatcctccttgcggcgggtgatgcgcatgacgccgtcgcccagagcgaggatctcagaggcatggcccggccagacgccgacttcgccggtatatgagacaagcacgacatgggcgataggcccctcaaggaggagcctatccggtcgcactatctgacaggtgagttctgccatctgtacttccctactcagcctcggcggagccctccgcctcggccttcatctttgctgcacgtgcacggacatcgtcgatgttgccggcattgcggaatgcctgctcggggatatcgtcgcattcgccgtcgatgatggcagcaaacgagcggacggtatcttcgaccctgacgtagacgcccggctggcccgtgaacttctcggccacgtggaacggctgggagaggaactgctggaccttgcgggcacggttgacggtctggcgctgctcttcggagagctcgtccataccgagaatggcgatgatgtcctggaggtcggagtactcctgcaggatctcctgcacggccgtggcgacacggtagtgctcttcgccgacgacagcggggtcgagggcggagctggaggaggcaagaggatcgactgccgggtagatgccaagctgggtaatggcacgcgaaaggaccgtcgtggcgtcgaggtgcgtgaacgtcgtggcaggtgccgggtcggtcaggtcgtctgccgggacatagactgcctggacagacgtaatcgagccctcgcgcgtcgaggtgatgcgctcctgcaggtcgcccatctccgttgcgagcgtcggctggtagccgactgctgaaggcatgcggccaagaagtgcggagacctcagagcctgcctgcgagaagcggaagatgttgtcgatgaagagcaggacgtcctggccctgatcgcggaagtactctgcggtcgtaaggccggcaagagcgacacgaaggcgtgctccaggtggctcgttcatctgtccgtagaccaggcaggtcttgttgatgacgccagactcgctcatctcgaggtagaggtcggtaccctcacgggtacgctcgccgacgccggtgaagacggacgtgccgccgtgctcctgcgccaggttgttgatgagctcctggatcaggacggtcttgccgacgcctgcgccaccgaagaggcccgtcttgccgccgcggacatacggctccaggaggtcgatggccttgatgccggtctcgtagacctccatggtcgtcgtcaggtcctcgaaggcaggtgccggacggtggatcggataatacgcgagtccctcgggcatgggcttgccgtcgaccggctggcccatgacattccagacgcggccgagcgttgcctcgccgaccggcatcatcataggctggcccgtatccttggctttgaggccacgctgcatgccgtcggtcgatgccatggcgaccgtacggacgacgccgtgcggaagctgggactcgacctcgagcaccacatggaccttgcccatgggggtctcgccgtcgacgatgagggcgttgtagatgtcaggcacctggtcgtcgaacgcgacgtcgacgacagcgccgacgatgcgcacgacggtgccgacaccggcgctatgcttgcggtagtcgcgcgcaagcgcctcgaagtcgacgctgttcttttcttgttctgccatcagttgtcctccaatgcggacgcaccgccgatgatctcgttgagctcggtagtgatggagccctgcctgacgcggttgtacatgcgcgaaagcgatgtgatgacctcgttcgcgttgtccgtagcggactgcatggcgcgacggcgtgcgccatgctctgctgcggcggagtcaagcagcgcgtggaagatgaccgtcctgatgtaggccggcatcagatatccaagcaccttggaagcgctggggtcgaacgtgaactccgtatagagctcgtgtccgacgtgctcgagcgcctcgggattgcgcggtgcgttaggaatgacaagatcctcggtacgcacgggcaggagctgctcggtgaccttgtcctggtcgaccctgttgcgggcgtgcatgtagtagagcatgacgcggtcgatggtctcggccttgtagccgtccatgacataggaggcgatgcggtctgcctcgtccatcgtcggctcggaggagatgcccacgaaggacatgaccggctcgaggccgcggtaggtgaagtagtccgtaggcttcctgccgcacgtgatgaggaggctcttcttgccctggcgcttcagggcctccatctcatgctggacctcgcgctggaggttgatattgaagccaccagcaaggccgcggtcggatgcgatgaggatgaagaggacgcacttctccttgtcgtgcgtggccaggagcggctgcgacaggtcgacgccggcattggcgacgtttgcgagcatgcgcttgattgcatccttatagggtgctgcctgctcggcgcgctccaatgccttgcggatcttggcggtggagaccatctccatcgtcctcgtgatctgcatcgtcgccgtgacggaggagatgcgcttgtttatctcgcgaaggttcgacatgtgccgtgcctcacgccttctcgttctcgtccgtgtcttcctcttccttcttcacgccgtgcttctcgaggaagctcgccttgaagtggtcgaggtgcgtcctgatctggtcggccattgcgtcggagatgcggttcttgcggatctcctggcggatcccgtcatggcgggtagccatgtactggaccatctcatccctgaacgggacgacgaggtcgaggtcgagatcgtcgacgtagccttccttgcccgcgaagagcgtgagcacctggtcggcgacatcgagtgcggcatagcggccctgcttcagcagttccgtcatgcgtgcgccgtggttcagctggtactgggtcgttgcatccaggtcggagccgaactgggagaaggcctgcttctcgcggtagtatgcaaggtcggagcgcagcgtgcctgcaacctgcttcatggacttcagctgtgcggcgccgccgacacgagacaccgagatgccgacatcgactgccgggcgctggccctggaagaacaggttcgtctgcaggtagatctggccatccgtgatggaaatcacgttcgtcggaatataggccgagacatcgccgtcctgcgtctcgatgatcgggagtgccgtaagcgatcctgcaccgttggcgtcagaaagcttgcaggcgcgctcgagcaggcgcgaatgcagatagaagatgtcgcccgggtaggcctcgcgtccaggcggacgatgaagcgtcagcgacatctgacgataggccacggcctgcttcgacaggtcgtcgtagaccacgagcacgtgtccgccgtgatgctgcgcatctgcgggatggccatgctcgtcgttgtacatgaagtactcgccgatggcagcgcctgccataggagcgatgtactgcataggagcagaatcggcagccgtagcagagacgatgatcgtcttgtcgaggacgccgtgctgcttcagggactcgcggatcgatgcaaccgtcgaggccttctggccgatagcgacgtagatgcagatgatatccgtgtccttctggttcacgatcgtatcgattgcaatggcggtcttgcccgtcttgcggtcgccgatgatgagctcacgctggccacgtccgataggcaccattgcatcgacggcaagcaggcctgtctggacaggctcgcagaccggctggcgctccatgatgccgggagccttgaactcgatcggacggcggtgcgtcgtgttgatcgggccgagaccgtcgatcggctggccgagcggattcacgacacggccgagcatcttgtggccgacaggaatgtccatgacgcgaccggtcgtgcggcactcgtcgccctccttgatgaagtcgacttcgccgaacaggaccgcgcccacatcgtgctcgtcgaggttctgcgccaggccgtacacggtatgtcccgtctcagagctcgtgaactgcagaagctctcctgccatggcagacttgagtccggagacacgggcaatgccgtctccgacctgggtcaccacagacgactcctgcgtatccaccgtggcggtcacgccagccagctggctgcgcagctgcgccatgatggcttcggagctgatttggctcactattcttcacctccgaggaaggatgtagaaagcttcttcctgatgttgacgagctgcgccttcaccgaagcgtcatagcggttgccacgctcctcgatgacgatgccgccgatgattgaaggatcgacacgctcgacgagataaatcggggccttgaggtccttctccatctttgcgcgcacctctcccctcagcttgtcatccatcggcacagctgtcgtgaccgtgacggacacggtcttgtcatcctggtcgaccagggtcttgtactgatgtgcaacatcctttacaagatcgaggtcattgtcctcgcgcatcgccgtgagggtctcgaggacctcaggcgtgaacttgacggcatgctgccattggacaaggtcggcattggctcttccctcggaacgggctgcatcgagcagtgcgcgggtataggcctcgaccttctcctcatcattcttgcttgccatcagcgctacctacttccgcaaggtacttctcggccagctgacgctgctgatcctgggtcagtccatcgccgatgatcttgctggcgatttcgaccgagaggtcgacgacagagctggaaatctcgatcatggccttgtggcgctcggaatcgaccacatcgtgggcctttgcgacggttgcggctgcatccttctgggctttggcaagcaccttggagcgctcggcttcggcctccttctttgcagctgcgacaatctcgtcggcctggcggttggcatctgcgagacgcttctcgtattccttcttcgtcgcctcggcatctgcctttgcctttgcggcatcgtccagatcgcccttgatcttggcctcgcgggcatccattgccttcagcacggaaggccaggcgaacttcgcgagaacgatccagatgatgatgaaggcgatgcaggccgggatgaactcagccggcctcggcatgagcagtgccatgccgcccgaagactcctcagcaaatgccagcgtcgggagcgcaaaggcgacgacgcccgccgcgctcgcagctataccgcggaagaagctgttgttcttcaaatccatattgctccctctttccgcttgctggcctagactacataatcgagacgacgaagccaatcaggcacagagcctcgatgaatgcagctgccaggatgaagacggtaaagagtcggccctggacctcgggctggcgagccatgctgtttgcaacgttggctgcagagaggccgataccaagtgctgcaccaatgacgcagagaccgtagccaataacgttcacgattcctcctttgtcattcgccagtccttatggccggcgaataccgaactatgtactagcaggaagtccctgcgagtaacctcgaagctattattcttccgtgctctcggcgccattgatgtagacggcagaaagcagagtaaagatatacgcctggatgaaggcgatcatgagctcgacgccgtagatcatgatgagcaggaccatccagagggcagacatggcacccgtgccgactgcagcggcagagattgcaccattgatgagcggctcgaggaagattgtgcacatgattgcgaaggtgcccatgacgacatggcctgcgaacatgttgcagaaaagacggacggcaagcgtgatcaggcgaaggaacgtcgagaagacttcgatgatccacacgacgacacgaatcggaagcatgagaccggaaggcgcgaggctcttcacatagccccagaggcccttcttgcgcacgccgatgtagatgaagtagcagaacgacatgagcgcgatggcgcccgtgacaccggtggagccggtgcccggcttccacgtcggcagcatgccgatgtagttgccgaagagaacgaagaagaagagcgtcgcaaggaacgggaagtgcttcctccacgtatcgccgagcattgccttcgcgatatcgtttctgacgaactcgatcaggtactcgacgccgttcacgaagacgccgtgcggcacgaggctcgcgctctgcttcttcgtgaagacgagcagcacagctacgcacagagcgcatgcaacgaggagccagaacgtatagatcgtcaggccgaacgtcgtatcgccgacaaccgcagtcggatagaacgtattgatgagctcgctcatcgaattcgagacttcggcaaaggcttcgcccacgatgactacttcccttcactcacacatatcatgctcagtctgaagagagggcggagcgtatggcttcgactacccatgcagacaggaacacgcctattgctgataccccaaacatcaggacatctttcggtttcagcacgtacaccataacaaacgcagccatcaggagagcaaaggagaacacggctgcaccgaaggcacggcccaggcgcgcttctatcctcttcctcctgaccagctccagaaggacaacgcctggcagcgccgccagaaggccacacatgagccctgccgcggtcacgcccaagcgctacctccttcttgctgcagcattcgcgctgaaaaacgtcttcagacaatattcgtacccaccgagaatgtccactcatccacctaaactcgggtctgcacctcagtttcgacacatttctgacttgcgttcaaaaacaggagacacccccggtgggaacggaattacttcgtgccgtagatgcggtctcccgcatcgcccaggcccggcaggatgtaggcatccttgttgagctcgcggtcgagcgcgcaggtgtagaggcgcacatccgggtcgtagtcgaggacagcgtgcacgccttcgggagcagagacgagcgtgagcgcacggatgtccttcacgccggcctcccgcaggaactggattgccgctgtcatggatccgcccgtggcaagcatcgggtcgacgatcaggcaggtgcgcttgtccacatcgggcgggaacttgcagtagtactggtgcggctcatgcgtctcgggatcgcggtacatgcccacgtgtcccacgcgggcagacggcacgaggtcgaggatgccatcgaccatgccaagtcctgcacgcaggatcgggatgatggcgacctttttgccggcgatgcgcttgcagaccgtcttctcgagcggggtctcgacctcgacatcctcgagcgggaagtcgcgcatggcctcatagccctcgaagatggcaagctcggtcacgagctcgcggaactgcttcgtgctcgtgttcttgtcgcgcaggatgtggagcttgtgctgcacgagcgggtggtcgatgatctggaagcgtggatcgttgatttctgccatatctagcacccctcggaatcgacgccagcaaacttcggatcgtcctcgcgcatgatcttcgtgaccctgcgctcatgcctgccgcccagaaagtcggtctcgaggaacgtcttcacgaagtccatgttgtcggaaagcgacacgaagcggcccgagaggcagatgacattggcattgttgtgctggcgggcaagctctgcgaactcatgcgacgtgattgtcacggcacgcacgtccggcaccttgtcagccgtgatggccatgccgaggccggtgccgcagatgaggacgccgaagtcggcctctcctgctgcaaccttgcgcgctaccttgtcggcgtagtcaggatagtccacggaatcgaagctctcaggcccgaggtcttccacctcatggcccagagactcgatgaactgcaccataggcggcttgaagccgtatccgccatggtcggatgctatggcaatgcgcacgtcgtgctcctttcaaaggctatactcttttccgattatggcaccaaacgcgcagcttggctatgtgcgctcctgcctcacgagagggcacgctcaacagcgcggcgccaccctgcgatgaggcgcgtgcgctcttcctcttgcatctcgggcacgaatgtacgctcgatgctccggagctggcagagctctttgcgcgagccccagacgcctgtggcgagccctgcgatataggcggcaccgagagccgtcgtctcgccgactgcgcagcgcacgacatttgcctggagcaggtctgcctggaactgcatgatgaaatcattgcgcgacgctccgccgtcgacctcgagcgaggagagcgaagacgaggtgttcccgaacatggcctcggcgatatcgtaggtctggtacgcaagggactcgcaggcagcgcgcacgatgtgcgcccgcttcgtgccgcgcgtgaggccgcacaaaaggcctctggcatctgcgtcccaccagggtgcaccgagtcccgtgaatgcaggaacgagatagcagccctgcgtatctggaatggagagtgcaatgtctgccgtctcctgcgcagaggagatgaggcccacgtcgtctctcagccactggatgatcgtgccggcattgaagacagagccttcgagcgcataggcgatctctgagccctgggcgatgccgattgtcgtgacaagaccatggtcagaaagcttcggctcggcaccgacattcgcaagcaggaagcagcccgtgccatacgtgttcttggcagatcccgacgcaaagcagcagtggccgaagagcgctgcctgctggtcgcctacgacacccgtgatcggaggcctgtgcgagaggatattgtgcgtcacatagccgaagtcgccatccgatggctttgcctcaggcaggagattcatgggcacgccgacaagatcgcacagctccttgtcccagcagagcttcgtgatatcgaagagcattgtgcgcgaggcattcgtatagtctgtcgcatgcaccttgtgcgccgtgaggttccagacaagccacgtatcgatcgtgccggccagaagctttcctgcctccgcatcagcacgcgctctctccacatggtccaggatccaggcaatcttcgtgcccgagaagtatgggtcggggatgaggccgcacttcttgtggatgagctcccctgccccttcgtccaaaagcttctggatctggggcgccgtgcggcggcactgccacacgattgcgttgtagataggatgccccgtctccttgtcccagacgaccgtcgtctcgcgctggttcgcaatcgagaccgcagcaagccggtccgaatggatgccggtcttgaactgcacctcgaccatgcaagccacgatgcccgaggcgatctcttcgggatcctgctcgacccagcccggatgaggatagaagttcttgatcgggcggctggcctgtccgacaggctttccttcctcgtcgaagatgatggcacgcacgctcgtcgttccggcatcgagcgacatgatatagcgggacatgggctgcctcctgggatggcttcctccgaacagacgcccccattctgcgagccaaggccgcagaaaacactaccagttccgcagacgtcatcccgctctcggttgaactccgccttctgccgcccacccgcgaaatcctgccgttcgctgattctgattcatcgattcagatattgctgaatcatttgtctattctgattcatcgtagactggttcggcgattcagatcgccggatgagcaaaggaggagtgggatggcagattacaaggctcttgcccagaccattgtagacaacgtcggaggagcgaacaacgtacgcgccctcacgcactgcgtgacaaggctgcgcttcacgctcaagaatccgaagctgacaaagacagatgtgctcgagaagaccgatggtgtcatcaaggtcatcgaagccggcggccagtaccaggtcgtcgtcggcgccaaggtcacaggcctctacgacgagatcctggcagactttgacgtccagggtgcaggcgcggtcgagccagcaccggcagaggcagacggagatgcgaagaacaacgccgtgaaccgcctcatgggcacgatgtccgccatcctcatgccgacgcttccggtccttaccgcagccggcatcatcaagggcctcgtcgccctctttgccgccctcggcgtgctttctgcgacctcgggcgtctacatggtcctctacgccgtgggcgacggcttcttctatttcctcccgatcatgctcggctatacggccgcaaagcacttccgctgcaacgagttcatcggtgcagcgatcggagccgccctcgtctacccgagcatggtgaacatcgcgacgacgcttccggtcgcaggctcgctctttgccgggacgccgttccagatggacttctacaacacgttcttcggcatccctatcgtcatgcccggctccggctatgcctcctcggtcgttcctatcatgattgctgtctggttcgcctcgatcctcgagcacacgttcaagaagcacctcaatgagatggtgcgcgacctcctgaccccgctcttcgtgcttgcgatctccgtgcctgtgacctacctcgtgatggccccgtcgtccagggcatctgcggcttgacactccccatggctagagccaggggattctcgcttcacagcagatagccttcccccgcatgcgcgggggcgggtcttacgcctgctccacgagcgttcggggcgcttgcgcgcccccggttcccgcaagccctgcggtaccgtttccctccgccagcagcctcgcgccctcggcggcgatgttcttcgccgcgttgaggtctcggtcgtggcgggccccgcactcggggcatgtccagctctcgaccccaagcacgacgttcttgttcacgtagccgcagcacgagcacgtcttgctggacgggtagaacctccccaccttcacgaaggcacgcccgtaccaggcgcacttgtactggagctggcggatcatctctgacatgcttgcgtccgccacggccctggcaaggcggcggttcttctccatgccagccacgttcaggtcctcgacggcgatggcttggctctcgcgcaccgcttccgtcgtggccttgtggatggcgtccttcctctggttcgcaatcttctcatggacgcgggccacccggacccgctgcttgctccgcctgttggagcccttcctcttcctcgacagcctcctctgctcccgcgccagcctcttctctgacttggcgaggctcctggggctggcgacagccttgccgtccgaacgcgccatgaggcagcggatgccggcgtctatgcccatgacctcgacagggccttccggcatgtcgggcgcagggcagcccgtgcagcagacggtgacgaagtatttgcccgtcggcgtccgcttgacggtggcgttcacgacgcggccctcgggcatgcgcgagacgcgggccttcaccgtgccgagcttcggcagcctgatatggccggcatccggcacggctatcccccagttggtgcggtagctctggcggctgtcgcgcttggacttgaagcgggggtagccaggcttgccgccggtcttgcagcggcggaagaacccgtcgaaggccctgcccaggttcaccacggcctgctggagcgcgtgcgagtccacctcggagagccagggggcctcttcccccttccaggcggtgacgagcttctggagctggtagacggtaggcgacttgcccgtcttctcgtactgctcccttttcgtctccaggcacctgttgtagacccaccggcagcagccgaaggtccgctcgatgagggcgcactggtctgcgctgggatagatgcggtattcgtaggccctctccatcgctagacccccttctggctctcgatgtactgcttcacggctgagaggggcgctccgcccacggtggagacgaagtagctgttggtccagagggacgggagcctcttcttgagccaggggaactcctcgcggaggtcgtggctggtccttcccttgatgcgcttcacggccctgtggatgccgagctgcgggtccacctccagcagcatgtggacgtggtcgggcatgacctccatctcgattatctcgaaggagagctcttcggcgacctcgcgcgctatctccttgaggcgctcgtccacgccgtccacgagcacccgacggcggtacttcgggcagaagaccacgtggtacctgcagctgtagacgacgttgttgttgctcttgcactccatgcaggcattataccacatcgacctgtctattgtcgccttcggcgatgcgcggcttggccccatgcctgaaggaagaggcttgcgccgcgggtctggccatcccctcggcctttccaacatcgcccttgccggcttcgactacatcatggctgcaggcggcatcggacctatggtcggcatggcgcagggactgtgcgtcacgctgcgcacgaagtccaagaaggtccgcgacctcgcccttccctccttcatctcccaggtcatgggcgtcggcgagcccctcatgtactcgatcctgatcccgctcaggaagccctacgcgatcaacatcatcggcggtgccatcggcagcgccatcatcggcgctctcaagggcaagatctacgtcttcggcggatctggcctcttcggccttgcgaactacgtcgatccttcgggcgatccgacgaacttcatccactgcctgatcggcattctcgtcgcaatggtcgctgtcttcatcatccagtggattgcctatgatttcgatgtcgagaagaaggtcatcggagaatagaaagccttgcagaagaggccggccaaggccggcctcttctctgaaagagagagtgtctcatgctccagcatcttgcaccgaaagacttcgagccggaaaccatcacgctcgatggccgtacgctcagataccgctcatgccgtggcgtccgctactgcgagcgtccccaggatccgatacaggtcctcaacatcttcgttcctgaagcctacttcgagggtggcagcatctcgggctacacggcagagaccgcccccgtcttctgcccgagcacggtcggcggctacatgccaggaccagctgcagggccaggacccgaccacttcttcccgacgaacgccgtcttcgaggcccttgtgcatggctacgtgattgcaggcatcggcgtacgcggaaggacgaccggcagcacctccacggagttcttcatgggaggctccatggaggccagggaggcagcggccaccggcaggctctgcggccgcgcccctgccttcatcgtcgacctcaaggcgggcatccggtacctgcgcacctatgcccaggatgtgccgggagacctcggccgtatcgtgacgaatggcacctctgccggaggcgcccattcagcccttgccggcacctcgggcgactcttccgactacgcagacgagctcgagtgcatcggcgctgtcatggacgcctccgatgctatcttcgctgccagctgctactgtccgatccacaacctcgatcatgcagatatggcatacgagtggcagttcaaaggcattgccgactgccactacacacatttcaggaagcgcgatggcaagatcgtgaagatcagcgaggattccgtcctgacggcggagcagcaggagctctccgaagagcttgcctgtgccttcccggcctatgtccgaagccttggcctcacagacaaggacggcacctccctcacgcttgcagaggacggcaccggctccttccttgactggatcgagcgccagctcattgcctcagcacagcgcgagctcgagaccggggcaaacacgcagaaccttccccagctcatgacagaaggctctgctcctgaagcgctttcctgcctctcgatcgaagacggcaccgtgaagggcatcgactggcctgccttcgtccgcacgatcacccgcatgaagccctgccccgccttcgacgccctcgatctccattctcccgagaacgaggagttcggcacagaggacatcatcgcccgccacttcacggcattctcgcaggagcacacagcaatgcctgcagagcttgcgcctgacaggacgatacggatgatgaatccgctctcatatgtgagctcgcctggctgctgcacgcactggcggattcgccatggctcctatgaccgcgacacgtcgcttgccattcctgccatccttgcgctctcgcttgcgaatgcaggcaaggacgtcgacttccgctatccctggggccttccccacagcggagactacgacctgcccgagctcttcagctggatagacgggctctgcctgaacggacgctagacaagatgcggccccggctcaaaaaccgaggccgcttcatgatggtacggtatggaacataatgtatgtgatgcctgatgcgggaaaggacatgcggtggacgtcttcgacgagatagcgcttcacaaggactccctcacgcctgctgagcaggccgtgagccgcatcgtccaggagcatcccgatgcgatactcggatgcacgagcaacgagcttgcccgccgcttcggcgtctcccagagcgccgtctcccgcttctgccagaagcttggctttgcaggctacggagagttccgcatggagctccacaagacgctgacgctcagaagcttcgatggaggagcagagccgcaggaccgcacttcctgccttgcccgcctcatgcagggcgtaagcgacgctgtcggagaggagacattttcctccttctacgaacgcatggcacgggctcgctccgtctatgtcttcggtgccgggcagagctccatccctgcccgcatgcttgccggcaggctcctcgaggattcgattccggcccgctatgtcgcgctcggctacgagaccgaagtgctccactgcatgtcggacgcagatgaagtcgtgatcttctccgcgaaaaacgacacgttcaagcagctccttacgaccgcatcgaccgtagggcccaagaggcgtccgcacatcacgctcatcgcgaatacagccaagcaccccgagcgcaagcatgtggacgacgtgatcgtccttccgacgtggtcaaacctgaagcttccgctctatctcgagccgcagcattccatgatcttcttctgcatgcttgtaggcggtgcgccgaagaagcggtcccagcagtcctaggcagaaaaagccgggccctgctccatgcttggaacagggcccgaatattgtgcgctgcagaatctgcctcttagctaggcaagcgcctcttcgatgtctgcgcctgtgatggcaccctcacgcagaatctctggcttcccctttgtgcagtcgacgatcgtcgaggcagcacctatacgcgacactcccccatcgaccacgagatctgccagctcgaagagcctgtcctcaatctccgaagcctttgtggcagcagggtttccatgcgtattggcgctcgtctgcgcaagcgcgccgaccttcctcacaagcgcccgcacaaggcctgagtccggcacgcgcagcgccaccgtgccggtgctctgctgcacatattcaggtgccagcctgtccgacgcacgcacgacaagcgtgagcgctcctggccagtacttctgcgcaagcgtatgtgcccaggcgggcacgtctcttccatacacgtcgaggtcccactcatctgcgatgaagagtggaagggtctgcgcgagcggacgctccttgatctcgaagatgcgcctgtgcgccggatttcctgctgtcgcccggcagctgagcccatagaccgagtcggtcggaaggacgcagaccccatcgtgcaggagcactcctgcaatagcatcgatagcgctttccgcaggcgccatctggtcagcttgaagcatcttctcctccatggcctatgccttccttcttgccacaagcacgcgcgggcggtgcgtcaagtcctcgcgcacctcggctgaggcccagccgtcacgtgcgcgcacataggcagctgcggtctcgagcgaatcctcgaagagctcgacggcgagcataccgcccggcagaagcgcatgctcagccacgggcacgatccttctgaacacatcgaggccgtcagcgcctccgtcgagcgcgagccctggctcgaagccgatgacctcttcgggaagcgtcggcagaaccgacgtcgggatatagggcggattcgagacaaggacagagaacgtgcccatgagggactcatcgacacctgaagcgaggtctccttcgacgatatccacattgtcattcagattgagggcatccctgttgcgtacggcaagggccagcgcctgcttcgagatgtctgtcgtgaccacatgggcgcccgggcgctccgaggcgatggagagggcaatgcagcccgtgccgcagccgatctcgagcacacggggacctgccggcaccttcacatgctgctggagcggcaggagctctgcatcctctgcatggagcggagcgtcatcgccgagctcgtctgcatccttcgtcgattcctggatcttctcttctgccgccgcacgggcctcctgggccttctggtcgcgcgcctcgagcttcggctcgatatcgtcgaagacatctccgcgcgccatagcctcatcgaccccttcgagcgccgcatcgacgaggatctccgtctcaggacggggaatcagcacacccttctcgcagcgcaggatgatgtgccgaaacggcatctctccggtcacgtactggagtggctctcccctgcccctcctcagcaccgcatcatgcatgagagcaagctccgactcgtcgagcggacggtcgaagctgatatagatctcgaccctcgagaggccggtcgcattgctgatgagccattcggcagaaagccttggatgctcgtctcccttgccctcgagatagtcggtgcaccacttgagcatgcgcccgacagtccaggcagcgtctcccatcgcttttgctccttcagaaagcagggcgcccagaggcgccctgcacatggcttacgattcagatgagggcatcagacggtctctgcaagcttctctgcacggtctgctgccgcaagagcctcgatgatcgatccgagctggtcgccctcgaggacacccgtgtacgtcgcattgaagccgatgcggtggtccgtcacgcggtcctgcggctggttatacgtgcggatcttctcggagcggttgccgtggccgatctgcgagaggcgctctgcgccctgctctgcctgttgcttctcgagctccatctcatagaggcgggcacgcagcatctgcatgcagacggcacggttctggatctgggagcgctggtcctgagactgcacgaccgtgttcgtcggcaggtgcgtgatgcgcacggcagaatacgtcgtgttgacgccctggccgcccgggccggaggcgcagtacgtatcgatgcggagatcctcgtccttgatatcgatatcgatctcgtctgcctcgggcaggacggcgaccgtcgccgtcgaggtctggatgcgcccctggctctccgtcttcggcacgcgctgcacgcggtgcacgccgctctcgtacttcatgacggaatagaccttgtcgcccgtgaccttgaactcgatggtcttgaagccaccagcctcgccggggctcgaagagagcacctcgatcttccacttgcgggtctgggcaaagcgctggtacatctggaagaggtcgcctgcgaagatggcagcctcgtcgccgccgacgccggcgcggatctcgacgatcgtattcttctcgtcgttcggatcgcccggaatcagcatgatcttgatctcgtcctcgagcttcggcaggcgctcctcgttcgaggagatatcctcctgaagcattgccttgtcgtccgggtcggacgtctccttgagcatctccttggccgtctcgatgtcctcgagcgcctggagatactcgcgcgcctttgcgacgagctctgcctggtcggcatgctcctttgcgaggcgggcatattctttcgggtctgcgatgactgccgggtctccgagcttctgctcgagctcctcgtaggcagccaccagcttcttcagcttctctggcatggctgtgctccttgcatatgatgccgcatggcgcggccgtggcttttccatccataagggtaccaccgaaggggcacttccatgcgccttgcagatggctccacctgccgcacaaggatgcggcaggtgcatattcaattgctagtagcagaagccgacgacgacgccgagctcctgggtcgcattgtcgaccgcgtaggggccggagaccgtgctcacggcacggaagtggtcagaggaggacggagacgaggtcctcgtccaccaggtgttcgcatcggtgccgatgccggactttgcctcgacctcggaagccgtgccgaagccgcccgtgacgcccgactcggagaagacggcatactgcgtgccttcagacccgaggatcgtgttgtagttcgacgtgtagctcgactcccagttccagttcaccgtgccatagacctcgacgaaggacggaatccacagcgagtcttctgttgccgtgaccgcagccgtgttcacggtgtagcccgtgttgttcgtcatcttctcgaccggcacgatgtaggtggcaagctcatccggcagaagatccatagcatcggaggagagccaggagcggagcgcggagctctcccagccgccctggtcggtcgccgtcgtattcatcgcatgcgtgagcgagcttccggaaagcaggaacgttatgccagcctttccgccgtctgccatatcgtccgtatagatgtcagcgacacggagctcggctgtcgtgccatccgtgagcgtgatttcgtttgcctcggtcgtgaccgtgccatcctcgttgcagatgccatactgctcggcaacagagagcgcctcatcgcgcgaggacgtcttctcgattgcctgggcgatgcccgcaagctcggaggcgctgtactcgctgaagctcttggcagaagagggcagtgcggcctggggctcaggcgacgtctcctctgtcgtggcagcctgctccgaggtggtttcctcggtcgtctcgctcgtgcccgaaagggcgcccgagtgcacgaaggcgacaatcgccacgaccgcgcagacgcagagcactgcaatggctacaggcatcgcatgcggtgcatgcttctcctcctgcttcgcgctgcggctgcgcaccaccggtgctggcggcaggacgcccgtcttctctgtatccggctcctgcacggcagcagccgtcctctcgtcctcgagtgcctcgtccattccattgaggctgtcccaggagacgtagccgtcgatcggatgcagctggtcttcggatgcctccatgcggtggactccggcatggagatgcctatgcggggccgcgacaggagagagcggtacaggcgaggagacagtctcgttctcgtctgtggcatcctcttcgctcaccggtgctgcttcggggatgtctgccacatcgtgcgaggcaagctcctcgtccattccatcggtcaggacctcggtcctgtctgcctcatcggaaagcgcgcctgcagaataccaagacttggccttccgcatgcgccaagcgcatgcacaaggtatcatcggttcatacagaacacgcggtgaaaggtgacgcatgaagtgcagcaattgcggctatgagcttcaggaaggcatgaaattctgccctgaatgcggcatgagggtcaagggcacgaagcctatcaatgcgcgggaaagacggccgcgctcggctctcccgacgagacgctgtgattctggcggtgcctctgatagtggcgcctgatgcagacaggacgaccgtgctgtcccatgaagtggcagcagatatcgcatcggaagcgacacaggtcctgccgcacgaagtggcagcaagacattgcagccgatgctgccgaagagggctcggccccctcattcctggctggcgcaaaggaggagcctgaggcagagcccgagcctgcagaagaggaagctccgcctctgaggagagcgggaagacgccggtggcagcaggaaggtgacaggtccagcgcggaccccaggtggcccgcatccatatccatgtgcctgaaggcaaggaagccccgcggacagagagcttgccgaagaggctcctgctcaggagacggctgtcgaggaagcgcctgcagaagagtgtggcatcagaagaggctgcccctgctgatccgtccgctgaagcgaagtgccggcagctgcttccgaagagctcggcgagatggcagagcccgcaagcgagcctgcacctgagcctctagccgaagaggatgaagacgactgggacgacgagccgagggagcccttccgcgtctcgatgcaaggatgcacctgcgaaagagcctgagctttcggaagctgacgaggaggcgctcgagcagaggatc

SEQ ID NO: 114 - DNA, 19234 bp, Unknown
  Metagenome-assembled genome
gcgcgcccacgcccccgtcagggccgtgaaggggccacatcgcattcaaggccgacgccgaggatccggctatctcgagggcatgaaatggtcaacgcctgtgtgcctggatcaggcgcttccgtgagggctatgtgtggcatgaagacctcgacctccaggagtattctcaatggtctgtctactctcttccgggtccagggtcaagcaggctgacgagaggtggccgaagaccgcaagggtccttcgccatctgatgctcaccgatgcacattaccgcagctcaaggaagcgcgaacgtccgcactctggttgactattcaattgcagatttggaacgcattgaagagcggatggacgagctgaatgtccttatcgaggcctgtaaaagaaaggttcctgacagtaattgactgtctcgaggcaaaaaatgaggcaagcccgctttcgcgaccctgccttgcaaaacccgaaggttttttctgtctgaggacatgctctcagattcaaacaggaaatcaagtgccggcgaaagacgggcgagggttctgtaaccgacttggaatttccagacgaattgctgcgggggagtgtcactgcactttgcttctctgcatgaaaaagccggctcccacagaagcggaagccggcttgcagttcgaaggaatagcctccgaagccttacttgttcagtgcctcttcgacagcgacagcacaggcaacggtgcagccaaccatcgggttgttgcccatgccgataaggcccatcatgtcgacgtgtgccggcacggaggaggagccagcgaactgggcgtcagagtgcatacggcccatggtgtcggtcatgccataggatgcaggaccagcagccatgttgtccgggtgcagggtacggccagtgccgccaccggaagcgacggagaagtacttcttgccggcagcgaggcgctccttcttgtaggtgcccgcaacggggtgctggaagcgcgtcgggttcgtggaattgccggtgatcgagatgtcgacgttctcgtgccacatgatggcaacgccctcgcggacgtcgtcagcgccgtagcacttgaccgcagcacgcgggccgttggaatacggaacctcgcggacgatctcgagcttggaggtgtagtaatcgaacttggtctggacgtaggtgaagccgttgatacggctgatgatctgtgctgcgtccttgccgaggccgttcaggatgacgcggagcggcttcttgcgggccttgttggcgttgttggcaatgccgattgcgccctcagcggctgcgaaggactcgtggcctgcgaggaagcagaagcactcggtgtcctcgccgagaagcattgcgcccaggttgccgtggccaaggccgaccttgcgctcgtctgcaacggagccagggacgcagaatgcctgcaggccctcgccgattgaggaagctgcctcagcagcggtcttgcagcccttcttcacagcgatagcgcagccgagggtgtaggcccactttgcgttctcgaatgcgatggactgaatgccggtcgtgatgtcatacggatcgaatccgaggtcggtgcagatcttgcgggcgtcctcgaggtccttgatgccatactgctcgcatgccttgttgatctgggcgatgcggcgctcatagccttcgaacgtaactgccatgtttatcagctcctttcctggttactcgacacgcggatcgatgaccttggcggggttgtcccactgaccgtagcggcccattgcgtcgtctacagccttctgggcgtcgacgcccttcttcagggcatcggtgaacttgccgaggttcaggaactcgaagccgataatttcatcgttctcgttgagtgccagatgcgtgatgtagccctgcgtgagctcgaggtagcgggcacccttggccttcgtgccgtacgtggtgccgaccatggagcggaggcccttgccgaggtcgtcgaggccggtgccgataggcaaaccaccctcggagaatgcggtctgggagcggccgtagacgatctggaggaacagctcgcgcatagcgacattgatagcatcgcagacgaggtcggtgttgaggcactcgagaatcgtcttgcccggaaggatctcagctgccattgcagcggagtgcgtcatgccggagcagccgatggtctcgatcaggcactcctcgacgacaccttccttgatgttgaggctaagcttgcaggcaccctgctgcggtgcgcaccagcctacaccgtgcgtgtagccggagatgtcgctgatctccttggcctggacccacttcccctcctcgggaattggtgcaggtccgtggtatgcgcccttggtgacggggcacatcctctccacttctgcggaatactgcatggattctcctctccaaacgcaatcggcctcagaccccctatgagccaaggcacagcttgctaaaccgataataccgcgaacgcggatatgcgccattctgaatttgcagatggtgattgtcctcagaaaatggccagataggggccagaaggctcaagggtacaattgatgggaatagcaagttgctcaacgaaaggagcagagctgtgacattcaggcagacatctgacaagaaggttgcggtcttccttgccaatggcctcgaggagatcgaaggcctcacggtgtgcgaccttctctatcgtgctggcatcccttccgatacggtctccatcacgggcacgaaggacgtgacctcgtctcatcagatccatatcgtggcagacaagaggatcgaagatctcgacttcgacgagtacgacatgctcgtgcttccgggcggcatgccgggaaccttgaatctcggtgactgcaagatgctgacggacaaggtcgtggagttcgcccagaccggcaaggagattgctgccatctgcgctgctccttccgtctttgcaaagcttggccttctcaagggcaggcatgcgacgtcgaacccgaacttcaaggatgcctgcgtcgagggtggcgccatctactccgaggcaccagtcgtcgttgatggcaacatcatcacttcccgtggcatgggcacggccatcgacttcggctttgctatcgtcgagcactatctcggcgaggcaggggtcgaggacctgaagccgaggatcgtctggcagggaaagtagccctgcttgcatgagcgtcccattccggctaccatggcgctgcaaacaattcgtggtcgtttccgggctctgccatctttgcgctgcgcagctacttcagctgtgcggcgcttttttgtgcgcagatgccggacagggaggtttcatggcagaagagaaaggcgccaggcagagccttgccgccttcgagatgcttctcgggggagcaagctatgggttcatggcaacaacgtacaagctggcctatgcagcaggctatagctggcaggaagtcgtggcagcgcaggcctggacaggatgcggcctcttcgtgctcctggcgctcatcgaggctctcagagggacgaagctcgtgcgactgcctctccgcgaggcagccaagctcatggggctcggtgcgctctcggccgtgacttcgtccttctactgcttctcgatgacaaggctcgaagcgcccgtggccctgacgctcctcttccagtattcctggcttggcattccggtgcagcttgtgctcgatgacaggaagccgacgcgcagggaagccatctctgctgcgctgatcgtggcagcgacgcccatagcaagcggtgtctggcgacatgggctttcggggctcgatcctgccggtgttgccgcagctcttgttgcagctctgagctgtgccacgttccttgtgctttcgggacgcgtgagccccgcatgcggaacaggggagcgtggcaccctcatctgcctggggctgggattggcatcgcttctggtctgccctgcctatattccttcgggtgtcttcttctccggcatggcgccctttgccctcatggcggggcttttcgggatgtttctgccggtgcttctcttcgggcttggaggtcctcatctgagtgccgcttcggcaacggtccttgcctcggcagagcttccggcgggcctcttcgtgtctgcgcttgtactcaaggacagtgccgagccgctccagtggacagcggtggcgctcatcctcggagcgattgccttctcgcaatatcagggaaaggagcacggttcaagacggaggacgatccaggaagtctgaatctgcagtcgcgccattcatcccgaaacgcgtacgcgcacttttcaggctacgagtggcaagcccgatagaaggcagctccgatttcggtctcgctcgtcggctcgtatacctgctctttctgtccgccaagattgatggcgcggagatattggctgcgcaggttgttcgatgtgcctgaaccgcggaatttgatatagcggttgtccggtttcgttgtggtgaagacaaggcagctggatggcagacattccagcggtctgagattgtgcgctgtgaagatgagctggcctttgctgtggtcagagattacttggagaatctcgccgaggaggaattcgaagattcccgaatcgagctcatctatgaccagacaggcgttttcgtcgctatagacgtcaatcagccgtccgagaatggagatgattttcttgacgccttcagattcgcagcggaagggaacatagatatcccctctgcgcgagagcagctcgacacgctttccgggcttcccatcatccagcgtctcttcgtggagctctttgagctccagagacagccccggaatgatagcgcctagaacttcgttttccatcttgatggctgcatgaagctcaggacagattgatgctggcacaacagatgatctgtctgatcggagcaagaaatctctgaagtatctgctttcgccatccggtgtgaaatccgatttctccatcaggcgtttcaagccatctggggcagggaaaggaagcaaattgaaggcaagcgaggctccgcgggtagtgctgaagacttccagctttgctgatgcataagctgagaggagagagatgatgccagaaaggggaaggagcgtgcgcttgaaggcttcttcgccagcatgcgagatggtcccctcctgcatgcggtcggcgcagccttttctgacagcatcgacgaatcccccgaatgccttcgagaagattttagaggcgcttgcctgctcggatgaacgctgcgagaccgtcagctcaaggctggcttccggtcctgccagatttctgagagcacgtcagcgaatctccggagcgagcgcaaaatcttttcctgtatcgccgaggccataggcaataagggtgcgttttggcaagcctctctgctccagcaggcagggagcgtccacacatcagcagcttcaggcatgagaaagcgtcgacgactgctgtcttgcccgaaccgttctgtccctagatgccggcaatgcacgacccgaaatcgctgtcgcggaattctatggatccaagatggacgtttttgatgttcgagagctcgatctttcttgcacgaatcacggcaatccctttccttggttgcgtgatacgttaataggaaaggaaatcgccaattaaaacggaatatcgcaatgtatttacgtggcgaatccgcactccgagtgcaacaggatattacgaggtagccgcccaggcgcgacctatgatgatgcttgcggagacatgcatcattggaggcaccatggacggctacagccatcttagcatcgcggagcgcgaggacatcatggtccgctggaagggccatgagggggtcagccagatagcgagggagctccacagggacaagtcgaccatatcccgcgagatcaggcggaacggctggcagggccctgcagggcgccgctaccgcgcgtctacggcacagaggaaggcggacaggaggaggctgcgctgcaggcgccccaggctcatggacgagcccgagaggcgctcgctggtcgtgaggctcatgcgggacgagcactggtccccggaggagatatcgggccgcatctcggaggagcggcccgacctcgccgtgagcgattccgccatctaccgtgccgtggagtcgggatccctggactgcgggcttccggggcaccggaaggccgcaaggctgctcaggcaccatggcaagcgcaggcacaggaagggaagccaggagcgcaggggcagggtgcgcataacccatgacatctccgagaggccggaagaggcatcgtccaggaaccggacaggcgactgggaaggcgatacggtcgctggcaggcagggcggtgcatgcctcgtcacccaggtcgacaggatgagcggataccttgtcggcggcaaggccgccaggaaggcccatgccgaggtcaacgaggccacggagagggcgctcgagggagaggccgtccataccgtcactctcgacaggggcaaggagttctcggatgcagagggcctccaggaggcgctgggagcgccggtctacttctgccatccccaccatccatgggagcggggcaccaacgagaacaccaatggccttctcagggactggttcccgaagggcgagagcctcgacgatgtcagcgacagcgaggtgcaggaggcatgcgattcactcaaccggagaccacgcaagcgtctcaagtggaagtgcccctgggaggtctaccaccaccagtcgttgcacttgctctgaggattcgccgtctataaagtttatcgaaggaacctgattgctaacagggcatgaccagcatgccgaagaggtagagatcgattgccccgagccctgctccgatgaggagagaggcgatgccgagcatgatggcggaggagcggcttgtcttgatgaaggttgggtccttcttgcggtaatagatgtgctgcggcttctcattgtcgaagcgcttctgcacagcatgctcgtcgtaggtgtcccttgtcgtgctctcatagggctcaccgtcgatctcataggcaaagctcacatgatagatgtggggtgctgcgggcagatggtctgctgccacgaacgtggcatcggtcttcttgaaggctatgagcggaaagaggatttcgcggatgccgaggacgagaaagaggatcgtcaggggagccagtgcatagctcaggatggcaagctcctggtcggtcaggtacgaaagaaagttcacggagatcctcatccttcccaggacgtttcctcatcatcaccttcgctctggcatggagccgaaggtgcagcatctaccgtatactacaacggaatgaacaagccatatgctgtctggttgtgatgaaatgccgactacttcccaccgcgagcttcctcccgcggtctacaagctcctgattctttccgctgcactcttctggggaggctcgtttgtcgtcctgaaggatgccatcaatgcggtaacgccctcctggctccttgccatccgtttctcccttgccgctcttgtcctgggcttcatctgcaggaagaggattgcccagaacttcgacaggagccatcttttcgtggggggcgtgaccggccttctcaatggcctcggctatctcgtgcagaacatcggccttctgggcacgacgccgggacgcaatgccttcatcacggccatctactgcgtgatgacgccgttcttctactgggccttcgcaaagaagaggcctgccatccacaacgtggtcgcggcagtgctctgcgtgacgggtcttggcttcctctcgctgggagacgatctttcgctctcgctttcctggggcgatatcctgacgcttgtctctgccggcttctttgccgcagagattgcctcctatgcctgcctggcaaaggatgaggatcccatcacgctcacggtcgtccagttctgcgcctatgcaatcgtctgcgctatcggcggccttctgacggagcccctgcctcctgcctctgccttcacgcaggatttctggctccagatggcctatctcgtgattgcttcgagctgccttgctacggtcgcccagaatatcggccagaagcatgtgcctgctgcagaggcggcgctcttcctttccttcgagagtgtcttcggtgtcctcttctcggtgctcttcggctatgaggcgctgacgctcacgctctttgtgggctttgccttcatcttcgtctcgatgctcatcaccgagctcatgccgtcgcccgaggcacgggctgtcgaggccgagcttgcggcagggggaaagccggagctgtaggagctctggccccacaagagagacagagcagaccctccgccatgaagctgccgggtaccgcataaagcggacccggcagcttcatgttcagatacctaccgcgtcaggcttgagaagcctatggctactcggcgtgaggacggcgacgcaggaagtcgaagatggcggcgataccgagagtggctgctgcaccggcgcctgccatatcgttcgtatcggaagtgttcggcagggcctctgcgcttgctgcggcagcaggctgggctgcgtcgtgcttgctgtctttgcggaagccctgtgcttcggcgcgtaggcgtcgctcacggtgccctcagactgttgcgcgttgtcgatctgctttacggcatcgtcgattgccttctgggcatcgtggtcagcctgtgccctcctgaggtcatcggcggtcttctgctcgttttcggcagcggcgtcgtaggcgtcctggtctttctgggcctgggcatccgcgaggtcctgcttcgcggtggcagcatctgctgctgccttgtcgtgcgctgccgttgcctcatcgagtgtctgcttggcagactcggtcgtggtggcagccgtctcggtctgggctgtttctttcgcaggtgcggtttcagatgcggactcctctgcgagagccggcgtcgccgtcatgatcagtgcgcctgcagatgcagcagcggttgctgctgccaggatgctcttcggtgccttcggcttctcggtctctttcagatgctttggctctgcgcttctcctcatgatttcccccttccgagcaggatgtgatggatgcggctggccgggaatggtgtggcctcaccccatcctttcttccgtcattgttcaaggaggcttcaggatgctgcgcagcatttggcagcctgagggcctcccgcagaaagaagagagagccggaagagcgaagatgctctcccggctcgtgtgagcgcttctgagaagatggcctctaggcgtcgaggctcttgagcacaagcctccatgccatctggaacggcagtccctgtgcctttgccagcgcggcgacagaatcgtattcaggataggcgcgctcggtgccgtccggcatcgtcacgatcttgatgctgaccgggccgatctcggcctggatggtctcgatgcggcgggggagggtcgtcctctgatagggatagcggcggatgcctatagtcgtcgtgtcctcgaagaggatgcgctcgagggcttcccgcttctcctcggtgcagaggacctggatctgccagccgggcctttccttcttcatgaacacgggcaggaagtgcgcatcgagggcgccggcatcgaagagatgctccatcgcgtagccgagggcctctcctgtcgcatcgtcgacctcgcactcgagcttccagaccgtgccagcaccaccgcaggcattctctgtcgcggccttctgcttcggggcatcttgagactcgatgaggtaggcacgtacggtgctcacggggtggtagtcgcgcttgccagatcctatgccggaagcaaggatcttccaggaggaggggagcgcctcttcggtcttcaaggctgctgcgatcgcggcgccagtcggcgtcacgagctcgcctttgcgctctgtcgtggcaagtgcgagcctgtggctctcgcagatatttgcgacagcaggcaccggaatcgagaggacaccgtgctgcgtgcggatgcgtcctgtgccctcggcaagcggccccacatacgtccgctcgatatcaaggtcgtcgacacagacggctgctgccacggtgtcgacgatggagtcgacagcaccgacctcgtggaaatggacctcctcgacgggcacgccgtgggcatgagattctgcctcggcgacgatgcggaagatcttctttgcaagctcgtttgcacgcggcgtgagctcgcccgcatcaatgatggattcgatctcggcgaggccacggtgcatgtggtgatgctcatgatcgtgttcatgttcgtggtcgtgatggtggtcgtgaccatgctcgtgttcgtgctcatgatcgtggtgatggtgatgctcgtgcccgtcttcgccgtcgaggtcgccatagagccatgccatgtcgtggtcgtggttctcctcgtcgagctcgacatcgaagtcggtggccacgatgcctgagacctgcttcttcgagatcttcaccttatagccatcgagcggcaggctcgagagtgcctgctcgagcttttcctggttcgcacccagatcgaggagggcgcctacgaccatgtctgcggagattcctgtctcgcaggacagatacagcatgttgctcatagctcagcctacttccctacatgattgatgaggttcgcctgatagcctgccccgaatccgttgtcgatattcacgaccgagacgccgcttgcgcaggagttgagcatggagagaagcgctgccacgccgccgaaggaggcgccgtagccgacgcttgtgggaacggcgatgacgggacaggcggcaaggccgcccacgacggaggcaagcgccccttccatgccggcaacgcagatgattgccgctgcatgctggatatcgtcggtgtgggcaaggagacggtgtattccggcaacgccgacatcgtagacgcgcctgacctcgcttccaagcatctcggctgtcacggctgcctcctctgcacagtagaggtcgctcgtgccggcagcaaggacaaggacggtgccttggccgtcaggcgcaggcgggttgccgatgatgccgagacgtggggtgggctcatagcggaatgcgctgctgtcgtgcaggagcttcttcgcagcttcggccttatcctcgtcgagccgggtgatcaggatgcgcttctcgccggcatccatgagggcgtccgcgatgcctgcaatctgtggggcagtctttccggcgccgtagatgacctcggccgctccctggcggatgccgcgggaaaggtcgggcacggcgtagccgaggtcgacaagcggtgcctccccgatcctggcggttgcatcgtctatcgagacggtgccttcctggacctcggccagaagggccttgagctctgcacgttccatcccttacgccttctcttctgcagcgagcgtctcgttcatggatcctgtgcggtatcccagaaggtccatcgtcacataggagaagccgatcttcttgagctcatccgccacctcgagcctcaagtcgaggagcttctggagctcatcgggtgcaacctcgatgcgggcgatggcgccggtctttccctcctgatggatcctaacgcggagctggtggaagccgaggtcgagcaggaactgctcggatttgtccaccatggcaagcttctggcgcgtgatctcctcgccgtagacgaagcgggaggagaggcaggcaaaggactgcttctgccaggtcggaaggcccatctcgtggctgaggtctcggatttcctgcttccagagattggaatggcggagaggcgacttcacgccgagctcggccacggccttgaggccggggcggtagtctccctcatcgtccatgttcgagccttcgaggagataggagaagccttcctcgtccttcttctgaaggatctccgagaagaactccttcttgcagagatagcagcggttcgtcgggttgtggctgaagccggggatgtcgagctcctccgaggcgacagagagatggcggatgccttccttctggcagaagtcctctgcctcgtggaattcccttatcgggaaggattcggagcgggcggtgatagcgattgcgttgtcgccgagcgtgtcatgggcgaccttcagaaggaacgtcgagtcgacgcctccggagaaggcgacggcgaccgatccgagctcctgaagatagtgcttgagggcatcgagctttgcgtgctcttctgcagaagcggtgaattcatctggcatgtagatccttccgtacgtggctgtcactcaaagggtagcaaataggcagggtttgcatggggctctgtaacaagaaatagcggggccttaaaaccttatagtataagggctatgagaacgtgcgtgaggtgatagcgtggacgagaactaccgcaaggcgatgaagcagggcgagcgcgactgcaggaaggcgcaggcgcagggccgccatccctacctgacagcgctcgattcgatcacgggcgaggagtcgtttgccggcgagaagccgctcggcacgttcgagattccgctctcgcaggtcgtgggcacccgcacggaaggccgccaggtcgcgttctcgcgcacgttccttccgatcctgccccagaactccgagttcgcgatgaagtggtcgcacctctacgacatacaggtcacagaaggcttccgcgatccgatcaaggtctatgagttcctgcaccgcttctatgtgctcgaaggcaacaagcgcacttctgtcatgaagtacctcggtgccaagacgatcgaggctgaggtcacacgcctggtcccgagcgaggccgatggcacctacaacgagttccttgccttcttcaaggtatgtccgctcttcgagatcgatttcacccgcgaaggctcctatgcaaagcttgcggcctgtttcggcgaggacctcgagcatccctggcccgatgagcgcgtgcactatctgaggagcacctactacttcttcgaggagatgttcctgcgtgctggcggctggcacctcgatgtcacggcgtcggatgccctcctcatctatctctccttcttcggccaggacaatctcctcgagacgccgtcccagatcgtgctcgagcgcatccagaggatctggaaggagcttgtcttccagggctccacgctcgacggcgaggaaggcctggtcgtgctcgtggacgggccgaaggtggctccccggagcctcatctcccatgtcctcgggcgcctgccgcaaggcagccagaagcccgtcatcgctgccttcatccacggggagacagcagcggagtctgcctgggtgcgtgcgcatgaggaaggcaggaaggagatggcagagcgcctctccggcgtcgtcgagacgcttgcctatgagggctgctcggacgatacggcagtcgccggagccatccaggacgccgttgcccagggagcgagcatcgtcttcacgacgtctcctaccctcatgcaggcaaccgtgaaggaagcggtcatgcaccccgaggtccgcttcctgaactgctcgatcacgctgccgcaccagtcggtgcgctcctactatgggcgcatgtatgaggcgaagttcgtgctcggtgcgcttgcggcaagcctctccgaggaccacaggctcctctaccatgcccatgtcccgatcttcggcacagtatcggagattgatgccttcgcgctcggagcagcccttgtcgatcctgcggcagaggtcctgctttcctggtcgaagcgcggcgagcagacagagttcttccaggcagacctcgagaaatggcagggggctccgctcatctccggaaacgatgtgacagcccctgtcggcgagccctctgccttcggcctcttcacgctcgaggagggccacgtccacaacctcgccgtgccggtctggcactggggccgctactacgagctcatcatgaggagcatgctgcagggggcgcttccgccggcactccaggatggagacggcaggctcgagctgccgaagccggcaggagatgcccaggctgtgagctactggtatggcctttcttccggcgtgatcgatatcgtgctcgcgccgggacttcctgagtcctcgaagcgccttgtcgggctcctcgagcacgatatcaaggcccggaccctcgagccctttgcaggcgagatcgtgctccaggatggcaggacgattgacggcacgaagcttgcaccgtccgacatcgtctcctgcgactggctctgccagaatgtgcggggcggccttcctggggactggaagccggccgaaagctcgcttcccgaagtgcctcagaacacccagaaaggtgcgtgagggatgcgcatccttgctattgccgacgtcgaagagaagctgctctggggctccttcaacaggcgccgcttcgagggcatagacctcatccttgctgcaggagacctcgatcccgactatctcgagttccttgtcacgatgctgaacaggccgcttctctatgtgcatggcaaccacgatgacaagttcaggaagtcggcaccgggaggctgcatctgcctcgacgactccgtctatgtctaccagggcatccgcattgcaggccttgccggctcccggaaataccgggacggcaaatatatgtatacggagcgcgagatggcgcggcagatccggcgtatcgacccccagatcaggcttctgggagggctcgatatcctgctcacgcatgcgccggagcgcggcgtcggcgacctcgaggacctgccgcatcagggattcgagtgcttcgatgagctcgtcgagcgctggcatccccgctatcacattcatgggcacgtgcatgcaagctatatcccggacttcaagagggaacgcgtgcttgcatccggcacccatgtgatcaatgcctatggctatacgacgatcgatgtacctccagcgtcccagctctcctatggatggaaggagtcctgggtgaacaggcgctgcctcaagaagagcgacgggctcacggtccaggaggcaggtgtgctcggcgccggctacacgtatttcggctgatcgggaggatctcagcatgcatcgttcattcgtgctcgcgttcgacgacagacctgggtccttcctggcgcaggagcggctcttcgcggcccatggcctcgatatcaagcgtgtgagctacaacaaggtcatcgatgtccataccctcttcatcgaggcggagggggaggaagaggccctcgatgcagcagaagccgagctcagggagcgcagggtgcttgccggccagcggctctggggcagggtcgtcctcctcgagttcgagctgcccgatgcagagggggcgctgacacccttcctcgagctctgcgagcgctacggcttctcgctcacctatctcaatgcccgtgcgaaggactaccacgtgggtgccgccttggatgcccttgtatctgagcctgagctgccgggtgcagagatcgtgcgcgccggcctctatgtggaggatccggcacgtctccaggtcttcctcgatgaggtacagaggatctgcccctgccggcagctgccgttcgggcgcgaaggctacctgatcgacaacacgctcttctacgagccattcgcgaaggacatctcgaagatctgcggcttcacggaggcgcaggcaaagcgggtcatggtgaacgcaaacaggctcatccaggtcctcgagacgacgagcgcagacccgttcaagccgttcgactacatgcgccagttcgcagaaaggatcgagcgctaccggggagacgggtacgccgaggcggtgcgcacgacgcgctttacggtgccaggcggagcccagtgcgccctgattgagccgccctgcggctccgacacctggatcctcttcggcgacgaaggcccgctcttcgtcgatactggctttgcggtctacagagacgagctggcgcgcgagatcgaggcgctctgcccgggctggaagccgggcgagggcaccgtccttctgagccacggagatgcggaccattcgggtgccatcaatctttttgcccatgcccttgcctcagagcatgtgatcgagaactatgcacggcagcgcgagggacgtcccgactggcgcgagcgcgacccgcgcggccttgcctattcgaggcttgcaaacctcttcagccgctatgagccgcccgcggcggagctcttcgagagcctcggcaagcgtcccgaaggggaagatgagcctattgcccgctgcgtcgatgcagacggagaccctgtgacgctcgacttcgcccccttctccttcgaggtctatgaggggaagggcgggcatgtgaagggcgagaccgtcctcatcgaccggacgcagcatctctgcatctcgggcgacatcctcatcaacatccacggagagacgcgtccccagtccgagttcaaccgcctggcaccgttcctgctcacccgtgtggatgcggtccccgatcttgcccgtgccgagcgcaagtatctgatccgccttcttggtccgggggtttggcagattctcggtggtcacggcgctgtgctcacaaggcagccgtaggatttctgggagaccacgagagacaaggggagaccatgccaagctggacgaggacagagccggtagaggcagcattcttcgatgcagacggaacgctcctgtcgtttgcgacgcaccagataccggaatcgacgaagcaggcgctgcacgagctcaagcgggcaggtgtcaagtgcttccttgcgacaggacgccctccctatcaggtcgatatgatcgatatcgaggacatggaggccttcatcctcttcaatggccagttcgtcctgaaccgctacggcgtgatcttccagcagccgatcgaccccgacgatatcagggtcgtcgtcgaccaggtgcaccagggcctctacaactgcgccttcatggaggcgacgaagtgctatgtgagcggacgcgatgagctcctcgagcgtgccttcgaggcagccaatatcgatatgccgacagaggatatcgaccaggcgctcgaccacgatatcatccagctcaacatcttcctgggacccggcaagaccgacatcgtgaccaagaacacgaagcatctgaagctcacgcgctggagcccgaacttcgtcgatgcattcccgctcggcggcggcaaggccagggcggtggcccgcatgctcaggcactacgaaatacctcccgagcatgccatctgcttcggagacggcggcaacgacctcgagatgttcggcgtcgtcggcacctccatcgctatgggcaacggcaaccccgaggtgaaggagtttgccgactacgtgacagacgatgtggaccacgacggcatctggaatgcctgcgtgcgcctcggcctcattcccggcaagctcagaggggatggcgcgaaccagtgaatctcttcggtgcgctcgtgaatggccttgcggcatcaggcggggcatttgtcggcctcacgttccggagccggatctccgaggacctcggcaccttcctgatgaagggcatggggctctgcgtgatcctggtcgccgtggaagggatgatgagagacgcgtcggtcgtgacgatcacgctctcggttgccttgggcggcgctcttggccatgcactcgacctcgacgctctgatctcgcgcttcggctcctgggtggagcaaaagctcggcccggcggcacctgccgagcagaaggcagcaagccccggctttgcccggggcttcgtctcctcgacgctcttcatctgcgtggggtcgatggcaatcgtgggatcgctcgaggcaggccttgaaggcgatgcatcgacgctcttcgcgaagtccttgattgactgcgtcgtctgcatgctcatggcggcgacgctcggctcgggcaccgtggcctcaggcctctgcgtctttgcctatgaggctgtgctcacgatccttgcaggagcggtggcgccgtatctctcggatgcgaccatctcccagatgcttgtcacaggatcgctcctccttcttgccattgccttcgatatgatggacatctgccatatcaagacagccaatctcctgccggcagccttcctgccgcttgtcctctatcccctgatatcgctcgtgccggcgcttgcctgaggcacagaaaagaagcatccatgattcaggaaatcgctccgcacgtcttcgacaatgccttcaaggcgctcgatcccgaaccaggagactatgtcctccactatgctgccaatgcgtcctggacaggggcagacagcatgcgggtgcacggcaagggcatgcttgcgcaggaacgtgatggagagctcgtgctgccgaagcttgcggactacgcacggaagccttcctgtgtctatctcttctcgatcgacgacaagcggttcttccttgcgaccgatgtgctcgtcgaggtcaagggatccttccgctacctctccgtctcaggctgccggttctatgagccacgctggctggcattcgctgccatcacgggctaccagctctgggactggcggcagcacaaccgctactgcggtgcgtgcgccgcccctcttgtccatgcaccgcgttcccgcgagcttgtctgcccgtcctgtggaaacatcgtctatccccgcatcaacatcggcgtgatcgtcgcaatcgtggacggcgagaggctcctcctcacgaagtatgccggaagacgcatcacgcactatgcgcttgtcgccggctataccgaggttggagagacgctcgaggagtgctgccggcgcgagatcgcagaggaggtcggcctttccgtcaaggacctcacctatgtcacggaccagccctggtccttctcggataccctgcttgtcggcttcttcgccaggctcgacggctcggacgagctcacggtcgacgaaggggagctcagcctcgccgagtgggtcgagaggaaagatcttccgaagacgcatgaggacacctcgagcatgacaaactggatgatcgagctcttcgcgaaaggggaggacccgttcagcaggaaggcttagacagtatgacccgaaccctaaggactgggaggctctgccgattccgtcggagcgggacctcccgaagccgcacaatgtctttcatcgcagggaaaggcgcgcggcgccacaaagggacgggag

SEQ ID NO: 115 - DNA, 18232 bp, Unknown
  Metagenome-assembled genome
gtggcagctcgggttcggaaggcctgccttcgattttcggttcgctcagggcagcgggagccgtagccgcttcctcttcggcaggagcagccgtctcatcgtctgcctcttcaggagcagactcttctgcagcagcagctcctccgccggggctgtgtgcttccggctcaggcgcctctatattctcttcctcagggatgtcgtccttctcgggctccgcaagcggaacgtcgccgtctccgctctccccttcctcacccttcttctcgcctgcatcggaagcttcgcttctcggccttggctcgccgaacagacgttgctgccgagggcggttcgtcggtgccatgccggcaggcgtcaccgtatcgattggctcccactcggcatccatgaccttcggccagaggcgcttctggcggtctgcgaaggtctgcccctgataggggctctcttcggactcggcagccttgtagacgctctcggtctcgatcgcgcctgggcaggcgtctcgctaagatcttccggcagcctctcgaaggtcgtcgttgcctcgtcgtccttccgctcttcgaaacaggtgcctcttcagcagcaggagcttcctcttccttcggacgcacgagtgtcttgtctgcagcatcctcatcggcaggttcagtcttcggctcttcgtcgtcgtagccctatcgctctcgagcgaatggcagacacgctgaagaggcttccgatcgaaggcttcttcagtggtcttgtcgaggcttctcctcttcggcaggagcctctgccttctcaggctcggcttcagcggccgccgtgccggagcggcagctgcctcttcgggcacgtgcctcatcgccttcaggctctgcggaagcaggcgtctcggcggtctcttcctttcgttccttcggctcgagctcaacatgcggatcctcgtagacaatcgggcagcctgcaggaagcatgcccagcgccctcgatggtctccttgccatgcctcttgtagcgggcaggcgctccgcttcggccttggccttcgcctctgcctcggcggcagcggctgctgcctcctcctcctcttcgcgggctcggcgtgctccctcgcgcgcacgctcctcttcctcctgctgcaggcgcacagcctctgcgtcgagtgcgacatctgcgccaggacggacattgttgaggatggagaggagagctggcgacagcagccttgttgtcattcgcgccatccgtgcagtcgccgaacgggttgcgatatcggagatagcagaagggcagggaccaaggcggcgaggatgccgaggaaccagaagacccttctcacacaggcggaaggaagccgaggagctgcacgaaggaggcgatcgcaacgccgtagaggcaatagacgcggatagcataggcacgggcatagaacgtgccatccccttgttcgcaccatcgggttgacacgcggcgtgtcatagtgggcgacaatgacgatggggcggttgcccttcatgaccttggagccggtctgggcatggaaggcgacgacattctggctctggacgacagggcccatcttcgcaaacggcgtgcgccctgcatggatcatgaggagcaggacagcgcaggcgattgcgacaacgacaccgacaaagccgatgatgccgccgaagcctgcaaagacgaggccgaggagcatggcaagagtgacgaccgactttgcggtctgggctcctgtcggcgtgctgaattcctcatctcgatctcagggttcaccccatggtctgccatgacctcagagatggtctgggcagcctgcagctcctcctggctgttagccggcgcgatcctatctgctcatccaggtagttcagatattcgtgcgtcttggacatatgtatgctccacctgccatgcgggtctatcaaaacgaaacagtcagattgagtatacgtctagcattcccgcttttcccgacgcagcaccgtacaagagaaaaacggtatcgctgcatgtaccccaaagaccatgaaagcagggctcatccgtaccaagagagggcctttgccgtaagctaatgtgagaaatctgcaagaggcaagcgaggggaagccatggacatacgccagataccgagatgaggtgcgtctgacacgaaggatgaggcggccaggcgcgtcgcgtcgctcgcgctcgagctcatcaatgcccggcgtcccctcgaagccacctatatcaatgccatatatatccagaccttgaccggagctccttcttcaggccttgggacgtgactgcgagaggctcgctgcctgcggcatgcatgtcatgaaatccacccagaatgatgagcagctctaccagatcgacgagaagaactccttcataggagatgcgaagctcacccaggaggaggcactcgagctccaggtgctgctctctcccgcaggtcgcaaaccctgcctttccgcttgcaacgagctcaggatggcgctcctgaagatcgaccgctccttcgcagcagacagccgctcgtgagcacgagcgtcccaagtaaggtcctgaccgcacgctccagacgctccgcgatgcctatgggcagcacctgcttgtcgaggtaggctactgcgatgcgcaggggtgaagagcacgaagatcctcgctccctatggcttctacagcttccgcgatacgctctactgcgtctgtgcaaagagaaaggcagcaagctcgaggacccaggacctaccggatcgaccgcatggaaaagccgaagatcctctccggcagaagctatacggtgccggacagcttcgagatcgaggactgccggctctccccttccagatgggaccagcggtcggaacggcagtctttgctgctcggcatccacaccagacctcatctcctcatgaaggcgctgtgcacgctcgaggaagaagaggatgggagctccatctggcatgttcccgccacctcctgggaaagcagcagcctcctggggcaatagcgcagggactcatcccccagaagccagaagagctgatctctgctgcgaaagcctgccttgaaggagcgattgcccatgcctagcggacgtacaagcaacatccaggagatacgcgagcttgtcgcgcttgcaggagccctccacccaggcaggcgacacgatcaccgccgatgcgatagcggcacgcatgggcatctcgcacgcagaggccgagcattatctcaagctgctgctcacagcaggagatgcagaaggaacctatctctccctctgcattccggatgatgaaagcgaagtcacgctcgccttcgatggcggcatcaagggaggccgctccgcctcacgcttgcagagacccatgcggtgcttgcagcccctcaatgcctgcggcgtgccggaagacgatgagctgcgccaaagattgccgcaggcttcggccgtgccaatgtcacgcctgccacgatcgagcgccagctcgagccccttgcctcgccggaggagcacgacgttctcacctccatctcgaaggccatgatcccgacatgcgctctccttcctctatcaggggacgaaggatgatcaccaagacaccgtcatgcccttcccaggagctctcccagaaggatgacgcctggtatctcgacgccttcgatctcgacaggcaggaagagcgctgcttcaagatcgagcgcatggatgaagcggagcctgaagaggtgcccgagaatcttgtcagcgccccgccaagacagaggcagagccagcacgcatggtgaagctcaccttcctggacggcactacctttcgcttttcgcctggccaggctcaagatctcgaagaatgccaagcctgtgcagggacgcatcccctacttcggcaccatgtggcttccgcgccagcttgcaggatgcgccggcaaggtcgtctgccaggacgaaaggtcgcagagaaatgcacagctatgcagaagggctccttcaccagctttcctagctgggaagagcccctctggcttcttcttatatatatgtagggctactgcttctcgtgcgagagcgccacatctcgagatagcggccgatatgttcgcactcgagctgtgcccgtgtcttcgaggcatggagttaatgaagtcgcggccatagcgcttctgcacaagacgcgagtcgcagagcaaaagcacgcccgtatctgtcgaggtacggatcaggcgtcctgccgcctgcttcacgccagcacggcctcgggcagctggtagcgccaccaggcacctgctctcgcgcacctcccgccctggaccagcggatcctgcgggcttgcaaacggcagcttcggcacgacaacgcagcgcagcgtatcgcctcagcatcaagccttcccaaaagctcttgagcgcaaaagcgagaacgacttctcgctgatgaagcgctcacggagctggcgggagatgacctcttctcctggccacaagatcgagcccgagcatctccgcaagacggggctggaggccttcgaagaccttctccatctcgcggcggttcgtgaagagcgtcaagaccgagccatccatcgccttgtggatatcgaagagcacatcctcgagcgccgggagatagcccggatcggaacggctgcgcaggacctctccaaaaactggctgccggatacgatgagtgccgtcttcgacgtcggcgacgatgcagtgtggaagctttgccattcaaccatgcgagtcggcttcgaccgttcctgagtctgcctaccgcgatgtgcagcctcgacgagcttcgactacgacagcatagtggcagtcgtcgtggcaaaggacctgccgcatgtccgtccgatccgggctatctcccggcgctcgaggatgtgctctcgatatccacaaggcatggatggctcggtctttacgctcttcacgaaccgccgcgagatggagaatgcttcgaaggccccagccccgtcttgcggagatcgggctcgatcctttgtgccaggaaagaggtcatctccccgccagctccgtgagcgcttcatcagcgagaagtcgttctcgctctttgcgctcaagagcttctgggaaggcttcgatgctgcaggcgatacgctgcgctgcgttgtcgtgcgaagctgccgtttgcaagcccgcggatccgctgggtccaggagcggggaggtgcgcgagccgcgtgcctggtggcgctaccagctgcccgaggccgtgcttgccgtgaagcagcggcaggacgcctgatccgtacctcgacagatacgggcgtgcttgtgctctgcgactcgcgtcttgtgcagaagcgctatggccgcgacttcattaactccatgccttcgaagacacgggcacagctcgagtgcgaacatatcggccgctgatctcgaatatgtggcgctcctcgcacgagaagcagtagccctacatatttataagaagaagccaagggctcttcccagtaggcaaagctggtgaaggagcccttctcatagctgtgcatcttctctgcgacctcttcgtcctggcagacgaccttgccggcgcatcctgcaagctggcgcggaagccacatgtgccgaagtaggggatgcgtccctgcacaggcttggcattcttcggatcttgagccctggccaggcgaaaagcgaaaggtagtgctcgtccagtaggtgagcttcaccatgcgtgctggctctgcctctgtctggcaggggcgctgacagattctcgggcacctcttcaggctccgcttcatccatgcgctcgatcttgaagcagcgctcttcctgccttcgagatcgaaggcgtcgagataccaggcgtcatccttctgggagactcctggggaagggcatgacggtgtcttggtgtcatccttcgtcccctgatagaggaggagagcgcatgtccttggatcatggccttcgagatggaggtgataacgtcgtgctcctccggcgaggcaagggctcgagcgggcgctcgatcgtgcaggcgtgacattggcacggccgagcctgcggcaatcttctggcgcgctcatcgtcttccgctacccgcggcagtgagggcttggcaaagcacacgctgggtcttgcaggtagcgtgagcggagcggccttcccttgatgccgccatcgaggcgagacggagcttgtctcatcatccgggaatgcagagggagagatggttccttctgacatctcctgcatgtgagcatcccaaaaaaacgcacttgagataatgtcggcctctgctgcgatagcccatgcgtgccgctatcgcatcgggtgatcgtgtcgctgcctgggagtgctccggtgcaagccgcgacaagctcgcgtatctcctggatgttgcttgtacgtccgctaggcatgggcaatcgctccttcaaggcaggctttcgcagcagagatcagctcttctggcttctgggggatgagtccctgcgctatgccccaggaggctgctgcttcccaggagctggcgggaacatgccagatggagctcccatcctcttcttcctcgagcgtgccatgcgccttcatgagggagatgaggtctggctgtggatgccgagcagcaaagactgccgttccgaccgctggtcccatctggaaggggagagcccggcagtcctcgatctcgaagctgtccggcaccgtatagcttctgccggagaggatcttcggcttttccatgcggtcgatccggtaggtcctgggtccctcgagcttgctgcctttctcttctgcacagacgcagtagagcgtatcgcggaagctgtagaagccatagggagcgaggatcttcgtgctcttcacccctgccgcatcgcagtagcctacctcgacaagcaggtgctgcccataggcatcgcggagcgtctggagcgtgcggtcaggaccttacttgggacgcctcgtgctcacgagcggctgctctgcgaaggagcggtcgatcttcaggagcgccatcctgagctcgtctgcaagcggaaaggcagggtttgcgacctgcggagagagcagcacctggagctcgagtgcctcctcctgggtgagcttcgcatctcctatgaaggagttcttctcgtcgatctggtagagctgctcatcattctgggtggatttcatgacatgcatgccgcaggcagcgagcctctcgcagtcacgtcccaaggccctgaagaaggagctccggtcaaggtctggatatatatgtgcattgatataggtggcttcgaggggacgccgggcattgatgagctcgagcgcgagcgacgcgacgcgcctggccgcctcatccttcgtgttcagacgcacctcatcctcggtatctggcgtatcgtccatggcttcccctcgcttgcctcttgcagatttctcacattagcttacggcaaaggccctctcttggtacggatgagccctgctttcatggtctttggggtacatgcagcgataccgtttttctcttgtacggtgctgcgtcgggaaaagcgggaatgctagacgtatactcaatctgactgtttcgttttgatatgacccgcatggcaggtggagcatacatatgtccaagacgcacgaatatctgaactacctggatgagcagataggcatcgcgccggctaacagccaggaggagctgcaggctgcccagaccatctctgaggtcatggcagaccatggggtgaaccctgagatcgaggaattcagcacgccgacaggagcccagaccgcaaagtcggtcgtcactcttgccatgctcctcggcctcgtctttgcaggcttcggcggcatcatcggctttgtcggtgtcgttgtcgcaatcgcctgcgctgtcctgctcctcatgatccatgcagggcgcacgccgtttgcgaagatgggccctgtcgtccagagccagaatgtcgtcgccttccatgcccagaccggctccaaggtcatgaagggcaaccgccccatcgtcattgtcgcccactatgacacgccgcgtgtcaacccgatggttgcgaacaaggggatggcacgcttctatgcccgtgcctatgctatccgcgtctattgcctctacggcgttgcgatcgcctccttcgtgcagctcctcggcttccttccgcctgttgtgagaagggtcttctggttcctcggcatcctcgccgccttggtccctgcccttcttgctatctccgatatcgcaacccgcttcggcgactgcacggatggcgcgaatgacaacaaggctgctgtcgcagctctcctctccatcctcaacaatgtccgtcctggcgcagatgtcgcactcgacgcagaggctgtgcgcctgcagcaggaggaagaggagcgtgcgcgcgaggcagcacgccgagcccgcgaagaggaggaggcagcagccgctgccgccgaggcagaggcgaaggccaaggccgaagcggagcgccttgcccgctacaagaggcatggcaaggagaccatcgaggcgctgggcatgcttcctgcaggctgcccgattgtctacgaggatccgcatgttgagctcgagccgaaggaacagaaggaagagaccgccgagacgcctgcttccgcagagcctgaaggcgatgaggcagtgcccgaagaggcagctgccgctccggcaccggcggccgctgaagccgagcctgagaaggcagaggctcctgccgaagaggagaagcctgccgacaagacactgaagaagccttcgatcggaagcctcttcagccgtgtctgccattcgctcgagagcgataagggctacgacgacgaagagccgaagactgaacctgccgatgaggatgctgcagacaagacactcgtgcgtccgaaggaagaggaagctcctgctgctgaagaggcacctgtttccgaagagccggaagacgacgaggcaacgacgaccttcgagaggctgccggaagatcttagcgagacgcctgcccaggcgccgatcgagaccgagagcgtctacaagcctgccgagtccgaagagagcccctatcaggggcagaccttcgcagaccgccagaagcgcctctggccgaaggtcatggatgccgagtgggagccaatcgatacggtgacgcctgccggcatggcaccggacgaaccgccctcggcagcaacgtctgtcggcgagccaaggccgagaagcgaagcttccgatgcaggcgagaagaagggtgaggaaggggagagcggagacggcgacgttccgcttgcggagcccgagaaggacgacatccctgaggaagagaatatagaggcgcctgagccggaagcaccagccccggcggaggagcctgctgctgcagaagagtctgctcctgaagaggcagacgatgagacggctgctcctgccgaagaggaagcggctacggctcccgctgccctgagcgaaccgaaaatcgaaggcgagccttccgaacccgagcctgccacgcctgtgcaggagacggctgaggctccggctcctgtcgagcccgaaccagaggcagctgtcccggcagagcctgaggtacctgctgctgcagagcctgctccggctccggcacatgcggatgaagccgagtatctggcacaccgctccgaagacatagcatcctatgtcgattccatcttcgccgaagagatacaggcagcacagggtctgggcacagatcatgcaccggccccttcggaagcgcccgctgctcctgctgcacaggagccagagcccgcaccggcaaagcctggccccgatgattctgctgtcatggcagcgcttgcctctctcgacaccatgcctcaggcgaaggactatgcacctgccgccgaagaggcagctgcaccagagtccgaagctcctgctccgcgcaatctcggcaagcaccttgcagacatcacgccggctgtcgatctcgccgacataaaggatgtctcatctcctgaagaggatgcttctgaggttcccgagccagccgagcctgtggctgaggagagcgtgtctgagcctgagagcgaagagcctgtccacgcttcgtgggaagaggaccccttcgcacatatatccaagtcaacgcctgtcgatgctgtcttcgaagagatagaagaggagccagaagaagaggcgctctctgactacgctcctgaagaggagacagctgagacgtccgaggccgataccgaggaagaggccgaagagcctcaggcagccgctcctgaagaagtgcctgcccagccagaagaggatgagcctgcggcactggaatctgagcccgagccatctgcaccggcattcgagcctgaacctactgaggcagaagagatgccggcagagcctgaggcttctgttcctgaagatgatggggaagccgctcctgaagatgcagcgtcgcagctcgatgcatccgatgccgctccgatcgtgaacgaagagcccgaaggctatccggaggaggctgctgccgaagagagcgaacccgaagcagagactcataaggaagagcccgcggctgagcagcaggaagatgcaggggaagatccctctgcacccgatgagatggattatctgccaaaggcgccccgacccctctatccttccgtcatggacgccgaggcgatagaggtcatcgaagaggagccagagcctgtcgaggaaccggaacctgaagaggccgaacagcctgaggaggctgccgccacagagccagtccccgaagccgaagcggaatctgaatccgcaccggagccggagccagaagcagtctctgaagaggagcctgaggagacatacgagccagagccagaatctgagccggcagccgtttccgaaccggagccggagcctgcagaggcacctcagcctgaagcaggagaggcttccgaagcagagccggagcctgagcctgtgctccctgcagaagagcccgcacctgtccaggaggcagagccggaagcagaggctgcgcctgctccgatcgaggaagaagctgcagagccggaagacgcagcgggcgacaccgctgccatgcccgtttctgtgcctgaacctgaggtgagcgaagaagagccagcgcctgcagctccggttgcagaggaagatgccgctgcggctgaatccgaagagcccgcttctgagcctgccgaagaggcagctgctcctgcagaagagacctctgaggcggaggagacggatgctcctgtgctgccccagaacttccagctcgatatggacgatgtgacacccgaagatcctgacatcgcgccgaaggatctctccggcgtcgtcacggaagctgaggatatggaagagcctgagccggcaccccgcgagaagcctcagatgccggacgatcccgagtggggcaagacaagcttcaagcctgccatctcccagatggcccgccgcgtcatcctgaacgaccttcccgatccctcgcagcactcgatcgatccgttcggatccggaagcattgccagccagcccatgcagatacccgaaggacagcaatccatgccgaagaagccagaacaggggacattcgatgtgatcacgccggagtcgctcgaccgcatcgcgaaagagtcgcatcaggagaagaagcatcatcacttcggccgccatggcgggaagggtcgccacttcaccgaggctcctgtccgcgaagaccatgagaccggcatccacggcagcaccgctgcccgtcctcaccatggctcgaaccatggctggaagggcggcgctacgccgaaggacgagctgcgtctcccgcagctcgatcttgcggatgatggtccggagtcccatggctatgagctcgatcctgaaagagcagaagccgtgcgtgcgcaggcggcagcggatgcagctgcccaggcccaggccgaagcagaggccagggctcaggctgcagagcaggaagcagcagcacggagccagcaggtctccgaagaggagctccgtgacgcggtcctttccatgaacgacgaggacctcatcagccacgacatctggttcgtcgcaacgggtgcctccgagctcgaccatgccggcatcaaggccttcctcgatgcccacaagcaggatatccgcggcgccttcctgatcgatcttgactgcgtcggcgcaggagacccgaccgtgcttgtggaagaggggcatgacaatccgaagcgcgccgaccgccgtctcgtgcgcatgttccagaacatcgcacaggacttcggcctcccgcttggcagggcccgctacagcatcggcgagaccgatgcgaccaccgcgctccgtcgccatatccgctccgtcactatcatgggcatggacaagaatggcctgccggccttctcccacacgctcgacgatgttccggagaacgtgaacggcgaccaggtggcagatatcgtcgagatggtgacagagctcatccgccagtcctgatgcatgcgctgaagagacacgaagaaggcggccaggatttcctggccgccttctctcatgacgcatgtcttttagctgctagtgcctcgagcggacccagatgcctccgacaagcgctgcgatgcccgccagggcaaaggctccccaggcaacagaggaagtgtcgctcgtgtcaggcacgcctgtttcctcgaagacgactgtctggccctcgtcgtggatgtcttcatgctttccgacgacatgccccttgtgcgtgagctcctcgaagacgacgatctttgtgcctgcgaagttctgtgcattgaactctatcggcacatcgaccgtaccatcttcggattcgggcacgaagtccttcgtgaacgtgatggtctcgccggcggagttcacaagcgcccctccgtcattccccttgctgtcgacgacgtggagcgttgcggtgagcgtgtaggtctcgttcgggatgagtcccgtgtaggagacggtatcggtgagctctgcagcagcggctgccttgagcgcatggctgccggatccgctttcggctgccgtcgtgtggagctcggagaagcgcacgctctgcccttcgtcctctatgtcagcgtgcacagcaatctctttgccttcttccttgaggctttcgaaggcgacaatgcgcttcacgctcgagggaagacctgtgacggtgaaggtgacctccatcgtgccgctctcggaggctggcgtgaagctcgtcgtgacgggctctgcatagggcagcgcctctccggtgtcgtggtccatgagggtgccggtgagctcataggtcttgccgggctcgaggttcgcataggcgaccgtatcgacgagcgtgaaggtctcgtccgttgccggcacgatgtgctcgccctcctcatctgtgagtgtcgtctcgatatgcggaccctcttcgttcgtgacggtaccaagatgcacgccgaaggcatcgcgcgtgatcgttgcctcgaagcttacgagcttcttgcctgcgttggcaggagaggagagctcttcgatcgtatagacgtcgtaggggagtgcccccttgctgtcatcaggatcggaggatccatccttcgtgccagcgaaccagatgccggcatcgcgtacgatcttcgtgtcgtcgaatgttccgtcatccttcacggctgcgccatcgttggaattcgtgctctggtatgcggttactggggcagccgcggtatcgaggatgccattggcatcggtcacggcgatatgccattctcctgtcgtcttggatgtgatctgaaggggatatcggcctctcgccgaggtcgtgcccatcctccttcacgaacgagaggtcgcctcgcttgacctggtatggcaggcatcgtctcctgaagctccagatattgccgtcctcggtgatggagatggtcttctcccagtcgctgttgagaagatagccctcaggtgcttttgtctcatgcacggtataggggccgaagtgggggacatccgctggccgtgcagccgcgtcccgtgctgtcggtctcgatagcggcgacacgcctgcccggggcatagcatcgtgcctccgacgacggaccgcatgcgtgcttgcatcacggatctcgaagacagcgccagaaacaccgccttgccctgggagaggcgctcttcgattcggcatcgaccttctggacagcaatgccccacgcatgacctcttcatcgacggtagctggctggagtatggtgggcgcctgtcggagcagaatcgtctgccgcaatcgaagagcgctctcccaagggcaaggcggtgctttctggcgctgtcttcgagatcgtgaatgcaagcaggcatgggtcgtcgtcgggagcacgagctatgccccgggcgaggcggtcgccgctatcgagaccgacagcacgggacgcgtgccacgcagcggatgtcctcccttcggcacctataccgtgcatgagacaaaaggcacctgagggtatcttctcaacagaggctgggagaagaccatctccatcaccgaggacggcaagtcttggagctcaaggagacgatgcctgcgcagaccaggtcaagcgaggcgacctctcgttcgtgaaggaggatggcacgacctcggcgaggatggccgatatccccttcaagatcacatccagacgacaggagaatggcatatcgccgtgaccgatgccaatggcatcctcgataccgcggctgcccagtacccgcatacccagagcacgaatgcaacgatgcagccgtgaggatgacggaacattcgacgacacgaagatcgtacgcgatgccggcatctggttcgctggcacgaaggatggatcctccgatcctgatgacagcaagggggcactcccctacgacgtctatacgatcgaagagctctcctctcctgcaacgcaggcaagagctcgtacgttcgaggcaacgatcacgcgcgatgccttcggcgtgctatggtacgtcacgaacgaagagggtccgcatatcgagacgacactcacagatgaggaggcgagcacatcgtgccggaacggacgagaccttcacgctcgtcgatacggtcgcctatgcgaacctcgagcccggcaagacctatgagctcaccggcccatggaccacgacaccggagaggcgctgccctatgcagagcccgttacgacgagttcacgccagcctccgagagcggcccgatggaggtcaccttcaccgtcacaggtcttccctcgagcgtgaagcgcattgtcgccttcgaaagcctcaaggaagaaggcaaagagttgctgtgcacgctgacatagaggacgaagggcagagcgtgcgcttctccgagctcccacgacaggcagccgaaagcggatccggcagccatgcgctcaaggcagcgcctgcatgctgcagagctcaccgataccgtctccacacgggaccatcccgaagagaactacacgctcaccgcaacgctccacgtcgtcgacagcaagggaatgacggagggggcttgtgaactccggcggcgagacatcacgtcacacgaaggacttcgtgcccgaatccgagaatggtacggtcgatgtgccgatagagttcaatgcccagaacttcgcaggcacaaagattgtcgtcttcgaagagctcatgcacaaggggcatgtcgtcggaaagcatgaagacatccacgacgagggccagacggtcgtcttcgaggaaacggcgtgcctgacacgagcgacacttcctctgttgcctggggagcctttgccctggcgggcatcgccgcgcttgtcggaggcatctgggtccgctcgaggcactagcagctaaaagacatgcgtcatgagagaaggcggccaggaaatcctggcgccttcttcgtgtctcttcagcgcatgcatcaggactggcggatgagctctgtcaccatctcgacgatatctgccacctggtcgccgttcatgttctccggaacatcgtgagcgtgtgggagaaggccggcaggccattctcgtccatccatgagtggagagcggatatggcgacggaggggtggtcgcatcggtctcgccgatgctgtagcgggccctgccaagcgggaggccgaagtcccgtgcgatgttctggaacatgtgcacgagacggcggtcggcgcgcttcggattgtcatgcccctcttccacaagcacggtcggatctcctgcgccgacgcagtcaagatcgatcaggaaggcgccgcggatatcctgcttgtgggcatcgaggaaggccttgtgccggcatggtcgagctcggaggcacccgttgcgacgaaccagtgtcgtggctgatgaggtcctcgtcgttcatggaaaggaccgcgtcacgggctcctcttcggagacctgctggctccgtgctgctgcttcctgctctgcagcctgagccctggcctctgcttcggcctgggcctgggcagctgcatccgctgccgctgcgcacgcacggcttctgctctttcaggatcgagctcatagcatgggactccggacatcatccgcaagatcgagctgcgggggagaccagctcgtcttcggcgtagcgccgcccttccagccatggttcgagccaggtgaggacgggcagcggtgctgccgtggatgccggtctcatggtcttcgcggcaggagcctcggtgaagtggcgacccttcgccatggcggccgaagtgatgatgcttcttctcctgatgcgactctttcgcgatgcggtcgagcgactccggcgtgatcacatcgaatgtcccctgttctggcttcttcggcatggattgctgtccttcgggtatctgcagggctggctggcaatgcttccggatccgaacggatcgatcgagtgctgcgagggatcgggaaggtcgtcaggatgacgcggcgggccatgggagatggcaggcttgaagcttgtcttgccccactcgggatcgtccggcatctgaggctttcgcggggggtgccggctcaggctcttccatatcctcagcttccgtgacgacgccggagagatccttcggcgcgatgtcaggatcttcggggtgtcacatcgtccatatcgagctggaagttctggggcagcacaggagcatccgttcctccgcgctcagagttctttctgcaggagagcagtgcctcttcggcaggctcagaagcgggctcttcggattcagccgcagcggcatcttcctctgcaaccggagctgcaggcactggcttcttcgctcacctcggttcaggcacagaaacgggcatggcagcggtgtcgcccgctgcgtcttccggctctgcagcttcctcgatcggagcaggcgcagcctctgcttccggctctgcctcctggacaggtgcgggctcttctgcagggagcacaggctcaggctccggctcgcttcggaagcctctcctgcttcaggctgaggtgccttgcaggctccggctccggttcggaaacggctgccggctcagattctggctctggctcgtatgtctcctcaggctcctcttcagagatgcttctggctccggctccggtgcggattcagattccgcttcggcttcggggactggctctgtggcggcagcctcctcaggctgttcggcctcttcaggttccggttcctcgacaggctctggctcctcttcgatgacctctatcgcctcggcgtccatgacggaaggatagaggggtcggggcgcctttggcagataatccatctcatcgggtgcagagggatcttcccctgatcttcctgctgctcagccgcgggctcttccttatgagtctctgcttcgggttcgctctttcggcagcagcctctccggatagccttcgggctcttcgttcaagatcggagcggcatcggatgcatcgagctgcgacgctgcatctcaggagcggcttccccatcatcttcaggaacagaagcctcaggctctgccggcatctcttctgcctcagtaggttcaggctcgaagtgcggtgcagatggctcgggctcagattccagtgccgcaggctcatcctcttctggtgggcaggcacttcttcaggagcggctgcctgaggttcggctcttcctcggtttaggcctcggacgtctcagtgtctcctcttcaggagcgtagtcagagagcgcctctcttctggctcctcttctatctctcgaagacagcatcgacaggcgttgacttggatatatgtgcgaaggg

SEQ ID NO: 116 - DNA, 27176 bp, Unknown
  Metagenome-assembled genome
gtatatgaccaggcgacgctgcttgaaagcgttgcgatgctggggatggcagatgaaagggcagacacggaaatttctttgccacatgacataccgcggctggtcaggactgcatactccgatgcagtgaaggcgctcatcccagatgcatggatggcgaggtatgagaaagcctgcaaagaaagatcgaaaaagaacgagggaaagacggaaagggcgcagacatacctgctgcatgatgttgctaaagttgcaaaaaacgatggcagcctgatcgagcttgccgaatctcagcaggtgctggaagaagatccaagagactccgacaaaggccaacgtgctgtccgcgatacgcaggaaactgtcgaagtgctgctggttagagagacagaggatggcggcatcgccctcatgccctgggttggcagcaaggatgtgccaaagggagcgcagcttccctgtgactgcgagccggaacgtgcagcggcatcgctcttgctgcagtgcgccgtaagactgcctctttctatctgcccgctcaaggacatcgacaacgttatccatgagctagaagacaaatcgtggccatacgtatcatgctggcagcagtctccatggctcgccggacagcttcttcttgtcatgcatcagggggagaatagcgagtatcagactgagctcaatggcaaggtcttggagtattcccttcatagcggtttggctaccgttcgcggatagaattacattcacataacagttgagtttatatttatagctagcaaagcgataacttctgatgaggggaggcggatatggacttgttcccttgagatgctggggatgacccgtgttatgtgaagggtcgcaagtgttccccgcatcggcggggttgatgagttaaacggtctgaaagagaggaggaagtatgacagaccagaagcaagagccatcgttcgatctttgcatggacgcatggatgccagcggtgtatctggatggaagcttgggagaaatctcgctcaaaacggctttcgaggaagcagattctatcaaagagctgtcaggcgacatcccagaacaagtcctgcctatatacagaatgatgctggcagttctttaccgtgcctatcctttgccggaaggagacgatgaaaaaagtcttctgaagacttggggagagatttggcaagctggacattttgatatggagcccatctgccagtacctcgactttttcaaggacaggttcgatctctttgacagccagcatccgttctatcagactcccggtcttgtctactcaggcaaggattcggacggggtcggagagctggttgcagatgttcccaaggatgacaagtacctgttttccatgagggataagggcacgctcgaaagtctgagtttcgcagaagctgcgaggtggctgatcttccagcagtcatatgcgacagcaggaatcaagcctgctgttgttggcaacactcatgtgaagtcaggaaaggtctatgctccgaaaggctctgttggaactggaatgctgggggcagaaggcggcatcttccttgagggacattcgctctttgagacgctgatgctcaattgggtgctctatgattccaaccggaagtccactccaatcgtaggggatgaaaaggatattcctgcgtgggagctcgattcacatagcttcgatctcaaagacgcaaagccgggcgagccctgcggtcctgctcaggcgtatacctggcagtcgcgaaggatgcgtctcatcccctcagcagacggaaaacgcgtcaccggcgtcatcagctgctacggcgatattccaagcgttctgaatgcagatgccgctgaacctatgacagcctggagaaggagcgaggcacagcagaagcgtcttggccttcccgttcctcctcgcatgccgcaagtgcatgattcttcgagatccatttggagaggtcttagttcgattgtctctgctgaaggagatgatttgcggcctggcgttgtcaggtgggcagagctgctgcgttcggtgcatgcaatagatgaccatgatctgccggtgctcgcaatacatgcacaggggatgacatatggcactcaaagcagcgtcttctcggatgccatagacgatgtgttcgatatgagctcatccctgctgtctcatgatgccgcttcatgcaagagagctgtagaggtggtggacctagtcgatcagtctgtaggtgcactggtaaacttcgtttccaatctacagcgtgcagcgggcgataaggcagcaaaagatgttgcgcgagctgagcgcgagaaggttcgagagcttgcatacagcgagcttgattcgatatgccgcagccggcttgcgcactttccgagcaaccaggaagaagcctatgacttcagcgaatcctggaagcaggaagttcatttcaagctgctgagcatcgcgaatggctacgtgcagtcctcccagcgttcgttctttgacgagcatgagggcatgactgccggacgggctgttgccatccttcacggcagcctaaacaagatcctgggaaaaccgaacgtcgctgcggaaggcacgaatgccaacgcggctgtttcggatgcgaaaggggcgtgatgtcatgttcatatcaacatgtgcaaagacacttggcatatgcgtcaatcgcaaagtcggaggcttgcagtcagcctatctggcaggctcctcttcggcgcgtgcgagcctggcgcgtctccgcaagaccgaccagcagggaggagcaccctggattgtcgtaggagaggaactcttcgaggatttgcctgatttgggatacggaccagcagtcgagcacaaggagctgctcagcatacgtgcatctctcagatactatgcaatgctccagcaatcgaagaaatatcctgttgctctgattggctccaagggaaacgagggtactttcggttcggcatgcggacgcattgcatcgggagatgacaaaggcgctcccggcgtcaggagacgtatggctgtgctggaatcagcaacagacttcaattctctcgagaatggaattcgggctctgatacagctcatgcatgcggcagatagccagattcagcttgatttcggcaggttggccggcgatttgctcaagctccagttcgaagatatgcggcaggaagtcttcgaggcatgggcgagagattattatcgcgtcggatcttcgacgagcacaaagaatgacaaagaagaatagcgggaggcaaccatgtttgttgatatctatgcaatccagaatgtaccgccctgtgacatcaatcgcgacgataccggtacgccgaagacggcaatctacggtggctatctgcggtctcgtgtttccagccaggcatggaagcatgccatgcgcgaagagttctccaagcacgtggatggctcccagcttggggtcaggtcgaagcatgcggtcgcgctgattgcggatgagatcgtgaagcagcgtccggaacttgccgatcttgcagagtcgatggctactgatgtcctcaagatcacaggggtgaaggttgaggagtcaaagcgcaagggccaggatcagggcacctcagtcacgcagtatctgatcttcatcgcccgttcggagattagcaagctcgcagctattgccatcaaggcgcatgatagcggagatgatcttacgaagccgagcaaggaactgaagaagcaggtgtcgagcgctttccacggagtgcaggcgctggacatcgcgctcttcggcaggatgcttgccgatgcgcctgacctgaacaccgatgctagcgcgcaggttgcccacgccatatcggtggacaagatttcgcaggagttcgattacttcactgctgtcgatgatattgcagcggaagacaatgcaggcgctgcaatgctggataccattggcttcaattcctctacgctctaccgctacgcaacggtgaatcttgacactcttgagcagcagcttggtggtgcagatgctacctctgcagcaacgaaggcgttcctggatgcgtttgtgaccgctatgccgacaggcaagcagaatacgttcgcgaacaggacgcttccaagcgctgttctcgttgcgctgcgcaaggaccagccagtaaatggtgttgcagccttcgaagagccggtcagcgccaaggaaggaacttcaatctctaggcaggcagaggataagcttgcgaagacgctcgtgcagatttctggtgcatacggagacgctcctgctgcagcatggtggactgccgtggatggaggaacggaggcgctccaggacttcggggctggttgttcgttccctgagatgctggatcaggtcgaagctagcgtaaagaacgtgctggctggtggtgaagcataatgacggtattgctgctcagactttctgggccaatgcagtcatggggcgattcttcgcgctttgtgcgcaggacgacgcgcaatgaaccgacaaagagcggagtcatcggattgatggctgctgcgcttggacggtcaagggaagacagcgtcgaggacttggctgcactcgaattcggagttcgtgccgatcagcctggaaacctgattgttgactttcagaccgagaagacgctcggcgatgcaggaaaaagcatgccgctttcgtacagatattatctgtccgatgcgaagtttctggctgcactgggcggagatgacgaactgctcaaggatatcgatgcggcattgaagcatccctgctggccgctttaccttggcaggcgctcttgtcctcctgatggcccggtgtcgcttggcctctatgaggaatatgaaggcgtgagagatgctcttgggaaagctccgtggcttgcatctcaggcttacaggaaaaagcactcgcgtacacgggaactggaagcagtatgcgatgccaaggctgatgaggaaggaatcagtcaggccgatattccgattacctttagcggcagtggccgcaagtatgcaaacaggaagacatggcgctgccggatagagatatccggcctcgagggcgaaactgctccccgcaaggatggaacagacaagcagcctattgagtttcacggcagccatgatccaatgagcttcttctgagaggaggtgccaacgtgtatatctcacgtatgccgctgaatatcgctcgcatgcaggccgtacagcttgtgaattcgccatacaagatgcacgccgccatcgaacaggctttcccgccgaatgcgcttcgcagcgatgactcaggtcgcattctttggagaatcgattctacgaagaacgcgaaggatggtgcatggctctatgtcgtgagtccctctaagccagactttacgcatatagtcgaacaggctggctggccttctacgacaggctgggagacgaaggactactctcctgtgcttgattcccttgctgcaggacaggtatggcagttccgtctcaaggcaaaccctgcgagaaaggtcatgcagaatcagggaagaaggcccaacgacaaagtggtcggcaccatccaaggccatgtgacagtcgagcagcagctgacctggctgatggaccgctgcgagaagcatggcttcgaaattgcaacagacagcgatgggaatcgaatcatcactgttacccatcgaagcatcgagcgctacaagcatcgggacggcaaggtcacaatcaatacagcggtatttgatggagtgctgatagtgagggattcggagctgttccgcaagtctctgtgctgcggcattggcagggccaagggatttggatgtggcctgatgacaatagcgccattgcactgagcgactgaaacatattgaaagacaggaggagcgcctatgtctgacgagaacgcaggatcgaggtcgtcggcgaaaagaggtgctcctcctcctgatattgcggaccttgcaagagtcgaggatcgcatctcgtttctgtatttcgagcattgcaagatcaaccgagcagacaatgccattaccgtacgaaatgaccagggtacgacatatgtgccctcagccattctcagcgtcctcatgctggggccgggcacagatatcacgcatgatgctatgaagctcataggggagagcggcgtgtcagtggtatgggtcggtgaacgaggcatccggatgtatgccttcggacagcctctgactcattcgagcgctcttctgcagcagcaggcaaagcttgtttcgaatactcgaaccagacttgctgtggcacgaaagatgtactccatgcgctttgctggcgaggacgtcagcaagctgactatggcgcagctgagagggcgagaaggcgtacgagtcagacgcgtgtacaagaaatggtctcaggaaactggcgtggcatgggaccagcgcacctataatccagtcgatttcgacgatgcgacagagatcaacaaggctctttctgcggcgcatgtctgtctgtatgcacttgcgtattcggccatagtggcgctgggatgctctccggggcttggctttgtgcatacaggccatgagaaatcatttgtctatgacattgcggatttgtacaaggctgaaatatctattcctgttgccttcaagactgccgcagagcatccagacgatattggagccgaaacgaggcgcaacatgcgcgatgaaatctatgacctgagcatcctgtcgaggatggtgcacgacataaaggggcttctgctcgccggcgatgctgacggcaaggcaggggatatcgatccatcatccaatcatcttggcttgtgggatgaaaagacaggcgaagtgcctgctggcaaatcctatgcggcatattctgctgatggatcagaaggcgatgacagatgatcgttattgctcttactgcttgtccggtcggtctaagaggggatctgacacggtggctgctcgagatatctcctggcgtattcgtaggtgacgtttcggcacgtgtgagagtggccttgtgggaccgtgtaattagcatggtgagaaacggtcgggcaattatggcgtactcagcaagcaacgagcagcatctcgcgtttgagacatttcagcctgactgggaaccagtggatgtggaaggagttgagctcatcagaaaaccatccggaacagaagatgctccgatgtttggcgcacctccaaaagcttggagcaatgcaagtaaataccatatggcacgaagacattgagggaagctggctagtggtaaagataagacactaatcagattgccaggaccttccgtgatagttgaatagaaatgactgagtcatgctagaattacgcaggttcttagtgtgctccccgcacgagcggggatgatccctcgccgttgagcgtgcgccgcgcaagatcgtcgtgctccccgcacgagcggggatgatcccctgccccatcttctggccgcctagatcgcagggtgctccccgcacgagcggggatgatcccttcgcgccggatgccgtctggcttatcgtgaagtgctccccacgagcggggatgatccctggaaggtaaggattcgtaaccgcaatttctggtgctccccgcacgagcggggatgatccctcgtggccgcactcggtgcactcccacaaaatgtgctcccccacgagcggggatgatccaccgctggtgcgcctaaggccacgcgcgccccgtctccccgcacgagcgggatgatcccgcccgagcgagccgagtgtgcgcggagcttgtgctccccgcacgagcggggatgatccccagctcttaggtaggcgtagtcatcgggaaggtgctccccgcacgagcggggatgatcccctattacggaccttctggctggaataccgtcgtgctccccgcacgacggggatgatcctgggtgcaatggcacctcccttccgcgtcatggtgctccccgcacgagcggggatgatccggggacaggtggatctggacggcgatagagacagtgctccccgcacgagcggggatgatcccaagacggcgagggcagatggacaacctattattgctccccgcacgagcggggatgatcctacgatctttcggagctggaagatatcggagacgtgctccccgcacgagcggggatgatcctgcgactaaccgcatcttgcggcagcctccatgctccccgcacggcggggatgatcccgatgagcagatcagaggtacgaggacgcagggtgctccccgacagcggggatgatccttgccggtaattctgcgagcatctggctcctgtgctccccgcacgagcggggatgattcccatcgccgtgctttccgctacgagcaccgagtgctccccgcacgagcggggatgatccggacgtcgagcgtgacggtacgcgaggaatagagtgctccccgcacgagcggggatgatcccaactcgggcgaggcagatggggaagattcgcgtgctccccgcacgagcgggatgatcccgtggctgcacaggggcgacctctgcctggagtgctccccgcacgagcggggatgatcccgactgctctccgtagtgctttcgcttgcagtagtgctccccgcacgagcggggatgatcctccattcctggcaggtccccgagatcgcggaccgtgctccccgcacgagcggggatgatcccaaaccaaagagactcggcacgtcgttcgacgggtgctcccgcacgagcgggatgatccaatctgcacatgaagcctgctgcccgagccggtgtgctccccgcacgagcgggatgatccgaccgaggtggatgagaagaccggcgcgatcacgtgctccccgcacgagcggggatgatcctgccgaccgagggcctgcacgcccgagaccatgtgctccccgcacgagcggggatgatccggacggtatgtcgatgggcacgtcgacctgtccgtgctccccgcacgcggggatgatcccgcagacggcacccgcacgatcatagccgcccgatgctccccgcacgagcggggatgattctgccgtgagcgtaggcaccgggccgagctgccgtgctccccgccgagcggggatgatcctgtgagcttggagccgtcagccggtgccggagtgctccccgcacgagcggggatgatcctgccgcgtgcgagctcggtgctaggttctgatgagtgctccccgcacgagcggggatgatcctcgcccggcacgagaccgacgaggtctggatgcgtgctccccgcacgagcgggatgatccagaaggcgcaggaggtcgaggccagggtcatagtgctccccacgcacgagcggggatgatcctactacaggctccacccgaaagccaacctcggcagtgctcccgcacagcgggatgatccctccttgatgctgcggccaccgcatcgacagcttgctccccgcacgagcgggatgatcccaaccagatcttctacctgcgcgactacagcagtgctccccgcacagcggggatgatcccaaccagctcttctacgtgcgcgactaccccaggtgctccccgcacgagcggggatgatcccatatgcctcagcaaggacgagacgagctcgacgtgctccccgcacgagcgggatgatcccgacgtggagccacccaccccccccgacgtcctgtgctccccgcacgagcggggatgatccgacctttcggagctggaagatctcggcgatggcgtgctccccgcacgagcggggatgatcctgccacgaaccgcatgcttgcgtcacgctccagtgctccccgcacgagcggggatgatcccccgccgtgacggagtacaacaagccacggagtgctccccgcacgagcggggatgatccttgtccgccgagatcgtcttccgcgacgatggggtgctccccgcacgagcgggtgatccgtacgaggacgcaggcttcaggcgctggacaaagtgctccccgcacgagcggggatgatccccagtcagccatgatcctcctatcctgcccacagtgctccccgcacgagcgggatgatcccggctagccctgcaacgcttagcgagggaattgtgctccccgcacgagcgggatgatccctcatggccgcactccgtgcactcccagaggatgtgctccccgcacgagcgggatgatcccgaggacggcaagctcgactatgcggcactctagtgctccccgcacgagcggggatgtcctctagaaaaaaagattagactagctttagcaagtgctccccgcacgagcggggatgatcccctgtcgtccgcgatgctcgagagatcgcgtgctccccgcacgagcggggatgatccccgcgccaatatgccaccagaccgaggttgacggtgctccccgcacgagcggggatgatccctcggcaagctcctcttctcttcttccatctgtgctccccgcacagcgggatgatccctggcgaaggatcccagcagactgaggaggcaagtctcccccgcacagcgggatgatcctaacaccatgcggacatacatcgacagcgaatgtgctccccgcacgagcgggtgttattctcggcaagccatggaagcgccgagatcatcttctgtctccccgcacgagcggggatgatcctcgaccgcaagtgccgatggattgccggactcagtgctccccgcacgagcggggatgatcccctgcatgcatccatcgcggatatccgcgagagtgctcccccgcacgagcggggatgatccctcctcgagagcccgtctgaatcggcaagccagtgcctcccgcacgagcggggatatccccccacgatggtcgcaagcaggcttaacgaggagtgctccccgcacgagcgggatgatcccgagatgctctcctgagaggtgatgccaattgggtgctccccgcacgagcggggatgatccctcgccattgatggcacgccttgcaaatcgtcgtgctccccgcacgagcgggatgatcccagcgcttcacaattgattccagacatggtaacgtgctccccgcacgagcggggatgatcccgtccgctcaggcatcaacgccgatgggagaggtgctccccgcacaggggatgatcctatcgcgaagctcgtgctcgacgccctgacaggtgctccccgcacgagcggggatgatcccgatggacgttagtctaactaacgaacttgctggtgctccccgcacgagcggggatgatccatggcaagagcgagggaccatacttcggcatcgtgctccccgccacgagcggggattgatcccggtatgtactcgtcgtaaaggtctgcctgcatgtgctccccgcacagcggcgggatgatcctgccacagacacgccccggcgatggtgcatatagtgctccccgcacgagcggggatgatccccgcaccaatcgggctcgagcgtgaaatcctcgtgctccccgcacgagcgggtgatcccgtcttgaacgaaagcttgagcagcagaagcagtgctcccgcacgagcggggatgatcctctggttgcatatcgctcagatccagagcgctgtgctccccgcacgagcggggatgatcctgaggaatgcggatgaatattgcgaaatggctgaggacctccggcataaccgcaggattcctgtcgccgctccgctgcatcatatggataacggctgatgcatccgaagagcggaggaagcaatggcagggccatgcaggcggactgagcggaggaatcgagagcagggcacgctcctgagttcctgggaagatatcctgacgagagtcgtgcgagaggaggctcctcgaggaagggcatcccggagcttcgtctgccccgcatgcggaaaccgccctgctccaaggtgcacgggcatgcccacaatggcagtgcaccagtgctcccaccgttcagcgtcaccgcaggcacgatgatggaagggacccgcctcgagctcaggaagtgtgtcgtggcgatctggctcatgtcgagccagaagcaggcatcagcgaatgctccctgcagcgccagataggctgcagctgcaagtcggcagggcgcgtcctgcgcgcatccgctgcgcgtggccagatcggagtgccttcacgtcctcgctgctgactgcaatcgagcggacgacttctatataggcgcgagccggaggcacgaggggaaggggcacggagcagcagccgatgcttgccgccgtcgacagggcccctgcgggaggctcctgcgccatccggtgcgcgcaggactgctcggaactcatggcgccagttcgggcacgaccacctctgccatgcatcgaggataaggcgggatgcctggagcggcatagctgccgggctctcgtccttccgcggcctcgagcagaaggaatacgacagctcgacggcgatgcctcgctccccatggtccacgggtcatctccaacttcaaggcatacgtggagggagccttccacggcctctcgaagacacctgcagtcatatgcggactcctacagctggagatcagccacaggagctcctccgatgcctgcatggagctcctcacggatgtgcctcatgcatgtcccgctctccgcatcgcagccacgccacggtccagccgaagcttcctgcgacttgcctaagccgtttgcagttcagggagcctaactatgccggaggtactcagccatttagtgcgattcagacgtgctccccccgcacgggggatgatcctatcgtcgctccggtatctcttgagtgcagcccgtgctccccgcacgagcgggatgatccgtcgcttccgacgtgactccagcacgtcacgtgctccccgcacgagcggggatgatccctcgaaccaagaaatgacaccagtggcgtgctcgtgctccccgcacgagcggggatgatccgaagattgcgagtccgacgatcctgcagccatgtgctccccgcacgagcggatgatcctagtgacgatgatagtgctgatagtagtacagtgctcccgtgaatgctggataatcccatccaaccgcgctggcaagcagtcgcatcaagatgatccctgttacgcagaagtgattcctgggtagtagcgcttcacgaaggtatcgtcacgctcctacggacgggatggcctctagaagtttcaagcagccaacttcgttgttcacaacgcgggatagttctaggcggatgcctttatgccgggataataatgttcctgcaagcttgaggcgatcgggatgttctgttcgaagaaagacgtagcctgagatagtagcgttgttgtgaagggtgtgagccgagactacggcaggtggattgacgttcagttgaggtgatagatggtcgggcagttaattggttacgctgtgagctgtgctaattcgcgtgtgttatagttcacgtaatgttcacacaagggagcgtgcagagaaaaataaaatttgcttgcattggtctgtctactgctcaataattacgagctgcctgagagggcatacgaacgagatggtgggtgtagctcagttggtagaggacggaccgtggctccgtaggtcgagggttcgagacccttcacccaccccattcgcatgatactaggcgccgttagctcagctggccagagcaggggactcttaatcccaaggtccagggttcgaatccctgacggcgcaccatttcctctttgcagcgacatatttgcgccgttagctcagctggccagagcaggggactcttaatcccaaggtccagggttcgaatccctgacggcgcaccagaaattacgagccaggttttgcctggctcttttcgtatagagaggaccttctcgctatggatcttcgtgcaggaaacctgagaccatcaagcgctatctggagcttgatcctgctctctacgaggagacagtcgatgacgaggtccagtggaaaggctgcatcttctcggctgatgtcctcaaagttaagctccctgacggctctttcgccacgcgtgaaattgcatggcaccatggcgggtgtggtgtggctgcatttcatgagggcaagctttgcctcgtacgtcagtatcgggttgctcttggacgcatgacgctcgagatacccgcgggaagctcgagatgggggaggaacccgttgtctgcgcagcccgtgagcttactgaagagacaggccttgtagctgacgaacttgtgccgcttgctgtgtctgcgggatcgataggcttcaccaatgaagcaacgagagtctccttgctcgtggactgcatcaatcagaagcgcaccccgatgaaggcgaattcgtgggcgtcgtttggcttccgcttgaggatatccttgccggagtgagagcaggtctcatccaagacagcaagacaattatcgccgcgcaagctctggcgctgggcgagcgatagagacagaagaagagccgagagggcagacctcccggctcttgtcatctgtgcgccctatgcgactcgaacgcatgaccttgggattagaagtcccctgctctatccagctgggctaagggcgcggacttcatatgatagagcatcaaacgcaagctatcaaagtattctcttcaatttccgtcgaggcccagaccggctacgcttgccggacgttatgaattggatagggctttaacgggcgaatcctcagagcaagtgcaacgacttgatggtagacctccaggggcacttccaccccagacgcttgcgcggtctccggttgagcgaatcgtacacctctgcacttcgtcgtcggtgacatcgtcgaggctcatgcccttcgggaaccagcccctgagaaggccgttggtgttctcgttggtcccccgctcccagggatggtgtggatggcagaagtagacgggagccccaagcgcctcctgccaccccttggcatcggagaactccttgcccctgtcgagcgtgaccgtatgcacggccctgccggcaagcgccttctccgtcgcctcgttgaccgcgcatgcgccttcctggctgccttccgccggcaaggaacccgctcatgcggtcgacctgggtgacgaggcaggcgcctccctggcttcctgccacggtatcgccctcccagtctccgatgcggctcctggaggaggcctcctccggccgctcggagatgtcatgggtgatcgggaacttccccctgcgctcctggctgcccttcacgtgcctgcctttccatggtgcctgagcagcctggatgccttcttcatcccgagctcgcagtcgagggaccccgactccacggcacggtagatggcggaatcgctcacggcggggtcgggccgctcctccgagatgcggcccgatatctcctccggggaccagtctcgtcccgcatgagcctcacgaccagcgagcgcctctcgggctcgtccatgagcctggggcgcctgcagcgcagcctcctcctgtccccttctctgtgccgtagacgcgcggtagcggcgccctgcaggccctgccaccgttccgcctgatctcgcgggatatggtcgacttgtccctgtggagctccctcgctatctggctgaccccctcatggcccttccagcggaccatgatgtcctcgcgctccgcaatgccaagatggctgtaccgtccatggtgcctccaatgatgcatgtctccgcaagcatcatcataggtcgcgcctgggcggctacctcgtatattctgttgcctcggagtgcggattcgcccggtaaattccttacggtaaaattacctttgtcttcacaaatcaaatatatgaaacgtggtggtgtcgagagtttagaaatatcgccgacttcgttagatgattttacggcatagcactcaaagacttgatgcatttgcctattggtgactcaggatgttgtatccttagagccaaaggtaattcctcagggataccggcaagcagctcatgagattttgggaaaggaatctaaaatgagtgaaatgatcgcatccaccaatgttttcctgaatgtcgaagctaagagcgtcgacgacgtgcttgagttcctgtctagcaaggcagtcgagcttggctatgccgacgacaaggacgctgtcctcgcttccttcaagcaccgtgaggagctcggctccaccggcatggctgatggctttgctatcccgcacgcaaaggacgatgcaatcaagaagccgggtatccttgtcgcaaagctcgcaaatgacgtcgcttggaagtccacggatgatgtccctgtgaccaccgctatcggccttcttatgccgggcgcagaggctggcaccacgcaccttctcgtccttgcaaaggtctccagcatgctcatgcatgaggacgctcgcaagcgcatcgcagagtccgacgatcctgcagccatcgcttccgtgatcgcagacgcggtcaagtagtttcctttataggaaatgggcagacggtcttggggggaagccgtctgccatcttttgatggcaaaggcgaaaggagcctgtggtgatttataccgttaccctcaatcctgcaatcgactacgtgatgtaccctctgtctctcgacatgggcttcactaatagatccaagcaggaggagattcatgtaggcggcaatggcatcaacatctgctgcctgctcaatgagctcgatacccccaacgtcgctctcggcattgctgccggctttacgggcgactacctgatcaagaggctccaggaaaagggtgtcagctgcaactttgtccgtctggacaagggcaatacgcgcatcaacgtcaagctcaatggcattgtcatgaccatggtcaatggcatgggtccgaagattccgcagtccaaggtcgacgagctgcttgaccgcatcgactacctcggcgagggcgacacgatcgtccttaccggctcgattccggcatccctgccgcgcgatatgtacatgatcatcatggagcgtcttgcaggccgtggcatccgctttgtcgtcgatgctccgggcgagcttctcacgaacgcactgaagtcgaagcccttcctcatcaagccgaacaaccatgaggttggccgcatctttggcatgaagccgcttcctgagactcctgccgaggtcatgccgcttgcccacaagcttcatgagatgggtgcacagaatgtcctcgtctcctgcggcagccatggtgcagccctcgtggatgagaatggcgaggagcatgtcgctccttgcgcaaagatcaagcttgtcaacgccaccggtgctggcgactccatggtcgcaggcttcctggccacgtatgacaagacgcacgactatgaccgtgctctgctgttctccagcgcctgcggcactgcaacggcagcaagcaagggcattgcaaagcgctccactatcgaccgcatcgttgcccgcctggacaagatggtcgccgacggcgaagcctaattccggagattgcgagctgcggtgtggggacaccgcagctcttgtcttgcacccttcggggtgacgctatgggggagttgcagcgggcggatgcccgctgcttccgaatggaggaaacatgtacgagggagttaacgcatctgagggcatcggtatcggcgttgcacgcgttgctgtggagcccgatctttctttcacgccgcatagccctgaggacgctgacgccgagaagcagcgctacgtcgcagcccgcgacaagttcgttgcccagacgcaggctcagatcgatcgcatgaaggagaccgtcggcgaggagacggctgcaatcatgcaggcccacatcgagttcgccgaggatgagggcatcgtcgatatggtcaacagctccatcgacgatggtatgtgcgctgagcaggctgtgcagaatgcctatgacatgtactacaacatgttcgcaaacatggaggacgagctcttccgtgagcgtgcagcagacgttgccgacgtcaggaccggccttctggctgacctcctcggcaaggagcttgtgaatctggctgtccttcccgagaactctgtcgtcgtcgtgcacgagctcacgccttccatgacggctgacatcgacaagaagaacattgtcggcatcgtcaccgagaccggtggccgtacgtcccactccgctatcattgcacgccagctcgagattcctgctgtcctctccgtgcctgatgcaacggcgaacatcaagaccggcgatatgtgcgtcgtcgatggcaacaagggcgttgtctacgtcgatccttctgctgacgagctcgagggcttccgtgcaacggcaaagaagcttgcagaggagaagcaggcactcgaggccttccgcggcaagccgacggtcaccgctgacggcgagtctgtgatgctcgttgccaacatcggcaacccgtctgacgctgcatctgctatcgagcatgacgcagagggcatcggcctcttccgttccgagttcctgttcatggatgctcaggagcttccttccgaggaggagcagttccaggcctaccagaaggtcgctcttgccatgaagggcaagcaggtcatcatccgtacgctcgatgtgggtggcgacaaggagattccgtatctcaacatgcagaaggaagaaaacccgttcatgggcttccgtgctgtccgctactgcctgaacaacccggagcagtacaaggtccagctcagggctcttctccgtgcctctgctttcggcgacatcaagatcatgctgccgctcgtcacgacgctcgacgaggtccgtcaggcaaaggcactcatcgaggtctgcaagaaggagctcgacgccgagggcatctcctacaacaaggacatccaggtcggcaccatgatcgagacgccgtctgcttccctcatcgctgacctccttgccaaggagtgcgacttcttctccatcggcacgaacgacctcatcggctacacgatgtgcgcagaccgcggcaacgaccgtgtcgcctatctctacaacgtctatcagccgtcggtgctgcgctccctcaagcgcatcatcgaagagggcaacaaggctggcatcatggtcggcatgtgcggcgaggtcgcagccgatcctctgatggtgccggtgctcctgtccttcggcctgaacgagttctccgtctccgctggctctgtcctccgcacccgcaagatcatctccgagtggacgaaggaagaggctgacgctctgactgagaaggtcatgaagctcgagacctccaacgaggttcgcgccatgctccaggctgctgtcaagtagtcagcgactcatagggaataaggaagggcgcccagcgatgggcgcccttcttctttggatatggtggctgcgacgctaggggatgagcacttcaagggctcctgggcagatcgagatatcgaagtgggtgccttcgagcctctctccatctacctggcagggaggagcactctcgaagtcgatcgtgatgtgcttcggctgggcgaagaagagatgctttgagtgcgtatgtaggccgaagcgggcgaggcagaagatgcccaaggtcaccggtacggcaggaagcgtctttgaatagcagacatcaagcttcccatcgtcgaccactgccttggggcataccctgaatcctccgccgtaggtaggacctacctgcacggcgaagacggcttcgttgcccgcagccgggacaccgtcaatctctgccttgaaggcatagccctgcttggcagaggagaagatcttgaagccggagtccgcaaagagatgggcgccacgccctgtcgagcggtggttcatcgtatcgagggcgatagcagcatcaaggccgaaggagagcgtctggacaaagtagacgccgttcacgagcccgaggtcggctgcaatctttctgccgtccagaagctcttccagagccttctcgggcttgtttctcgtgatatggagtgtccttgcatagtcattgccagagcccaaggggatgggccccaatgtggggcgggatgctttcggtatctgcatgaggccgttggctgcctcgtggatgacgccgtctccgccaaggacgagcacagtatcgtagctctgcgcattggcagcgatgtgcacggcatcgcctgggccagttgtcagatagacgtcgaaggctgggacttgctcaggcagctctttgagccttcgctcgatagctgtggcaccagccttgcccatgccgcttctggataccggattggcaatgaggagcgtatgtcccagtgtctgctgcatggctcagcgctgccaggaggcacgtattgcgtcgatgatttcggcacagcgaagagatgctgcaagcggcatgatggggctctcatgcttgccagcaaggagaagaccctggaaatgctcgatctgtcctgcaaagtcatcccgtgcatagggagcgctcagcgtctggtcgggctggccgaagcgatggaccgtggccgtctggggcctgtgaagcgtctgcacatcgacagagccccactcgcactcgatgtggagcgtgctcttggggccgcggtctgctgcgacctcgagctgtaccggaaccgagcctatgctcagctggacattgtcgtaccagtccacaccgcgcaggaacagggcattcgtgcggtcgatctgcaccttgccgggaagcagctcatcgagccagcttacgcagtagatgccttcgtcgtaaaggcagccaccctggaccgggtcgatgaaatagcccgtgatatcgtcggggaacagatagcactgcgatgcttcgacgaactggatccgtccaaggtctccttcatcgaggagcttcatgaggcgggcatggagcggtacgaagcgggtcttcatggcctccatgtagagcctgttcgtgctgtgggcacaagcgatgacaccatgcatctcctgggctgtaaggacggcaggcttctcgcagagcacggccttgccggcacggagtgccttgatggaccagtcggcatgcagggcatgggggagagcgatatagatcgcttcgacgttcggatcctcgagaagggcatccaggctgtcatagaccacagcgaccgggcattcatgggcaaaggcttctgccttgtccgaatcccttccagtgactgcataggccagtccatgctcagagcctttgaggcttgcatagaagcgtctggcaatcctgccgcagcccaagatgccccagcgaataggtgcgtccatctgcgctgcccctttctcctgataccacttccatacataccagctggtatagaccgtcaaggtgtcaattgcatgtacggtgctatcaatcggccagtgggcatattctgggacaaaggtgcatggctatgcaagtctttcagctcagtgctggtgttttgtcctgttccatgcataaggagaggacagatgccgacagatcgacagcatgggagaggggagtcaggcatcgaactcgctgactcggtgatgcgtaaagggcagtctgcatggcggatggcagatcaaagggaatcctcgctgcatcatctgtcgggggggtcacagagcaataaagaagcaggccacagcgtgtgctgtggcctgctggtctctcatggagcggcggacgggactcgaacccgcaacaatcagcttggaaggctgacgctctaccaattgaactaccgccgcatttcgtggtcggggcgactggattcgaaccagcgaccctctgctcccaaagcagatgcgctaccaagctgcgctacgccccgaagtgcgttgtttagtatacgtgagcgggcgccggatggcaatgaaaaaactagaaggagtaggtgctctcgacaattgctgcaacttcgtccacagactcggacggagcttcggctgcgacatagcggatattgccggagtcatcggtgagcacccagcagatgacccttgtgccatcgccgtaggtgatcgagagcttcgtggcctcgcggttggcaagcgtcgtctgctcctgctggatgttgtcatccgtcacgtcgtattccttcgcgtgatagatgatggccttgatagcatcgtcgatcgtcacggtctcgctctccgtgctcgaagacgaggtcgaggacttgtctgtggtgctggtcgaagaggaattcgttcctgtcgaggaagtgccgctgttcgtggaggaattgctgctctcctctgtcttggcagtggaggagctctcggcggtgctgctctgcgtcgtagtgccagacgtggcattctcggccgtcgtggagcctgtcgtggtcgaggtcgcggctgacttctcggcattcttggagttcacgatatcgacgtcggtcgagtccatgaccttcatcgtgatgatcttggtggccgtgatatcgcagaactcgatgtcgcccgagccgctcttcgtggcaagggaaatccagtcggaaggaacggtcacatagccgacgcctaccttgccgacgcgacgagtggtctgttcagtcgattcgctggtcgtggtggtctggtctgcttcctgttcgctggtcgtctgtgccttgcaggcgctgacagaaactgcgcatgcagcggcaagaatcgggaccagcaccttcgttgaaagctttggcatcgcgcctcccctggagtgactgtttgatgaaaaccatagccatcttatgcacctaacatgccttgtttccggcgaattacctgtaattacacgaacaggcaggtattcctgcaaaagttttgcaaggtgaacggaatgttacgaaacatggaagctgacgttaccaaatacgcaccatttcaaatgcttattagcaaacaattatatttttagctgctttccagagctttgcggtttgaagactctgctgcactttccctgtaacgaactgcataggaaggaagctcatgaactactctgagcgtgtggtaaaggatctcgagtcgcgctatgctgaccagcctgaattcatccaggcggcccgcgaggtgctcctcaccctccagccggcacttgatgcccatcctgagtatgagaaggagggactgctcgagcgcctggtagagcctgagcgtatcgtcatgttccgtgttccctgggtggacgacgagggcaaggtccaggtcaaccgcggctaccgcatccagttcaactctgccatcggaccctacaagggcggcatccgcctgcatccttccgtgaacctctctatcctgaagttcctgggcttcgagcaggtcttcaagaactcgctcacgacgcttcctatgggcggtgcaaagggtggctctgacttcgaccccaagggcaagtctgaccgcgaggtcatgcgcttctgccagtccttcatgctcgagctctatcgtcacgtcggtcctgacacggatgtcccggcaggcgacatcggcaccggtggccgcgagatcggctacatgttcggcgcctacaagaagatcacgaacagctggcagtctgtccttaccggcaagggcctctcgtacggcggctcccttgcacgtcctgaggctacgggctatggtgcagtctacttcctgctcaacatgctcaagcagaagggcgaatccatcaagggcaagacggtcgctgtctctggtgccggcaatgtcgcccagtacgctgtccagaaggcagagagcctcggtgccaaggtcatcacggtctctgactccaacggctatgtctacgatcctgatggcatcgacttcgataccctcgtcgatatcaagcaggtccgccgcggccgcatcaaggagtatgtcgaggcacgtccttccgctgtctaccatgagggagagcgtccttggggtgagaagtgcgacatcgcaatgccgtgcgccacgcagaacgagctcgatctcgacgatgccatcaagctgaccgagaatggctgccgctatgtggtcgagggcgcgaacatgccgacgacgaccgatgctacgctctatctccagcagaatggcgtcttcttcgctcctggcaaggctgccaatgctggcggcgtcgcaacctctggcctcgagatgtcccagaaccatgagcacctgtcctggaccttcgacgaggtcgacgacaagctccatggcatcatggattccatctacaaggctgcgtgggatgctgccaaggaatatggccacgagggcgatctggtcttcggcgccaacattgctggcttcctgaaggttgctgacgcaatgatgtcccagggcatcatctaacgttcgaaatcagctgcattgaagagggaagctccggattgcaaggtccggagcttccctttgatgtatctatgcagcaatgggcgggaatgtagctcccggctgaaagcggtggcagtccatgatggggtgccagccgaaaagcgaatcatgctatgcctgctggacagccggtccctctccgccgtcgtccttcctgccgaaggagagcacctcgtcgatcgtggactcgtcgaagccgcgggagcggaggctgtccgcaaggcgcctcctctcgagctctgcgccctgctccaggccttgcctgcggctctcttcgcgggccttctgctcgcgctcggcatacttctcgtccgcttcgcgcttctcttcggcataccgctcgtcagcgaacttcagtatcttcacgcccatggcttctccggtctccaacgtcccagatcatcatcatacagccagctcatcgccaggctggatgcttcaggcctgctggatggccggtccctctccgccgtcgtccttcctgccgaaggagagcacctcgtcgatcgtggactcgtcgaagccgcgggagcggaggctgtccgcaaggcgcctcctctcgagctctgcaccctgctccagtccctgctctagcccctgcttgtggctctcttcgcgggccttctgctcgcgctcggcatacttctcgtccgcttcgcgcttctcttcggcataccgctcgtcagcgaacttcaatatcttcacgcccatggcttccctcacctctctctgcaggggctcatagccctgcagcagatggtctgatactttgattataagctccgtcatgcgtctctgaaatgtgctgctgccctctgcaccctctgctagggactgctcagaggcgtttgcatgcagcgcctcggcaaagcgcatctgcagggttctgcattctgcgagcagctgttccgcaagtgcactgtcacgcgctgctgcctcgaaacttccttcgtagcgcatgaaccagaaggggaggaggatgaagagcctatgctctagcatctcctccagatcgatctgcttcacccatatggccgctgtcctatgctccgaggtttctccgctaggctctccgatttcaatggaaaggaaaggctgcatacgttgtgcatctctcaggaagataacgcaggaatgcggcagcttcaggaaatggtgctcatgcctggcctctgcttcctcatgcgctatctctccgtcatacctatccattctcatggccatatgcggatcccaggagctctggcattcgatatggaagtctgtctcctctattcgaaagacagagtcggcgatgcgcttcttgatcctgccttcatattcctctcccatgcgagatatgcgcgcgtcttcgggatagcttgttccgaaggcgtagttcgcaagcgggatgaggagtgtcatcgtctgaagacagaatcgtatatgagtccgcgcccatggatgcttccctccctttttcgccctgcaccaacaaagtgcgggaagcatagcatgaaacaagaacaaatgttcacagcattcttacatgtctctgacaacgtcaggaaatgatgcgaaatgacgaagactggccgatgaatgacggcaacacaagaatggatgcagcttcatggcagagggcaatctggaccgttcttcaagacggggaagaattcacggacatgaagaacaagcatctgcaagagggtcacaactgaatgcatgcagcctccatcaacgttctgcggaggctgctcaatggggcctgcgctgtgtgctcaagacctgtgctgtacgctgtccctgcgccatctgtctgccggatgccattgctttgcttatgtccgatagacctgaggctctgcagcgcacctgatgccgggtgcgctgtcgatggcggtgggcatacatgcataaaagtttgagtatataactgattgttagatgcgtgccttcccgtaaagacaagaatggtctttctttgggggagcttgccgtataatccttgcaagcctttaaagcggcacgagatgccggtaaggagaatctgggtgagtccttcttcctcatagattcagggagcattgtcacatggtgacgtgctcccttttttcgtaatggggcctctgtgccccatgctggggttttggttttgccaacgaaggaaaggtggccatcttgaaccttttggtggacgacggcaacatccgaggcgcttctggcgctcgaggacgggactgtcttcgaaggaaggtcgtgcggtgcccaaggggagaccttcggcgaagtggtgttcaacacctctatggtgggcatcaggagatcgtgagcgatccgagctatgctggccagatcgtcacgctgacgtaccgcgcatcggcaactacggcataacgagaaggatatgcagtcgaggaagctgaacctgcgcggcctcgtcgtgcatgacattgtgctatgcgccgagcaactggcagagcgtcgagagcctgccggacttccttgcagagcgtgatatcgtcgctatcgaggatgtggatacgcgtgcgcttacgctccatatccgcgagtgcggtgccatgcgtgccgccatctcgacggtcgataccgaccccgagagcctggttgcccgtgtgaaggcgtcgcccaagatctccgagcacaactacgtggcagatgtctcgacgcgcgagcgctatacggtgtcgtcgctgacaaggttcctgtgaagcacaacgtcgtcgcctacgactgcggcgagaagctcggcatcgtaaagaggctcgcagctgtcggctgcgaggtcacggtcgtgccgtgggatacgccgttctccgactcgaggccatgaatccggatggcgtcttctctcgag

SEQ ID NO: 117 - DNA, 6550 bp, Unknown
  Metagenome-assembled genome
acgaagcgaagccgatggaggagtgacgttacggacaccctcgcgctcatgggtaggtcgtgcgggtctcgaggtacttctcggtctcgacgcagatcttggccatcgtcttgacagcctcgaccgggtagcggccagcagccgtctcgccggagagcatgacgcagtcggtgccgtcgtagacagcgttagcgacgtcgtttgcctcacgcgggtcgggcgcgggttgcggatcatggagtcgagcatctgcgtagcggtgatgaccggcttgtaggccatgttgcacttgtggatgatcgtcttctggatgtgcggaacctgctcggtcggcacctcgacgccgaggtcgccacgggcaaccatgcagccatcggaagccggaggatctcgtcgaagttcttcacgccgagagcggactcgatcttcgggaagattcgacgtgacggcggccattctcgtagcagatctggcggatctcgttgacggcgttagcgtcgcggatgaaggaagcagcgattgcatcgatgccaagctcgcagccgaactcgatgtcggcgcggtcctggtcggtgacagacgggaggttgatgaaggcgttcgggatttgacgcccttcttctcgcccaggacgccgccggactcgacgaccagtgaatctcgttgccctcgacggactcgacctgaaggccgatgaggccgtcatcgataaggagaagggtgcccttctcgacctcgttggcgaggttctggtagtcgagggagatgaggtcatgcgtgccctcgatggtgttgtcggtcgtgacggtcgtgtggtcgccgacctcgaatgtgacagcttgtgatccttcagaaggccggtacggatctccgggcccttggtgtcgagcatgatggcaacagaatgccaagctcctgggaaatggcgcggacgcgctcgatgttcttgcggtgatactcatgcgaaccatggctgaaattgaagcgggccacgttcatgccgccttgatgatctcgcgcaggacatcatcgtcgtcggttgcaggacccattgtgcagacaatttggttctcttctgcatgtcagactctccttgcattcctggtgtccgcaccgtgcggacacgttttgcactgtctggtgtgtttctactacctttgtcttctttcacccgagctaggcgccattataccgattcgtgcttgccacgtttgaaagaagagaataaagagcagcagaattcgccgctaaacaagatgcggcaacgttctcaccacaaagccaacacagtactcgttcgaagaattgccctttttgttcgcattataccccgcaaagcgaggcacatatcgcaggtcgtaaggaaaaaccgccccagacgaaatgtctgggcggctgaactctacaggtcgagtttctgtcgagttggctactcgacacccggagcggtgacgatgctcttcggcacgaagtcggtgccgcggccgaaggcctgggcgttctcgagcgtgcactctgcgatctggccaagggcttccttcgtgaagaatgcctgatgctcgtcatgacgacattcgggaggagcagaggcgggcgacgatggaggagccgagaatctcggactcgcggtcctggtagacgttcgcgttctcctcttcgtgacgtcgaggccagcagcgccgatcttgccggagcggatgccacggatgagggcgttggagtcgacaaggccgccacggccggtgttgacgaagatgacgccgtccttcatattgcgatcgtgtcgtcgttgatcaggtggtaggattccttgttgaggaaggcatggagcgagatgaggtcagcacggcgatgagctcgtcgtagtcgacatactcgtcgatgcagccctcttcgatgaggttctggttcggatagaggtcggagccgaggacggtcatgccgaagcccttgcagatgcgggcaagtgctgcgccgatgcggccggtgccgatgatgcctgcggtcttgccatgaagcgtgacaccgacgaggccctcgagggagaagttgttctcgcggacgcggatgtagcccttgtggatgcggcggttggcgcgagggcgaggcccattgcgtgctcagaattgcctcaggagagtaggcaggaacgcgcgtgaccgtcatccgagctccttggccatcggcacgttgacggcgtcgaagcctgcgcagcgcatgaggaccatcttcacgccgaagccggcgaaacctcgagcgtcatggcagaacatcggcattgacgaaggcgcgaactgcgtcatagccgcgtgccaggccctcgtcatcggcgaaaggttggcgtcaatgaagtcgaccttcacgtccgggaacttcggcagagcctcggagaacgaatccctgtcatagctcttcgtctcatagaacaaaaccttcatgcttcttcctccattacgttatgccgcaggtgcggcaacctaccgtacaagcataagcaaattctatccttaaactcctatccgttgccaatcttaagcttcaatgctgcaatcaccatgaatggcctttcggcggacctccttttcgtcggaatgcatccgcttgtccgtgaacgtccgaaggcacgcttttcagctgatatcagggagatacggtaactcgaagctttaagattctcgtatctgacaacattcttgcaacacttaggcacgtattcgctcaaggcacgtcacagaattccacagaacggggccctatgcccacgttcatgaacacgttcatgaacgaggcagtccctcctgtggaccgcacgtgtgacgggtacttcgctgatttgcgccgtctaatcgtgcctaagtgttggcaagaatgttccgcccagatacgagaatcttaagcttcgagttaccctgatccccctgcatatcagctgaaagcgtgtcctctccgacgtgtcacggacaagcggatgcattccgacgaaaaggaggtccgccgaaaggccattcatggtgattgcagcatttgaagcttaagattggcaacggataggagtttaaggatagaatttgcttatgcttgtacggtaggttgccgcacctgcggcatcaacgtaatggaggaagaagcatgaaggttctgttctatgagacgaagagctatgacagggattcgttctccgaggctctgccgaagttcccggacgtgaaggtcgacttcattgacgccaacctttcgccgatgacggcaggcctggcacgcggctatgacgcagtctgcgccttcgtcaatgccgatgtctctgccatgacgctcgaggttctcgccggcttcggcgtgaagatggtcctcatgcgctgcgcaggcttcgacgccgtcaacgtgccgatggccaaggagctcggcatgacggtcacgcgcgttcctgcctactctcctgaggcaatcgctgagcacgcaatgggcctcgccctctgcgccaaccgccgcatccacaagggctacatccgcgtccgcgagaacaacttctccctcgagggcctcgtcggtgtcacgcttcatggcaagaccgcaggcatcatcggcaccggccgcatcggcgcagcacttgcccgcatctgcaagggcttcggcatgaccgtcctcggctccgacctctatccgaaccagaacctcatcgaagagggctgcatcgacgagtatgtcgactacgacgagctctatcgccgtgctgacctcatctcgctccatgccttcctcaacaaggactcctaccacctgatcaacgacgacacgatcgccaatatgaaggacggcgtcatcttcgtcaacaccggccgtggcggccttgtcgactccaacgccctcatccgtggcatccgctccggcaagatcggcgctgctggcctcgacgtctacgaagaggagaacgcgaacgtctaccaggaccgcgagtccgagattctcggctcctccatcgtcgcccgcctctgctccttcccgaatgtcgtcatgacgagccatcaggcattcttcacgaaggaagcccttggccagatcgcagagtgcacgctcgagaacgcccaggccttcggccgcggcaccgacttcgtgccgaagagcatcgtcaccgctccgggtgtcgagtagccaactcgacagaaactcgacctgtagagttcagccgccccagacatttcgtctggggcggtttttccttacgacctgcgcatatgtgcctcgctttgcggggtataatgcgaacaaaaagggcaattcttcgaacgagtactgtgttggctttgtggtgagaacgttgccgcatcttgtttagcggcgaattctgctgctctttattctcttctttcaaacgtggcaagcacgaatcggtataatggcgcctagcttcggtgaaagaagacaaaggtagtagaaacacaccagacagtgcaaaacgtgtccgcacggtgcggacaccaggaatgcaaggagagtctgacatgcagaagagaaccaagattgtctgcacaatgggtcctgcaaccgacgacgatgatgtcctgcgcgagatcatcaagagcggcatgaacgtggcccgcttcaatttcagccatggttcgcatgagtatcaccgcaagaacatcgagcgcgtccgcgccatttcccaggagcttggcattcctgttgccatcatgctcgacaccaagggcccggagatccgtaccggccttctgaaggatcacaagcctgtcacattcgaggtcggcgaccacacgaccgtcacgaccgacaacaccatcgagggcacgcatgacctcatctccctcgactaccagaacctcgccaacgaggtcgagaagggcacccttctccttatcgatgacggcctcatcggccttcaggtcgagtccgtcgagggcaacgagattcactgcgtcgtcgagtccggcggcgtcctgggcgagaagaagggcgtcaacatcccgaacgccttcatcaacctcccgtctgtcaccgaccaggaccgcgccgacatcgagttcggctgcgagcttggcatcgatgcaatcgctgcttccttcatccgcgacgctaacgccgtcaacgagatccgccagatctgctacgagaatggccgccgtcacgtcgacatcttcccgaagatcgagtccgctctcggcgtgaagaacttcgacgagatcctcgctgcttccgatggctgcatggttgcccgtggcgacctcggcgtcgaggtgccgaccgagcaggttccgcacatccagaagacgatcatccacaagtgcaacatggcctacaagccggtcatcaccgctacgcagatgctcgactccatgatccgcaacccgcgcccgacccgcgctgaggcaaacgacgtcgctaacgctgtctacgacggcaccgactgcgtcatgctctccggcgagacggctgctggccgctacccggtcgaggctgtcaagacgatggccaagatctgcgtcgagaccgagaagtacctcgagacccgcacgacctaccatgagcgcgagggtgtccgtaacgtcaactcctccatcggcttcgcttccgtcacgaccgctgagcgcgtcaatgccaagtgcatcctgtgcccgacgcactctggccgtaccgctcgcctgatctccaacttccgtccgaagctgccggtcatcgctctctccccgagcgagcacacgattcgcaagtgctgcttctcctggggcgtcgaggccatcaagaccgtcgagcagggcacgctctcctcgaccctctatgagtccctcaatgtcgctaaggagcatggcctcgtcgagcctggcgacatcgtcgtcgttaccgccggcgatccgcagacgtctccttcccagggcgactacatcacctctacgaacatgctcatggtcgcacaggtccagtagttcggtctgcataaggacttcaagagccagcttccatccgaagctggctctttctttttctctggattcgcaaaggaggccggcaccccatacaggtgctggcctcccttctttccacagcatcgatggccatatcaggtcctgctgtagacattccttcctccgacataggtgcgcacgacctcgagcttctggtcgagcagcacgaggtctccccgcatgccggcagcgacatggcccctgtcatgcatctcgaagagatctgcggggttctttgtcatggccttggaggcgtcctcgattggagccccggtgaacttcatgaagttgcgcagtgcctgcacctgcgtcagcgtggagcctgcacgcacacccgtcgtcgcgagctttgcatccccatcgacgaccacgacatcgttcacgccgagcttgtactttccatccggaagccctgccgccatgatcgaatcggtgatgccgaggatgcggtcccatccctttgccttgagatagagcctgacggtccctggcacaagatggcggccatcgcagatggtctctgcatagatatcggtctcgagcgctacgccgaagatggcaggctcatgctg

SEQ ID NO: 118 - DNA, 16278 bp, Unknown
  Metagenome-assembled genome
gggattctcgcttcgacgcagatagcactcctccgccgtgcggcgggaaccggtcttacgcctgctccacgagcgttcggaccttttgcgtcccacggttcccgcaagccgctgctgtaccgtctgcttcatttagaagccgcgctccttcctcgcgagtgttcaaggccgcattgagatcgcggtcgtggcgacacccgcatacagggcaggtcatgcctccacgcccagcacgaccgctgattgacctgtccgcaggcagagcaggtcttgctcgacgggtatgaacctgccgaccttcacgaacttgcccgtaccatgagcacttgtactccagctggcgggccatctcggacatgaggcatccgcgacggacttggcagccggcggttcttctccatccctctgacgtccaggtcctcgacggcgatgcttggctctgcgcaccccgcctcggtcgtggccttgtgcagggcgccttttctctggtggctatcttttcgtgtatgcgggcgacccttgcgcgctgctggcgcgtcttcggagccccctcttcttccttgagagcctcctctgcgccgcgccagcttcttctcgactggcaaggctcttgggtttgcgatcgcattcccgtccgaggggccatgaggcagcggatgccccacgtccacgcaggacctcgatgcgcccttcgggaatatcggcttcggacagtcgtgcacgtgagcacgcagaagtacttgccgctcggcacgcgctcacggtcgcgttgaggacgcgcccctcgacgggcggctcactcgtgccctcaccaggccgagcttcggaagcctcactgcccgcgtccggcaccgagattccccagttggtgcggtaggacggcctcgcgtcccgcttcgacttgaagcgcggatatccgggctttccgcccgccctgcagcggcggaagaacccatcgaaaggccctccccaggttaacggcgcctgcggagcgcgtgggagtccacctcggcaagccagggtgcatccgtccttttccaggcgtgacgagcttctggagctggtagacgacggcgatctcccggtcctctcgattcggccttctggtctcgaggcaatgttgtagacccacctggcacacagccgaaggtgagctcgatgagttcgcgcgggcggcgttggggtagaatgcggatctcgtagccctttccatggactacacgctcttctggtctcgatgcattgcctggcgatggcagggcgcccctcccacggtggagacgaaatgggctgctggtccaaagcgtagggatgcgggtcctgggccgtaggggaaactcagccctcaggtgtcgtggctggtcctgcccttgatgcgcttgacggccctgtggatccccagctggggtctgcctccaagagcatgtggacatggtcagcaggaacctccatctcgatgatgtcgaagcccatctcgtccgccacctccagcgctatctccttgaggcgctcgtccacgccgtcccaccagcaccggcctgcggtacttcgtgtcagaagaccacgtggtacttgcagctgtagacgacgttgttgttgctcttgcatttcatgcgagcattataccgcttgcagatagctatcacctgacggcgatgcgcggcttgaccccaagcctgaaggaaggggttgcgccgcgcttttggtcatggctcccaccttctgcttccgtgacgaagccatgagactcaatccgttcttccagccatcgtggtgagcggctcgacattcacattgatggcgggctgaggcctgcgcgcagctccttctgcagcgtgctgctctcgcattggaagcagacgtcctgggtcagggcagaccgcccggcttcagcacacgggcatactctgagagggcttgtccttgctgtcggctgtgagcatcgtgagcatggcctcattgataacaatgtcgaaggagtgcatcctcgaaggggagctcgaaggcgctggcctgaacgacagagcctgtcggcaaggcctttctcgatattctctctggcctttgcgagcgccttctcgtcgagatcgagtccggtgacgctgcacccatacttctttgcaagcatgatcatggtcgtgcccatgttgcaggccacttccagaatctttgtatcgggaccgatgccagccttctcgacaagccagttcgtggcgcgatgcgcgggacggagcttcgtcttgccgagacgtgcagaaatgtatgtccagcttcatgcatgagaggcctcctgacgatgagttaactgtgctcataagctgcagaggcaggaggactgatgctcatcaagtaaaatacggctaacttggcgcagacgtcgttcggggagctgtcccatggcatgcagatgctcggtatcatggagatcgtcggttgcaagggcttcacgggtcaccgagacggaaatctggacaggaagctggttgtgccattggaaagccgaaggtagcattcatctgcgtgcacaacgcatgccgaagccagattgcagaggcactgggcaagctccttgcctctattgtcttcgagaggctgctcggcaaacagagacgaagtcccatatcgattctgatgcggtacgatcatgaaggagctttatggcatcgatatgaaaagacccagcatcccagccatagcggagatacctgcgccggatatcgcgatatccatgggatgcaatgtagggtgcccttcattggcaggccattcgaagagaattgggggctcgaagacccgaccgggaagtcggacgagacctatgtctctgtcatcaaggagatagagaccagaatacaggcactcagattggagctggccagagatgattgatgtgccctgcatgggaccccgctccgtggccgttgttcccggccttgctggctgggcgataagtgagatgccgggtgccttgcgtgggatagctgcagaaggaaggatctgcgagatagggagatgcctgcacgatgcagagcgaagcggaacagccagcaagagaggcctcgcccttagatgcagcatctcgtgggcgaggatgacagagctgcatatcttgatgctgcacgcgaaacaggggatttctggctgtttgaggtggcgctgggcgatgcgccgtgccgcagcagaatgaggcgggtgtgcgacacccaaacgctgacgtattgcctgcgattcatggggcaggtctggcctgaggtgggattctatgcagcaggccctgtggcctctcgtgatgctcaactggcgggtttgacctatctgcaggatattcctcggcatcgcatggatgaagctggccaagctggttttgagatggagcgttgccagaatcatcgggcatgcagtaaaatagggggcggacggcacccgtgccagggcctcaagccgctccttgcacttttttagagtttggagagtggccgtttccgcttaagcgggggcggctattttcctcttcgtccgatatgagtagcccaaccagattccgaggtctgtagctgcgataaggattcctgcgacagtatgacggtttcgatgttcaccaggcttcctttctttcgatggagcggccccgtctgtcccgtatgctgctgcatgattgcctaggtacgaaaaagaacaaatgttttgtcaatgaaatgatatcgcctatgcaaatctgaggcaggggaaagccgtttcatctgcttgaagagtacatatgttcgacaaaaggcagccgtcgctgccgtctggcatcggtccgggaacgggaagttcatctgcagctcgctctctttatggagagcagtcctctgccatatgttctcctgcacgaggacgataatggactcattccatttccatagcgccacccagccctggctgtgctctgcacaggatggggaaggggcggggcatgcatgttgagcgaaaggatcctatggcagcttctcggggaacggcaaagccgatcgatatccttcatggcaatctctggacatcggtcctgcgttttgcccttccggttgcagccacaggcatcctggagcagctctcgaacctgattgacacgatgatggttggcaggctctcgggcgatatgggcaccctcggcatggctgccgtcggctcgaacacgccgatctctggcctcctgattggcctctttgtcggcattgcccttggctccaacgtgacgattgccactgctatcggcaggcgcgaccaggatgcggtcacgaaggccgtgcatacctccatgctcatgacccttgtgggcgttgctatgaccatcgtcggagaggttgccgcagagcctctgctcaggctcctgcttgtgcctgaagagacacttggtgaggcagtgctgttcctgcgtgtctatttcctcgcgcttcctgccatcctgctctacaatctcgaagcggccatcttccgctcggtgggcatcacccgtctgccgctccaggcccttgctatcgcagcccttctcaatgtggccttcggctacctcttcatcggcgtcttcggctggtttgttgtgggatctgcgcttgcaaccgatctctgctatcttgcgagtgcactcatcctgcttgtgcggctcttgaaaatcgactcgcccatcagggtggagccttcgaagctccactgggacggccgctcggctgcccagatcgtgcgcatcggccttcctgcaggcatccagagtgccgtcttctcgcttgcgaacatcgtgatccagtctgctatcaacagtctcggcaccaccgtcatggcagcatcgagcgccggcatctcgatcgagtcggtcgtctacaacctcctgaactccttcagccaggcctgcacgacgttcgtcggccagaacaatggcgcccgccagcttgcgcactgccgctccgtcttcaaggtctcgctcgccgaaggcttcatcgcagacatcgcggtcatcgtccttgtcctcatcttcggccatcagatgatcgccctcttcaacggcgacccggaggtcatagagctcggctatacgcgcatctcgatcatcatctcgtcctacgtattctcgatgctctacgaggtcacaagtggctacctccgcggcttcggcatctctgccattcctgccatcatcacttctgtcgttatctgcggcatccgcttcttctggattgccttcgtcttcccggcagatccgaccttccgcacaatcatgcttgtctacccgatcagcctggcggcgaatgccgtctgcattgcagcgctcgcgcttttcctccatccgtcacgcacggacaagaaggcagatgctccgaaggctcaggcatagctgccagcaacatggctccctgccacagcaaaggccccggctgcagaatgcgctgcagccggggcctggtcgttgatcggaagtgcccgctagcccttgagccaggtgacattggccacgctgtagagcgggatgaagggaagaaggattggcgtcttcttcacataggcctgatactcggggtctttcccgtagctcctgttctgcctgagctcgagcctgcgggcgccgccgaacatcacgtagacgatgccagcatatcctgccagggcaaagatccactggaatggcccttcgagtgccgtgaggccggagatgaggacacctgtccaggtcaggacctcgccgagatagttcgggcagcgcacgaaggagtagagccccttgtcgcagaagcgcctggggttgaccttcttctgggcgctcttctggaggtcggcagcagactcgaggacgatgcctgagagcatcaagacagcaccgatataggtcgagacgtcggcagctgccccattcgcgatgcggaagaagataggggaggcctcggcagcatagaggagcgcacagactgcccagatgaggatacggatgggaagcgagagcccagagccgtcattcacctgcgtcttcatcacatggttataggccttgctcctgcgctctcggatgaggagatagaggccaagcctcatcccatagaacaccatgagccctgccatcaggaagaggacaggcgaggtggcaggggtggccgctgcaaagacggtcagcgccacaccgatcgctgccatggagaagccgtagccaagcgagatgaaccagacgaacttgtggaagccaatcgagctcacgacgaggccaatcaagaagagtgtccagatgctcatggagcctcctgatttgaatcggttgcatgccttaacaagctatcaagtatatgcttgttccgtacccgcagatgcgtgtttcaggaaggcggaagggttatggagcagaaacagggaaaggtgttgccggacgcagagatgcccgagggcttcacggtgacgcttgcgcttgaggatgccgtgccggtcgtgctcttctgcctggctgccatctccatgggccgtgccatacagagcctgctcttcgtcctcggcgcctctattgccttcgcagcaggagccttgaaggtcgcctggaagctcgtgatggccttgggccacaggaatatccctcttctgtcccgccagatgcgctatgtgatgcctcttggcttcctgcttatggcaatcggcctcatcgtgcagcgcgatgcagcaggtgcgctgatactgcgcatgctcgagctcccaagccttcccttcacgcttgcctgggcagccctcatcggctgcatggtccgcttcgcccgcacgaaagaccagctcgaccctaaaagcaactggaaggagcaggggacaaacagcctggcgcagcttgccttcctcgtcgccgtgttgctggcagggtgaagggatgctgaaagcgccctctggcagagacatctgcaggtggggtaggctggaggaaaaggatcttttccggcagcgcgtctgctgccagacataaggagagcatcatgatgtggcccgaaccgattgtcaccgaacgtcttgtcctgcgtccctggaggaaggacgacgcagcagcgctctatgcggcagcgtccgattctaccatcggcatcccctgcggctggccaccccacagaacgcccgctgattctgcagcagcgctcgagtctgtccttatgaagccggagtgctatgcgatatgcctgcgtgcctccaggacgccggatgcgcccgtcggtgccatcagcctcaggaaggaggacaaggatgtcccgattgcggcagatgaggcagagctcggctactggatcgcaaagccatactggaatgccggctacatgacagaggccgtccaggctcttgagcgccatgccttcatggatatggggctttctgccctctgggcagccagctatacggagaacccggcaagcgctgctgtgcagaagaaggcgcatctcacgttccatcaccaccaggaccgctcgctcgaccttatgggcaaggcgcatggcctcgaggtgagccgcatcacgcgtgccgagtgggagtgcgcgattgccgcagatccgaccggcaaggactatcgcggcgcccagcaggcagaggcttcccgggtcatagcgaagatgtcgctcatctcccaggtgcgctcgggaggccagaccggagccgaccgaggaggccttgatgccgcacgcgaggctggcgttgccatctgcgtgtggtgcccgccggtggcttggcagaggacttccccgaggcacaggtctcatgaagctctaccccgagctccaggaaggccatgctcccggctatgtggagcgcacggcctggaatgtgcgcgacgccatgcgacgctcatcgtctcaccggagggctcgagcctctgagcggcacggagatgacaaagatcttcgcagagcgcttcgggcgtcctgtgctcgtgcttgaaggcgacaaacatcgaggacgatgcagcgaccgcgcttggctggctccgtggcctcgatatgctgggcttgacgctcaatgtcgcaggaccccgcgagtcgaagatgccaggcacctaccagaagacgaaggacatcgtcgcagcccttcttgcagctcagagaagcgacagcacgatataggcggcgatgccgccgacgcagcaccagagcatgattcgtcttggcagcgataaggcaacacagcagatgccaagcggcatgaggccagccagacacctgaggcaaacatcgtgggcgagagcaggtcgtttgccacaagggctgcaaagaccgcggccggaatatagctcagcgcctcctcgacgcgggaggaaggctcctgccctggaggagcgctacgggtagcacgcggcagcagaagatgaagagcagagcagacaagccaatgaaccaaaaagtcggtcgtgctcatgcctggtccctccttacagctgctgcgatgagtcctgcggcaacgccgacgagtgccgctatgggcacggcggcgcctgctgcccctgcgcactttgcaaggaagacagaaagcgctgctgccagagccacgacgacggaggtcctgtccttcagctgtcccgacagcagatagatgaagaggcttgtcattgcaaacgatgcgaccgctgtaggtatattggcggcgcttcctatgacagcaccggcagcgacagatactgaccaggtcagaagcaggatgatatcgagcgtgaaggcatggcggaaagaccaggagctgccctctgcgagcttgcccagggtgatgccgtaagcttcctcggtataggtcgaggcaatggccagagactcgcgcttcgagaagcgggccaaggcaggggcgagcgatgccgaatagagggcaaagcgcgaggagacggcacagacggagatggcaagcgaggcgataggcgttccctggagccagaggttcgatatcatgaactgccccgatcccgagagataggtagcggagagcaggaagcactcgggtccgttcatgcccgcctggtcggcgagcacgccgcaggcaagaccgacagcgacataggagagcatgacaggccaggcgacggcgaggatctctggaaatacggatgagcgattctttgtaacagagaccatgggatagctttcagaagagcgaatgtgaataaagtgcatgaagcgtagcacacgtgcgggcgggcaggcttccaggaaatgccgatatccagatatccaagggagatattggccgctctgaccgatctgtgtctgaggtaagatggctcagaaccagaaaggatctcaatgacccatacctcgaagcatccgcaagcgctccaccatccccatgatctgcatcctggccatcccctcatggtcttcgatgacttctgctttgcctatgagaacagaccggtgctctcgcatatcgacctcacgatcgatgcgggggattcggtcgtgctgatgggggacaacggctccggcaaatcgactcttctcaaagccatgtgcggcctcatcttcccggcagaaggcacctatcgcttcgacggcgaggtcgtggatagcaagagcatgaaagatccgctcttctcgaagcggctccaccagagggtcggcttcatctttcaggactcggactcccagctcttctgtgcaagtgtcgaggaggagatagccttcggaccccggcagatggggctttccagctccgaggtggagcggcgcgtgaacgatgtgatgcatctcctcaagatcgaggacctcaaggagcgcgctccctggacgctttcgggaggagagcagaagaaggtcgctatcgcctccgtgctctcgatgaacccggatgcctactgcttcgatgagccgatgagcggacttgaccagaagtcgcgcgaatggctgctcgggttcctcaagagtctcaagtcagcaggcaagaccctcatcgtcgcgacgcatgaccagtcgcttgcagatgaggtggcagactatttcgtctatttcggggactatcacggctacgaggacaggccccatatccatatcaacaggtaccctgagaaggaggactaggcttccttctctgcagcaagtgcctggctcaggcgcctgtagtgcaggaagatcccgtcatcggcgagtgccctgatctcgtctcttgtggcaaggcggaccgctgtggcttcgcgctcctggagcttcacatctgcgagcgtgaagtcgaggtgcagatggtagatgtcgacgatataggagtctccgcgctcggcatcgtcgttcctatagcgccagatgggcgtggcgtcctggggcacatcgagcccgacctcttccttcacttcgcgggtcacggcttcaagtgaggtctcgcctgaacgcacgccgccgcctgtgacttcccaccagccggcagcccacttcttgtcaagcgcgcgctgggtgatgaggatgcggcccgaagggtcttctatgagggcaaggacatagagcatgtagcggcccggagccaggaaggtgccacgaggagccgtctcgccggtcttcgtgccgtctgcgttatagatgtctatcgtctctgccatcagaggtccaactctccttctgccgcctggagtgccggcgtgaggtcgatgttcagatccacgctgccctggatgccattgacggtgccggtgttcgtgtactgccacatcgtgaaggcgacgcttgtcgtcggcgtggcggagtactgcgccatccagaatccgtactgggacagtctgtcgaggttgtacatgttcgtgaggtcggaggagctgcagtagatggcagccttgtagccggcatcctcgatcgtgctgcagaaggcagcagcgatgctcgtgcgctcctgggtcgtcaggccaaaggcacggtctcccgcgaccggctcgaagtcgaagatgacggggtaggagagctgggcgccattcagctgctcgagcacgaacttcgcctcggtcacggcctcgtcttctgtcgttgcctgggagtagaagtaggcaccgacgccgagtcctgcctccttggcaccggcaagattcctcgagaacgagtcatcgacgacgattgcatcgttcgctgtgccgtgggcaccgatgcggatgattgcatagtcgatgccatctgccctgaccttcgcccagtcgattgtgccgttgtgctcggagacatcgatgccttcgcgcgagagcgtgacgtcggagccgtcagatgctgtcccgacgtagatgaagttgccgttggcatcggtcgtgagattcgaccagtcatacggattgctgtagaggaagcgcgacttgtcgaccgccaggctcacggtgccagaaatcggataggagccatcgcctgctgccgtctggatgtcggaggtgtcatctgcatccgtgttcgtgacatcgctcacagcattctcgacaatctctgctgccttgaagctcgggtcggtgaagaccacgacgattgcgacgccgataacgatgagggcgatgaagagggcaaacgggaagatgtgacggcgcctctgtgctgggcgcctcatatgcctgtcatcgggacgggtgccgcgcggacgcggtgccggacgtgcctgctggaagccggatgcgctcctcgacgttgcggcatagcggctgctggagctccgcggagcagtgctcctggcagaagaggtgctgcgtgcagacgtcgcgcgggtgcttccgtaagggcggggcgtgtaggagcctctagctgacgaggtccgggcgcttgcctggtatctctgggacgcagcagagggcctctgggcagagggacgcgatgtgcgggcatgcggttctgcggcatacgaaggccgccccgaagcggtgtacggtttcggggcatatgcgcgagagcttgtgtctgttcggttatagctgcggttcgtgctgcgttgtgctgtgtttctcgagctctggcgcggtgtcggtgtggtgtgtcgtcttccttgcacctatgctccgtcgtgcctgccaaaatcctgagaatgaactcggaatattctagaagcttgtctgggccttgcatagagctatggacgttctcgacaaaaaggacagccattaattctcatggctgaaacgcagatggcaggcatggaactgcctggagaatctggcagctgttatccaatatttctgtctgagggaaatggggcatagggcagatcggagagaccttgccttctggggtgcagggggcgcagcttgcctgtccgtcatctggcaggcagcctccattcagcttcatgctgcctggatgtcggaaaatggggagaatattgcgggcatgcggctttggttacagcttgcgcatggaaatgttacaagcctgagagatgcttgaccgtgcattcgtttggcggtttcctgtcaatggcgcatcccttgcatatccaataatggcagggagcccaagctaccatcccaactctttaaaggagccagccatgtccttcgtcctgcctgcctaccatgagcccgatttcacagatccgaagctccgccaggcacccgatgccacaactgcccgtgtcatgaaggacggcgtcgctcctgaaggcttccacagcacctcgatgtatcccgagtacttcaagctcggcggcaaatgggtgcttgcccaggagagcaggatggactcttcggtcgtcgtctgcccggatggctcgctcgacgtcgtcgaaaacaggaacctcaaggcagggcagaagattgtgattggacgcaccgaggatggctctgaaggcatcctcgtgcatacgaagggcttctcgtccggagaagacgatgaggacgcaggcgagttcgtgttccgccagggcaggagccgcgagacctcctatgcaagggactacgacaagctggtcgaccttctgcgctatgagcatgaccacggcttcgtactctgggtcatgggtccggcctttgccttcgactacgatgcccgccgtgccatgcaggccatgatcgacgcggggtatgtgaacggcgtgcttgcaggaaacgcgcttgcgacccatgacctcgaggcagcgaccctccatacggcgcttggccaggacatctatacgcagaagtgccaaccctcaggacaccacaaccacctcgatgtgatcaaccgcgtcaggaggtccggctccattccgcagttcatcgaggaccagcatgtcgataacggcatcatgtatggccttgtgaagaacaatgtcccgttcgtgctcacaagctcgatccgcgatgacggaccgctccccgaggtcattgcagatgcctatgagggccagacgcagatgaggaacctcatccgccagtccacgacggtcatctgcctcgcgacgatgctccatacgatcgcaacgggcaatatcacgccgagcttccgtgtgctgcctgatggcaccgtgcgccccatctatctctacgcggtcgatgcggccgagttcgtcttgaacaagctgcaggacagaggatcgctttctgccacgacgattgtcgcgaacgtccaggacttcatcacgatcgtgtcgcgcggcctcggtgtcttcccgaaggactagccttagctcctgaacggactagactggagctgtcccagatctatccgcttgaggggaacggcatatatgagcacattcctgaaccgcacgcatgtctatgggccggtgcatagccgcaggcttggcctttcgctcggcgtgaacatgaatccgctcgacggcaagcactgcacgttcgactgcatctactgcgagcttggcacgaacgagctgaggcatacggcaacgcccttcccgaaggcagaagagattgcgcgcgccttggaggagcgcctcgccgagcttgcctgtgacggcaccgtgcccgacgcaatcacgcttgccggaaacggcgagccgacggagaaccccgagttcccggagatggtggagcgtgcgcgtgcgcttcgcgaccgcttctgcccgaaggcaaagattgccgtcctctcgaatgcgacgtttgctgcggtgccgaaggtgcatgaggcgctcgagcaggtggacatgaatatcctgaagctcgactcggtcgaccccgagttcatccgcctcgtcgacaggccgcacatcccttacgacgcggaggctgtgatcgatgcaatcgcttccttcagaggccatgcaatcgtgcagacgattttcctcacgggcgatgtcgagggcgtgcatatcgatgataccgtgcccgagctcgtggatccgtggctcggcgcgcttgcccgcatcaagccggaggaggccatgatctacacaatcgcccgcgagacggcgcttccaggccttcagaaggcagcgcccgaggtgctcgatgctatcgctgccaaggtcgagaagcttggcatcccctgcgaagtcgcgtactagaaggcaggacagacagaaaagaggggagcccggacctgcgcgtccgggctcccctcagcatgtctggagcttcttgcttatgcgcggtcggcgacagcctttgcgacgacatctgcaacgctcttgtcgagcgcagacgggatgatgtagtcgggagcgagcttgtcctccggcacaagtcctgcgatagcctcggcagcggcgacctccatgtcctccgtgatctgggaggcgcgggccttgagagcgcccttgaagatgcccgggaagacgaggacgttgttgatctggttcgggaagtcggagcggccggttgcgacgaccttggcgccggctgcgagcgcctcgtccggcatgatctcaggcgtcgggttcgcgcaggcaaacacgatgccattgttcatggaagcgaccatgtccttcgtgagaaggcccggcttcgagacgccgatgaagatgtcggcacccttgatgacatcagcgagcgtgccctcttcatgattcttgttcgagatcttggcaatctcttccttgacggggttcaggttgtccctgtcttcatagatggcgccatggcgatcggtcaggataacgtcgccgaagcccatgtggatgaggagcgtggcgattgcgatgcctgctgcgcctgcaccggacatgacgatcttgaggctgcccttctgcttgcccgtgaccttgagggcgttgatgaggccggcggccgtgacgatggcggtgccgtgctggtcatcatggaagacggggatgtcgcacatctccttcaagcgcttctcgatctcgaagcagcgcggtgcggcaatgtcttcgaggttgatgccgccgaaggacttggaaatcagatagacggtctcgacgaacttgtccacatcgtgggtatcgacgcacagaggaatggcatcgacatcgccgaactccttgaagaggaggcacttgccctccatgacgggcatgccggcggcaggtccgatgtcacccaagcccagcactgccgtgccgtcggtgatgacggcgacgaggttgccgcggcgcgtgagctcccacgacttctggtagtctgcctggatctggcggcagggctcagcgacacccggcgtatagagcagcgccagatcctcgttggtctcagccttggcgcgggcaacgacctcgatcttgccatggagcttctcgtggagctccaggctcttcctgctggtttcgtccatggtgctaaaccatctcctcaggtctcatgaccttgtcgaattcctccgccgtgagatagccaagcgcaaggcaggcatccttcagcgaagtcccttctgcatacgccttgtgggccactttcgcagcccgctcatatccaatataagggttcaggcacgtcacaagcatcagggaattatgcaaattgctttgcatcttgtccctgtttgcaactatgcctgagacgcagtggatatcgaacgaatggattgcatcggccaggagcctcaccgactggaggtagttgtaggcaatgacgggcatgaagacattgagctcgaaattgccctgggaggccgcaaagccgatggcggcatcgttacccatgacctggacggcgaccatcgtgactgcctcgcactgggtcgggtttaccttgccaggcatgatggagctgccgggctcgttcgcagggatcgtgatctcgcccaagccaagcctggggcccgaggcaagccagcgcacgtcgtttgcgatcttcatgaggttcgcagccagagccttcacggcgccgtggctgaagacgatggcatccttgccggtcagggcatgcctcgaaggtggcagcgctgacaggccagcccttcgtgaccgacccgaaca

SEQ ID NO: 119 - DNA, 14258 bp, Unknown
  Metagenome-assembled genome
gcatgtcccgctctccggcatcgcagccacggccacggtccagccgaagcttcctgcgagcttgcctaagccgtttacagttcagggagcctaactatgccggaggtactcagccattttatgcaataacctttacgagaattcagtgtgctgaggtgccatttatgccgcccgtatggcgggatgcgtcatccacggaggaattgctacggataagcgtacaatggtgcgcattctgtatggggaacgccgtataaaggagattgggtatggcattgctcgacaccatcaaggcgaaggccatcagcatcaccgtcaaccaggcattcgatatgctctatgacgacttcgatggcaatctgccaaaggtcgagtccatgatcaacaagttcgccggctcaggcgacaacatcaatgcagcacagctgcgtctgttcaacatggtcatgggcttcatgaaggatcctgacaacaactggcgccgtcttgtccagaacgttatcgataacgtcgacaaggaagttgcccgcacgttcgtgcagaacttcttcgtgaactccgtcacgctcggtggctaccgccagcgcgagatcaaccagaaggaaggctgcaactgcccctgggccatcctcatggacccgacgacggcctgcaacctccactgcaacggctgctgggctgcgaactacacggactccaagcagaagtccctcacgttcgatgagcttgactccatcatcacgcagggcgtggagctcggcacctatatctacctcttcacgggcggcgagccgacactgcgcaagaaggaccttatccgcctctgcgagaagcaccctgactgctacttcagcgccttcacgaacggcacgctcgtcgacgaggagttcgcagacgagatcctgcgcgtgaagaacttcatgccggccttctcgatcgagggcaaccgcgaggcaaccgactcccgccgcggcgccggcacctacgacaaggtcgtccatgccatggacctgctccgcgagcgcaggcttccgttcggcgcctccatctgctacacgtcccagaactatgactccgtcacttctgacgaatacgtccagttcctcgtcgacaagggcgtgctcttcgcctggatcttcacgtacatgccggtcggcctgggctctcctgtcgagcttcttgccacggcagagcagcgtgagggcatgtatcacaaggtgagcgacgactggcgcaagaatgtgcccatcttcttcgcagacttctggaatgacggcgaatacacgggtggctgcatcgcaggcgcccgccgctacttccatatcaacgcaggaggcgacgcagagccctgcgccttcatccactactccgactccaacatccgcgagaagacgctcctcgagtgctacaagagcccgctcttcaagagctaccagacacaccagccgttcaacccgaacatgctgaggccgtgcccgcttctcgacaaccctggcgccctctccgagatggtgcacgagacgggtgccaagtccacggactacacgcatcctgaggatgtcgacgagctcgagagcaagacgaaggcagcagccgagcgctgggccaaggcgtctgctccgatctggtctgcaagcccgaagggccgcctctccgaccgtcttgcggccgagggcaaagatcccaacagctggatcgagaagaacgcctaagagaacgcctagaataggctgcaaagcagtgcattgctggcagggcccaagcagttgctgggccctgcttttttagagatggagcatgatggagagctaccagacgctcaaggcaggcacttctgccataggcgagttcacggaccgcaagagccgcttcatcgcggagatacgcccctgcacatccgagacagaggctcacgaattcctttccgaggtcaagtcccactacttcgatgcccgccaccaggtgcctgcctggatcttcgcagatggcaggaagcgctgctcggacgatggggagccatcgaggacagctggcatgccgacactcgaggtgctcgaaggggcgggcctcaaggatgtctgctgcgtaacgacccgctatttcggagggaccctgctgggaccaggcgggcttgtgcgcgcctatacagcagcagcccaggcagccgtcgaggcagctcggactgcaggctccatcatcgagatgacgctcgtgacgcctgtcgtggcagagattccctatagcgcctatgagcgggtgcggcgcatggcagaagatgccggcggcaaggtcaccgactccatcttctcggccgatgtgcagctcacgctcgcgttcaggagcggggaggaagagccgtttttggcggcgctcaaggagcttgcggcgggcgaggagcgggcccatgccctaaagacccgctttgccgaattctgaggctctctaaagcttcaggccttcatctttgagccaatcctcgagctcgtctgcaccacggaagagatgggctctcatgcctgctgcaagggctcccgtgatgttgtcctggttgtcatccgtgaaggcacaggactcaggtgcaagatcgaagcgcttacagaagcggcgatagatctcggggtcgggcttcacgatatgctcgaaagccgatgccatccatccatctatggaatcatggcaagggatgcgcttgacgatgcgggggaatcggacgctggcattcgagaggatatagacgccgtagcccgcctgcttgatcttcgcggcaagatcgttcgtctcctggatgggcgtgcgcttgaggtcccactcggccagagcctgctcgacgttcggatggagacgctccggcagcttcgacttcgcgatgaggagggcagcgtcttctgagatggcgcccgcatcgagataggcccagttcaggctcttgaagagcgcctggcagatgagctcggcatcctcctccgtgtccgtgaacaggcgggagaagccgatcggatcgaagtgcatgaggacgccgccgaggtcgaagaccacattctctatcatggagctccctttcccgtgagatgagtcatatccgatggtagcgcaaggggagcgcaggactccctgcagctgaaaagagccccagcagatgccagggctctcggtgcatatatggagtgctgtgcctagaggcgcttcttcgcgaagccggcagcaaggccgctccacggcgtgacatcctctgcgggaagctcgtcccacatcttcaaggtctcatcgtccacgaactcgcgcttcacgatgacctcgccgccgtagaggtggaaccagtcggcagacgcgatgaggtagccatccttgccctgctccttgccccaggagttctcgatcctccaggccttcggggtgccgtcctcattgagctcgactccctggaatgtcattgcatgcgtgaggctcgtctcgcgcatatcgagcatcgaggtacggtccatatcgaagtcgacatcgaacaggccgtccatatcgacgccgtcgagcgagaggacatgcttgaagtcctcgatatggcgcgggaagttctgcatgacatcgcaggacatggagacggggatgccggccttgaggcttgcaatggcagcctgatcgagcacctcgggagcgacattgaggagacggatcggcgtgccgtcgatcacggagtcggtgagcgtcaggtgatacacgtggccatagggcctcgtgtctcccggcatcgagacgaggttcacatagtcatcgggatcgaacggcacatagtgcgcagcgaactcgagcggcgtgaggccgaaatcgcggaggatcctgacaggcttcgctgccttgtcctcatcatcgcccttggcgccgaggtccttcggcgtcggtgcgacctcagaaatcttggactcctcagcctggcaggcagggccgaccttgacctcgaggtcgaagtgctgtggcggctcgcccaagcagatggcaagcacgcggtagacctcgtcgagcatctcgtccttctgggcacggagcagatcctcgtcgatgccatctgctgctgccttgcggagtattcctgcatcgcggtggagcaggcgctcgagctgggcatccatctcggaagagctcttggagcaggcggtctcgggcattgcgcccttggggacgaggccatatttcttgatgaggttcatggcgaagggccagtacccgccatcgctcatgccatcgtccaggatgtagcagacctcgcgggagtcgaagggaaggtccctcgtcgcgatgatgcgctcgagcatcgcatttgccttctcgagcttgtcgtagaacatgccataggcctgggagaactcgaacgtgtcgacatcgaggtacttcatcgtggcatggcgggcaacgttcatggcagagaacatccagcagcggccgctctggcgctggttcgtgatctcggccgtcttcggcacggagatgccgtacgtgtcatggtaggtgcgcatggccgatgtatcgcgggctgcctgcatcacgttcgtggccgtcaccgcattgcgtgcaatgcggtttgcacggctctgtgcgaagtcggatgcttcctgtgcggcccagtcagggtcaattgctttgcccatagaggtaaaaccactccttttgtccgaaagcagcctccccgggcgggaggctgcagattggctagctagcactgggcgagagagcccatgggatcccacggctcgaggacagtggcctcttcgtggtcgaagatgtcgcgctcctcatctgtcagatacttcttgtccacgacgacctggtagacatactcgtcgaaccaggggtcggagagggtgtcgaagccgtcgcggccatggtccttgccccaggagttctcgaccttccagagcgtcggcttgccgtcagcgtcgagattgacgccctcgagcaccattgcgtgcgtcatgaggctctcgccgtagtcgaggcgctctgcctttgtcatgcatccctcgaccgggaagccgaagagcgtatccacatcgagggcacgggtatccatgatgccctccttctggaggtagctctgggcaacgtcgcagccgaaccacacgggcaggtcgtccttgagctgggcgatagcgacacgcttgagctcgtctgccggaaggttcaggtagcggacgccgtggtcctcgaagacattgccgagacgggcaaccgtataggtgtgcatgaagggcttgtctgccgtcggggcgctgatgagggagatatagtcatcgaggttcatgccgacagcagttgcgaagaactcctgcggggtgaaggtgcctgtgagggcgagcttgtcgtccttgtcacgcagacgtacctcgaagctcttgggcggctcgccgaggcaggtcacgagcaggtgatagacgtcgtcgagcatctccttcttcatggacctcaggtcgtcagcggagacctctgctgcataggactcgcgcaggcgcttcgcagcaccgcggagatagcgcgtgaggtaggaatccatctcgcgggtattgcgggagcaggcagtctcgggcatggcctccttcggcacgacgccgtacttcttcacgagggacttgaacatgtcccactggccgccgtcgccgatcgggtcctggagaagataggagacgaggcgtcccgagagcggctcgtcgagcgtatccaggatgttctcgaggaaccagttcgacttctcgagcttgtcccagaagaggggataggcctgagagagctcgaaggtcttgaggttgtacttcttgatcgtgcggtagcgcatcgtattcaggcttgcgaacatccagcagcggcctgagcgctcctgattgcagcggtcgccctgctggacctcgatatcgaaggtcatggtgttggcagcgacgccttcgggggtccttgctgcttgcctgatgccgttcgagctcacggcgttcttcgcgatgaggttcgcgcggtcgctcacgaagttgtcataggaatttgcaatgtcatcagctgtgacagagcgcatctcgtccatagttccacctttctgatttgttacagcatataagcatatcagagtatgcgttggcatgccgtacgtctcgtggggatgcgcagcagctacactgtggaaaacgagctttcgaggaagggccatccatggatcagagtgcatcagcaatcgccccggagcttctgccggagtatgccgaaagggtgctttcggctcttgaggatgcaggatatgaagcatggatcgtcggcggctgggtgagggatgccctccggggagacgctgcccacgatgtcgacatcaccacatcggcccattggcaggagacggagcggatcttgcgcggctccggcatcgaggtgcatgagacgggaacgaagcatggcaccgtgaccgctgtcgtctgcggccagccgatagagtgcacgacctaccgtacggagggcacttatactgacatgaggcacccggactccgtgaccttcgtagacaatgtccgggaggaccttgcccgccgcgactttacgatcaatgcaatggcatggcatccggagcgcggccttctcgatcccttccgcggaagggaagaccttgcgcatggcctcatccgtgccgtcggcgacccgaagaggcgcttctccgaagatgcgctcaggatcctgcgtgcggtgcgttttgcagcacgcttcggctttgcgatagagccccagacgcagaaggcgcttgtggcatgcgcatccgaactcaaggagattgcgcaggagcgtcgcggacaggagatcgctggcatccttgcttcaggcaggacctcctgggcgctcatggcagagccagaagtcatgcgtgccgctgcgcctgagctcgagcagcttgatgaggtctcgtatgcgcgcacggcagcatgccttgctgccgtggaggagctttcaggtggcgtagcgtcttcatcgctcagatgggcggcactcttttcggaggctggccccaaggggacgaagcgtgcactcaagaggatggcaataggcatcgatacggcccaggaggcggcctccatcctgaagctcggagcgcagattctggaaagcatggacaaggagccttgctggacaaggcaggagagctacgggcttgcggtcacggccgagcgcgcctgcgcccatgaggggatagcgctgtctctctgtgcggcagcctatgcaggggcgcatcttctggctgaagcagcgcttggagaagtcgcacgaggcagggcagaacagatgcttcaggcaatcgacagcataagggccgatatcagaggaatcgcaggagagggagcgccgctgcgcgtgcaggaccttgctgtcggcggttccgaccttatggatgagctttcggtcccggcaggccccgagctcggcaagattctgaacacgctcttctctcttgttgtcgcaggggctctcgcaaacaagcgggaggcgcttctcgctgcagcccggcatatgcagcaatctgcagcaatgcatgatgaagacagggatgaaaattattaaataatctagattataaaactaggaacgcctcatgtttgtcgggcgtgagcttgagcttgccgagctcgaacggctctatgcaaaaggcggctttcagatggtcgtactctatggaaggcgccgtgtcggcaagactgccctgacggcagagtttgcaaaggacaagcctgcacttgtcttcacggccaaggtccagagcgatgcgctgaaccttgccgacttctctcgcagcatctatcgcttctattcgggtccggaagagacaggctcgttccgcacttgggatgctgcacttgcattcattgcccagcaggcgaaagacacgcatcttgtatttgtcttcgatgaattcccctaggccgcaaagcgcaatgcaagcctcatctccacgtttcagattgcttgcggccggctctttccggagaccagcatcttccttatccttacaggctcgaatcagggcttcatggaagagaaggtgctcggagacacaaacgaagacagcctcggggagaagaatccgcttttcggtcgccggactgcccagatccatctcggacctttcgggtatcgggatgctgcgctcatgctgtccgggctctccagcgctgagcttgtcgagttctatgcggtctttggcggcacaccgtactacctctcgatgattgatacgtcagagagcctgaagacaaatgcagagcggctgttcttcagaaaggaagggctgctctatgaggagccgatgatgcttcttcggcaggaactgcatgagccagccatctacagctccgtgcttgatgccatcgctgcaggtgccaacaagccacaggagattgcagacaggatcggcgaagaccgaggctctgtcggcaggtacctggagacgcttcagtccatgaagatcgtcgaggagagggagccatacggcgagtcgcgcgagaggtcgcggaagggaatctactggatctcagaatcggcacttgcattctggtaccggttcgtgcggccggctatggatgcaatcgagatggatgccggagagctcgaggcccgtgagcttttcgaaggaaatgacatccctgcctatgtcgggcactggttcgagacgatctgccttgaatggacaatcgttcaagccaagaagggcgcgcttccgattcgaccggtcagattcggaagctggtggggagcagaccctgccagaaaggggcagacaggcatcgatgtcatggcaggcagcaagcgccgccgcgagctcttcgtcggagaatgcaaggggggaattcgttcgatgcgggaaaaacgacgcgggagcttgtgcggagggcacagctcatatcgggctacgacacggttcgctacggcctgttcacgaaggaccagatttcagcgggctttgctgggacgcttggtccagagtggaccttcgtggatgcagagaggctctacgaagaatgagatggcatgccgcagattcaaatgggctaaggcgggaaatgggcgagtggcctgtattgaggacagagggaagaagacaaaaagaaaagcgctccggaaaccggagcgcatctcatttggtagcccgtagcagattcgaactgctggtctccgccttgagagggcggcgtcctaaaccgctagacgaacgggccatatgtaaggccagcaagtggccgaggaaaatctggtagcccgtagcagattcgaactgctgatctccgccttgagagggcggcgtcctaaaccgctagacgaacgggccagatggctgggatagagagaatcgaactcccattgacggaaccagaatccgctgtcctaccgttagacgatatcccaagaggtcgtgcgcgcgcttcatcagcgcgagaaagaactataccgcagaggacgggggtgcgcaacgacaatctccaaattgcagaaattggggctcactgtaccgtttccaccacaatctcgccacaagtcgtctccagctttctggattgggctttgtccatgaggaatgggcgctgacgggatgcatcccagccagagcgtccagtgccgggtatgatagtaaggcggaattcggagggttgcacatgcagagcagaagggatgcggatggccaaggctgacggcacaaaggcaggctcggccacgaaggcttctgtcggcacggcgcccaaggcggctccgcacgggcacgcaggacatcattcctcgaagccgaagctcaaggtctcgacaggacatatccaggcagaagggaacgaggaccagaaggcaagcgcgcgcaagggtgcgcttttcctggctggtgtcgttgccctctatatcgtctatctcatcttctcgggacagatggtccagttcctcgatgcactctcgacggtcgatacgcactgggtctggcttgcctgcctctgctgtggcttctacttcgccttcggcgtccttgcctacgtgattgctgtcttcatcgaccatgactctcccgtcggcatccgcgacctcatgagcgtcgaggcatcgggcgtcttcttcgggaacctcacgccgatgatggcaggatcggtcccgtcgcagatcgtgcgcctcacgaagacaggactcgatccgggcgaagcttctgctacccagttcacccgcttcatcatgttccagttcggtgtcgtgctctttgctgccatcatgcttgccgccaagctcgagttcttcttcgagacctacggcgatatcgtgatcttgaacctcattgtcttcggcgtgcacatgctcgagctcatcgcgctcttcgtgatctgcctctgcccccgcttcgttatgcgtgcgggcatggcagctatccgcttctgcaagcgcgtgggaatcctcaagaagcaggaggatgtcgaccactggaccgaggtcgtaaacattcaggtcatgcagttctccgatgccttcaagacggcagcaaaggactggtcctcgatgctcctcacgcttgccgtgaccatggcacagcttgccagcctctacatgattccgtggttcgtgctcaatgccttcggtgttcaagcggacttcctcgactgcctggctgctggctccatggtgcagatggtctcctcggctgtgccgcttccgggtggtaccggcggtgctgagggtggcttcttcatgttctatggaggcctcttcggttcgtctgcgacggcaggatacctgatctggcgcctcgtcacgttcatcgcgcccacgatcttggcagcaccgctcctgagcctcaagaccacgaacaggacaagaagcatctaccagcgctggcaggacctcacacatggcgggggcaggagcgccggcgtctcgatgtctggtaccacgatcaagcggcgcgttgcccaggagaagcgcagcacccagagaaagaagcgttagccagaaaggctttgtcatatggcattcggaaagagcagaaagacgcaggcggcgtcgcagcctggcaaggactctgccgagaacaagggccgtgccttcaagggcatgctgttcctcgcaggtgtcgtcctcttctatgtcctcgacctcatcgtcacagggcagatggagaccttcctgacgtcgctccatgagctcgagacaagctggatcgttgctgcggtcatctgctatgtcctctactacatcgcaggcgtcgcagcctatgcggtggcagtctggctcgaccgtgactctcctgtcggcatccgcgacctcatgagcgtcgaggcctctggtacgttcttcggaaacctcacgcctgccatgatcggatctgtgccggcgcagatcctgcgcctcacgaacgcgggcctcgatgccggagaagcaaccgcaacgcagctgacccgcggcatcacgcagcagattgcatccgtgagctattgtgctgtcatcctctttgtcggcttcgtcgccttccaggcttcctacggcaacctgatcttccttgcgctcatcgcctgggccatcgggctcttgaagatcctcggcgagcttgctgtctgctatttcccgaaccaggtcatgcacttcggcaatgctgccgtcaagtggatctcgaagcgcggctggctcaaggactatggccgtgcctatcattttgtcaacaacgaggtgggggagctctccgctgccttcaggcgtgccacgaacagccgccagggcatcctcgtcacgctcgtgatcaactacatccagctgacgctgctctacctgattccctggtttgtcgccaatgccttcggctgcgacctgaatcccattgcctcgattgagctctgcgctctcgtccagatggtcggcgctgccgtgccgcttccgggcggcacgggaggcgtcgatgtggcctggaacatcttcctggggccgaccttcggcacgctgacgaccgctggcttcatcatgtggcgtgccgtctcctatatcggcccgatcttcctttcaatccctcttctgaacctgcattcgggcaggaaggagcagtcgctctaccagaggtggaacgagattgcacacggtgccggcaagagccgcaggtactgaaaagcttggacatgaaaaaaaggaaggcgtctgcatgggcaggcgtcttccttgcatcttgtgcgcttctccctacgcacaggctccgcaggaagcgcatccccgcagggctgaaggctctgcggcaaggccgcccagagcggtctccctgagctctttgggtagggcatgaccgacttttgccattgcatccacgacctcatcgaagggaaggggtgccttgatgccggcatgtgcaagctgcgctgcgctcatggctgaggcaacaccgatcgcattcctgagctggcagggatactcgacgagtccctgcaccgggtcgcagacaaggccgaggaggtttccgattgcaatggaagctgctgcgagcgcctcttccggcgtgccaccgagaagctctgtgagcgctcctgccgccatagcgctcgcggtgccgacctctgcctggcagccgccttcggcgccggcgacgcttgcgttggcagcaatgagggcgccgatggcagaggaggtccagagtgcctgagatatctccttgtcatcctttccgagctcttctgctgcggctaggacagctccgggcacgacgcctgaggcacctgctgtcggtgctgcaacaatcacgcccatagcgctcgaccgttcaagcactgccatcgcataggcagttgcacgcgtgagggcacctcccagaagctcgggagaggaggcagccgcctttgctgcctggccgaagaggaagccgccgagcgagcgcacggggtgctcgatcgtgtcgtgcgtctcttctttcatggtggcaagcaccttctccatctctgcatcagctgcctcctggcttcccagaagctcagcctcgcgggcgcgcatgatatccgctatggatgcgctgcgggcggagcagagatcttgcagctcgcgcccggatgcgaaatcgagggcaagcgccgtatcgggggagaccgtgctcgctccggggatgctcaccgaggaggcaaagatgatgtcagggcgctcctggcaggtatccacaagctcttcgggcaccggctcgtccgtctcgaagaccgtgtaggcacggcctccgcgcgactggcgaaacgtgcgcatcgtcgcgatattgacggaggctgaggagagggcaccggtaagcgctgccaggacgcctggcctgtcatagtgcgagacgaaaagggtcgggtagtcgccggtgatttcgacatgcacgccgttgatcgaggagatgcggatgcggccgccgccgacggattctcccgttacctcgaaggtggagccgcttgcgcagagcatggagatggatgccgtgttcggatgcggcatcacgccgtcgggcccctcaacgatggagaccataaggttgcgatcgcgcgcaatctcgagggagtcgcggacgcggacatcgtcgggaagcatgcccagaaggcctgcgacaagcgcctggtcggtgccgtggcccttgtgcgtgcgggcaaacgagttgtagcagatgatgtcagcacgtacgaccggagagggtgccaaggagcgtgcgacgagcgcgatcctcagggcgcctgctgtatgggaggatgaagggccgaccatgatggggccaagtatctcgaaggcagaggtatgcacagatccattcctctcgaaacattctggaaataggcatgccccatcgtggctcattgagattgtcttggcaagacaggaacacaggaatcgtggatattggccggcattcagataagtttcctgcctgaaacagcagagcatcacaatggatgaggcatatcaaaaagagaaaggatgcagacatggacaggagcatctatacagggcgcagggaagagatcctgcgcaggatggcagaagacggcttcgatgccctcgtcattccggcaggtgcagatatctcctaccttaccggcttcacgggcgaggcaggggtcgcggttgtcgtgctgtctcccgaaggttcgagcttcgtcacggattcccgctaaatggctgaggacctccggcataaccgcaggaattcctgtcgccgctccgctgcatcatatggatgaacggctgatgcatccggaagagcggaggaagcaatggcgaagggccatgcaggc

SEQ ID NO: 120 - DNA, 27756 bp, Unknown
  Metagenome-assembled genome
gctcaacacgacaaggacagcccagacaccatcgcccgctccatcggctgcgacaagtcgatcgtctccgggaagatccagcgcaaacttatggcacgtgaagaagcgcagccgtacagcgtcgcctacgctatcgagcacacggcgcaaaagcaggaggtgcaggcgcaaaagctgtggcgaccccgaagcgtacgcatcgtctgcgagaagatcttcgagcagcgctgctcacccagggtggcgcgtgcctggtagggactgcaagagcgggatctcgccaaaggcacgtgtgcgcgcaggtagaaccaacaataagggcgccttgcgggcaagccgatagagacgatcacgctgagagcgggacaaccagttcgcgtacacgaggggctccaggaggctctcagggcccggtcttcttctgcctgccgcaccatccctggagagaggcaccaatgagaacaccaacgggctcttacgaacttcttctcgaagggcagaccccggacgaacgtgagcggcgagtaggtccaggaggtatacgatacctcaaccgcaggccttggcaagcgcctgggctggaagtgcccgtgggagggtcttttgtgggtcacgtttgtacttgctctgaagattcgccctatcgaataaagcgtttgccatagggtttgccgtccgctttgttggcgacaagtctcgggcggcaggccttatggtagatggggcagccgaatatggagagggggggaattctttacagaagcgggccagcgccctgctgccgacaacttcaagcttcttgtccaagctcgtaggagaaacgcagccgctaagatgcgatttggcatgaggtacgctcagcgaagcgaagggaaagcttcaggatgcatccgaagtgcctgcgtgcggttgagctacagctcgcttacgggagctgtctttaagcacacctgctatgagctagcaagacccaccagataacctgggagtaaaggcagagggtttctaggcagtcgaggctaccaagaagaatgatcctcagcaagcgcgcctgcctcaatgagacctaacatcgctgacaccgatcttccccacaccttcagacaggcgagcaagcgcagcttgtcggcgcagctcctctgcatcgctttagcgatagatgcccacaaaaacccggtcactgtagcatgtagccatggcaagccatccacgaaaagaactaaaggatgcccttagaaccctcagaagggtgccacgatcctctacggcaggccgcgcgctcacagtggcttagtagaagacctcttaaggcctacagggccgatgtggcagagcgtatctgtcttgagaacatgggcttccctgaacaatcttttgcttgtggctcaaatgctacctctggcacctcacagacatatccaaggccaacatgcaaaagctaccttaactggcaggtctagctcttttgggtcaaccaagcttgtgataggtggcctgggactgcaggagtggttcgccatatgatgatggccgatgcaagccttcgcagctcaacgtaggtctatcgcccctcatttacttggctgttagaataatagacggttgatgaatgaaggcttccttcgaaaggaaatggaacgccctatgaaaggcatcattctcgctggaggctccggaatgtgtctctagtctttgacgcgggtcatctcgaagcagctcctgccggtctacgacaagccgatgatctattatccgctgtccacgctcatgctggcaggcatacaggatatcctcatcatctcgatgcttgcagacctgccgtgcttcgaggcccttctggggaatggctcccagtacggcatcttgctgagctatgcagagcagccatccccgatggcctcgcacaggctttcatcatcggcgaggacttcataggtggcgatccctgagccctctcatcctgggagataacatcttctacggcaacggcttctcgaggcatctgcaccacaccgtggacaaagcggagcagtcaggtggcggcacagttttcggctactatgtggacgaccccgagcgctttggtgtcgtggagttcgacaggacgcccatgccgtctctatcgaggagaagctggagtgtccgaagtcaagctccgccgttacgggcctctacttctatgactccagagtgtgcgatatggcaaaggaagtgaagccctcggtgagaggcgagctcgagatcacgtcgctcaacgagatgtacctcagggcggaggatcccgatgtcgtgacattggggtgcggttatgcctggctcgatgccggcacgatggagtcgctctacgaggcatcgaacttcgtgcggaccatcgagataccccagggcatcatgatctccgttatcgaggatcgaggagatcgtatatgagtgcgactagatatctcggaagggcagcttgaggctgcagccgaagagtacggcaacaacccctatggccagcatctccggaaggtgctcgaccgccgtatccagttcacgagggacgactggatgcccttgttcgtcaggtatcatcagtcatgcaacctgtgggatgtgatgtatcaatgccagatatcttcgagccgaggaacatcgtcgttacaggcggctgcggcttcataggctccaacttcgtgcgctgggtggcgaggaaccaccccgagtgctacatcacagttttggacaagctcacctatgctgggaaccccgcaaacattgcaggacttcctaaatcgcaggtggagctcgtcgtgggggatatctgtgatgcggagctgctggaccagctggtccctggccatgacgcgatcgtccactatgcagcggagtcccacaacgacaactcaatagcagaccctgagcccttcgtgcagacaaacgttgtggggacctataggctgctgcaggcggcaaggaagtacgatgttcgctaccaccacattagcacggatgaggtgtatggggatttggcactcgacgagccgcgccgcttcgagccggacgatccgtacaggccgagctcgccgtattcctccacaaaggcatcctccgacctcttggtccgtgcctgggagaggacctacgggatccgcgctacaatctctaattgctccaacaactacgggccctaccaacatgtggagaagttcataccgcgccaggtcacaaacatcctctgcgggatacgtcccaagctctacggcacgggcgagaacatacgcgattggatacataccgaggatcactcccgcgccgtctgggacatcctcacgaaggggaagataggcgagacctacctcataggtgccaacggtgagaagagcaacatagaggtcctgcgcgagatcctctccctcatgggccagccggaggataccttcgactgggtgcgtgaccgccctggccacgacaggagatacgctatcgacccgacgaagctggagcgagagctcggctggaggcctgtccacactgactttgcggaaggccttgcccagaccatagagtggtaccgcacgcatgagagctggtggcgccctgccaaggaggccaccgagcgcaagtactccgagcaggggcagtagggagacaggtacatgtctgagttcgcattcaagtggagtggctacaatgaaagggacaatcctatgagggactggggcgcttgggaaagaaggcctgcgatggcggaccctaagcaccccaggaagttctcaggagagttcaagcgccagatcgttgagcctaacgatgacaacaagagctcggacagagatatgtgccgataacgatatcgccagcttgaccctgcaccgatagataaaggcgatccacgagagcggctccacccgtgtctcaaacaactgcacacctaagcaggagtgcattttcgatcttacggttcaatcctaaaagttgtgggccggtgcctgcagcatagtgcctgcaaagacagagaagcggccctcctctagaatcttgcatcgcaacaagaagatcccgaataaggatggagcgcactgacaagtgtagcatcgccagcagcccgccatttcccatgtcaaagaagctcctgccttcctttcgatcccctcgcatctcgagggcttcgtgcagacaggagagcccagagaggctgttcgcaccgaggaggctgaaacatcgtccaaaagataccggaagccaccttgcatactcttcgtgccgggcaggctggcagtgtcggatgcaccgtcgtgtccctgccgcggaaggctgatggaggagaaaggcccccatcgcgctttggcatctcctgcttgagatgggaaggcaaggatagagatatctcggccaagatgggcatgcagggagtgcggggcctcctgcatcgaggatgtgcccttcagggcttcaggccagcgcatcacgctgttgctgctcgctttcgttgcgacctgctcgccctggggcagaccctcaaggcggtgtcgcccacggcaggcctgcctagaaacgtcgtgaaaaagatcgagcgcgcgaggctctctgggctctacacggaaggggaagacagtaagcgaaagctgcgcaagcccgagcggcagggaaggtatctgggtgcagatacgttcaagcttcacggcgggcaccgctgcgccaccgtgatcgtcgacctcaagatgggacatgtgctgtggcttgtccattcgaagggtggattagcattctaagtgcaacacaatggcccgctgaatgcaggcgtggcacactccgaaaggctacgatgttggttgtccacatcaacgtcgaaagctagaaggaatgtgccactacacacatcttagcctacaggagagggactgcatagccgtactgtgtggcacaagggaaggccaatcggctatatcgcggcagagatcggcagggacagctccagcgtctgccacaagctcaagaggaacgcacggcacggacgctttagggcatgcgctgcccaaagggagggcggatgagcgccgcaggagatgcaggccgaaaaggcggctttcagaccctgcgcttacgcaaaaggtgcgcttactcatcatggacagacactggtccctggaggagatagactatatctcaggctcgagggtagcggcaggtgcaccgttgagcctgccgactattcttaccggcaggtccgtagccgccacgctcgacctgccgggatccggcccgcaaggccaggtgcggcgccacctgcgcagcaagaggcctaagactaaaggcaagatcgagatcttacataccgtggaggagaggcccaagaggccgatgagaggtctcgtctcggagagtgggaggacgacacgctcgtggcagtgggacccgtgtgcctgctcgtgcttgccggcagggcagtgaggctgcttgccgcgagaagatgccaccacgacagcgggagcgtctctaaggccgaggtcgggcttttgcaggaacgtcccctcgagacgctcaccccggataggggcaagcagttcgcagggcatgcagggctcacaaaggtcctttgaggtgtgcagttctacttttgcgacccccaccatctatggcagaagctaacagttaagaacaccaacgggctcctgctagagttcttcccctaagggcagcgacttcagcaaggtcacaaacgaggaggtgcagcatgcggtagagctgatctgtgacagagcgaggaaggtccttggatacaggacagccaacgaggtctttagggagatgttgcactcagcttgacaatctgccaagggaaagaaggttctccatgccttttgcgaccacgccagcgaggagtggatgtttgcatgtagaggctatcgcctgcgacaatcgcggatgagatgctctttgaggcctacttgtgcacgcaggagcaggacatgcgcgcagcgatggagcggatcgtcgcctatgcccgccaccatatcagcagcggcagagtcgaagggaccaactgcacgatcaagacgctcaggagggcaggctagggataccccgactataaatacttcttcctcaagatattcgattgccagcaggcgctgctcgaagccttccggggccggcgcgtgatgggtctgcacacaggtttcaggattgagccgatcttacaaggaagaacaagcaccttaaagatggagctcgacattttaaggacggctgcgctgatagccgcactgaggtagccgcgatagcggaacgcgccggactctatctgcttatcagctctatgtaagcagctcgctactccgaggtcgacctactgcaggcttgcgcggcacacccgagcctgagaagtacaaagaccctttcgccggtgccgtcgaggaaagaagcaccgggtatcacgggacccagagcacaaggggacactggccaagtgcaggatctgctccagcagcagacacctcgccgcagccataagggagtgtggccttaagagtggccacaccaaggtgaagttcaaggcgtaccctgacagatccagagaggccttagtccttaccttgcgtctgtgtgtcgggagtgtgggtgctacatctgcctgttcgtcgatccgtacagctgaaagatagccagccacacgtttgggacaaggaagggcacagggctggccaaggcagtattcgtatgcgtggtgttttcgctcttcgacaagggtgagctccacacgaagtgcggctttaaggtcgctggagccgttatagacgagcctctgaaggtcttctagatagtgaggttgcggtgtatgaggggctgccactacaacagtgccatagacgagtagagcaacaagacacttaaggctgagttcgcccaccacaagcgcttcgagggcctctgcgaccttcaggtgaagcttggcgcttaggtgtggtggtacaacaacgagaggctgcactcgacgctggactacatgagcccggtggagtctcaggaaggcgggtctcagtctctgaagaagatgtccccaagaagggttgccatcctaatgtttagataagtggaaggcacatctaccttggcagatgtcatcgatcggctcagctattacatcgtctcctgagggcccccggcaccatgcgcgccaaggagattgtcacctgcgtcaggcaggtcttcgcaaagtacgtaaccctctccatcatgaactttaagccgaaaggatcagatggaggaacaacgctctcatgcaaagatggctcaagacgctcaagggcaaatgcctgcggcaggaggagtacagcacacctgcagagcttaagggtaaccatcgagaagctcgtcacgcgtggtacaacgaagagcgaatccactatgcgcttagctgcggcacgccaacacaatggtacaggagcatcgtctgcgaggctgcatagccctacaatggtgttgttcggacgggaagggattcagaaaggatcaggctttccctgtctcacaggtttcggacacttcactgcacagagtgtgccgcagatgaccttagagacgaatatgcaacgctttacgggaggggaaggcccaccgagagctaaaggatgccctttcaggcatcaccgacagcttctgggtcgtaacagataactatgcaggatatggcgcgcattcttcccttactcggggttacgaagccacacggccacacttaccaagaagtccaggcacggcgagagcagccttaccaatgccatgcagcgaaggctcaggcaagttcttgctcccattccatggggtgtcgacgaaatggctgcagcatgcctcgcctgcttcctgtggatagagcaggcgaggcatgctgcacaggacagcaaggcgatgctctcaggacagcttgcggaaggcaactatgtacacacgagacgcgcgctcgtcgatatcagccctctctgggactggtgggaagaaaggacctaggtcaatcgtggtctaacatagagaaaaataatcacaggatctgtgagactaaagattgttcgtatccgttgatgtatatcagtcgccttacactgtctttgtaatggttcaaacgtccctggtgttagggcatacagatagtaggaagggttagttttttacgtggaagggaagctcatggcagacagatacgatgatctggcgaaaactatcatccaaaacgtgggtggaaaggacaacattatttccgccgctcactgtgttacacgactacgttttaagcttaaggacgagtcgaaggccaacacagacgttttgaaggacaccaaaggcgttcttacaattatgcaggctggcggccaatatcaggtcgtcatcggcccggacgtgggcgatgtttatgaagctgtactcagaataggtggtattcaaggcgctggcgaggtgccggaagattatagagaaggggataagggtgtcgataccgttaaaggtggcgccattggtgtcctgattgatttgatctccggcatcatccagccctgcctaggagtactggcagctgccggcctcatccagggcttgctctccctgtgtaccttccttggattattcacccaggattccggcacctaccaggtgctctattcagtcggcaacggctttttctacttcttcccgattatcttgggttacacttccgctaaaaaattcgggtgcaacgagttcatcggcatcgcaattggtgcctctctgtgctatccgaatatggtcaactccaacccgtctatggttggtgcaaccgcacagacactgggctatgtcttccagggaaccccgtttgagatggcatactcgatgacgttcctcggtatcccgatcattatgccagcttccggttacacgagctccgtcgtgccgatcattttggctgtatgggttgcctccaagatcgagaagccgctgcgcaagaatattccggcaatgattcgcttcttcaccgtcccactggtgacccttgttatcagtgtccctctgacctacctggtcattggcccgatcgcaagcatactgacgagcctcgttacacttatgttcaatacattgtatggcatcccgcaggtcggtggccttatcgccggtaccgttctgggtgccctttggcaggtacttgttatcttcggtcttcactgggctctggttcctattacgcttgccaacctggcaacgcagggttatgacctgattctggctcctcagttctgctgtacattcgggcagatcgcggttgtccttgctatctctatcaagaccaaggatcagagtctcaaagatatgtgcttgcctgcgttcattaccggtctcttcggtacgactgagcccgctatctacggcgtcacgctgccgagaagaaagcccttcgttatctcatgcatcgcaggcgctatcggcggtgccttcatcggcgctacgggcactaccatgttcagcatgggttattcaggcgtcatcggtttcgcgtcgtttattgataccatcggcagcacaggactgagaagtgtcctcactgcggcaatcggctgcgtgatcgcaatggtcatcggctttgcggcaacgatggcgacgtacaaggacaacgtgccggagcccgcaccagcggctgcataagttcttaatgtttagctctctgttagaccaccattgacttcggcccttaccttccaccagtcccagagagactgggacatgttgacaagtgcgcctcgtgtgtacatagctgccttctgccagctggcctgagagcatctacttgctgtcctgcttcgaatgcttcgcctgttttgtccacaggaagcgggcgaggcagtggccgagccactgcctcgccacctgcaagcgactcgtcgagggagagcccatctgcctggcagcagacagaaagggatgtgcctgggtggcctcagggcagattccatcttcgctgagaaggtcctgccgcaggagcaacatttccatgatggccttgcgcagagtgccccttacagaagaggtctgcagatgtgcgcctcgggtatcttttgggcttacctgcgagggtagatcctgccatcttcttagcgatgagggccttgagcctctctaagagctcgcgcttttccacgatgcccatcttctcgatccactgcagtatcattgagtctatccgggtctttccgtttctcgatgtctttgtttggcgacatacattgtaggcaaaagcccggacaacattggacccttctcaggtcaatcgtggcctaatagagggatgtttaaatgttgcggggtccacacagggtaggccccgccttcgagaaaggacaaacatgagcaaacagtttcccgacggtttcttctggggcggtgccctggcagcaaatcagtgcgaaggtgcttgggatgctgatgggcgaggaccctcggtcgatgaccacctaacgggtggtagtttcaagctttcccgtatgcttacacaagatatcaagcccggtgtgttctatccgaaccacgatggcattgacttttatcatcactatgcagatgacattgccctttttgccgagatgggcttcaatatgctcagggtctccatctcctggagccgtatctttccgaatggcgatgagaaggagccgaacaaagctggccttgccttctatgattctctcttcgattgtatgcatcagcacaatatcgaacctttggtgacgctgagccactatgagatgccttggggcttagtcgagaaatacaacggttgggaatcacgtgagaccattgactgcttcgtacattactgtgaagcggtctttaagcgctacaaggataaggtacattggtggcttactttcaatgagatcaacaccggcactactgatatgggcaccctgctctccactagcatggtgaaaggttataatggtccgatttcaggactcaagactaccccacagcagcgcttccaggcgctgcatcaccagtttgtcgcttcaggccgtgtggttcagcttgcccatgagaagtatcctgacttcaaggtcggcaacatggactgcttcatcttgagctatcctgccacctgcgatccgaaggatatcctcgcgaacgaagcgcagatgcgcttgtccaactggttctgctccgacgtccaggtccgtggctactatcctgcctatgcgcgtcggtacttcaaagaaaacaatgtcgaactcaagatggagccgggcgacctcgacgatatcgctgggggcaaagtggacttttacaccttcagctactatatgtccaacgtagtaggcacgcataaggatctccaaaaggctcagggtaatatgaccataggtggcaagaatccgtatctgccctccactgactggggctggcagatcgaccctgatggtctgcgttatgctttgaacgagatctatgaccgttatgaaatcccgattatggtcgtcgagaacggtatgggtgcgcgagacaaggtggaagcagacggttccatccacgatacgtaccgtatcgactatctgagaaagcacgtcgctgctatgcgtgaggcggtggtagacggtgtcaatcttatcggttacacctggtggggaccgattgatatcgtctccgctggcaccggtgagtttgcaaagcggtatggctttatctacgtcgacaaacacgacgacggcacgggtaccctcagccgtagtcgcaaagacagcttctacgcttatcagaagatcatcaagagcaacggagctgacctttcctagggcggattagcattctgagtgcaacagaatagcgccaggcaaaggtcatggcgcacgtccgaaggctacgatgttggttgtctcaatcaacgtcgcaagtcagggagcaatgcgccactacacatatcttagcgctgagcagcgcgacaggatagccgagctgcacgccgagggcaagggggttccacgacatcggcagggacagctccacacttagccgtaagctgggaaggaacggcaagcacgcaaggtgcaaaccgcacaagaggctctcgaggcccagcgttggccgaggaggtgagagagcacatcgcagacgagcggtagtcacccgagcagacagacaaaaggctttgttttaagcacggcggctcgtctatctagcgcgccgtcggctcaggcgagctcgatatccttgatgtggcccccacaggaccagctccgccgccatctgtacagcaaggggaaacaaacgcacagggggcacgaagagaggaggggcaagatcaaggtctcctgcggcatctcagaaaggcccaagcaggcagacgacacgctcgtcggcaagccgggagggccctgcctggtgacaattgcggatcgctaagtcgcagctactcgtgggtggcaaggctcacgcgcacacaaggtcgagctcacggctctgttaggccgtgaccgcaagaccatcacgcctgagcgcggcaagtagtttgccctctgcgcgaaggtgagcgacaggctcggcggtgtccagttctacttctgccatccccaccatctatggcagaagcccactgctaagaacaccgatgtcctcatctgtgagttcttcccctaagggcacggacttctccaagctcatcgatgatgaggtacagcgcgtattcgacatgatcaacgacaggccgaggaaggtctttggatacaggacggccagcgaggtctttagggagatgttgcactcagcttgacaatccgccaggtcttaaaagctcatctgtctgtccatatctgtcttttggatatgcaggaatgtgtggatgtagctataccatatccagaagacagataggcatctatgtgggtatgagcactgcgtggttcgagacattttgagccgatgtcatacagcgtgtggccccactggcctcatcgaggcgaattaatcatcatttccctagaggacgagccccataaccagactgatcgcaccgatcgcggcgagcggtaagcacccatcgataaaggaaggctttgggtctaagtggtagtagaggacgtagcacatgaggctaatcacaaagccggcgagtgcgaggatgatcaacaggactgcctgaccggcgaggccggctgcctgaagcccataggcacaaaagagctccagaacgatccacgcgacaaacaggaccagctccgtagtggggttgcgttgaaagaggcgatgggtgataaagagcaacaagatatagagcgctataccgctgacgagcgtcgcgacaccagcgacgggcgtattcagtttacctgcgcctgaagcgataccgactgcgccgagcagaccgaagacaaccgccccgataatggagatgatcccaaagaccctaggagcgcccgtggcaacccgattgtagattttgggccaaaagaagatgatccaccagatcaggtagaacgtgcagcatactgccatctccagatgcccggccttaatctgtgctaaagcttgtgcattcataccgatcatgctccaagcgttgaccagcgcgtgagggtctccctgatccaagctttgaatttcccaacgtccacgctatatgcgacattgatagggggtttatccatctggggctcccgtttctctccctgatagatcaccgtggcaccctgggtataggtgccctcacattcgacctcgacgtggtatgaatcagtcttgaagaactccgggtggatcagataggcgatcgtcgaagggtcaaagagcggtttggtcgcttcgggggcctggcccttcggactcgacatgagctctgaggcagctttgccgactctgttgagctggctcagctcgttgaggtcatcgagcgtcaggagcgccatgttcgcagcctcaagcgggagcagcgtgatcggcagccctgaggaaaatacggtagccgcagctttcggatcacatccgatattgaattcggtgtagggggcgatattgccgcgcccgaaggcgccgcccatgataatgagacgagagatgtgggagcggacctcgttgccgtagtccctgagcagtaccgcgaggttggtaagagggccgagcgctacaattgtgacctttttctgtgcctgcatcaggagatctacctgtgcctgcacggcggtctccggtaggagcaatccatcgccggtgacgtcgatatcacactgaaacgccccaaggccggtggcgccgtggtggtagtcgtcatgcccgtcttcagtgacgctcatggcggaaaagcctttagcgatcgggaccttggttccgagaaagtcctcgatgagacgggcattgtgaatcgtgagtccgatggggacgttgcctgccgtggaggtgatgagctggatgtccaactcaggcgaggcgagggcaagcatcagcgcgagcgcatcgtcgcaacccgggtcggtgtcgataatgacgggagttgtttccatggcagctactctactccgtgcaggcgcacgataaagtcgtgatcgtccggatcgaccgggatatcgtcgatgtttgcgatcctatagtcaatgtgccagcggctgtactggttctgcagcagtccgaaaaactgtttgatcctctcgttggggccctgcagctccatcttgacggtgccatcccactcgttgtgcacccagccggcgagcccgagctgtgttgctaacctttgtgaagtccatctgaaaccgacaccctgaacctgtccggtgaaatggactttgatacggcgaagaccaccagtatcggaggttccccgattgttctcagccacttctccctcatctcctggaattcgtgtccgtttttgaatgtgtataatgacaagttatctatacttcatattattctataagcgagtgaggcatggcattcgttgaattttccggcgtgaataaaatctataacatgggcggaaaggatgtcgctgcggtcaaagatatgaattttacctgtgagcgtggcgaatttgtcgtaattattggcccctccggagcaggcaagacgacggtcctgaacatgctcggtgggatggactcctgcaccttaggtaccatcacagtcggtgatagggttgtctcctcgatgaacgaacgggagctgacgctctaccgacgctacgatgtcggctttgtgttccagttctacaacctgatccagaacctcactgcgcttgaaaacgtggagttagcctcacagatctgcaaacatccgcttgatccggcggaagtcctgaaggatgtcgggctgggaaagcgtctgaacaacttcccggcgcaactttccggcggcgagcagcagcgcgtctccattgcgcgcgcgatcgctaaaaatccaaagctgttgctgtgcgatgagccgaccggcgccctggactatcagaccggtaaggcgattctgaaactgctgcaggatacctgccgcaacagcggccgtaccgtgatcgtaatcacccacaatgcggcctttaaggacatcgccgaccgcgtgatttcgatccacgatgggcaggcgacgggcaatgaaatcaacgagcatccggtcgacgcctcgaccttggtttggtagtcatgagaagtgcattcgcaaaggatctcttccactcgatcaccggttcgatggggcgctttctggccatcttgggcatcgtcgccctcggctgcggcttcttcgtcggcctcaatatgaccggccgggatatgcgctatagcgcggataactactacgatgccacccaactttacgatatccgcctgatctcctcgatggggttaacccaggatcaggttgatatgattcaagacgtagagggcgtcaaggacgtgatgcccacctattctactgatgcgatggcatccctgaactccgaccaatatgtggtgcgcatcagcgcactgcccgaagctgcacccctggggagaaatccgaatgcgaaaggctacctcaaccagatcgatctgatcgagggtaggtggccacaggcccccaatgagtgcgtgatgtcttacgaccgcgtgatgcgagaagacttacacaccggggacacgatcacgatcctctatggcagtaccgatctggacaatgttctgacccagaagaccttcacggtagtcggtctcgtccgtgatgcggactatgtggaccagaccgtactcggtactaccacactcggcggtggctccctggagcagtacctctatgtcccgcgtgaggcattctctgactcgatgccctatacccaggtctatgtgactgtggagggggcagaccagcagcaggcgtactcggatggctacgacaaggcagtcgaggaggttgaagaccgtctcaggacagagtccccggagcttgcagcctcaaggctttcagagatccaagccgaagcgcagaagcaggtcgatgatgcgaggaatacgtataacgagcaggcgcaaagtgtgcaggatcagctggatcaaggccagcagcagctcgaccaggcgctcgataccctgagccagagcagtgatcagctgcgctcaagcgaggatcagttggcgcagggacgccaagagcttgagcagcgccgcgccgaagcgctggcacagctcgatcaaacccgccaacagttaagcgatgcccaggctcagctcgatgcggcgcaggcacaggttggaatcacccaggacgatgtcacctcctatgaacagcaggtggcgcagggcagagcgcagactgctcaggcacgtgcgacgattgagcgggctcgggctgatctcggtgtgatcaaggcgagccgggatgccttctccggcttcctgcagcagaccggaatccccactgaggaagagctcgaacaactgcggagcaccgcgcagagcgcccttagggctgccgatgacctctatagaactgacttgatcgatccgacctcacaggacgtacaggaccaggtgagacaggtcgcccaacaggtgcgcacagccctcggcgacattgacctttcaggcagtggtgatggccttgttgaagagctacgtcaggcagcccagaccatcgtggatgagatcatcccgggaaccttaaatcagctcgacgagggactggcacagggaacctcacagctcgactccgctgaggcagagcttagagtaaggcaagatcaactggatcaggcacagtccgccctcaatcagatcaaccaggggagaatacagctcgcacagggctgggagcagtacacgcagcagagcatggaagcctcccggcagctcgccgccgcagagcagcagctgtcagactcaacgcaacagctcctggacggttccaatcagataacgcagggctatgcggatacggtcacaggcttgaccaccttggccgatcaacggctgaatgccgcccagcagctcgccgatggggcacaacaattgcagaatgcccaaaacgcggtgaactccatccaggcgccgaatatctatgtgctcgaccggaatcagggcgtgggacagctgagctatgggaatgacgcttcccgcatggaccgcatcgcgggcgtgttcccgctcttcttctttttggtggcggctctcgtcgcgttgacgacgatgacgagaatggtggagagcgaccgggtggagctcggcaccctcaaggcgctcggctattcgacgatgaagatcgcaagcaagtacctgatctatgcgctgctcgcttccgcgaccggtgccgttatcggcatcctctttctctcgcagttcctgccctacgttattatgaacgcctacggcatcatgtacgtggtaccactgccctcgttgcccttaccgatcgatccggggctcgggttcggcgcgggtgtcgcaggtgtcggtatcaccctgattgcgacgctcgtcgcggtgtgggtggagatgaagcagactccggcttcactgatggtgccggaggccccgaagccgggcaagcgtatcttgctcgagcgcatcaagcccctatgggcgcatgtcagcttcctgtggaaagtgacgctcaggaacattttccgctacaagcgccgactcgtgatgaccatcgtcggtatcgctggctgcactgcgctcttgctcaccggtttgagcgtacgcaacgctgtgcaggacattatcaacaaccagttcggtgacatcatgcactacaacctgactctcgggttcagaagcgatgcgaccgacgaggacaaacagaacgcgatccagtacctcgaggacacggggcactacaatagctccgcttggggcacgagctacaacatgcaggcgggcaccgatgggcacgaccctgagcagatgcagatgatcgtgccggaggatacctccgagatgtcaaagcagatcacgatgcgcgagcgcgtgagcaaacgcccagttgaattcgatgacaattccgtgttggtaacggagaagatggcgacaaacttagggctgcacgtgggggacaccgtacaggtctatcaacaggatgagatcggcaatgccacgggcgatgggacgccgcttaaggtgaccggaatcgtcgagaactacatctacaactacgtctatgtcggcaaggatgcctataaggctgccttcagccaggatccgaccttcgaccacctctacgccaatgtcggtgggggtgaaagcgagcatcaggccatcatggaggatctccatgggcgtgacggcaccgacacggtggtcttcaacgatgagacgatcaagagctaccggtcgatgatgtcgacggtggatcaggtgatgatgatcctcgttatctccgctgcaatgcttgccttcatcgtgctgtacaacctgaccaacatcaacatctccgagcgtgtgcgggagatcgctagcctgcgtgtcttaggctttacacatcgggaagtcgagatctacgttttccgtgagacgctgctgctgacgctgttgggggccttaatcggcttggttgggggctactttatggagcagttcgtcatcgtgaccgttgaggtcgaccttgtgatgttcggccgcacgatccatacgatttcctacttccaggcgcttggtatcacgatggtctttgccctgatcgtaatggctgccctcaccccaaagctgagccgtatcgatatggtcgagtccttgaagtcggtggactagggaagcaaatcgtgtgacggtgggtgccccggatagcttcttaagaactgtccctgggaactgaacggcgtatgttcagcagggaagcgctatttgtggcacacttaacagtgtttgagaacaacagtagcttgctgaaggaaaggatgaatcttggcagaagctaagttttacttaatgactgattccccttgtgacttctcgcccgagatggtgaaggaaaccgggatcgggatatttcactttacctacactgaggccggcaaggccgatgggggcttccacggggtcgatgacctctttgtctcccgtacgccgcatgagttctacgaggcaattcgacatggggcgcagccgatgacatcacagccttcccagatggagtttgagaaggcctttaaggagcgcgcaaaggcggatctgccgacggtgtaccttgcgttcagctccggcatctcaggatgctatgagggcgcctgcaccgcgcttgagcgcgttaaggatgagctcggggagccgcacctgccgatctacattgtggactgcaagatcggctccacctcccagtatctctttatcgtcgaagccatccggcagcgcgacaaggggctcacagcgcaggagatggtcgcctgggctgaggaagcacgctactacgtacacacgatctttatggtcgataacctggataccctgcaccggggcggcagaattccgaagagcgtcgccgtagtcggcggtgccctggacgtgaagccacttttgacctttgatctggacggtgcactgagcatcatcgccgtctctcggggacgcaagaagggcatcaaacggatggctaacttctatcggaagctgcacagcaccgatatgctctcctccgcggtggcgattggcaatgcggactgtcctaaggatgcggagcgcatggctaatgaggtaacgaagattaacgactcggcgatcccgatgatctccacgatcgggccgacgatcggctgccatgtcggtcctggcatgctgtcctgttgcttctggggaccagatcggcgtaagaacgtctcggtatcagaccgtatcgcgcacagtgtgcgttcctccaagtaaaaccaacaaaaagagagccttcggtagtttctgtgggtgagaagttcatctaagcagccttcttcttcgtgctttcctcggcccttcccggaagcgttggcctgctgtcggagcacctcaatatgagcagttcgatgaggttgtcggcgttgcggaagccatagcccatcctgaccgtcaccttgatcttgttgttgatcgcctcgacgcggtcgttgccggttccgagctcgactaccgccacaatgtcggccttgcgtcttcgtaccttcttctcgacggcgacgagcggcttgatcctgtaatacattgcatcgcgcatccacgcctcgagcagcgacgcggccttatcggccgtccttgccctgaacacggcccgcagatcctcttttcagctcccaggccctgaacaggcgcgaagctgccttcttcagggagtagagcttgacacgctgggcagcggtgagatcctcaggggttcttgacgagcgcgaagcggctgcccttgatcgcgtcggcggcctccttcagcgccttctcgcccttgcgcggccaccccgggcggggccttctcgctcttgcgcaacccgccattcctcacagcgcatctcgtcgagcgtatcggttatcccctgcacgatatggaacaggttcatgacccaccgcgcactgtcggcggtgatgacctcgatagcgcgcctctgctctcaggtgagctcgtcgaaaaacaggttcagcacatccttgccatacccctcgtgggcccatatcagccatccccggtcgtggtcgatgacgacaatcaggtacttgtggcccttcttgtaggaggtcttatcgatcccgatgcgccttgcgccctcgaaggcccctgccgcgtgcggcctcaagatcggtgcagacgcgggcgcacacctcgccgagcgtgtgccactccacgcgcgagcgccgcgacggcgcggggcgcgccgcgccaggcacgccacccactccttaaagtcgcgcgtgaagcgcgctttgcgcctcgcccagggcattgactctaccagcacgccgtgctctggccaccttaccctgtgcagcgcgtattccagataagcacatcgaccgagccaggtccatcgcccgccacgagctgagggcctcggcgatctgtcgtagcaatcgcatttcctgttgcagatcgggcagcgcaggcctcaccctaatcacgactcgatcgccttcgatgcgtacgtattcgatcactgtgtgtgccaatgtgagcgcgcagcgtagtatcctgttcatgcgccagggcctttccgctaggttgttgtagcagacgtagccctaccttgcccgacgcggcaacggcccctgatggggccgctaccctttatttgccttgatatcgcgctctcatcggggcccttgagcgaatctcacccatagaaactaccgaagagccgaagaaactcttcggcattctcgataacttaaccgaggaagcaaacactgtgcagaagaaagaaacacagcagtacttcctcaaatcctgcgagatggagtggagattctaggagcaggccttgaagcaggaggactggaagttcaacgatgtgattctcctgaagtaatcagaaggtagcgagtgatcgaagggggagcacaatgaagatcgattggggcattgcagatagaatccgtgaaaagcagcccattgttttaaacttgtccaacgtcgtaacgatcggaaaggtggccaatgcgctgagcgcgatcggcgcttcaccgatcatgtcaaagggcattgacgaggccaaagagatggtgagcatcaccgacgctgtggtgatcaacaccggtacctggaccctgggacgaatttgtgcgggtgcaagccgtagccggctttgctaatgagctccacaaaccattggtgctcgacccggtggtggtaggctcgccgagcagaaagaagattaacctcacgctgctcattaagtatcagttcagtgcaatccacgtcgatgcaggtgagatcgctgcgatcgtcggtgcggaatgggagagccgtggcatcgacgcaggcaccggttcggtggatgtggaagcgctcgcccagacggtggctcagaagtatcacgcgttggtgatgctctcgggggcaatcgattatgtgagcgacggcgtaaacctgttgaagaatgagcagagtgaacctatgctcacggtcaacgtgggatccggcgacattctctcgagcactctgggagcctgtttagccgtaagcagcgattcctgttctgcaggtatcgtgacagcacggatcctgacctgtgccggggcgaaggctgtacagtattctcacagcttagggagctggatggtgcggttctttgatgagctgacgacgattgacagcgcagcgattcaggagggatacagcaatgctcaatgattttcctcaggccttaacgatcgcggggacagattccggtggcggtgccgggatccctgcggatgtcaagactatgcagatgcgccacacttttgggacgatggtggtcgtagcagttactgcgcagaatacctacggggtacagatggcgcagccgatgccgaccacgctgatcgaccaacagtttgcctcgattgcagatgacttcaacattaaagcctgcaagaccggcatgctggcggataccgcccgtgtcaaagtagttgtgaagaacctcaagaagtatgacttcgggtatgtgacggttgaccccgtgatgatcgctaagggcggtgccaagctcttgagtgacgatgcaatcgcggtcgtccacgataaactgctacctctggcggatctggtcaccccgaacctgcctgaagctgagcagctcaccggcatgcacatcgagactcgtgaggatatgaaggccgccggagagaagctgcaggagctcggctccaagaacgtgttggtcaaaggtgggcatctgagaggtacaaagcaggtggccgacttcgtactgcttgaagatcacagcagcttctggatggtgtcagagcgcatcgataccaagcgcactcacgggactggagacacgatctctgcctgcatcacctcagagctcgcaaaaggtcacacaatggaagaggcgatcaagatcggcaaagcctacgtcgaggggacgatcaagcattcgatcaacgtcggccacggctatgggccactcaaccactgggctccgctggaaggggggaattatgagattcagaagtgagatgctgcacgtctatctgaccggcggcacacaggataccgatcatgatccggacctgtttccgaaaaaggttactgaggctatgtgcactggtattactgtcttccagtactgtgagaaggggtccacaacgctctctgaggctcagaggctgaatatgacacagcagtgaggaaacttaacgcaggaccatgggaccccgtactttattgacgacgacgtcgatctggcgcttcaggtacatgtagacggtgtgcacgtcggacagaaagacgaagagattcagtcggtccttgatcaagctgctggcaagttgatcgtggggtactcctgcaatacccatgaggaggttgtagaggctaataagctctccggagtcgactgtctgggcgtggaaccggtcttcccaacgaattctaaggacgatgcggacccggcgttggggctcgaacaactgaaggcgctgaagcaacagagtgtccacccgatcgtggcgatcggcggcattcggaacagaatataaaatctgtgcttgcaaccggcgctgatggaatctcttccatctcgatgatcctgggtagcaacagcagtatccgcactgtgcaggcggtgcgcgcactttattagagattctgacagtcaagcacatgaggactgatgcaggccggccggacagcccaggtgatacaactttccataccaaagggagctatgcctgggagcctacccagctctgtgtttggtgacaacctcttaggctagccttcaaggagaaagtggaaccgtcaggatccatggtacgcaaaagtcccttctacacccgcagtgccaaggccgaagataccaagatctgccggcctaagaaggccacagctgagtgttgctgctgaaagcacataggctttgctaccttcgctgagctaagtgccaagatgggagtgtcctgactgcaggcgcaggtacagctcgcttacagggacagtctttaagcacaccaggcacacaccctgccgaagtgggtatcacccatcaggctcatgcgctacagtgtgccccttaactgcaagagacaaagcgctcagatatcgcatcaaaagcgcctggagatggcggcattgggtctttcgtcctcaaagcagtgcgtctggatcgacaaggcctacatcgctgatgcgcacctctcctgcgccttcgggcaggcgagcaagtatgccctgtcagcaggttggcacagacgtccacacgagcccctataccgtagtctgtggccacaaagagccgtccacggaaaggatcaggggactttgcggccactgagctgaaggcacaagtgcacccacaatagggctgatgagggattcgggggctgtcgctaaatcctacaaggccagttgtgcgcgatccgcactatctggacagcatggcgcttgtggacaatctctgcttttggctcaagagatacctgtgacacctcacagggatgtccaagaccaacatgcaaaagctacctcaactggtaggtctagctgtctcgcaccagacaggcaagggacagatgggttgaaactgcaagggcgccatatgcttgtggccgatgcgagtcttcgcagttcggcatgggtctagcggccctcatttacttgactgttagggagaaagaaaaatagagaaactaatccccatcgcttgttggagacaatgggaatctttgggctgattatttgtccctgttctcggattcgtaggcttcggtcaccgttgcccgccaggtcttgatggtctctgcctggacgaaggagcggaagggtttgaggtctcccttttcgtcgaaggctgtagagcgtggcagcggatacaatggtagcgatgaccacttccatggacgcggagcgttatcaacagctcgaacgtggaagttatagcaggaccgcatcacggatcgaccgggtccacacgtgggatcaatcgcggtggataagttagatggcggatacggtcccgacaacgggccaccatcccatgatcactacccataacaaaacaatgatagtgggctcggttcacggtatccgcgcaagaaccagggagacgcagtttggagtctcacgatctgctcaatctcctcgtagcttcggtattacacgagagactgttggaaagctctgagagcatcagggcgtcgatttgttctctgtcacagggatacgcagtgatcccggtgccatcgctctgccggcgacatcgccccaattccaagccatcctccgagaagggcatccgcacttacgctgacatcgattctccctgtttgcgcatagagatgatatcagcggccacctttgggcacctctatgtgcagcgggggatcgtgcagaaccgctatcatcgaggggcgacgcagagccaacaggcacaaaaggacactcctacagtcagaatcccgttcatctgcccgacgcagtctgcagatcacgttcccgaattggtgggatgatagatgatttttgactttccgccttcacatctttgcgtcttgcacacttccgccagctcaacacttctggttttcttcttggcctattcataagtttgcacccagtttcgcttctcaagggactgagaagctcgtaaggaaagagggagctatctatatgaaacgtttgctgcagcgaaggccggaattctcagcgattgccaacgagagagtattccactgccacagcttccatgctctaggattttctcatcagtttgggcgttgtcgacgctatccttggactgttccgccacagcgtcggagtttatccagagccactgccatctcacacagtgaaacgttcagagacttttcaagaaaatccgctcaaaggaacctatatttctatgtggggatccttgttgatgttgttgtcctttccttatatgatcgcgattacgctctgtccggtctttacaatcctaacagtatcctagtgcagctgccgttctgatttccacgccttgaagtgctcttcctcattattttgtgcggtgcttcggtccttatagcgcttcaaaccggcctggttgggatactcggcgattccagattctctggctcttggcgggagatgttttagtaccggacgagcagatccttgggcccgataacggggaagtgatccgctcggcctcggaggttcctactgcacaaagcatgtaaaaaggccggtcaccctccgatatttctgatttcgcagacgccttgccccgcgatgtacaacatattctccaaccttcactgcgcactcctcctttaaagtaacttcatattaacacatttcctcgaattattgtgcattctgacgaaaattttatttgtatttatttttatgtcactattgaattgtttgtcactgtagagtccatcaactctacacctgcttttaccgttttagcgcaattccaccgcagtgatcccttgtatgccctacgctatgggtaagatgaaggcgcgcgaattcacgtcttatgtggcaaaggggtaacaatcatgatgtctcatcgcttatgccggaatataagacgtgtgtgcacgatcagcatcctgccgtgcaggatgctatgtcgatgacttcgcactgaacttctctcattcagcccagatcgaaaagggacacaccaccaaagagggtggcacagcagagatcttcgaccacaacgctgtgaagaactacaccggtgccctgaaaccgctcgacaggtcttacaccaacgccgtgctgggtacgcgcccgacaaaccttcaagacccgtccggtcgataaatcctgttatggatctccaccagacctgctgcgccgcaacctattcaagagcctatttgccgaaggagagcgtccgggaactatctctcggcgactatatctcccgactccaacgaggggggagcgctgcgcagatagggtacccggccttgtcaacgacctctgcgagcaggtgcgtgacgccctgcaggaaccgaccgctaagcggtcctgaccgccgcaagtttcatgcatgcgagctatgagacgattccccgtttgcggacggaacggtatcccggccgccttctgatgaactatgtaagctcgcggtggcaaccctccctgcacggtcttcgctacagaccgccagcctactttgaagctttgcaggcc

SEQ ID NO: 121 - DNA, 12854 bp, Unknown
  Metagenome-assembled genome
cgacaccgtggacggtgtagagccagcgcggtttgcgcggatcgtcgccgagctttgcacgaggttcttcacatgggagtcgatcgtgcgctcatagccctcgaagtcatagccgagaccttctcgacagctccatgcgcgtagacacgtcccgatagcgggcaagcgtcgtcaggagcttgaactcggaagccgtgagatcgacttccttgccctcgacgagcaccttgtggccggagatatcgataacaaggtcgccgaatcaagcccctcgagctggctctccacctcgtgtgggcgcggcgcagaacgcgcgggacgcgggcaacaagcctcgcgcgggagaacgcttgatcaggtaatcgtcggcaccgagctcgaggccgatgatgcggtcctcgactcgccctttgcggtcagcatgatgatggggacattcgaggtctcacgtattgcgcggcagacgcgctcgcccgaaagcttcgaagcatgaggtccagatgatgagatcgaaggaatgcttctcgaactcctcgactgcgctctggccatcgccgacaccacgcacatataattctcgcgctcaagatatgcagccactgcatcgcggattgccttgtcgtcctcgacccagcagaacttcttctcgtctgaagccatatcggcccccctataagacatgagagcaaactttcatacactctacattctaccccactgtgcagaggatttgtgcgtcaagccttacaaattgaaggtcctgacggtcacagctgaagggtagccggtcgatgcatccttcacggtgggaaggtcacgaaggtgtcacaggcgcccatgcgtgccggatattcgccgtagtcaagcgagcggtcgaccgcagagatcacgcggtaggactcgtttgcttatcgtcacatagtaggaggcgcggaccttcacgatgtaggtgccatccttgccggaaggacgcagaagggctcgctccgacagacggaacgtccatccccgtgtcctacataggtgcccatggaggcaagagtccgcctgtgctgtagctggcctcgatcggaagacgaactcgtctccgatgcgggtggcgcacatcggctttaccgactggggcagcacaagctggtctgtgaccgtgcccatatcatcggacagggggggtgagtgaccgtaataggtgccagaaggctttgacgcgcgcgcgaaggatcgcgtggccatcagatatcgagatgtgcagccgaaccggccagatgactcgatgaccgcctttgcgctcgaatctccggtcttccagagatagcagtgcgagctttccttcgtgctcgagcctgaggtggaaggctgaacctgccagatgaccttggagccagagactgccaaggcaggcggatcccagtttgagtctgcctcccacagaagcgacgcagtgcctgtcacggcaccatccgagaaggcctggccatagagcttccaggacctgttgaggatattgatctcgacccacgcataggcagagtcagagcagcgtgcgtcatagatctccatgttggagccagagcttatgggctgcgcgatgacagtcttgagcgtgccggaggatgtatcgagtgcagagccggtgatcagaggagatgccttggcacctgctgccgtgacagggatccaggtgccctctgccggatgcagcacgcagcccaaaggcagcgaccaggtcgaggcggcgtcgaccgtgctctcatcgtaggtgtactcctcgagcacatcggtgcccgaggaatcatccacgacgacagaagaggacgccgcatcggtagagttcgagctcttgcagccatagagcatgtcgacggctaccgccgtggcagccgttgctgccgtgcccttgagaagggcacggcgcgagaagatgtggtgggtgcgggccatccttacgcttcctgctgtgctgcagcttccgcctgcttcagggccttcgagagctggtctgcgcaggatgtcggacggggtccgcaggtattgccagcgaggacctctgcaatctcgtctgcagacttgccctgtaccaggcggccgatagccttgaggttgccattgcagccaccctcgaagctgacgttctcgatcgtctttccgtcgtcagcaagatcgatatggatggcacgggagcagacgccccggggcctgaaatcatagtggaacatggaactccttattcgaactcgagcttctcgaggcggtcgaagacatagtcgatcctgccgaggaaggaccagggatcgaagatgtgatcgagctcctccttggagagcgtgcaggcaggatcggccaggagcttctcctcgaaggtcgtcccctgctcgcactgctgtacctcgtgccaggtagccatagcgttcgtctggacgatcttgtaggcatcctcgcgggtgatgccggtatcgacgagggccaggagcaccttcgatgagtagatgaggccacgagtcttgttgaggtttgccatcatctgcttcggatagaggatgaggccgtcgacgatcctgatgaggcactggaacatgtggtcaagggcaatgaaggagtctgcctgggcaacacgctcggcagaggagtgcgagatgtcgcgctcgtgccagagggcgacattgtcgaaggcgacctgggcattggccttcacgacacgggaaaggccgcagaccttctccaccgtgatcgggttcctcttgtgcggcatggcagaagagcccttctggcccttgcggaacggctcctcggcctcgagggtatccgtgcgctggaggttcctgatctccgttgcgatgcgctcgcaggtggctgcgatcgtggcgagcacgcctgcaagataggcgtggtggtcgcggctgatgacctgcgtggagagcgggtcggcgttgaggcccaggtgctcgcagacatactgttcgaccctcgggtcgatggagctgtaggtgcccacagcgccggagatggcaccgaaggagacattcttctttgcgtccttcaggcgctcatagtcgcggtagagctcccaggcccagctgccgaacttcatgccgaaggtcatgggctcggcgtggatgccgtgggtacggccgacgcagagcgtctccttctcctcgaaggcacgcctcttgcagatctcgccgagcttcttgcagtcatcaagcaggatgtcggttgcctgcacgagctgatagcagagcgccgtatcgccgaggtccgagcttgtcatgccgtaatggacccacctcgacggcttcggctccccttccggcacatccttgtcgatgtaggagcccatgttcgtcaggaaggcgatgacatcgtggttcgtgacagcctcgattgcatcgacctcttccttgttgaagtcagcatggtcgcggatccacttggcctcttccttcgttatgccggactctccgatctcggcatgcgcctcgcaggccaggacttcgatctcctgccagatggcatacttgttctcgagggagaagatatgtcccatcttggggcgggtatagcggtcaatcatgggaatcctttctgtgaaccagagcaggcaagccctgcattctcgctttcctcatgatagcgcctgcgcatcccctctcagaaggaagacgcaggcgctacaagaacgactcatggaatatggctacttggcctcttgcggcagcttctccttgtcggcagcaaggcgtgccgctgcctcctcgagctgtgcggccacggccttcttgccggtgccgccgtaggtgttccttgcgtaggcaatggctgcagggtcgaggtcgcgtgcgatatcgtcctcgaaaagcgggcttgctgccttgaattctgcagccgcgaggtcttccaggcccttgccatgctgctcgcaatagagcacgagctcgcccacgatgcggtgtgcctcgcggaagggcacgcccttctttgcgaggtagtccgccacatcggtagcggcagtgaagcccttgcctgcctcgtcgagcatcctgtccttgttcacctgcatggtctcgagcatgccggaagcgatctgcatgcagtcagagagcgtctttgcggcatcgagcggaccttccttgcactcctggaggtccttgttgtaggcaagcgggagtcccttcatcgtcgtgagaagggccatgaggtcgccgcagacgcggccgcactttccacgggtaagctcggcgaagtcgggattcttcttctgcggcatgatcgaggagcccgtggagtaggaatcggagagcgtgatgaagccgaactcagtcgagctccagagcacgatctcttcgcagagacgggagagatgcatcatcgagacggagcaggcgtactcgagatcgagcagatagtccctgtcagagactgcatcgagcgagttcggaatcgtcgtggcaaagcccaggagctccgaggtataggcgcggtcgaggggatacgtcgtgcccgcaagggcggcagcaccgagcggattggcgtctgctccgtcataggcagcctcaaggcgcacatagtcgcggccaaacatccagaagtaggccagaagatggtgagagagctggacgggctgtgcatgctggagatgcgtgtatcccggaagcacgatgccctcatacttctttgcaagatccagaagcacgcctctgagctcgaggtttccctgcatgagatcgcgggagaggtccttcgcaagaaggcggatatcgacagccacctggtcgttcctcgagcgcccggtatggagacgcgcccccggggctcccaccatcttcgtgagcttcgactcgaccgccatgtggatgtcttcgtcgttcacatcccactcgaaggtgccgtccttgatttcgcctgcaatcttctcgaggccggcatcgattgccttctggtcctcatccgagatgatgccctggcgggcaagcatcttcgcatgggcacgcgatgccctgatatcctgctgcgccatcgccttgtccacctcgagcgatgcaccgaattcctgcgtgaaggcatcgacgcccttctcgaacctgccaccccagagagccatggatgagctcctccctcttcttctgtcgacacttcaagtatgccacggagctgccttgcagcggaccttctgcaccacttatgagaaggctggcaacatgccggaagcacaaatggctgtgcgcatctcgtgcaatcgagcccgcagctcgccgagacgaaaatgccgctgccgggcatgccctggcagcggcaccgagtcgcgctatgaggcgagcgccagaaagctactcgccgtcctggaggccagagcccgggccctggacacgggaccaggtcttcgactgcaggccgtggatgatgatgaagcccttggatgcggtgtgatcgaaggtatcaccctcgtcgtaggtagccaggttgtagtcatagaggctgtacggcgaacgcaggccgtcgacgaagaggccgcccttgcagagcttgatgcggacctcgcccgtcacatactgctgcgtgtaggcgttgtaggcatcgattgccttgcggttctgggagtaccagaggccacgatagaccgtggaggcccactcgacatcgagctttgccttctgcttcagcgtctcggcgtcgaggcagagggtctcgagggactggtgtgcctggatgaggagaagcgctgccgggcactcatagcactcacggctcttgatgccgacaacacggtcctcgatcatatcgatgcggccaaagccgttgcggccggcaatctcgtttgccttgatgatgcagtcgagaagagacatcttctcgccgttgatcgagacgggcacgcccttctcgaagccgatgacgacggtctcaggatctgcagggcagtcctccgggttctttgtcatcgtccagatgtccgcaggcggctggttccaggtgtcctcgaggacaccgcactcgatagcgcggccccagaggttgtcgtcgatggagtacggcttcttgtgggtcgtaggcacgggcacgccgtgggcagctgcccactccatctcggagtcgcgggtcgtgaggtcccactcacggacaggagcgatgatctcgagcgtcgggtcgagggcacggatgctcgtctcgaaacggacctggtcattgcccttgccggtgcagccgtgggcgatgtactttgcgccgtacttgtgggcaatctcgacgagatgcttggagatgatggggcgggagagtgcggaaagcagcggatagatgccctcgtacttgccgtttgcccagatggccttcgacaggatcgtctctgcgtactcctcgcgcatatcgatggcctcagaggcgatggcgcccatatcgagtgccttctgcttgatccaggaaaggtccttctcgtcctggccgacgttgccgcagattgcgatgacgtccatgttcttctctatctgcagccacttgacgatgacggaagtatcgagtccgcccgagtatgcaagtacgaccttctctttttctgccatgatttccagctcctcaattcaattgaatggcaaacagaacggttctggcacataagccagggcgcttgtatatctcatcaggcattttcgcgccaaaaatgcccggcgatgccgggcgaagtcaggtttaagctttggaaaatcgcttaagcgggactgccaccacgtgtcatcgcagcgtgattcgtcgtccctgacgtcggcaggccacctcgttcgcatcgaacatgttcctatgtgcgaacgtacgcttcattgcgtggcctcctcataagcgagtggcgcaggcaccgtgcctgcggctgcagcttgcacaccctctgtgtgctgttgagctgaactataggacaatgcaccccgcggaagtcccgcgaggtgcatttgccatcagattgaaacacaatgattacgaaaggcccgccgcagagagggcagatgccagaagcgaagcggcgtcggatgccgcagataccgcgctgttgagcgtctgcagattcgagtcgaccgcagaaagactgctctcgagcttcgtctgcaggtcgcgcaaggcatcgatatgtgaggaaggagcagaggcaatctcgcttctcccctcctcgaggatcgtctgcgcgctctcaaggcttgcagcaaggtcggacgctgcctggatgcggtcctcagctgttgcatcggtggctgtcgccttgtcgtattctgccaggaccggctggagggcctgcgtattgaccttctccatcgcgctcaccatggtcttggccgaggtgacgtcggtcccgatatagggaaccttctcgacaagcgaccagatccattcgtcggactcggacgagagctcgtccatatcggaggcaaggctcgaaagggcgcttcttgcacccgtgaggtctcctgcagaggcagccgtctcgagctgcgtcgccgaagcctcggcagatcccactgtcttcgagatccttatcatgctctctgccgcaaagcctgcaaggaccagcacggcaacaaggagcagaaggaagatgttgcggattggatggtgcttctttcggcggctgtcggggacgttcacctggcgcggctcatagggagagatcggcttgtagccgacggcgtggttcaggggctctgccacaggggcatgcggtgcggtcgtgccgggagccgtgccttgaggagctgcgcttctggcagccttccccgccggtgccacctgggtcttgtctgcgtcgtcttctgctgcatcctctttggctgcagtcttcttcatgtgcttcgatacgtgctgcgtttctgccacggtggtcctcctcggataccaaaaaaggcaggcggaggcatagcctctacctgcctgcatttcaagtggtgcaccgtgagggtctcgaaccctcgaccttgggattaaaagtcccctgctctaccagctgagctaacggtgcaggcttctgtggcatctgcgagctccattgtaccggcatgaggcttgccgccggcacccaattcggcaattgggctgcttccagatgcgtcgtcctatcctatcaccaaagaggctgctactcccaggcccattgaccattcacaaagatgggaatctcttcgcccgatgccgtaatgccggtgatatccatgtcctccgtgccgatcatgaaatcgacgtgggtatggctctggttcacgccggcatcgaggagctcctgctcggacatcgagaagccgccttcgtagcactccgggaagccgatgccgagcgccagatggcaggaggcattctcgtcgtagagcgtgtcatagaagaggatgcccgactccctgatcggcgtgttcttgctgatgagggcgcactctccgagccggcaggcattctcgtctatctcgaggatatgcttcagcacatccttgccctgcgctgcgtcatactccacgaccttgccgccttcgaagcggaaccagaagtcgcggacgaccgatccagcatgtaccagcggcagcgccgaatgcacgatgccgtcaaccctcatgcggtcaggcgaggtgaagacctcttcggtcgggatgttcgggaaatagggcaggcccttgaccgtacgggctgcaccgccctcccagatatggcggggagtcatgccgaccgtgaggtcggtgccattctgcgagcggtagtgcaggcggtcgaagtgatgctcgttcaggaagcgcttgttcttctcgaaggcagcattgtgcgtctcccaggcttcgcgcgggtcttcgcccgaagcgcggctcacctgaaggattgcctcccagagacgataggttgcctcgttctcgctgaggtcggggaagaccttgtgcgcccaggatgcgatcggggcaccagcgatgcaccaggtgttcctgccgaagtccatcccgtcatggaatgccttgagctcgatatgggcggcacgcgatgcggcggcaggctttgccggatcgatgcccttgaaggcttcgggatcctggccttcgatgaagaggaaggcagcacctgcctcggcaagggtgttcagctgctccttcttccaggacgggacatgctcgaaccagtcgagtccgacatgctcgtattcgagacgcttcgtctcatcgtctgcccagaggactgtcacatgggaagcgccgcactcataggctgtagccacaagctgccggcagaagtcggcacgctcgatcgggcactcgaccacgagctcctggcctttctggaggttcacgccctgctggacaagcagcttggcatagcgggcaatctggggctggaggcggcgcatgccagcgacgcactcctcatccgtcataggtagcggcatagaagcaccttttctgttgaagcttttatattatgtctccaggtcctagatggagaagagcctggagtctctctcaccgtcttctttacccatgcagaacgtcaccgcgacacacaaatcgcgggccagaagattcgcatcatccatatcggacttcgggaagacgatgaccttgcgccagaaggtcctgttcctcgccatgagcgcggagctcttccagaactggtcgtagctcgagcgcaagacgccgcgcttctggtaccagtccgcgacatcgcgggcatcatactccttcaggaaggccttgacctcggagttgctggcaagcgggtagtcaggaatgacgaagccttcgtggcgggcaacctcccagacgagcatctcagccgattcgaagtagtcgaggtcgtcgcggcaaatctcctgcgcaagcttgaggagcgcttcgggcttcacctgctgcggcagatcgagcttgccggagtcgtcgatccatgactcgacagcctcgacgaagtccttgccgagattcaccaacatcctcgccacgagatgcctccgttttacgaaaaaggccctcgaaagggcccgtcagtagctctggagcgggcaacgggattcgaacccgcggatgacggcttgggaagccgttgccttaccacttggcgatgcccgcatgtgctggatgaatgatagcacagccatctcgggccggccactccgaaaagcggacgcaaagcagccagaaagctcctcggaggagattggatggagggcgcacccgggcaggagaaagacatcctttcttgtcagacgtcctgcctgcgagctcatctgctcccgtcagagacctgcgacatccctgccttctcaggcatgcattcttgcaagacgtgcccgctacgctttccgctccccggaacagccgagcggaaggagatagctgtgcacaggaacagacaaaggccccatccggaagtgccagaaacgcagaacagagagacgggatggctccgcaggtccaggacacgtgcaagagggaccggacatgcgggaaggcggcagcttgtacgcactgccatgttcgcggcctgccttgctgtggcagccctcgtgatcgggctcatgaatccgaaggcagccaaggcctattccggaagcgtcacctggaactatgacccgacgaacctgatcaccgatttctatggctcggacggcagccgcggctactgtgcgcaggccgagaaggcagggcctcaaggcacctatacggaatggcattgggtaagcgagatggactcggggacgctccgaggagatccgcatggcctctcctggctcattgcccactgctaccctctgaacagcaccttcagcggccagacgctcgatgcgaagggcgcagccacggtctcgcaggcagcgatctggatgtatcagggcgacctcacgaaggaccgctatgaggaaagacgtggccttactgtcaacagctgcacgcaggagcaggcagacctcgcctggacgcttgcgcaggaagcacatacacatgacggggaagcaggcagctgggaccatgtcgcgaagttctgggtctcgcccaatggcggaaggcagaacatcatcgcaatcccgccctatggatcgcttgctgtcacgaagcagagtgcagagacgctcgtctcggtctccggcaccggctattcgctcgaaggagcggaattcggcctctatctcgaccaggcctgcacgcaggaggtcgagagcttcacgaccgacgccgaaggcaatggcaagaccggccttgtcgccgaaggcacgtactacctgaaggagaagaaggcaccgaagggcttcctcgtgagccaggatgtcctcgagatcgcaatggcaggaggccaggagatccataccgaggttcctgagcagccccgctacagcgtgcccgacatcctgataaagaagcaggatgcagagacgggaggcgaggctgaaggcgacgccatcttcgaaggcgccgagttcacggcaacgttctatccggaagggaccgatacctctggcacaccggagcggacctggaccatccgctgcgatgcggacggcacagcaaggctcgatgatgcccacaaggtttcaggcgatgactggtacagaaagcaggatggcaccatcgtccttcctctcggcacgctcgtcgtcgaggagacgaaggcaccttcaggctaccgtcttcccggaaacagccgccaggagttcaggattgcggcagacgattctgctccgacaggtgccaccatactccagccagctaccgtcgaggaagaggtcatgcgtggcggcattgctgtccagaaggtcgatgccgaatcgaagagcgcctctcccaagggcaaggcggtgctttctggcgctgtcttcgagatcgtgaatgcaagcaggcatgcggtcgtcgtcggaggcacgagctatgcccctggcgaggcggtcgccacgatcgagaccgacagcacgggacgcgctgccacggcagcggatgccctccccttcggcacctataccgtgcatgagacaaaggcgcctgagggctatcttctcaacagcgactgggagaagaccgtctccatcaccgaggacggcaagatcttggagcttcaaggagacgatgcctgcgcagaccaggtcaagcgaggcgacctctcgttcgtgaaggaggatggcacgacctcggcgaggatggccgatatccccttcaagatcacatccaagacgacaggagaatggcatatcgccgtgaccgatgccaatggcatcctcgataccgcggctgcccagtacccgcatacccagagcacgaatgccaacgatgcagccgtgaaggatgacggaacattcgacgacacgaagatcgtacgcgatgccggcatctggttcgctggcacgaaggatggatcctccgatcctgatgacagcaagggggcactcccctacgacgtctatgcgcacgctctgcccttcgtcctctatgtcagcgtgcacagcaatctctttgccttcttccttgaggctttcgagggcgacaatgcgcttcacgctcgagggaagacctgtgacggtgaaggttgacctccatcgtgccgctctcggaggctggcgtgaagctcgtcgtgacgggctctgcagagggcacgcctctccggtgtcgtggtccatgaggtgtgccggtgagctcataggtcttgccgggctcgaggttcgcataggcgaccgtatcgacgagcgtgggtctcgtcctttgccggcacgatgtgctcgccctctcatctgtgagtgtcgtctcgatatgcggaccctcttcgttcgtgacggtaccaagatgcacgccgaaggcatcgcgcgtgatcgttgcctcgaacttacgagcttcttgcctgcgttggcaggagaggagagctcttcgatcgta

SEQ ID NO: 122 - DNA, 66214 bp, Unknown
  Metagenome-assembled genome
gcgccgctggcggccatccgcctcgcggcatccgctcgcgaggagctgccccgcgagcgtgcgggcctttccgccacggcgacggaccaggtcgccggcgcggccgagctgggccagctgggtgcggaagacatctggcagaacgagctgctcgcgcacgcccagggggtgcgcagggcggccgcgcgcgtgcggcgcaacaacgccgtgggctccgcgctcgtgctgctggtgtgtgtggacgcgctcgtgcttgcacatgcctgcctggcgggtgccgtgtccggaggcctcgccacggccacggcgacctggctcctggcgctctttggctgctcgcttctgcccgtggtcgcgctcgcgcgggcgagcatggagtccagccggacctccgcgtccgcgcgcgtggtgctcgacctcatggcgcgcgagcgcgaggtggacgtgcccgacgccgcgaacgcggacgcggacggcgagcctcccgccccggaggacgcgagcctcgcgctcaggaacgtgtcgctttccgttggggaccgcaacatcctggcgggcgtgacgctggaggttccggcgcgccacctcgcaaccgtgtggggtggggacgacgcggagcttgccgcggtgtgcgcgctcgccatgcgcttctgccagccggatgcgggccgcgtggcgctgggcggcgtgcggatggacacgctcgacccggccctcacttcccgctggctggcgtacgtgggtccggactgcgtcctcgcaagcggcaccatccgccagaaccttgagcttggctgccgcggtacggctgcctgcgaccagcctgcagccgagctaacctccccggaggaggccctgcgcctggcgcgtgcgacggacctggtcgagtccctgggcggcttggacacccgcacggaccagttgccgcgccggctcacggcgggggagcggcagcgcctgggcctcgcgcgggcgctcgcgacgggcgcgcgggtcatcgtgctgctcgagcccacggagggcctgggtgccctcgagcgcggggagttcctgcaggcggtggacggcctgcgcggaaggcgcaccgtcctccttgccacccgccggcacgacgaggccctgctgggcgacgtgttgtgcaggctcgatggcagtggggtagactagccccgtatgcccatgtgggtgggtggtaggttgcgcgccggtggcgcgcgttcgcggatggaggccgttgtgagcagagagggttgcgtcggcgtgttcgattccggcgtcggcgggatcagcgtccttaagagcctggtcgcggagcttccgcacgaggacttcgtgttctttggcgactccgcaaacgccccctacggcgagaagaccgaggacgaggtgctcgagctctcgcgcgcaaacgttgagcggctgctggccgatggcgccaaggccatcgtgatcgcgtgcaacaccgcgacgagcgtggccgcggcgaccctgcgccgcgagtacccggacctccccatcgtgggcgtggagcccgcgctcaagcccgcgacgctcgcccccaagcacgacaacatcctcgtcatggcgacgcccatcacgctcaagctcgacaagttccacaagctggccgaggagtggggctcggactccaccatcatcccggtgccgtgcgtcggcctcgcggcccgcatcgagcatggcaacctggacgcccccgacctgcacgacctgcttgagcgcctggtggggcagtaccgcggcaaggtcgactccgtggtgctgggctgcacgcactatccctttgtggcgcgccagattcgcgacgtcctgggcgacgtgccgttcttcgacggcgcgcacggcacggctaagcgcctgcgcagcctgctcgaggccggcgacctcctcaagccggaggacgaggatggctccgtcacgttcacgacgagcctccacgagccgggcgagctcgacctgtacgactggttcttccaccagcccacggactagccgtcggggcgcgcatcggctggccgcgcagtccttctcgcccgcgtggctttccaatttggtctggtttatgccgagttcgaagtatcttcacaaactcctgatatgccacctcatctgtgagcggtagaattatctccgtaagcgttgggttacctgaaggggcaggacccagcaatcccaggctaaaggagatgcaatgccgtacaaccttttggcggagtttggctcgaccgcactcatgatcgtgtttggcgtcggcgtccactgcgacaccgtgctcaagggcaccaagtaccacggctccggccacatgttcgccatcaccacctggtcgtttggcatctccgtggcgctgttcatctttggcggcgccgtctgcatgaaccccgccatggtcctggcgcagtgcatcgtgggcctcgtgccctgggcaaacttcgtgccctacgtgatcgcggacatgctcggcggctttgcgggcgccgtgatcgcgtggttcatgtacgccgacgacttcaaggcgtccgaggacgaccccgagatcaccgccgtcgccaagcgcaacatcttcagcaccaaccccgtggtccagaacctcccgcgcgacttcttctgcgaggcgctctgcaccttcgtcttcatctccgcgatcctggccgccgcctcccgcgccggcaagaacgtcctcctgctcgccatcgccgtcggcatcatcgtgtgggccgtcggcatgggcatgggcggcatcaccggcttcgccatgaaccaggcccgcgaccttggtccccgcctcgcctaccagctgctccccatcaagggcaagtgcgacaacaactggaagtacggcctgctcgtccccggcatcgcccccttcgtgggcgccacgctggcagcgttcttcgtgcacggcttcctcggcatgttctaagcttcgcatcacataagggtgagaagaacgaggcgcctccgttggggggcgcctctcttttgcgtgtatgttgctggttggcgggcagtccttctcgcccgcgactggtctagtccaggccctccgcgccgttggagcggatgatcttctggtacgcgaagaagctgtccttgcgcaggcgctcgtaggtgcccgagccgtcgtcgtgcttgtccacgtagatgaagccgtagcgcttgcgcatctcgcccgtgccggcgctcacgaggtcgatgggtccccaccaggtgtagccgcgcaggtcgacgccgtcgtccacggcctcgcgcatcgcgcgcacgtgcgccttgaggtagtccgtgcggtaggagtcgtgcacgtggccgtcgggcgtgacctcgtccagggcgcccatgccgttctcgaccacaaacagcgggatctggtagcggtcgtagatctggttgagcgagaagcgcaggccgtccgggtcgatctgccatccccagtccgtgctcttgaggtaggggttcttgccgccggtgaccatgttgccgtccgtcttggcaaggctgccgtgcgtgcccaccacgttgctcatgtagtagctgaaggtgtagaagtcgatcgtgccggccgcgatgtcgtccaggtcgccgggctccatgtggagctcgatcccgtgctcgcgccagtagcggcgggcgtaggcggggtaggcgccgcggacctgcacgtcggagcagtaccagttgcgctggcgcatctcggcctggttggccagctggtcggccgggtcgcaggtctcggggtaggtgagcacgaagcagtccatgttgcccagacggaactccgggtagtgctcgtgggcgtagcggaccacgcgcgcggacgccacaaactggtggtggagcgcctggtagcgctgctgcggcgtcgtgtgggactcggacgcgggaccctcgaagccgcggatcatgctcgtctcgaagaggttgccggcgtcgctcgcgcccaggttgatctcgttgaacgtgagccagtagcgcaccttgcccgcgtagcgctcaaacaccgtgcggcagtagcgctcgaacagcccgatgagctccctcgactcccagccgttgtacttctccaccaggtgatagggcatctcgtagtgcgagagcgtcaccatgggctcgatcccgtgcgccctgcagcagtcaaacacgcggtcgtagaacgcgaggccagcctcgttgggctgctcgtcgtcaccgttggggaagatgcggctccagctgatggacatgcggtacatgttgaagcccatctcggcaaagagctcgatgtcgcgctcgtagcggtgatagaagtcgatgccgtcgtggttggggtagaggaggtccgggcggatgtccaccgtgatcgtgcgcggcgtgtccttggtgcctcccgtgaagtggtcgtccacggagggtccgcggccgtcctcgtcccaggcgccctcgagctggttggccgccgtggcgcctccccaatagaagccctgggggaatccctgctggtctgccatgtccttctcccttcgcggcccatcgggccgtcccaagatgcgatgcggaatgcggttggtacgcaaagggcccgccgccttccggcgacgggccccgatgctcgcgttagcgatcgagcgacctgactacttggtcagggcctcctcgacggcgacggcgcaggcgacggtcgcaccgaccatggggttgttgcccatgccgatgaggcccatcatgtcgacgtgcgcaggcacggaggaggagccggcgaactgggcgtcggagtgcatacggcccatggtgtcggtcatgccgtaggaggcggggccggcagccatgttgtccgggtgcagcgtacggccggtgccgccaccagaggcgacggagaagtacttcttgccggcggccaggcgctccttcttgtaggtgccagccacggggtgctggaagcgcgtcgggttggtggagttgccggtgatcgagatgtcgacgttctcgtgccacatgatggcaacgccctcgcggacgtcgtcggcgccgtagcacttgacggccgcacgagcgccggtggagtagggaacctcacggacgatctcgagctcgctcgtgtagtagtcgaacttggtctggacgtaggtgaagccgttgatgcggctgatgatctgggcggcgtccttgccaaggccgttcaggatgacgcggagcggcttcttgcgggccttgttggcgttgttggcgatgccgattgcgccctcggcagccgcgaaggactcgtggccggccaggaagcagaagcactcggtgtcctcgcccagcagcatggcgcccaggttgccgtggcccaggccgaccttgcgctcctcggcgacggagccgggcacgcagaacgcctgcaggccgatgccgatggcggcggcagcctcggaggcggtcttcacgcccttcttgactgcgatggcgcagcccaggacgtatgcccacttggcgttctcgaatgcgatggactgaatgccctcggtgatcttgtaggggtcgaagccgaggtcggtgcagatcttgcgagcttcctcaaggtcagcaatgccgtactcagcgcaggtcttgttgatcttgtcgatgcggcgctcgtagccttcgaacgtgattgccatgtgtattcagctcccttcctactctttgcgcggatcgatgaccttggcggggttgtcccactggccgaagcggcccatggcgccctcgacggcctccttgggatcggtgccggccttgatggcgtccgtgaacttgccaaggttgaggaactcgaagccgatgatctcgtcgtcggcgttgagcgccatcttggtgatgtagccctgggtcagctcgaggtagcgagcgcccttggccttggtgccgtacgtggtgccgaccatggagcgaaggcccttgccaaggtcgtcgaggccggtgccgacgggcaggccgccctcggagaacgcggtctgggtgcggccgtagacgatctgcaggaagagctcgcgcatggcgacgttgatggcgtcgcacacgaggtcggtgttgagggcctcgaggatggtcttgccgggaaggatctcggcggccatggctgcggagtgggtcatgccggagcagccgatcgtctcgatcaggcactcctcgatgacaccctccttgacgttcaggctgagcttgcaggcaccctgctgaggtgcgcaccagcctacaccgtgcgtgtaaccagagatgtcagagatctgtttggcctggacccacttgccctcctcgggaatgggcgcaggaccgtggtatgcgcccttggcgacagtgcacatacgctccacttctgcggaatactgcatggttctcctctccaccacatcaagcgcgtcgggccttgtcccgcgcgccactgtccggtgtgcgattggcccatgcggccaatcaagcccattttatgccacgcggcggatgagcgaccacaataccttcaacttcgtccgaaaatatcgccgagcaagcggttgtttcggatacgtggtcattttgtggcgagaaggacgcgccccctcggccggtggcgccctcgggtcccgtataatcggctggatgaggcttccgaggaacataccgtcctgggcgtacgccgtggccgtcgtgctcacgaccgtggcgtacggttcgtcctacgtggtgatgaaggacgtcctgcgccgcatgcccacgtcgtggttcctggcgctccgctttgcgctcgcggccgtggtgcttgcacttctcttccgcaagaggatcgcgcgctgcctggacgcctcgcacgtggtggcgggcgcctgtgtgggcgtgccagagtcgccggggttcctcctgcagaacctgggcctcacgggcaccacgcccggccgcaacgccttcctcacggccacgtactgcgtgatggtgccgtttctggcctgggccgtggagcgcaggcgccccggcgccaacaacgtcgtggcggccctgttgtgcctcgcgggcgtggggctgctctcgctcgggggcacgctgggcccgagccttgggacgggcgacctcctgaccctgctctccgcgctggcgttcgcgaccaacatggtggccgtgggtaggctcggccgcgcgcacgacgccgtgacgctcaccttcgtgatgttcatagtttctgcgctcgtgtgcctggcgtgggcgctcccgacggagcccctgcccgcgcccgcggcgctcgggccggcgttttggctcgaggccctgtacgtcacgctcctctgcaccgtgttcgggctcctggtgcagaacgtcgtccaggcgcacctgccctcgtccgaggtggcgctcctgctctcgttcgagagcgtcttcgccacgctgttctcggtcctgttctacggcgaggcgctcacggccacgctgctggcgggcttcgcgctcatctttggctccgttctcgtgagccagttcgcgggcggccggcgccagaggttcgagctcgaggaggaggttcgcgatggaaggctctagcacggcgcgcgccggcgcggcggagggcaagcggggcacgcccgtctgggtgttcgagctggggctcctgctcacagccatcatctggggcgggtccttcgtggtgctcaaggacacgctcgacgcgatgacgcccatctggatcatcgcgttgcgctttggcctggccaccgtcgccatggtcatcgtgttccaccggcggctggcgtgctacctcgacctctcgcacgtggtcgcgggtgtggccatcggcctgcccgaggggcttggcttcctcatccagaacgttggcctcgccggcaccacgcccggccgcaacgccttcctcacggccacgtactgcgtgatggtgccgtttctggcctgggccgtggagcgcaggcgccccggcgccaacaacgtcgtggcggccctgttgtgcctcgcgggcgtgggctttttggcgctttcgggcgagaagggcttcggcctcggcgtgggcgaccttctcaccctgctatccgcgttcttcttcgcgctcaacatcgtggccgtggggcgctttgggtccgcgcacgataccatggtcatcacgacggtcatgttcgccgtgagctttgtggtgtgcctgggcgcggcgctcgcgctcgagcccgtgcccgacttcgcggcgctgccgggaagcttctggtggtccatggcctacgtggtgggctgctccaccatgctggggctcatcctgcagaacgtgggccagcggcacgtgccgcccgcgcaggccgcgctgctgatgtcgctcgagagcgtgtttgccgtgctcttctccatcgtgttctacggggagcggctcacgccggcgctgctcgcgggcttcgtgctcatcttcctggcggtcaccgtgagccagtttggcccggcgatgtgggagcgcctgcggattgggcgaaaatgaccgtgcccgcgcggcccggacacgctacgctagagagatgcggaacggcagcctatttcttgcacagttggccccaatgtccccatattgggtaccaatgtctgaaaacggcttgaaacgaactcgcgggaccctagcgcggggagtggccgtcgcgcacgcggcagcacggggaggttcgctggttgatatccgagaaggcactttccaaggcatgcaggcccgccatcctggggcgcgcgaggatcatcgcgcggcgccaggacggcatctggaagcgtagctgcagctacgaggacacgcttaccaggatagaggcgtgcgtggagagtagctccggctaccaggaccactacgacgcgagcatcaccgtggacgaggcggcggaccgcgtggtggcctacgactgcaactgccccgcggcgcgcacctacaagggcccctgcaagcacagcatcgccctcgcgctcgacttcaaccgcaacgcggccgagtacgcgggctacagcgagctcgagcacgccaacaccacgaccgtgctgggcgagtacctggacaaggcgtccgcgccggccatgccgcacgtgggcgcgctcacggaccagctgcccggcagcgtgcggctcgagaccacgctcagccgcgggcgcgacacgtacgtgcacttcagggtggtgggctcctccggctcctacatcgtgcgcgacatcggcacgctcgagcaggacctgctgcagggcgcctaccacgcctacggcaagaagctcgccttcgtgcacgagccgcagatgttcgacgagctgtcgcgccaggtgggggagttcgtggcgcgcgccgtgcagaaccgcaagtccttctccgcgcaccgcgtggccgcccgcgtgtacggcatgtcctccgcccagccggagctcggccgcgacctcaggctcacgccgcccgagctggacgagctcgtgggcatattcatgggccacgagctggaggtcgagttcctctcgcccgagacggggcgcgtcagcgtgccggcccgcagggtggccgtggcggagggcgacccggacgtgtccatgcggctggtgggcgcgggcgacaacgccttcgagctcgagcgcggcgaggacgtggacttcttcggcacgccagagcacctctacgccgtcacgggggacaagctcctacgctgctctgatcggctctttggcatcgcgccgttcctcaccacggtctactccagccccgaccagcgcatcatcctgggtcagcgcgacgtgccgcgatttgcggccacggtgctcccaaaggtgggcaaggccatgcgcgtggacgttccctcgcaggtgagcgcccagctgcccgacccgctgcgcgtcgagttcgagctcgaccacacccgtgccggcgtcacgtgccgcgcgagcgcggtctacggcgagaagagctaccccctgctcgcgcgcgaggtcggtcccgtgcgcgacctcggtcgcgacctcgcgggcgaggccgcggcgcgccaggtcgtggggtcgtacttctcgctcgggacgggggcctcgtccggcatcgccaccatcccggagcgcgacggctcggccatcgcgcgcctcgtgttcgagggcgtggacagcctgcgcagggtggggaccgtgcgcaccaccaaggcgttcgacggcctggtgcggcgcgaggccccgcgcgtgcaggtggcgctcaccgtgcgcgccaacctcatcaacctcaaggtgagcgcggacgacctgccgctttccgagctgtactccctgctcgagggctaccgccgccacgagcgcttccaccggctgcgcgacggctcgtttgtggacctctccggcgcggacctctccgaggccgcgcgcctggcggacgagctcaacctcacggcgcgggagctttccagcggcaacgtgcagattcccagctacaaggcgttcctgctcgaccacatcatgacggatgacgagaaggacgagtccttccgctcctacgtcgacaacttccgctccgtcgaccccacccgctacgagccgcccgcgaccatcgcgccgcggctgcgcccgtaccaggtggccggcttccagtggctgtgcgccctggctgacatgggctttggcggcatcctcgcggacgagatgggcctgggcaagtccgtccagatgatatcgttcctgctcgcgcaccgcggcaggggcaccacgctcgtggtgtgcccggcgtcgctcgtgtacaactgggcggcggagttcgagaagttcgcgccccagatggacgtggccgtggtggtggggacggcgccggagcgcgcccgcatccgccgcgagcgcggccacgaggtgctcatcacgagctacgacctggtgcggcgcgacatcgagtcctacgccaacatggacttctggtgcgaggttctggacgaggcgcagtacataaagaaccacgagacgctggccgcccgcgcggtcaaggccgtgccggcccgccaccgcttcgcgctcacgggcacgccgatcgagaaccgcctgtccgagctctggagcattttcgactacctcatgcccggcctgctaggcggctacgagcgcttccgcgagcgctacgaggagcccatcctcgcgggcgacacggagtgcgcggagcgcctgcgcgacgccatcggccccttcgtgctcaggcgtctcaagcgcgacgtcctgcacgacctgcccgaaaagctcgagcaggtggtctacgcgcacctggagggcgagcagcgccgcctgtaccaggcgcacgagcaggcgctgcgcctctccatcacctccaagagcgactcggagctccgccgcggcaagatccaggtgctggccgagctcatgcgcctgcgccagatctgctgcgacccgcggctcgtctacgcggactacacgggcccctcggccaagctcgacacgatctgctcgctcgtggaccgcgtggtggacgcacaggagaagatgctcgtgttctcgcagttcacgagctacctcgacctcatcgcggaccggctcgacgccgagggcgtggagtactacacgctcacggggtcgacccccaagcagcgccgcgtcgagctcgtggacgagttcaacaagaacgacgtccccgtgtttctcatctccctcaaggcgggtggtacgggcctcaacctcatcggcgcctccgtcgtcgtgcacgccgacccctggtggaacgcggcggcgcaggaccaggccacggaccgcgcgcaccgcatcggtcagaccaaggacgtgacggtctacaaggtcatcgcgcgcgacacggtggaggaccgcatcatggcgctgcaggaggccaagagcgagctggccgaccaggtcgtgggcgagggtggcggcatgtcgctcgggtcgctgcgcaaggacgacctcgtggagctcctgggggtgtagggcgcccccgccgcgcttggtgtaccattctccccgcatgtcgtttccgcaggccatgggccctgcgcaatggggggagaagaacgtggtcctttttggtgcgctcatgaacggtctcgaggcgttcgtgggcggtgtgctcgggctgctgttcaagcgccacgtctcggacgagctgggcgacttcctcctcaagggccagggcctctgcgtggtgctcgtggccgtccagggcatggtcgccaagggcggctccatcgccgtggtcaccatgtccgtcgcgctcggctcgctcatcggctacgccctcgacatcgacggctgggtcaagcgcctgggcgactgggcgcaggagcgtctcaaccgcctgttcagcgggagcgagcgcatgggcagcttcagcgagggcttcgtggcgtccaccctgttctgctgcaccggtgccatggccatcctcggctccatatcggccggcatccagctcgacccgtccacgctcatcgccaagggcgtgatcgacctcgtggtgtgcctgccgctcgcggcgaccctgggcatcggcgtgccgttctgcggcatcagcctcgtcgtgtacgagggcgtcctcagcatcctcgcgagcctcgtggggccgctcctgagctcggccgccatcgtgcagatgggcgtcacgggctccgtgctcctgctcgccgtcggcaccaacctcatgggcctcaccaacataaaggtcgccaacatcctgcccgccgcgtttctccccatcgccttcgtgccgctcgcgagcctcgtcacctccatcctgtagcggagggccgcccgccctggcatacaatggtcacgtaccatgcgggacgcacgaaaaggcagagcgagaggggaagtcatatggcagacgagaagagcgaggacccgtgcaagaagttcggcatgtacctggcgcacgtgggcgtgaacgccgagagtgacgaggacgtcgagaagatcgtcggcgacttccaccgcctcatgggcctcgcgaggctcgagtacgcccccgcgtccgtctttgccagcgacttcatcgaggtcatgaagccgggcaagggccgtggcaccaagggccacctgggattccacgtggacgacatcgacgctgcggagaaatggttcgaggaccgcggcttcaagatcaacgagtcctcccgcgtcctgcgcgacggcaagacctacctcgtgtacttccaggaggagatcgcgggcttcgctatccacctcaccgtccagaagtagcgaaccacctggcaccgggctggggcggggaggccgcgtccttctcgcccgtaagatattgatggcgtaacgcagcgaggcgccgcaccagcttcggtgcggcgcctcttgcaagcgggcccacttggggacggatgagcatggcgggagccatgtgggagggcgggccgctcttgccctagggaatcagacctcctggccaaaccacttgatctcgagcttcttcatggtgccgtccttcttcatggccttgagcgccttgttgatggccttggtgaggttggggttcttcttgctcacgacgatgccgtactgctcgccggtcgcgatctcgcccccctcggggatctcgaggtcggagtacgcctgcttgatctcataggaggtcacggggaggtcggccacgcaggcgttgtagagcccggactgcacgccggtcagggcctggatgatgtcgtccagggggacggtcgtggccttgggcaggttctccttggcccacgactcgccggtggtgccagactggacggcgatctgcatgcccttggcgttgagctggtcggaggtggtggcggtggcgcccttcttcacgacgatggactggttggagtccaggtacggcgtgctgaagtcgatctccttcttgcggtcgtccgtgatggtgatggcgccgatggagacgtccgccttgccgccctgcttgatggtcgggacgatggtgtcgaactggacggagggcaggatgcgcgccttgagcttgaggcggctgcagatctccttgtagacgtcgacgtcgaagccctcgaagtcgcccgtcttgtcgtccatcgatacgaagggcgggaagtagaagttcgatatcatcgtgaggctgccctttttgaccagcgtgtagccggagccgctggagcccgagctggagctggagtcggagcccgagccgccgcagcccgcgagcacgctgccgagcccgaggccgacggcgctcagcccgcacatctggaagaagtcgcgacgggtgaagtttgcctggttcatgcttggtttcccctctggagtctggtgtcaggtcgtgccgcttctttaggtacgctgggcgagaaggactacagcgtggtgccgaaccacttcttctggagcgtgtccatggtgccgtccttcttgatggcctcgatcgcgctgttgaggtccttgagcagcttggtgttcttcttgctgacgacgatgccgtactgctcgcccgtggcgatctggatgtcgacctgcaggtccgtgtaggacttggtgcagaggtacgacgcgacggggaggtcgagcacggctgcgttgtacaggccggactggacgccggtcatggcctggatggcgtcgtccagcgggacgcaggtcgccttggagaggttctccttgacccaggactcgccggtggtgccggactggacggcgatctgcttgcccttggcgttgagctggtcctcgctcaccttgccgtcggccttgcggttgacgaggccctggttggagttgaggtagggcttggtgaagttgatctccttcttgcggtcgtccgtgatggtgaaggccgagacgcccacgtccgccttgccgccctgcttgatgagcgggatgatcgtgtcgaacttggtggcgggcagccactccatctcgaggtcgagcttggcagccagggcgtccatcatgtcgatctcgaagccctcgggcttggtggagccgtccgggatggactcgagcggcgggtaggccatgtcggagacgccgatcagctttcccttcttgacgaggatgtactccttcgcgcccttggaggaggatgacgaggacgagccgctcgaactcgagtcagaactggagcctccgcagccggcgagcagggtcgcggcccccattccaacgatgctcagcccgcaggcgttgacgaactgtcgcctggacatgccggtctcgacgaggtccctgatgtggctctgcttcttgttctgcatgattgctccgtccctatttgcttgcacggcagtcatctttgttgccgcgctgttcacgcccgggggttgctccgtgcgttgttggggagtatcgacttttgtgcatcgtaggttgacgcaatctgaagattcgtaacataacggctataaataagatgcaaatttgcaagctaatgcgttggaagtgacttgcgaaacaactgcatgcatacaggcgaaatgtatgagaaacgcttccgtccatttgctgtgcccgttgcgtgagagcggaagaaaggtccgccgttcttctcagattgtgcaatacttcccatgttgtgtagtactgctcgacgtgagcatgagtgggaggcgtgttgatgagcgagaccgctgtgcgcaccaaggcgcagcaggtgggacggcgcgcaccggcgcggccgcaggcgttggaccggaggtcggtccgcacgcgctgcgcgctgagggacgccctggccgccgagatccaggcgacgggggacctctccaaggtgaccgtgaccgccgtgaccgagcgtgccgacgtgacgcgtcgcacgttctacctgcactttcgtgacatccaggacctggtgagccagacggaggaggagaccatcgaggacctgcggggcctggtgggaaacctctcgagggtgaacctggaggagctggagggcgcgctcgacgacatggagccgtgccccggctcgcgcgagctgctggagtacttcaagcagcgcggcagctacctgggcgccctcctgggcaagggcggggaccccgcgtttgcccagcacatcaaggacatggtgcgcgaggtcgtcgccagccgcgcgctcgacgggctggacgcccgcgccatgggatcgttttttgactactacctcacgtttgccgtgagcgccgaggtcggcgtcctggtggagtggctcaccggcggcatgcgcgagagcgtggacgtgatggcccgcctcatgacggccctcatgttcgtgcggcccggagacctgtacggccgcccgatcgacttcaacgtacccaggttcgccatgggccttgggcttcttaaccttaaggagaagaacgatgactaacaccgcagcgtccaacgcccgccaggcggcctccaagccggccgtcgagctcaagcagaacggcgccgagctcagccccaagaacccgatcgacctgtcccacgcgcacctgcgcctgggcatcgacgtgggctccaccacggtgaagctcgccgtcatcgacgagaacgacaacctgatctacgcgaactacgagcgtcaccacaccgacgtgaaggcgaccgccaaggaggtcttccgcaaggcgcagaaggccctgggtgacgtgcccatgcgcgtctccatcaccggctcgggcggcatgctgctcgcacagtggctgaacgtggagttcgtgcaggaggtcatcgcgtcgaagcacgccgtcgaggcgctcatcccgcagacggactgcgccatcgagctcggcggcgaggacgcgaagatcatctacttcgacaacggcatcgagcagcgcatgaacggcacctgcgccggcggcacgggagcattcatcgaccagatggcctccctcatggagaccgacgccggcggcctgaacgagctcgccaagggcgcgaagcacatctatcccatcgcgagccgctgcggtgtgttcgccaagtccgacgtgcagcccctgctgaacgagggcgcggcgcgcgaggacgtggccgcatccatcttccaggcggtcgcgaaccagaccgtgtccggcctcgcgtgcggccaccccatccgtgggtacgtggcgtttctcggcggcccgctgcagtacctgtccgagctgaggaagcgcttctacgtcacgctgaagctcgacgaggagcaccgcatcgtccccaagaacgcgcacctcttcgtggcgacgggcgcggcgctcgcgggcgagaccgacaaggtcgtcacgttccagaaggtcatcagcgacctggacaacctgggcgacacgcagggcaccgaggtcgcgcgcctcgacccgctcttcgctaccgaggacgactaccgcgagttcaaggagcgccacgacaagcaggtcgtccccaagggcaacctggccgactaccacggccgcgtgttcatcggcctcgacgccggctccaccaccatgaaggcggccgtcgtgggcgaggacggcgagctgctgtacacctggtacgacaacaacaacggtgacgtcctgggtaccgcccgcaagatcatggacgacatctacgaccacctgaacgacgactgcacgatcggccacgtcacgacgaccggctacggcgagggcatcctgatcgaggccctgggcgcggactccggcgagatcgagacggtcgcgcacctgcgcggcgccaaggccttcgtgcccgacgtgaacttcatcctggacatcggcggccaggacatgaagtgcctgcaggtgaggggcggcatcatcgagcacatcagcctgaacgaggcgtgctcgagcggctgcggcagcttcgtggcgaacttcgcggactccatgggcatgaccgtgcaggagttcgcggcggcggccgtgaagggcaagcaccccgttgacctgggcagccgctgcaccgtgttcatgaactcgcgtgtgaagcaggcccagaaggagggcgcgaccatcggcgacgtggccgcgggcctttcctactccgtcatcaagaacgcgctcttcaaggtcatcaagctgcgcgactacgacgagatcggcaagtacgtggtcgtgcagggcggcacgttcatgagcgacgcgacgctgcgcgcgttcgagctgctcacgggccgcgaggtgatcaggccggacatcgcgggcacgatgggagcctatggcgccgcacttctcgcccgcgaccgtgccggcgcggcggggacctcgggcctgctctcgcgcgaggagatcgacaacctcaaggtcaagcacaccaacgcgcactgcgggcgctgctccaacaactgcctgctgaccatcaacagctttggcaacggccgccgcttcatcacgggcaaccgctgcgagaagggctcgggcaagcccaagagcgagcagtccaaggcgccgaacctcttcgagttcaagaaccgcctgctgttcgaccgcaagagcctgcccgccgacgaggccccgcgcggcaccgtgggcatcccgcgcgcgctcaacatgtacgagaactacccgttctggcacacgttcttcaccaagctgggcttcagcgtgatcctgagcgacaagaccacccgcaagacgtacgaggcgggcacggagtccatgccgtccgagtccgtgtgctacccggccaagctcagccacggccatatcatgaaccttctggagaaggaccccgacttcatctggatgccgtgcatccgctgggagcgccaggaggacgacaccgcgacgaaccactacaactgcccgatcgtgatgagctacccgcaggcgctgggcctcaacgtggacgagctctctgcccccaatgtggagtacctggacccgttcatcccgtatgacaacaagaacgagctgaagcgccgcctgtacgagatcctgcaggtggagcgcaaggaggacgccgaggcgggcaagggccgcttcaggggcccggacatgacgcgcgccgaggtggacgaggccgtcaacgccgcctgggaggaggacctcgcgttcaaggacgcgatgcaccgcaagggcgacgagaccctcaagtggatcgaggacaacgatgcccacggcatcgtgctggcgggccgtccgtaccacaacgatggcgagatcaaccacggcatccccgagatgctgcacggctttggctttgcggtgctgaccgaggactccgtggcgcacaagatgaagcccgagaggcccatccgcgtggtggaccagtggatgtaccacagccgcctgtaccgcgccgcgcgctttgtggcgacgcgcaacgaccttgacatgatccagctgcagagctttggctgcggcctcgacgcgctcacgaccgacgaggtgcaggagatcctggaggcctcgggcaagatctacaccgtgctcaagatcgacgaggtcagcaacctgggcgccgcgcgcatccgcgtgcgctcgctcatggcggccctcaaggaggagcgtgccgaactggagcgcaagaccgccgcgggccaggtcgtggaggaggcccccgtgggcgtccacatggccgacggccgcctggagcaggcgcgccagaccgacctctcgcgccgcacgccggtgtaccgcaaggccaagagcgccgcgttcaagaaggtgcgctacaccaaggacatgcaggccgagggctacacgatcctcgccccgcagatgagccccatccacttcgagatctgcgagcagctgctgaggtccgaggggtataacctcgttcttctcccctccgtcgaccacaaggctgtcgacacgggcctgaagtacgtgaataacgacatctgctacccgtccatcctggtcacgggccagatcatggaggcggtgctctctggcaagtacgacctgagccgcacggccgtgctcatcagccagactggcggcggctgccgcgccaccaactacatcgcgctcatccgcaaggccctgaaggactccggacacgccgacatccccgtgatctcgctttccgtcgcgggcggcctggacgagaacaaccccggctggaacatcctcaagccgggcctgctcaagcgcgccgtgtacgcgctgctgtacggcgacctcctcatgaagtgcctgtatcgcacgcgtccgtacgaggccgagaagggcgcggcggaccgcgagtacgagttctacatgagccgcgtcaagtccatgatcggaagcatggacaagcgcgacttctataacctgtgcgaggacaccatccgcacctttgacaggctgccgctggtgaacgaccgcagcaagccgcgcgtgggcgtggttggcgagatcctggtcaagttccacccgacggccaacaaccaggtcgtgaaggtgatcgagaacgagggctgcgaggccgacgtgccgggcctggtcgacttcttcctgtttggcgtgtccaaccaggtgaacatgaaccgcgagctgggcaccaagctctcgagccgcgtgacccacaaactgggcatcgacttcctggagggcatgcgcgagcccatcaacaagatgctcgagaagtccgagcgcttcgagccgtacggcagcatcttcgacctggccgccaaggcctccgaggtcctctcgctctgcaacacgatgggcgagggctggctcctcacggcagagatgtgcgacctcatcgagagcggcacgcccaacatcatcgtgtgctcgccgttcgcgtgcctgcccaaccacgtcgtgggcaagtccgtcatcaagcgcctgcgccagatgcaccacgagagcaacatcgtggccgtcgactacgaccccggcgcctccgaggtcaaccagctcaaccgcatcaagctgatgatcagcgtggccaaggagaaccagcgccaggcccaggccgcgggcgacgcggacgcgtcgttcacgctccacaacgacgacgaccccacgaaccgcgtcatccccaacttcgaggagtacggccacctgcgccgcaagggcgagctcgaggaccacatcgtgaacgagggcgcccccgtgagcggcggctacgccgcctacggcaccaaggtggacgacgacggcggcatcaccgtcggcaggggagaaggacgcatccaccttacccgcgagcagctcgacgagatcgaggacgccaagcgccgcgccggcgtgaggtaggcgtcagttacaagagacctggcggctatggctgctgccggttgaaggaggcggcgtcgggcatcgtgtccggcgccgcctcttgtgtgggagaatggttgtcgtcaggagatatgggcggaggtttggatgaactggctcgtcgaggtcttgcgggaccaaagggggaggcacgtcgacggcaacgtctacaaggcgtgccagtgcgactttgcctacaactcgaaccacatggagggctccacgctcacgcacgaccagaccgtccaggtgtttgaccgcggcacctttgccgggaccgcgaaggtggatgacatcgtggaggcgaggaaccacttcaacgccttcgaccacgttgtcgacacgttcgacgagccgcttaccggcgcctacctcaagggcctgcatgggattttgaagcgaggcacctcggacgacgccaacccgatcatggccgtgggcgattacaagcgcgcgagcaacgcgatcgtgggcgccgtaccatccacgagggccgcgagcccaaatgacgtgccgcgactgatgtcggagctcttctcggcctacgagcgatctgcaagggaccttcgcgacatactcgacttccacgtgaggatggagcgcatccacccgttctcggacgggaacggcagggtcgggcgccttgtcatgttcaaggagtgcctgaggtccggcctgacgcccttcatcatcacggacgacctgcgcgagttctacctgcgcggcatacgcgagtggggcaaggtcgatggctacctgtccgacacgtgcgagcatgcgcaggacgtgtttgcggcagagtacctgccgctcgcgcgcgagtggtgggggctcatgcaggaggagcggccggagggccagcccaacggctccgaggccggggcctagggcttctccgcaggagcgccggcgacgccggggcggatgccggggaagaggtagacggccaccaggacccacacggccgcgccgatggtcgcctcaacaaagtaggtccacgggcccggccacggtgccaggaacgcgagcagcatgagggcgcccgccggcggcatccacacgtgcaggcggtcccacacgaggacgagcgccgcaaacgcgaagatcgcgaccagccatgcgggggcgtgcaggtactcgacggcattgcgggcggcacagcccacgagcgctgcgagcgctagcgtgcaccacgtgcggcgcggacggaggcgcagcgtcatgtccgggcgcgtgagctccgtgtaggcgaccagcagcggcggcacggccaggtaggcgttgccggtggcaaaggcagggcaggccagcacgcagaacaccaggagacgacgcccccacgccacaaaggcctcgcgcggcgccaggcggaaggtgcggtagtcgatcttctcgcgcaggccaagccgctcgagcttgacctggcccaggcacaccaggcacacgatggtggtgacggccacggggtaggcccactccctggtgccgagcaccatgggcaggatcgccgcggagagcatgggcgtcatgtccgcgccgacgacgttcatcgcgaccgcgcaaaacaggtatcccaaaggcgcgcgcagccacagcggccacgggagcagcaggttgacggcgagcccgaagacggagcccgcgcacatgaggccgatcatgcggcggcggtcgacgttccaggcctgggagggctggatccaggcgccgcagaggattgcggccgtctcggggaagaggacctcggggcagcgcaggatgccggaaagggcgaccatcgccacgacgaagacgcctgcgagcaggatgggcagccagcgacggcgtagggacatggaaaacctctctgtagggtggatttgccgtgcgccgtcgcaatggggcaggtcgcgacacacgcaccaatccagcctatcactttgttcaggtggcctcaaaggcgtcgagggagggtggggtatcatgctgttggacattggacggaaactctgacatcaaaagacatagcaagggagaagaacgtgacataccaacctacgccctccgacgtgctcgagcgcttcatgcgctacgtgcagatcgactcgcagtccgaccccaacaacgaggaggtcacaccctcgacccccacgcagcacaagatggctgcctacctgggcgacgagctgcgcgccctgggcctggacgacgtgcgcgtggacgagcacgcctacgtgacggcgagcctgcccgcctccgcgggggccgagggcctgcccgcgctggggctctgctcgcacatcgacacctcgttcgacgcgccggcgtctggcgtcaagccgcacgtggtgcactacgagggcggcaacctcgtccacggcgtcgtggacgggcgcgaggtcgtgaccacgcccgcacaggtgcccgacctggcgcagttcgtgggccaggacatcgtctgcagcgacggcaaggccggcgtggccgagatcatggcgctcctggccaggctgacgcagcaccctgagcttccgcaccccacgctcaaggtggcctttgtgccggacgaggagatcggccacggcgcgcgcctgctcgacataccgcgctttggcgcaaagtggtgctacaccgtggacggcgaggcgctgggcgagttcaactacgagtgcttcagcgcggcggaggcgacggtcaccgtgcgcggcgtgatggtgcatccgggcagcgccaaggacatcatggtcaacgccatcaccgtggcgagcgagttccagcagatggtgcccgcggccgagcgcccggagcacacggagggccgcgagggcttctatcaccccatcagcatctccggcacggcgagcgaggtcaggctcggctacatcctgcgcgacttcgacgcggactccttcgcgaaccgcgaggccacgctgcgcaggatcgctgccttcctgaacgaccgctacggcgagggcaccgtgaccgtggacgtgcgccagcagtaccgcaacatggcggagaagttcgaggactgccgcttcctgatcgaccatgcgctggaggccaaccgcgaggtggggctcgaccccaaggtcgtggccgtgcgcggcggtaccgacggcgcggagctcagcttccgcgggctgccgtgccccaacatcgccacgggcggctactcctgccactccgtgcgcgagttcgtgccggtgcggagcctcgagctcacggtcgacctgctcgagcggctcgtggccaagttcgcggtgccgcaggcctaacgggatcgcggcgggcgcgccgttcggaggtcccgcggacggcgccgctcgcgggacccatcgcgccgttgggcagacgggctcgccgcagacggcccccagccgcccgaacgccagagcaaggctccgccgcgggcttttttcaggctaatctattggtggaaactcgggacaagaggtagcgcaatgggaacagacagcacgatcacatgcgcgtgcggccagatggcccagggggcgtcgcgatgatgcggctcgtgtccctcgcgctcatgatcgtgcttcccgtgcttgcggcgaccgggcagcacctggccgataggggcctctccgagcgccaccaccgccaccacgacacctacgtcgcggcgtccgtcctcacgcggacgctcattgtcgtgatggtgttcatggcggtgctgggccttgcgctcacctggctgtgctcgctcggcgtgttcgaggcgagcacggtcgtgctgggctcgttcttctcgtccttcgtggtgaccatgttcctgctctggctgctcatgcgccgctactccgtggtcacctacgacgaccgcatggtcgtcactcccatcctggggcgccagcgcaccatcgcgtaccgcgacatcacgagcatggagtggcaccgcgccctgctgggcggccgccaggacgtgcgcgtcttcagcaaggggcagcgccgccccagcaccatccgcggcatcctggacgtgcagcagatcctgatgcgcatcaaccgctttgacgtgctgtccgcctcgccctccgcagatgagcgcgagcgcggctagcgctcgcggcggatggccttccagaacttttccgaaatgctggcacggcgcatggtgccggccgcggcctcgcgcagggcgctcccgtgtgcgatgaacatgagcacgcacagcagggcagcgcacacagtataggggctgagcaggccaaacatgagggcgcagcccaccaggaagcagaccgtgatcgtgacggcgcctacgcagaggtagccccagaccagcaccaccacgaggcccgcggcggcgctcgccatgcccagcgccggcaccgccaggatgatggcggagcaggtggtggtcacgcccttgccgccgcgaaagcggtgccagaacggaaagttgtgtcccagcgtggcgcccgtggtggccaggaagccgcacacgcccgcgtcagcgggaaagatcgcccgcaccacgagccacgccacgagcgtcttggcgatgtctcccgccagcacaacggccgcggcgcgcgtgcccagctcatgccccacgtttgccatgccggggttgcccacgcccacgtcaaaggcagacttgcccaccatgcggcggcacaccacgtccgccgtgaggaagcagccaaacaggtagcctatcaaggccgaaaccacccagcgcatcacgcctcgcctcccgcggcctccgccatggcatctgcgagcaggggagaaatgcggccctgcgacacgaggtccacctcgtgcatggcgcgcgatatcgcggtgtagagccggcggcgcgcaagcggcgtgtccgggtagacgtcggcctgcgcgtcgggcacgatcacgtggtcaaactccaggcccttggcgagcgccaggtccatcagcaccacgcccctggcggggagcggctcgtcgcccttgagggtcttcaccaggggacgggcctcggccggtgcgtccgcgtccgaggggagcgtgagcctttgggccagctgcttggagagccagctcacgcggcgccggtccgccgccacgatcgccgtgaggccctcgccgtgcgaggcgtcctccaccacctggcacagggtctggaggtaggcttccgcgttggcttggccgtccgccacctcgtggaagcgcggcggcacgccctcgcgctgcacggacgagagctgcacgcgctcgtccgcatccatcaggcccgcaaagaggtgcgttatctccgggctggagcggtagctcgtgagcaggcggcactcctccacgctgccgtgcgtgcgcgtgaagatgtcgcgtatctgctcgaaggtggccgtaccctcgtggatggcctggttgcggtcacccagcagcaggaagtgcgcgcggccaaagtagcgcgcgagcacgatgagctgcgtgggcgtgtagtcctgcacctcgtcgatcatcacgtagcgcgtgtcgtccgcgccgtggccggttatgaggagccgcaggaacatccactcggccgcgctgacgtttgtcttgcccagcaggcggcagccgatgcggtcgaggcgaagccacgcgagggactcgatctggtcgtgcgcgggggcgtagcgcttggcgagcagctttttggcgtaggcgtaggtctcgtcgtcgttggcgggggatatgacctcgccaaacgcctcgatctgctcgtccacgtccatgccgagcatcgcctcctgcacgtcctcgtcgtgcgcgagcgaggcgatgcggcggtccaggcggtcgtgcagctcgtccttcacgagggcgatcatgcgcgggcccaggccaaagcgctcgaacttctgcacggcgccgcggacggaggacgccttgaggagcaccacgtcgtcctggcggatgtcgcgcaggtcggcctcctcaagcgtcgcgtgctccacggccgcctccagccgctcgagcgactccgggctgtcctcggcgccggtggcgcggtcggccaggcccaggcttgccaggaagtcgcgccacgtgaacgtctgggggttggactcgcccagggtggggagcacggtgtctatgtacttctcgaacacgttgttgggcgtgaagaggaagacctggtcggggctgagcgtggagcgctcgcggtagaacaggaaagcgatgcgctgcagcagcacggacgtcttgccggagcccgcgatgccgtccaccagcaggaccggcacgtcgtcgtggcgcacgacctggttctgctcgcgctggatggtcgccgtgatggcctgcagcttctccgtgtggtggcgcttgagcgcgttcagcaggagcgagtcctcaatggccacggtggtgtcgaagtaggcgttcaggtggttgcgcgtgatgtcaaactggcggcgcagctccaggttgacggtgcgcacgcgaccgtcaaccttgtaggaggtggggcccatctgctggttgtagtaggtctcggccacggggttgcgccagtccaccaccagcggcatgcggttgcggtccgtcatgccggccgagccaatgtagacgtcgcgcgcggggcggccggggcgcatctgcaggcgcacctttgcaaagtagggctggcgcagcagcatcatgcagcgcccgagcttctcgacctcaaagtcgtgctgctggttgtacgtgtcgatcacggagttgagggtctcgatggcggcaagggtctccatcgtctcgtccgcgccgccaaagtcgatgcggacctcctccgagaggtccttcaggtccttggcggcctccttgtgcttgacctcgagctcctcggtcaggatgtcgcgcaccctctcgagctcggcgtatatcgcgtcgaggtgctcctgctcctccgcaaacgtcttgtcgtccatcgtgctcccatgcgtgagtctgcccctgaatgaatccttcccattatcgcacgggcatgtcccgcgggcgagaaggacggcggccttgcatgttgatgatgcggacaacgagtgagggggctgcggctgcgatttgtggagacgtcttcacaaacggaagtatttctttacagacggctaccttgtccctatatttattacttgcgcacagggtgcgcccagacattgcggggtggagcagtctggtagctcgccgggctcataacccggaggtcgtaggttcaaatcctgcccccgcgaccaaattcgcagtccctcatctggttgccgggtgggggatttttcttaccgtgcttctttgttcaacctttcgagtatggaccgaacgatcttctcgtcctcaatccgcgcaatcccaaaggtctttttccagcgtccttgagcgacgccccgaccagatacgcctcagtcccgtccagtatgaggaaccggtcgtgaaatgtatctgtatggcgaacttcgagctttgggtactgcgcgttgaaggtatcgacgtcccgttgcgtgaggcgcgtcttagggtgggtccagatggtgaccctgacgtccgaatgcttcttcgcgagtacattgagggtgcctgtatcgacgtagccgtccacgagcacgatttcacgttttgcgcgcagcacgaaggacgtgaggagctcgaaggcatcccagacctggccgtcgaaaaagactctctggattggttcctcgtgggcgtccatatagtcgaagatacgctcgaaacgttcatcggtgcatttctggtattcaagctgcctaagctctatggtacttatgcgttcgagcatctgagcattgtccgcaatgaagcggcgcatctcgacaaatgcgtccataatgcggatgctcacctcgatggccgtgtcactgcgtagcacggcggaaagcatcgagaccccctgctcggtgaagactcggggcagacttctcctcctgccaccccatccatctgcacttgaaatcacaaactgtgatttcaagtcatcagcctcgtccttagtcagcctgaagcagaatctttctggaaagcgatccgcgcaccatatagatcatgttgcggatttgaacgttggggacctggactacctcggtatgcttttcgatggcgcgcgcctgaatacgttcatctgtcatggaaccctcccgcctcccaaacatcacgaaatgtgatgtttgggaattgtatcaacgattgccgggcgtctgccgtttgaagtcacaaactgtgacttcaaagctctccccgattgaatcacgggcctctgacctgtctagatgctagattggcacctaggttggagaccccttgaggttccaaaatggaatctcgagtcaggtggcctgccgagcggcaatcgaacgttcttctcgcccgcgtaggcacgtggcgtatgtgtgacgtgtgaggcctcaatatcagccaaaggtgcgtgccgccgttggggtatcactcaagccattggatgcgagcgcgacggcgcggaaggcgaggcggcatgggcgagaagaacacggacgagaaggtcatcaacctcggggaggcgcgactccgcgcccacgaccacatcgtgcgcggcacggcggccgacggccagctgcgcgcgtttgccatgagcggacgcgagacggtgcaggagatgcgcgaccgccaccacacgagcaacgtggtcacggcagcgctggggcgcctcatgatggcgggccagatgatgggcgccatgtccaaggtggacgacgagctcatcacgctcgaggtccgcggagacggtcccgtgggcgggctcaccgtgaccgccaacaaccaggggcaggtcaagggcttcgcgtaccatcccaacgcctggctgccgctgcgcccggacagccacctggacgtgggcggcgccgtgggcgcgggcacgctcaccgtgatccacgacatcgcgcacatggagccgtactcgagcacgattggcctcgtgtctggcgagatcggggacgacctgacctactactttgcggagagcgagcagattcccacgtcgcttggcgtgggcgtcctcgtggacgtggactacaccgtgcgccaggcgggcggctttgtgatccaggcgatgccgggctgcgaggactacgttcttgaccagctggagcggaacctcgcgggcgtgcgctccgtcacgcagatgctggaggatggcatgggcccctcggacatgctggcgcacctgctgcgcggcatggactaccaggagctggacgcgatgccggcgcagttccactgcggctgcgacaaggaccgcgccgcccgctgcgtgctggcgctgggcgagcgcgagatgcgcgacatgatagagaagggcgagtctgcggacgtgcactgccacttctgcggcgcgagctaccgctttgcgccggaggagctcgaggcgctactcggttaggcgttgctggtgggggcgggtgcgactgagcgcggccggaccgtgcggcctagcgctccggcgccacgagctcgtacgccaggcgaggggagtggtcgcgcacgtagacgatgccgcggtacgtaaagccctcgcgctgggcagccgcctgcatcggcctgttgtcgcgatgcgtgtccacgcgcaggtggcggcagcgctcgagcgcgaggccaaccgccaggtggaacacgccatgcacctggccgtcgctcgcgacctggtgcagcgtcacgtacggggcgtctgactcccacgtgccgccctcgatgtgcgcataggacgcgtcccggccgggcacgagggcaaacgccgcgtgtatggcaccttcccgcgtgaccacgtacagctccccgcgcccgatgcggccctcgataagctcgcgcggcggaaagccgtcgccccactggccggggttgccggaccgcctcatgaactcgcgcgccgcggcgtacacggccatcacctggtcaaggtccgcccgcgttgcctgccgcaccgtgatgtcccgcatgacgcctccgccttccgccccgtcagacgcgtcccattgtggcacgcttgcgacgcaacggtgcccgcatgggcgagaaggacccgagcccatggtccaggtccttctcttgggagtgcccgcatgcggggttgcgggcgtggggtggttcgtcctgctcttctcgcccgccgctacgcgagcgcgccgctggccgtgctggcgccgttgccggacgcgttacgggagcccgtggcgtcctcgccctcgtgggcctgggcccagggctcgctctggatcacggcctctcgcacgagcagcgcgagcctgagcgcgagtggctccaccagcggggcgagcgcaaacgtgaggagcgccttggccgaggggagcgcacccgcaaacgcgaggcgcgccgcggcgtcgccggcgcagaccaccaggaaggcgatcagcgtcgcgggcacaatcatcatggcgttgctgacgcgcatggactcgcggcccatgtgccaggtgaggaacacggcgcacacccacgcgacgacggcgggggtcaggcatgccagggcggcaaggcgggccgcaaggcttccgccaaagagggcgtcggccgcgcccagggggctcagcacggcaatcgcaacggcagcctcgccaagggcaagcgccgccacgcacgccttgcgcctggtggaagtggccaccatcctgcgaaggcacgttcctgcatcgcacgcgtgggacaggtcgtccgtcatggcaacatcctcctttgcgggccggcttccatcgcgccctcgcgcgaccgaccctcgaatcagtcatacgacgttgccaactatggtcgctcacgccggtcgcgtgcgtgttagctgcgtttaaggaatcggtacgccttgtgacgttgcccgtaacgcccgtgcgggggagaagaacgtccctagtgcttgaagagcctgctcatgaggtcggcgttatgcgcgaggcggcggttcttctcgccctcgttggcgtgccagttgcccggctcgccgtcgaggacgtctccctggcgggtgccttccggcagctccgagagcggcacgtccgcaaagcgggtcccgtccagctcgagcacagccacgtcgccctcgatcctgtccacgattgcacgcatgtcacgccgtcccttccgcggggccctagccgccgcacacctggcaggcggtgtagccctcggcctctgcctgcgaccttgtcatgctcgtcacgttcttgctgcgcgagagcgtgcggcagccctgcgcatggtacttcttgcccgtgggtgccacgtagaccgtctggtcctgacccgccgtcgcgccgctggagggttgtgcctgcggggcggctacctgcgcgtttgttgacgcaccgcttccaccatgcccgccgccgtcaagggtcgaggagcccgcgcccgcatcctggctctgcgccacgacggtgccctggtgtgccgtggagacggacacgttggttccgtcggacgtgaccgtgatcgtcccctgcgcacccgtgccatagatggtggctcccacggcggagagcgcgtccatcacggtctgggcgggatggccgtaggagttgtccaggccatagcttaggattgcgaccttgggcgtgagcttctgggccacggccgcgttcgtgcccgacgcggatccgtggtgcgacgccttcagcacgtcaacgtagccgacagagcactgctcgagcgcctcggccggcgcgtcgcccgtgaagaggaacgtgttctgcccgtaggtcacgaggatcacgacgctgtagccgttcgagtcgtcgtagcttgcgcctgcctgcggccacaggatgtcgatgcggtagccgttctgcgcggcgatttgcttgccggcagtcgcctcgtcgatctggaggcccttggccgcgaccgcctcgaggaagcgcgtataggtctcggtcgagtggttgcagttgggtgcccagacggagccgatctcgtttgctccgatcaccgtggggagcccgccgatgtggtcggcgtcggggtgcgtcgccacgagccagtcgatgcggctccgcttgtccgccgcgagcgcggagtcgacggtcgagccaccctccctgccggcgtcgatcaccatggtcttgccgtccgggaactcgatgatggcggcgtccccctgtcccacgtccaggaacctcacgaccagcttctggcctttggtggcatcgcttgcggaaggcttggccgcctgcgccgcggatgatgccgtcgcgtcggtctggacaggatccttctgtttcgattccgcctccgtgccgctatcggatgcgctgatgctcgtgtccgtctgctgctgggcattgctgctggagtgcgagtctgcagtcgagcccgcgcatgccaggaccgtgctcagcagggcaatgaggacgaagccgaggaacccccagagacagccctttacgcatcctccgttgtcgccccttgtcatggcacgccccctagagcagacaggacaggagcgcgagtatggcgaggccgccctgggtgaggatgatcttggggttgctggtcacgctgccgtacgccgcgaccgcgacgacgtagagcatgagcgccaccacggcaggcttgctcgcgaagccaaagaccgcgacgagcaccagcacggcgatgaggccgttgtacacgccctgattcttgaagagggtccttacggaaggacggttgagctcggcggtcgtcatcccgaacacctttgccgtacggtccgaggtggtcgcgatggtctcgaggtagaggatgaagaagaactcggctgcgaccagcgtcgcgaggattgtggtgacaatgctcatgaggctccctccgtgcatcttgcttgtatggtggaaagtttagctgaagggaagccaagcgtacgcaacggagcgcatgccgaaacgcgtgcgttcaaaaagtaaggccgcgcccccgcaccggagcagagagcgcggccaaagcaaggcgaaagattcgtactcgcgttgtggtttgggtcctggttatcccgggtcgctagagggacctcagtgcatcgatgagtgcggtcttggcggtggtcttctcgtccttcatcttgatgaccttggcaggacatcccgcgacgacagcacctgcgggcacgtcctgcgtgacaacggcgccggcggcgacgacggcccccttgccaacgcggcagccctcgatcacgacggcgttcgcgccgagcatcacgtcgtcctcgatcacgacgggggtggcgcttgcgggctcgacgacgcccgcgaggacggtcccggcacccacgtggcagtgcttgcccacgatggcgcggccgcccaggatggcgcccatgtcgatcatggtgccctcgccgatgacggcgccgatgttgatgatcgcgcccatcatgatgacggcgttgtccccgatggtgaccttctcgcggatgatggcgccgggctcgatgcgcgcgttgacgttgcgcacgtcgagcatggggacgccggagttcctgcggtcgcactccacgacgacgtcctcgatctgggaggcatgctcggagagggcggggccgacctgggaccagtcgccgaacacgaccttgctgcccgtgccgaagacgtgggagtcgggtccgtagtcgatgtccgcgcccggcgcctcgcgaacgaagacgcggacgggcgtcttcttgggtgcgttggcgatgtagttgatgatttcctgtgcgtccaagtgttgcatccccttatcgattgagcggctcgtcgccgaacatgagctggtcgaaggtgtagaagccggggcccttggtgacgaggcgccttgccgcggcgacggctccgttcacgaagatctgacggctcgtggcgcggtgggtgaggcagagttcctcgtccgtgccgaagaagtggacctcgtgcgtgcccgccacggtgccgccgcggaggctgtgtatcccgatctgtccctgaggccgtgcgccgaccatgccttcgcgaccgtagacgacatccgcctcgtggccggggtcgacggcgtcgagcagcatgttcgcggtgcccgagggggcgtcggccttctggttgtggtgcgtctcgacgatctccacgtcccagcccgcgagcgcgcgagccgcctcggcggtgacgcggcggagtaccgccacgcccagagagtagtttgcggagtggatgaccgcgctcttctcgcccagcgccctgatctgcgcgagctcctcgtcggagtagccggtggtaccagagagaagcgcgcatcccgtgcggcggacgtaggccagcgtgtggggcagggccgcacggttgctgaagtcgatggcaaggtccgccgtgggggcgtcgacatcgagctgagaggcgctgtccacgtcgtacgtgcccgtcaccgcgaagctgccgtccgcctcgagtgcctgggcgatgagcgtgcccatgcggcccgcgccgatgagcgtgacggtgtacgcgttgccgctagtcaatcagaccgacctccctcatggcagcgtagaggcgctcgcgcgcggggtcggacataggccagagcgggctgcggtagctctccgtcagcatgcccatcttggcgagcgccgccttgacggggatggggttgacctcgcagaagagcgagtggatgagctcgaggtagtcgagctgcgtgcggagggctgccttggtgtctcccgcgaaccagttggcgcacatgtcatgaaccacctgcgggcagacgtcggcccagacgctgatgacgccggagccaccgagcgagaggatggggacgaccatgtcgtcgttgccggagagcatgcggaagtcgtcggagaggtagcgggcggccatcgtggcgtaggagatgttgccggaggcttccttgatgccccacgcgttggggtgcttgctcaggcgtgcgatgttgtgctccgagatggagcagccggtgcggccggggatgttgtacaggatgcacgggacgtcgaccgcgtcgagcaccgtcttgaagtggtggtagatgccgtcctcgttcgacttgttgtagtagggggtgatgagcaggagcccgtcgatcccgagcttctgcaggccgaggctcttgttgaggctctccgccgtggcattggagccggagccgccgatgacgggaacgcgtcccgcgacgcggtcgatcacgcacttggcgaccgcgaagtcctcctcgtccgtcatggtcgaagactcgcccgtggtgccgagcaccaggatgccgtcggtaccgttggcgaggtggaagtccacgaggcgctcgagcgcgtcgaagtcgacgcttttgtcctccttgaacggggtgacgagtgcgacgatggatccgcgaaggttggtcatgtccatagctgttgctccttatttggggacggggcattggcccacgtccattgtgtcgagaagattttgagccagccagtcgcgtcggcgaccgcgtcagcccggcgccccttaaggacgcgcggtcttgggcttggacgcccctgcctcgacgggcacatcccatccctcgagcacgtcgagcgtcgcgaagtagtcgctgggggtctcggcacgacggatgagcctcacgtcgccgtcgggctcgagcaggagctcggcatgcctcagacgaccgttgtagttgtagcccatgcagtggccgtgggcccctacgtcgtggacgtagagcaggtcgcccgggtggcactcggggagtgcgcggtcgttcgcaaggcggtcggagttctcgcacagggcgcccgtcacgtcgtaggtgtggtcgcagggctcgtcctcgcggcccatgacggtgatgtggtggtaggcgccatagagcatcggcctcataaggtccgccgcgcacgcgtcgacgccgaggtagtcatggtagatgtgcttctcgtgtatgactcgggtcacgagggcgccgtaggggcccgtgatgaacctgcccatctccgtgaagatcgcgacgtcgcccatgccggcaggaacgagctcctcctcataggcgcggcgcacgccctcggcgatcttgaagatgtcgttggggcgctcctccgggcggtagtcgatccccacgccgccggaaaggttcacgaacgcgaccttcgcccccagctcgtcgttgagcctgcgagccgctgcgaacagcgtgcgcgcgagcgtggggtagtagtcgtccgtcacggtgttggaggcgagaagcgcgtggatgccgaagcgcttgacgccaagcgacatgagccggcgcgtcgcctcgagcatctggtccatggtcatcccgaactttgcctccgcgggcttcccgaagatgccgttcgcgaaggggaactcgccggggttgaggcgcatgctcatgacctcggggaacgagccgacggcctcctggtaggagtcgatgtgcgtgatgtcgtccaggttcacggtcgctccgaggcgcgcggcgtgggcgaactcctccaggggggtgtcgttcgaggagaacatgatcctctcgcccgagacgcccatgcgctcggccatgatgagctcgcactcagaggagacgtcgagaccgaagcccatgtcgagtaggatctggatgattgcggggttggggcaagccttgaccgcgaagtactcgcgaaagcctgggttccatgagaacgcgtccagcaccgactgcgcggtcttgcggatgcccttctcgtcatacagataaaagggtgtggggaatcgcgaggcgatgtcctcgagctggctcgctgtcacaaagggcgtcttgcgtcccatcgttcctccctacgcgcccatcctttgcggtggccttttgccacggtcgcgtagggatagcgcacctgacgtgtgtcagacagttccaaggggtgttcccccaaggtcccaccctgccttcgtgcccgttggcaggattcggcggatttggcctccccgtgggatcgcagcctgccggctagcccacggattatcgtgtccgcgcctctatcgttggggggcagtgtagccttagtccgtcggaacgtaattgttcgaagcactttcgccacacgtcgttaacaatcgggcagacgcgacggtggggaaactggtggctggggctcgcgggggactatggttgtgacaagtcatgtgctcttcccgtccccttggcatgatgggccgtacaatgcggcagacgaatcgcaacgggtaattgtgcgaggcaacgaggaggcgtccatggagcgggagaacgatagggtcgcggaaccggggaacgtgacggtggacgcgcctgacgacgtgttgcgcttggtgcccaggctgcgcgggtggaggcgcgaactccaccagatccccgaatgcgacttcgacctgccagagaccatcgcgtacctgcgcgcgcagctcgagcccatgggggagcgctgcgactgcctcaggctcttctcgcccgcgtcgtctaccctgtgcgcgctgttcgaccgcgggacgggggcggcgaccgccttgagggcggacatggacgcccttcccgtgacggaggagacgggtgttccctttgcctccaggcaccagggacgtatgcacgcatgtgggcatgacggtcacatggcgatggccctgggggcgtgcgcgtggatgtccgagcatgtcgacctccttccgcgcagcgtgctcgtggtgttccagcccgcggaggagaccacgggcggggcgcgcaaggtgtgcgagagcggcgtgttcgagcgccttggcgtggacaggatctttggcttccacctttggcccgaccttcccgtggcgcaggtggcgacccgtgccagcgcactcctggctgcgagcaacgagacaacggtcgagttccaggggcgggcctcccacatcgccaaggcgtcccaggggagagacgcgcttctggctgcgtgtcgctttgtgcccgaggcataccgctacatggacgagcgtgccctcgaggagccgtgcctgctcaagttcgggcacatggaggcgggcgaggtccgcaaccagattgccgcaggcgcccgcgtggagggaagcctgcggacgttctcggtccagatgggcaagcgctgcagggaggagctgccgggcatagccgagcgagtggcctccgacctcggctgcaccgtacgaacgcactttagcgagggctaccctcctgtggtaaacgaccatgaggtcacctcctgggcaacgggggtgctgcgggaccagggcatttcggtcgaacaggtgccggagcccctgctcatagcagaggacttcgcctggtaccagcaatggctgcctggcacattcttccttttggggactggtacggggataccgcttcacgcgagcacgttcgactttgacgagacgatcctggcgcgtggcgtcgacgtgtaccgcagcctcgtgacggcgacggtctaaccgcgcaggctgcgcacgaagcccgcgaggcgggagagtccctccttgagcgaggcgtcgtccgtcgcgtagctgatgcgcacgtggcccgggcagccgaagaccgacccagggaccacggcgacgccggcctcgcgaatcgcccgctcgcagaaatcctcgtcgctggcacagaagccttcgatgctggggaacgcgtagaaggcgcccttgggctcgacgcaggggagtcccatctgcccgagcgcgtcgagcgtgatggcgcgacgcgcgcggtagcgctcccgcatgggcgtggtatccgtggccagcgccgttaccgccgcgtcctgcgtgaaggagacctcgcatgagacggcgtactggtgcaccttggcgacctgggtcacgacctcgggagcggtggtgagccagccgagtcgccagcccgtcatggcccagggcttggagaggctgttcactacgatggtgcggtccgcgagctcgggatggagcctcgcgaagccgcgaccgcgtccaggctcttctcgtccagaacgcagccggtcgggttgtttggcgaggtgaggacgatggcctttgtatgcggcgtcacgacagacgcgagcctttccgcatcgatctggaagccgtccgcggaggtgtccagcgtgaccgcccgcgcgcgggcgaggagcgttatcgactggtagagcacgaaggcgggggtggggatgatgacctcgtccccggggttaaggagtgccgtgagggtgctgtagagcgcctccgtcgcgccgtttgtcacgatgacctgctgcgcgtcgaccgggagccccgtgttggtgcagcgtgtcgcgattgcctcgcggagcgcggtggtgccgttgttgggcggatagtgggtcttgccctcgcaaaggctctgggtgacgcgctcgcggatgtgggccggcgtgacctcgcccggctcgccgagcgtgagggagacgcagccgggggtctgcgcggcgagtgcggagaagcgcctgattgccgagggcttgagctccctgagagcgctgttgagttctagcgacatgccctgcctccctccgggcgcgacccctggtgcggcgcgcctgccatgaatgcgaacgcgtgttctatatgtgacattatggggcctggcgcgcccgctgtccagagaattttacgcccaggcgatgggcctttcgccatgcgcctggaggaaggcgttcgcctgcgagaagggcctggaccccatgaacgggacgaggcctccgcccgcgcggtttgccgagagcggggaggggtgcgtggaggtgagcacgagcttctcgcccgcgagggttcccgtggcgcgcgcgtcgtccaccgccgtggtgacgaggcttgcggcatggcggccccacgcgaggtagcagatgggctgtggcagctctaccgtgcgcctgaccaggtagtttgtgaggacctgccagccgagccgcgcatgcgagttcgcggcgtgctcgcgcaccgtgagcgtggtgttgaggagaaggacaccctgccgtgcccagccggtgaggtcgcccgtggctggtggctcgcagccgaggtccgccgcgagctccttgtagacgttgcgcaggctgggcgggaggcgctggccggcgggcacggagaacgagagacccatggcctggccgggctcgtggtaggggtcctgccccaggatcaccacgcgcacggcgtcgggcggcgtgagctcgagcgcgcgcaggatcgcgtcctgggcggggtagatggtctgctccgtgcggaggtcccgcacgcgagcgaggagctcctccgtcttggtagatacctccgccggcgcgtcctttagccacaggtccacgttggccttgccccgtgcgtcgcccatgtatgcctcgcaatccgtcgcgttgtagatccagctgacggtagcaggaagcggcggcggggtaaagtccgtgcaggctggtgtctggtaccagtgaccacctgcggagaacgtaccgcccgcaaactggcacgcggcgcacggcctgtggcgtctggcttttctcgcccgtgggacctacagtcttttttgcgtacccttaattttctgtcaggtttggcgggaccgctcgtgttatatatgcgtgcgccgagcgcgccgcgcggccgccgccgcgtcgtcggaaggagccatcatgtgcacgggcgtcaggttcacggacgacaagggcaacatgtactttggccgcaacctcgactggagctgctcgtacggggagcgcgtcgtcatcacgccgcgcgggtaccgcacggagtcgccgttcggggccgtcaagccgtcggacatggccatcatcggcatgggcatcgtggagggcacgacgccgctctactttgactgcgcaaacgagaagggcctcgccgtggcgggactcaacttcccgggttatgcgtcctacgcggccggcccgcgcgagggcgccacgaacgtggccgcctacgagttcccactctgggtcgtggcgggccacacgacggtggacgaggtcgaggcggacctcgcggacgtcgtgattgtggacaggcccgtgagccccaagttcccctcgtccatgctgcactggatcattggcgacgccaagcgctcaatcgtggtggagcagaccgaggcggggctgcaggtcttccacgacgacgtggacgtcctcaccaaccagcccggctttgcgtggcatcaggagaacctgcgcaactacatgaacgtcacgagcgacgtgcccgggccgctcagctggcgcggccaggagctgacggcgtttggctccggcggcggcatgcgcgggcttcccggcgactactactccacctcccgcttcgttcgcgaggcgtacctcaacgcgaactaccccacgcaggagggcgaggacgccaacgtgagcaagatgttccacctgctgggcggcgtctccatgatcgacggcgcggcacgcatgaccaacggcgagttcgagcggaccgtctataccggcggaatctccacgcgcacgatgacgtactactggtccacgtacgccgacccggccatccgctccgaggcgctgttcgaccacgacgtggacggcaagtacctgcaggtggattaaagagaccctgcccccgcgaccggacgccgcggcgggcgcacgaccgacccccagatgggagcacgtcatggctaagaagccttttggcacgataggcaagggcaagggcaaggaggacgcggacgaggccggcaaggcatcgcctgcgggcgagaaggacgcagcctccagggacgcggacgccacgcagcgcgtgacgcctcccgtgcccgtgacgcccgagcgccacgcgacgagcgcgctcgacgcgcctgagggcgtgacgaggaccctgcccaccgccgcggcgcaggacgcgcaggccgaggaggacgcggagggcatgctcgcctaccagagcctcgagcggcaccgcaaggagaagaggcgcaagcgccgcgtcaagatcgtggtgggcgtgtgcgcggccgccgtggtcgcggcgctcataatcgtgccgcgcgtgctgacgcccgaggacagcgggtcgtccgcccccgcgacgtccgaggtcacccgtggcgacctcacgtcgagcgtgagcgtgacgggtgcggcccagcccgcgtcgagcgtgtacgtgacgcccgaggtgggcggcatcgtgcaggacgtccgcgtgagcgagggcgacaccgtcaacaagggcgacgtgctcttctcgctcaagaacgactcgctcgacaaggcggtgtccgacgcccagcgccaggtctccgacgcgcaggcgcaggtcaacaccgcgcagcgcggcgccgacaacgccaacgccgcgtaccagaaggcgctcgcggagtggaacgccgcgcccgacgcggagacccagtccggcctcacggacccggacagcctctacggcgacgtgcagaccgcaaacgacagcctgagcagcgcaaagtccgcactcgactccgccaacgaggcgctcgcggacgccaaggcccaggcggccaagcgcaccgtcgtcgcgccaagctcgggcagcgtcgtggcggtcaacgccaagaacggcgccgcgtacggcgacgccacgacgggctccaccacgagcgacggcacgggccagtcgtcgtcgcagtcgtcctctggctgggcggtgcagattgcggacctctccaagatgcgcgtcgcgacccaggtcaacgaggtcgacgtatcgggcgtgaaggtggggcagaccgcggacgtgaccttctcggccataccggggctcgagtgcaaggccacggtggagaagatcgcgaccgtggccacgggctcggactccggctcgacgggcggcgacggcagcgtggtcacctacgaggtggacctcctgattgaccagcccgactcgcgcatcaagccgggtatgaccgccaacgcgaccatcgagacccagagcgtgaaggacgtgctcatggtgcccgtggcggcgctccagaactacgacgagggctccggcgacgcgacggtgaccgtggtcacgctcgacaaggacggcaacgtcaagaagtcgcgcgacgtggacgtcaaggtgggcgagaagaacagctccgacgccgcggtcacgggcctcaaggagggccagaccgtgaagctgacggacgacgactccagctcgggctccggcgacgccgacgctgacgcgtccggcggcatgaccgcggactagtgatgccatgactccggtaatcgacgtgaggggtgtgcaccgcatctacgactccggcggggttcccacgcacgcgctcaggggcgtgacgctccaggtgcagcgtggcgagttcctgtgcatcatggggccgtccggctcgggcaagtccacgctcatgaacatcctgggctgcctggacacgcccacatccggcacgtacctgctcgaggggctcgacgtgtcaaagctggacgacgacgagctggcgcggatccgcgccgcgcgcatcggcttcgtgttccagtcgttcaacctgctgccgcgctcgaccgtcatgaggaacgtgatgctgccgctgctgtacacggacgtgccgcgggccgaccgcgagcgccgcgcctgcgaggcgctgggtgccgtgggacttcccgcggagtactacgaccaccgctccaacgagctgtccggcggccagatgcagcgcgtggccatcgcgcgcgccctggtgaacgacccggcgctcgtgctggcggacgagcccacgggcaacctcgactccgccacgagcgaggtcgtgatgcgcacgttcctcaagatgcgcgaggcgggcaagaccgtggtcctcatcacgcacgacgcggaggtcgccacctgggcggaccgctgcgtgcacatccgcgacggaaggctgctcacggacgagcaggagcgcgagctcgtggcgcggtccgcgtcgcgcggaagggggcgcacatgaggctgagggacctttgggccgagacctgggaggcgcttgacgccaaccggggccggtcgctcctcacggtgctcggcatcgtcataggcatcagcgccgtgatcgcgatgacggcgctcatcggcggcgtgcgccagggactcatgacgcagatgggcctcgaccgctcgcgcgtggtcaacatggccgtgtacggcagccagcagatcaaggtggaggacctcgacaagctccagaagggcatgcccgagtacgagtacatcacgggaagcgcgatgggctcgggcaaggtcgcgagcgagaccaagagctcagacggctcgatcaccggcgtcgcgagccactacttcgacgtcacgggccagaagctcgtcaagggcaggctcttcaccaccggcgaggacgactccgcctccacggtcgtgatactcgaccagtcgagcgcacgcaacctctttggcaagggcaaggccctgggggagaaggtccgcatccagggcatcgagtacaccgtggtgggcatcctcgaggacggccagatgagcgaccccaagagcgtgaacgcctacgtgccgctccacacctgcgtccagagggtgaccggctacgacaacgtggacaccgtggcgggcatggtgcgcgagggcgaggacatcgactccgcggtccggcagaccaaggagtacctcacctcgtactaccacctcacgggggaggacgcggacaacctctacgtatcgtccaccaagtccctgatcgacagcttcaacaccgtcatgttcggcttccagctgctcatgacctccgtcgcgtcgatatcgctcgtggtgggcggcatcggcatcatgaacatgatgctcaccaacgtgacggagcgcatccgcgagatcggcctgcgcaaggccctgggcgcgaggcggtcggacatcacgcggcagttcctgctcgagtccgtcttcctcacgctcgcgggcggcgccatcggcatcgtgctgggctacgtgggcgcgttcgcgctcgccggtgtggccacgagtgtgctgtcctccgccggcggaagcgacggcgggctctcgctcacgatcacgcccgtgatcgagcccatggccgtgctcgtggcgacgggcatctgcgtgctcatcggcgtcgtgtttggctactaccccgcgcgccgcgccgcgcggctcgacccggttgagtcgctgcactaccagtaggcgcgcccgcgggaggacgtcgcgacaacataaagaacgcgactaaaggagaaggacgcggccacgtggtcgcgtccttctcgtctgcgtacgcgttgtttagctgcggcgctagtccctggggcacttggagagtgccgcctcgtccgcgatgaccgtgcagttggtgtgcagctgcaggatggacgcggggcactgcgggtctacggggccgtagcacatgcgatagacggcgtcggccttctcctcgccgttggccaccacgaggatggagcgcgcgtacatgatggtctgcacgcccatggtgtaggcctggcgcggcacctggtcctcgctgtcgaagaggcggctgttcgccttgatcgtgctctcggtcaggttgaccatgtgcgtgcccttgctgaagtaggggccaggctcgttgaagccgatgtggccgttgcggccgatgcccaggagctgcaggtcggggtagccggcctccgccacgatgcggtcgtagtccctgcacgcggcctcggcgtcggggttggagccgtcgggaacgtgggtgttcgcgaggttgatgttgatgtggtcgaagaagttggtgcgcatgaagtagtggtagctctggacgtcctcgtggctgaggccgcggtactcgtccaggttgtacgtggacacctggctaaagtccacgtcgcccttggcgcaccacgccgcgagctgcttgtacgtgccgatgggcgtggtgcccgtggcgagcccgagcacggacgtgggcttgaggatcacctgcgcagaaatgacgttggcggccttgcggctcatgtcctggtagtccaccgtgcgaatgatcctcatgtctggtcccttccgtttgcttgccatgtggtgctgaaaactaataccagttggcgttgcgagcctgcggtctgagcgctccctcccagctttcgcgcggcgttcgcgcgtggcgcgcattgtggcgcgggtgagaagaacaagccaaccagctgcggctttgcaacagcctgtaccgcaaatgtagcggagcccaacgctaaaggcaagtcattttccaaagtgcacacgagcgctacgtgaggtagaattggtatgaggtacataccagtaaaccgggacgagaggcaggacgtggcatggcaagcatgcagcggaggaactccctccacaaccagctgtgcgacatgctgagggagaagatcagaagcgacatggcgccgggcgacgccctgccctcggagcggcagctgtccgaaaggtacggcctgtcgcgcacgacggtgcggctcgcgctggcgcagctggaagccgctggcctggtggtgcgccggcacggcaagggcaccttcgtgagcgactcggcccagggcgcggcggacctcgcgctctgctacagcttcacggacgagatgcgcgccatgggcaaggttccgcagacgcggatcgtgtcgtttggcgtgatcgacgcgaccaaggtggtgagcgcggccctgggcgtgacgctggggacgccggtgtacgacgtcttcaggctgcgcagcgcggacgacgtgcccatgctcctgggccacagctacctgcccgtggcgacgtttcccaacctcacgagcgaggaggttgccacgcgctcgatgtacgagataatcgagggcggctatgggcagcgcatcgcctccgccgtggaggaggtgcgcgccggcaccgcgcgcgcgagcgacgcgcggatgctcggcatagccgatggcgccgcggtgctcgagatcgcccgcgtcagcacgagcacgcagggacagaagatcgagtacacgtcctccatagcgcgggcggacaagttcaagtaccgtatggttcaccacagggcgtgacgggaggacgcgagcggatgacgggcaggacgcacatggcggttggggcagcggcggcgcttctggcggcgccgctcgcgtcgcggctcacgggcgcgccggtcacgggtgtggcacccgtgctgcaggcgctgctcggcggcatggtgggcggcatgctcccggacacggacgttgccaccagcacgggctccaaggagctgcgccgcgcctgggcggcgctcgccgtgctcgtggcgtgcgggctcgcatacgaccacctgcatgggagcgacctcctcgtggacgttgcctcgcacttctcgtacgagcagatagcgggcgccgcggtcctggtcgccacgtgcgccgtgggaagggcctccggccaccgcggcttctcgcactcgatcccggcgctcgtgttcgcgacgtttggcatgtggatgctgtgcaagccgctcgcggccgcctttggcgtggggtacctctcgcacctggtgctggacgtcctcaataagaagggcatccgcctgctgtggcccatgcgcgtgagcgcgcggctggggctcttcgagtccggtggcgtagccgactggctgctgctcgtggcgggcatcgcgacctgcgccatcgtcgcggcggcacggctcgacgcgctgcccgcgtgggtcgcggggctgcccgccaccgtgaggggcgcgctgccctggtagcaaagcgcccgcgtggcctgaggccgcgcgggcgacattggctctacttcttgcggaagcgcttgagcgggtgccttgcccgctccgccatctgacgctgcttgagctccgtggcgtcgcgccactcctccgtggcctccgggtgctccgccgtcgcgcgcgagcagagcacgtacatcaggatgcccaggccaaagctcacgacggacaccacgacctcgcccacggcgctcgcgccgagggaggtgcccggcaccatcatgaggacgacgtccacaaacgagaagagcaggggcacgcccgcccagccgcgcaccacctgcggcagctggctcacgtccacggcggccctgatggtgaggccgcacgccacgagcatcgcgccgaggcggatgacggccatgaggaggtcgtgctggtagaggcccatgaggtcgatggcgccgatgcccccctcgaagaaggcgacggaccagacggccacgacgagggagcacgctataagcccgttctgggcggcggtgcggggcgctcccagctgcgtgcggaagcgtgccgcgctcgcccggaagccggtgccggaggccgcctggtcctggcgcagctcgcgcgccacgcggccggccgccgtggacggggcctcgtccttctcgcccgcggacgcctgtgccgcgcgctcgtgctcgtacgcgcgcttcctgcgctcgcgttcctgcttgctggtcctcttggacatggcgtcccttcctgtttgctttggtgatgcgtcgccggtcttgcggcgtgggtcagatcttggccacggagtcgcgaatcacgaagtccgaggatatgtgcgtgacgcaggtgtagtggtgggggttgcgcacctggtcgagcagcttgtgcacggccatcgcgccgatgtcgtgcttgtggatgtggatggtggtgagggccgggagcgtgagcgtggcgagcggcaggtcgtcaaagcccacgaacgagacctcatcgggcaccttgatgccacgctcgatgcaggcgcgcatcgtgctcgtggcgatgacgtcgttgtccgcgtagaacgcggtggggagttcgggcgacgtctcgagccacgccttggcgtcctggtaggcggtggagagggtcgtgccgatcttgatcacgtacctctcgtcaagctcgaggcccgcctccctcagcgcgcgctcgtagccgcggcgcctgagcgggaagttctggatgtctgccttgccggagaggtagccgatcctgcgatgccccattgagatgaggtagcggacggcggcgtaggaggaggtctcgttggagaggacgatggactccatggcgtggtggtagcacgagccgtccaccacgaccagcggcgccttgcagttatagaagggctcgtagtcctgctcgtgcagctccgtgccaaggaggatgatcccgcccgtcgggtcgtcgcacagctccttgatctgcgctgctgcggtgggggaggtcatgtctacggtaatgtagcgggtgggcagcccctcgcggcgcgcggtgcgctcgacgccgtccatcacggcggggtggaactcgccctcgtccaggatcgcgcccgtcttgcgcgcgaccacaaagcggatgcccctcagtcggttcttgggcgcatagccaagctcgtccgccacgcgcttgatctgcgcggccgtcttggcggacacgccgggcttgtggttgagcgcattggataccgtggcaggggagtagcccgttgcctggctgatgtctcgtacgcttaccttcatgttgcatgcacccgattcgactgacgaatccgccgcgcgctggcccgaggcgcttccttgggcgtggccgcgtccttctcctccagtatagctaaacagaatgcctaatgtttagaaaagatttatttggttgctgaatgttgcgatttggttacagagtagcaatcttaagaagctctgaggactgcaaacgttcacggagacatcaatctgcatcatttgtcaaaatattgcgattgaaatgcatattatgcaaaagtgctcgaactttggtaccacgcgattcaaattggaaaatcttaagaataggaggtgcgggcgagaagtgcaagcaaaaattcccgggaacagctcgctaacgaaaacctaccgttcaagttttagccctgttgttttgtaaatctaaacagtacagtgaggatgtcctgagcgaggcaagctctgtactggcaaaacgtagcctaactaaacaaatcactaaacagacgaaacgatggtcttcagcaagtaaaagaacggaaggccgacaccaacgtccacaagcgtcagaaaggcagtgccatgggagagggatacaagaaggtaaagatcggcatggcccccacgaggaggagcatcttcagcgccccggacgcggtcaagtacgccaacctcacgcgcaagaagctcgacgagcttggcgttaactacgtcgacatcacggacatcaacgaggagggcctcctctacgacgacgaggaccgcaagaagatcgcccagaagttcaaggacgagaagatcgacggcctcttcctcccgcacggcaacttcggcaccgagtacgagtgcgcccgcctcgccaaggagctgaacgtccccgtcctgctgtggggtccgcgtgacgaggcgccgctcgagaacggcatccgccttcgcgacacgcagtgcggcctgttcgcgacgggcaaggtgctccgccgcttcgacgtgccgttcacctacatgaccaactgccgcctggacgacccggagttcaagcgcggcctgttcgacttcctggccgtctgcaacgtcgtcaagaagttccgcagcatgcgcatcctgcagatcggcccgcgtccctacgacttctggtcgaccatgtgcaacgagggcgagctgctcgagaagttcaacatccagctggcccccatcccgctgcccgagctcacggacgccatgaaggcggccgagaaggacgagcccaacgtggtcgacgacgtcgtccgctactgccacgagaacatgacctgcgacatctcggaggacctgctccgcaacgtcgcgtcgctcaaggtggccatgcgcaacctcgccaccaagtacggcgcctccgcgatcgtcatccagtgctggaacgccctgcagggcgagatcggcatcatgccctgcgccgcgaactcgctgctcaacgaggagggcctgccggtcgtctgcgagaccgacgtccacggcgccatctcccaggtcctggccgaggccgcgacctttggcgacgaccacgcgatgttcgcggactggacggtccgccaccccacgaacgacaacggcgagctgctgcagcactgcggcccctggcccatctccgtggcgcgcgagaagcccacgatctgcgtccccgtcgcgttcaagcacaacggcgccgtgtccgccgaggccaagcacggcaagctcacggtcatgcgcgtcgacggcgaccacggcgagtactccatgctcctgggccacgccaagggaatcgacggcccgttcaccaagggcacctacctctggatcgaggtcaacaacctcaagaggctcgaggccaaggtcgtggagggcccctacatccaccactgcgtcgccatccactccgacatcgtccccatcctgtacgaggcctgcaagtacatcggcgtcaagccggacctctacgacccgatcgaggacaaggtcaaggcgtacctgcacggcgaggacgtcacgttcgacgaggtgtaggcactcgtttccatacgttgcacgagcacgaagggagagttgaccgtgaactacaaggcattggcatatgacctgcgcaaggacacgctcgacatcatcatggcaggcggaggcggccacatcggtggcgacatgagcgagatggagatcctcgtcgcgctctacctcgccggcgggatgaacgtgtcgcccaagaacatggacgacccggatagggatcgcttcatcctctccaagggacactcggtcgaggcctactacgcggttctcgccaaggcgggcttcctcgacctggaggacgtcaagaagcgcttctccaagtttggctcgccctacatcggacaccccaacaacaagctcaacggcatcgagatgaactccggctccctcggccacggccttcccgtgagcgtgggcatggcgctggccggcaagatggacgagcgcgactaccgcgtgtacgtcctgctgggcgacggcgagctcgccgagggctccaactgggaggccttcgagtccggcgccatgtacaagctggacaacctctgcgcgatcatcgaccgcaaccacctgcagatctcgggcaacaccgaggacgtcatggcgcacgagaacctcaaggccaaggtcgaggcattcaactggaacgtcatcgacgtcgaggacgcaaacgacctcgaccaggtgactgccgccctcgagcaggccaaggcctgcaagggcaagccgaccttcatcatcgccaacaccgtcaagggctgcggctccccgatcatggagaacaaggccagctggcaccaccacctgcccaacgcagaggagtgcgagcagatcaagaaggacctggagtcgaggaaggaggcgcttgagaatgcctaacaagatcgcgaacaagaaggtcatctgcgaggtgctctccgagcacgccagggttgacaaggacgtcgtcgtgctgtgcagcgactcgcgcggctcggcctccctcacccccttcttcgaggagttccccaagcagtccgtcgaggtcggcatcgcggagcaggacctcgtgggcatcgcggcgggcctggcggcctgcggcaagaagtcgttcgcggtgtccccggcgtcgttcctctccacccgctcctacgagcagtgcaagatcgactgcgcctactccgacaccaacgtcaagctcatcggcatctccggcggcgtctcgtacggcgcgctcggcatgagccaccacagcgcccaggacatcgccgcgatgtccgccatccccaacatgagggtgtacctccccagcgaccgcttccagaccaggaagctcgtcgaggcgctcctccaggacgacaagtgcgcctacgtgcgcgtcggccgcaacgccgtcgaggacgtgtacacggaggacgactgcccgttcgagatggacaaggcgacgctcgtgcgtgacggaagcgacgtcctcctcgtcgcctgcggcgagatggtcaggccggccgtcgacgcggccgagctgctcgagaaggacggcgtctccgcggcggtgctcgacatgtactgcgtcaagccgctcgaccgcgaggccatcgtcaggcaggcgcgcaaggccaaggccgtcgtctccatcgaggagcacgcgccgtttggcggcctcggctccatggtcgcccaggtcgtgggcgaggagtgcccgcgcacgtgcgtgaccatgtcgctgcccgacgcgccggtcatcacgggcacgtcccgcgaggtgttcgactactacggcctgaacggcgaggggatcgcaaggcgcgccaaggaggcgctcggaaagtagggacgtccgcaggtccaaggcctgctacgtattgcaaggtagggtttcgaggaaagggaagacaatggcaatcactaggcgttcgttcttggagatgtccgcactggcgggaaccaccgctgccctgagcgcgtgcggcggaagctcgagcgacaagaccggctccgactccagcaagtcgagctccagcaagtccagcagcaagaagaccaaggtcctcaagggcggcggctccaagatcatgtacgtcatcaccccctccgtctccaaccccgcgttcaaggctgaggccaacggcgcttccgacgaggccaagaagctgggctacgaggtcaaggccaactcgcacgacgacgacgccaacaagcagtccgagctgttcgactccgccatcgccgacaaggccgcggctatcatctgcgacaacgccggcgccgacgccacggtcgaggccgtcaagaaggccgccaaggctggcatccccacgttcctgatcgatcgtgagatcaccaccaccggcgacgccatcgcgcagatcatcgccgacaacaaccagggcgcctccgacgtcgcccagacgttcgtcgacgcaatgggcgagaagggcaactacgttgagctcctgggcaaggagtccgacaccaacgcctccgtccgcaccaagggcttccactcggtcatcgaccagtacaaggacatgaagatgctcgagcagcagacggccaactgggagcagaccgaggcctacgacaagatggagaccctgatccagacctacggcgacaagatccagggcgtcgtctccggcaacgacacgatgctccagggcgcctgcgcggccctgaccgcccacaacatgaccgtccccgtcatcggcgtcgacggctccgacgaggcacgcgacctcatcaagcagggcaaggccaccgcgacggcactgcagcagttcgacgtcatcgcccgcacggcggtccaagaggccgacaagtacctgaaggacggctcgaccggcgagaaggagaagcagctcatcccctgcatcgtcatcacgaaggacaacgcggacaagctcaacggcttcgtctacaccgagtagcgacagaggaatagcggttttctcgtcaagtggctctgtttgatagcgggggtatggggccgcccatacccccgcgaccgtaaaacgctcatggcagcacgcgtgatcgagcgcgatgcctagataggaggagaaagatgaggaaggggtttctcccggtgctggcaagcgcactcgtggcgggcgccgttgcgctctccggatgcacggtcgtgccgataggccaggaggcaaagtacacgggcgaggtcacgtttgacgccaaggcccagtccaagagcctctggaagaaggtcgagaaccaggtcacgccgaaggcggtcgacatcgggcagctcctcacggacgccgactcgaccggcctgaccaaggacatgaccatcaagaagtacaacggcaagaacatcacgacgtccaagtacgccgccggcaacagcgttgtctacgccgtcaagggcacgggcacggtcaccgaggtcaacgcgaaggtcgccaacaagagcgcgtcgtccaagggcacgatgaccgtccaggtcgacggctacgtgggcagcaagaaggtcgtcatcaacgtcggccccgtcatgaccgacacgtcgcttcgcgactacctcgacatcagcctcaacgactacaaggacacgacgcagtggagcgaggtctcgcaggccatcaacgagtacgcccagaagaacgtcatcgacaaggccgacatcgcgagcctcaagggcaagaagatcagcttcgtcggcgccttcaccgcccagacgggcatgacctccgtgagcatcaccccggtggagatcaaggctgagtaatcgactcgacattaggaaggagatgcatgcacatggcaggatacagctgcccagataacgtcttcctgcatgccgagaagatctcgaagatctacccaggtaccaaggcgctcgacgaggtctcgttcgacctcctcaagggcaaggtgaacgtcctcgtcggcgagaacggcgcaggcaagtcgacgctcatgaagatgatcgccggcatcgagcagccctcgtccggcaagatgtacataggcgaccaggaggtgagcttcaaggacacgaccgaggcccgcaagcacggcatcggcatcatccaccaggagctcagcctgttcccgaacctgaacgtctaccagaacatcttcatgaacaaggagctcaagaagggcgccaagctcgacaacgagcagcacatggcaaaggcgagggcggtcctcgagaagctcgagcaccccatggaccccaacacgatcgtgggaacgctccgcgtcggccagcagcagatggtcgagatcgcgcgcaacctcgtggacgacgacctcaaggtcctcatcatggacgagccgacgtcctcgctctcgcagcaggaggtccaggtcctcttcaagatcatgcgcgagctcacggccggtggcctctcgatcgtctacatctcgcaccgcctcgaggagatcatggagatcggtgaccacgtcacgatcctccgcgacggccgctacgtggacgacgcggacgtcaaggacatcagcatctcctggatcgtccagaagatgacgggcggcgagaagaactaccccaagcgcgaccgcaccgtcgactggtcgaagcagcccaaggtgctcgaggtcaaggacctgtgcctccccaagcccggcggcggctacctcgtcgaccacgtgagcttcgacctcaagaagggcgaggtcctcggcatctacggactcctgggagccggccgctccgaggtcttcgagtgcatcatgggactccaccccgagcacacgggcgaggtcgacatcgagggcaagcccgtccagatcaagagcgtgtcgcagatgatcgacatgggcgtctcgctcatccccgaggaccgtcagggtggcggcctcgtccagacgctcgacatcgagaagaacgcgtcgctcgccgcactcaagcgctacaagaaggggccgttcatcgactccgcgctcgaggacaagaaggtggacgaggagatcgaggacctgcacatcaaggtcgcggacaagcacctgccgattctctcgctctccggcggcaaccagcagaaggtcgtcatcgcgaagggcctgctcaccgagcccaagatcttcctgatggacgagccgagccgcggcatcgacgtcggcgcaaagaccgaggtcttcgagattatcaacaagtacgcgcagcaggggctctcgatcatcgtcatctcttccgagctcgaggagatcatggcaatctccgacaggatcatcgtcctgtcgaacggcaagaagaccggcgagttcgtcggagacgagatcacaaaggatggcctggtcctggcctcgtacaagggccaccacacggcaaacaacaagcaggagggtaagtaaccatggcagcggatacaaagaagggctcgggcggcaacaaccagctgttgatgacgctgctcaagggtcgtacactcatcgtcctcgcaattctcttcgttttcttcagctgtgcggcgccgaacttcttcaacgtcaactcgcttctgtccgtggcaaagcacgtcgcgctcttcggcatcctcgccatcggcatgacctacgtcatcatcacgggtggcatcgacctttccgtcggcgcggtcgtcggcttctgcggcatgatcgccggcggcttcctgcaggaggggctcacgctccccatgttcggggtcaccatctacatgtccgtgccggtcgtcgtgattgtcacgctcctcatcggcatcctgctcggcgtcgtcaacggcctcatcatcaccaagctcggcgtcacgccgttcatcgccaccctgggcaccatgtacgtgtggcgtggcttcgcgaacatccgctccaacggcgcgacgttcaacgatattgccggcaaggccggtctcggcaaccaaggcttcacgttcttcggctccagcctcggcatcatcccgatgggcgtcatcatcctcgtcatcttcgccatcatcgcgggcctcgtgctcaacaagacggccttcggctggcacgtgctcgccatcggcggcaacaccaacgcggcgcgcctctctggcatcaaggtcgataagagcctcatcatcgtctacgcgatctccggcttctgctccgcaatggtcggcatcatcacgaccgctcagctcatggcagcgcaccccgcgaccggtgagtcctgggagatgaacgccatcgcggcatccgtcctgggcggcacgtcgatggcaggcggcgtcggaaccatcgtcggcaccatcgagggcgccttcgtcatcggcgtcatcaacgacggcatgacgatgatgggcgtcaccgagttctggcagcaggtcatccgcggcctcgtgatcatcatcgcagtcgtgatcgaccaggtgcagcgcaacatccaggcgcgcatggcactgcaggccaggaacgagtcgaagagcgaggacaaggcagccgcggcgacggcctagcgtccggttcgatcagactcgcaccacacagactcacggacgggggtgtcgcacgtcgcctaggcggccaggcggcacccccgcttgctttggaaggaagccaaccatgaagaagagcggaatcatcaacgcgcagctcgcgggcctgctcgcaggcctcggccacaaggacacgtacatgatcgccgacgcgggcatgcccatccccaagggcgtcgagatcgttgacctcgccgtggtgggcggcgtcccgaccttcaggcaggtcatggacgccgtcgcggacgagtgcgtcttcgagcactacacgctcgcggaggagatcaaggaggccaacccggagctgcacgcctacatccaggagcggctcgccggcgtggagcacgactacgtgccgcacgttgacctcaagaaggccgaggccaactgcaagttcgtcatcaggacgggtgagttctcgccgtacccgaacgtgctgctcaccgcggcctgcgcgttctagggggcaggcatggcggcatacgtattgggcatcgaccagagcacgcaggggaccaaggcgctgctctttgacgagaagggcgttcttctcgcccgcgcggaccgtgcccaccggcagatcgtgaacgacctgggctgggtcgagcacgacccggaggagatctacgcgaacgtggtcgcgagcgtggcggacgtggtggagaaggccggcatcgaccgggccgacatcgcgtgcgtgggcatatcgaaccagcgcgagacctcgctcgtgtgggacgcggacggacggcccgtgcacaacgccatcgtgtggcaggacgcgcgcgcgaccgacgtgtgcgagcgcgtgcgcgcggcgggcgccgcggacctcgtgcgcgagcggagcggcatcaacctgtcgccgtacttcccggcggcgaagctcgcgtggatccgcgagaacgtggacggcgtggccgagggcctcgcgggcggcggcatgcggctgggtacggtggacgcgtaccttgtgtaccggctgacgcacggcgcgtcgtataggacggacttctccaacgcgtcgcgcacgcagctgttcgacatcgacagcctgcgctgggacgaggacctgtgcgccgcctttggcatccccgtggccgcgcttcccgaggtgagcgactctgactccgactttggcatgacggacttcgagggcttcctgccgaggcccatccccatccacggcgtgctgggcgactcgcacggcgcgctcctggggcaggggtgcctgcgccccggcatggtcaaggcgacgtacggcaccggctcctccgtcatgatgaacgtgggggagaagcgcgtgacctctgggcatgggctcgtgtcgtccctggcgtggaagctgggcggcaccgtggagtacgtgctcgagggcaacgtcaactactccggcgcggtcatatcgtggctcaagaacgacctgcggctgatcgacgaccccggcgagaccgacgccctggcgcgctccgcgaacgaggcggaccgcacctacgtggtgccggcattcacggggctgggcgcgccgtactgggactccgacgcggtgggcgtggtctacggcatgacgcgcacgacgcggcgcgcggagctggtgcgcgcggcgctcgacggcatcggctaccagataaccgacgtgctgcgcgccatggaggcggactcgggcgtgcgcctgggcgagctccgcgtggacggcggccccacgcacaacggctacctcatgcagttccagagcgacgtggcccgcgtgccggtggccgtgtcccccacggaggagctttccggcatgggcgccgcgtacgccgcgggcagcggcatgggcatctacgacgtgccaagcctcgtggcgggcgtggagcgcaaggtgtacgagcccgagcgcgacgaggcctgggcgcgcacgaagtatgatgggtggaagcacgccgtatcgaaggcactgtcggacgaggggacgggtgatcgctcgtgaggatcctggactttggctcgctcaacatcgactacgtgtaccaggtggaccacatggttcgccccggcgagacgctggccgcggggcggcgcgacgtctttccgggcggcaagggcctgaaccaggccgtggcctgcgcccgcgcgggtgcggaggtgtggcaggcgggcatggtcggccccgagggcgacctgctgctggacgtctgcaagaaggccggcgtcaacacggacctggttgccaggacggacgtggcgaccggccacaccgtgatccaggtcgataggggcggccagaactgcatcctgctgtacggcggcgcaaaccgccagatcgacgaggcctatgccgacgacgtgctcgcgcacttctcgcccggcgactacgtgatcctgcagaacgagatatcgtgcctgccgcacatcgtggacgaggcggcacgccgcgggctcaaggtgatcctgaacccgtcgccctacaacgacgcgctcgacgccgtggacatgtccaaggtgtcgctcttcctgctgaacgaggtcgagggcgcgcaggtctccggcggctcgaccgaccccgacgagatcctcgcgcgcctgggcgagaagtacccggacagcgcggtcgtgctcacgctcgggtcggcgggctcgcgctaccagaagggtgcggagcgccacgagcagggcatctaccacgtgaaggccgtggacaccacggccgccggcgacacgtttaccggctacttcgtgtgggccatgagcgtgggcaagcccgtgccggaggcgctcgacctcgcggcgcgcgcctcggccatcgccgtcacgcgcgcgggcgccgtgccctccatccccacgatggacgaggtgcttgccgccaagctgtagccgcacgccctggccgcaccaacaggtcctcccgccgcgcgccgcctcccatggcgcgcggcgaaaccctcatagcgctcgcccagcctctcgtcctcagcgacgagctgggcgagcgttcgtgcgacgcccgactccgtgttggaccacgcgcacacgtgtgtggcggcgcgcttgacggcgtcctccgcgtgcggcatcacgtaggactggcccacggcgcccagcatgtccaggtcgttggggccgtcgccaaaggccacggcgtcggcggggtccacgccaaagtgccggcacagcagcctcacggcgtggctcttgctcacgcccttggccatgacctcgcacaggatggggctgctgcgcacgacggtgaggttggggtagcgcgcggacacggtggcctctgcggaaaggatcgcgtccggctcgcccatgagcaggaacttgtggatgccgcgctcgccaaaggtgcccgccaggtcgcgactctgggtggcctggacctccacgaagtactcctcctgcgtgacggcggggtcgcttgcgtcgtccacgatccacttgtcgaacccgtacgtgcccgtcactacgccgggcaggtcgtgctcgaggtacgccttgacctcgagcgcgacgtcgagcgggatggtcttgctgtagagctcgtcgcccttctcgtccagcacgtacgcgcccgagaacgcggcgatggggcccgtgatgcccaggtcgcgctgcagggcgcggatgcccccgggcaggcggccggacaccaggcagagggggatgtgctgcgtcacgcactgcaggatgggcgcgtcgctggggatggcgtggtgctcgtcgtccgtgatggtcaggtccacgtcgctaaaggcgatcttgatgctcatgggtgctccttccgctcgccctgtctggccacagcatggcacgacgcggcccgcgcgcgccgtacgtcgcgaatttgccccaaatgtatggtaggtatgatacattaaggacacacgcggcggcatcggtcggcgcgtggcaaggggcaagacgggggagaagaacgtggacccactcaggaccatctgtgcggagccgctggaccaggcgtccggcgtgcccctgtaccagcagctcaagctcaggatcatgggactcatcgcgtcgcactcgatcgacgaggccacgccgctgccgccggagtcgcgaatctgcgaggagctgggcctctcgcgctccacggtcaggcgctgcttccaggacctggtggaggagggtcgcgtggtcaggcgccgcggcaagggcacgttcgtcgcgcgctaccagctgggtgccacgagtgacgtcgccatgaacttctccgcacgcgtggaggcgctcgggaaggtgcccacgtccaagatcctctcgtttaggcaggtgcctgccaccggcacgctgcgcgagcgtctgcgtctggcggagggcgagccggtgtgggaggtgcggcgcctgcgcctggcggacggcgtgcccatggagaccaacaaggcctgcgtgcccgtgcgcttctgccccgggctcacgcgggagcggctctcgcgctcgctttactccagcatcgcggaggactcggggctccttcccgcctacgaggacgcctacgtggacgctatcgtgctcgactcggccgaggccaaggccctgggccagcgccgcggcgcgccggccatgcgcgtggtccgcaccacgttcgacgcgcagatggtcccgttcgaggtcgcggtgctcgtgcgcagggcggacgccaaccgcctgcacctgcgcctggggccggagggctctacggtggcgctcgagaacagctgagcccacggcgcgccggcgggcgaggcggccgtccttctcgcccgcgtacactagatagagtccgcaatacgaagggacccctcccgctgcgtgagcggaaggggtcccggtcgctagagcatgtccaggcatgcgcctggctgcgccgcactgcttacatgtgatcgtggcaggtgcgcgcgatgacgtcgagctgctgctcgcgggtcaggtcgatgaacttgaccgcgtagccagagacgcggatcgtgaagttggcgtactcgggcttctcggggtgctccatggcgtccttgagcttctccacgccaaagacgttgacgttgaggtggtgcgccccgcgcgagaagtacccgtcaagcacgttgaccaggttggccttgcgctggtcctcgtcgttgccgagggcgccggggttgatggtctgcgtgttggagatgccgtcgagcgcgtactcgtagggcagcttcgccacggagttgaggctcgcgaggaggccgttcttctcagccccgtaggaggggttcgcgccgggcgagaagggcgtgtatgccgggcgcccgtcgggcagcgcgcccgtggccttgccgtacacgacgttggacgtgatggtgaggatggacgtggtgggctcggagttgcggtaggtgtggtgcttgcggaccttggtcatgaaggtcttgagcagccacacggcgatgtcgtccgcgcggtcgtcgtcgttgccgtagcgggggaagtcgccctcgaccttgtagtccacgacgcagccgctctcgtcgcgcacggtgcggacgcgggcgtacttgatggcggaaagcgagtcgaccacgtggctgaagcccgcgatgcccgttgcgaaggtgcggcggacgtcggtgtcgatgagggccatctccgcggcctcgtagtagtacttgtcgtgcatgtactggatgaggttgaggatgttgacgtagaggccggccagccagtccatcatgatgtcgaacttgtgcatgacctcgtcgtagtcgaggtactcgctcgtgatcggggcgagctcggggccgacctgcatgtggttgccctgcttgtcgtcgaacttggtgtccttgccgccgttgatggcgtagttcaggcacttggcgaggttggcgcgggcgccgaagaactgcatctccttgccggtctgggtcgcgctgacgcagcagcagatgctgtagtcgtcaccccagacgggacgcatgacgtcgtcgttctcgtactggatggacgaggtgtccacggagatcttggcggcgtacagacggaaggccttgggcaggcgcttggagtacagcaccgtcaggttgggctcgggcgccggacccatgttctcgagcgtgtgcaggaagcggaagtcgttcttggtcaccatggcgcggccgtcctggccgaggcccgcgacctcgagcgtcgcccagacggggtcaccggagaagagctcgttgtagctggggatgcgcgcgaacttgaccatgcggaacttgaggaccatgtggtccacgagctcctgtgcctcggactcggtgatcttgccggccttgaggtcacgttccacgtagatgtcgaggaacgtggagatgcggccgacggacatggcggcgccgttctgggtcttgatggcggccaggtagccaaagtagagccactggaacgcctcgtgtgcgtcggtggcgggcctgctgatgtcgtatccgtaggtggcggccatctgcttcatgcccttgagggcgcggatctgctccgcaatctcctcgcgcaggcggatgacgtcgtcggtcatggtgccgtcgccgcagttgagcaggtcctcctgcttcttctggatcaggtagtcgatgccgtagagcgccacgcggcggtagtcgcccacgatgcggccgcggccgtaggtgtcgggcaggccggtgatcacgtggctgtggcgggcggcgcgcatctcgggcgtgtaggcgtcaaacacggcctggttgtgcgtcttgtggtactcgttgaagatctggtcgtacttggggttgatcttgtagccgtagctctccgccgcctgctgcgccatcttgatgccgccatagggcatgaacgcgcgcttgaggggcttgtcggtctgcaggccgacgaccttctccaggtccttgagctcggggtcgatgtagccggggccgtacgcggtgaggccgctcacgacctcggtctcgcagtcgagcacgccgccgttggcgcgctcctgggcctgtagctcctgcaccttgccccacagcttgtccgtggcctcggtcgggcctgccaggaacgactcgtcgccgtcgtagggggtgtagttctgctggatgaagtcgcgcacgttcacgtcagacgtccagtgacctcccttgaagccctcccactccttaacgtcctgcatttctcctcgctttccggcggcagcgccgccctcgcatgttgcttcctatctggtctgcagtctctgcaggtggtaccaaggtgaacgtcgcggcgctagccctcg

SEQ ID NO: 123 - DNA, 28650 bp, Unknown
  Metagenome-assembled genome
gccgcggcggagctgcgcgtcgagctgctgggctcgacggaccacttcagctgcatgctgtacccggagcgcgacggcgcctttgacgtgcgcgacttccagtacctgtacaacctgtccgcctggccgcgcgtgtggtgcggcgtgcggctgctgcgcggcgtcgaggccgacatcgtggacctggacggccacctgtttggctgggacagccccatcacggaggagataaacggccatccgctgcccgcgtccaccacgctcaaggaccgcgtgtttggcaagatcgactacgcgatagcgagcatccacgacgactcgtttgctgacggcgcaagcctcgcgcagacaactgcctgctacgtgcacgcgctggaggaccccaaggtgctgatccttgggcacacgggccgctcgggcgtgccgtttgacgtggacgaggtcctctccgtcgcaaaggagaagggcaagctgatcgagataaacgaggccacgctcgcaaggcatccgcaagccgtgggccagtgccagaagattgccgagcgctgcgctgagatgggcgtcatggtctccacggggacggacgcgcacatatcgcagtccgtgggcagggtcgaccacgtgcgcgagatgctcgagcgcatccactttcctcagaagctcgtggcgacgcgcgacgcccagacgttcctgggcgtactggagcgcgccgtcggcaagccaaagggaatgtagcgggagctggcgctgcggtcgcacccgtcgctggcgccgcgcgacctgcggctagatctggatcgtcagccccacggggcagtggtccgaccccatcacgtcgctcatgatcttggtgtcgcgcacgcggtcaaaggcgcggtcgctcaccaggaagtagtcgatgcgccagccggcgttccgggcgcgggcgcgcatgcggtagctccaccagctgtaggcgccctcgagcgtggggttctgcgcgcggaaggtgtccgtaaagccagcgtcaagaagcttgccaaagctctcgcgctcctcgtcggaaaatcccgcgttctggtggttggtgtccgggttcttgaggtcgatctcctcgtgcgccacgttgaagtcgccgcaggtcacgaccggcttctgctggtcgagctcgcccaggaactcgcggaagcgcgcgtcccactgcatgcgctcgtccaggcgcgcgagcccttgcttggagttgggcgtgtacacgtccacaaaccagaacgtggggaactcgagcgcgcacacgcggccctcgtcgtcggccacggggctgccgatcttgcggacgacgctcaggggcgcctcgcgcgagaagaccgcggtgccggagtagcccttgcgctcggcgtagctccacgtctgcgtgtagccggggaggtcgagctcgacctggccctcctgcagcttggtctcctgcagggcgaacacgtccgcgtccagctgcgcaaacacgtcctggaagctcggctccttcttcatgacggcgcgcaggccgttcacgttccacgacacgagcgaaagctcgcggccctcgccggcggtctctgcgttgggcatgcgttcttctcccttgggtagtcgctctcttgctcttttctgcgcacgcacggcctgcggcgggcgtggcgcgggcggctaggcctccgcgtcggccttccagttggggtccccaaacaggaactccttgtaggaggccatgtcgcgcagcgcctgggcgtggcccagcgcgtacgccgtcttgagcgcggtgcggtccgtggtggtgctggccacgggcatcatgtccgggcgcacgaccatgcagcggccctcgcgctccatctgctcgatgcggtcgagctccgcgttgtagcgctcccagcggttgaggagctcgtgcttgaggtaggggtacttgcgggccagcgtcgtgatggcctggcgcttgcgctccgtgggcggctccttgcggtagcctgccggtcgcgtggccaccaggaagaacttcttgtagccggcgacttccgccatgtgcacgggtaggccggcgccctccgcgatgccgccgtccaggtacgtgacgccgttgatgggctcgggcttcatgagcagcggcagcgtggagctcgcgcgcacgcacgccatcaggtcgcgcagcgtgggcatgtcctcgcgcgtgaagatgcgggtccggccggtctccagctcgaaggcctcgaccgatacgccggcggggtttgcctggaagacgtcccagtcaaaggggagggtgccgtcgtccacgcagccctcgtacaggtagtccgcgtcaaagtagcgcttgccgcgcagcagcgagcccaggccggccgcggggtgcctgccgttcttgaggcccaagaaggcgcggcgcacgcggtcctggtcgcggctcacgtagtctaccgtgtggcttgcgccggcggatatgccgcacacaaagtcaaagtggatgccctcctcaagaagggcgttggcgatgccgccggtgtaggcggcgcggtatccgccgccctcgaagcagagcgcgcagtcgagcacgttgttggtgagtggtgccatgtgtcctgccttacatagattgcacgtggtaacaaacttacccgtttgtcggcatgctagaccacgcgcgcggcgtcccaacaccaaagtgctaccgtaagagtgaccttaggaggctggcatgggcaagacgatcacggatccggcggaggccgcccaagagctcagggggctcttcgacgcgtccacgcacgcggtgttctttggaggggccggagtttccacggcgagcgggatcccggacttccgaagcgagaacggcctgtacaaccagcacttctcgtccaagtactccccggaggagctgctgagccaccacctgtggcgcgaggaccccgaggccttctacgacttctatcgcaagatgatgtgcgcgccggaggccaagcccaaccaggcgcacctaaagcttgccgagctggagcgcgacggcaagctcgacgccgtggtgacccagaacatcgacggcctgcaccaggcggccggctccaagaacgtgatcgagctccacggctccacgcaccgcaactactgcgtcaggtgcggcgcggagtactcggaggagtggatgctccagaccacgggcgtgccgcattgccccaggtgcggcggcgtcgtgaagcccgacgtggtcctgtacgaggagcccctggacgagaagaacataaccaacgcgatcgaggccatcagccgggccgacctcctggtcataggcgggacgtcacttgtggtgtaccccgcggccgggctcatccagtacttctcgggcgaccacctcgtgatcgtgaacctgcagcccacggggcaggactccgcggccgacgtggtttgtgcctgtgacatcgcaaaggcgttcgactggtagggtgcaagcggctacaatcttttagaacactccggggctgccgccgtggcgcggttgccccttgacccatctggaaggtgcgctccatgcttcgtgaggactactccatctggcgttgcggccggcacgagatctcgctggctcgcccgcgcgtcatgggcatcctgaacgtcaccccggactcctttagcgatggtggggagaacatcgaccccgcgaaggcggtcgatcgcgcactgcagatgatggacgagggcgcggacattattgacgtgggcggcgaatccacccgcccgggccacaagccggtctcccccgaggaggaggcgcaccgcatcgtgccggtgatccgcggcatcatggcgaaggcgcccacggccatcatctccgtcgacacgcgccacgccgccgtcgccaaggtgtgcctgcggctgggcgtgtcgatcctgaacgacgtcacgggctttacggacccggccatggtgcaggtcgccgcggaaagcgactgcggctgcatcgtgatgcactggaacaagctggccggcacgagcagccgccgcatggtgcagctggacacggagcgacccctgcgcaacaggcgccccgtccccaccagcacgcgccgctttaccctgccggagaccgcgcccatcatgcgcgaggtcatgggcttcctgggcgaccaggcgcgactgctcatgcgcgccggcatcgaccacgaccgcatctgcatcgacccgggccccggttttgacaagacctacgaccaggacgtggtgatccagcgcgagacgcgcaagctcgtgagcatgggctatcccgtgctgaacgccgtctcgcgcaagcgctttgtgggcgccgtgtccggcgcggaggacgccaaggaccgcgactttgccacggcgggcatcgcgctcgcggcggtggagagcggcgcgcgcgtgctgcgcgtgcacgacgtggccggcgtgacgcaggcgctcaacacgtactggtccgtcaccaagaacgacccgcggcagggcttcgtctccattggctccaacgtgggcgaccggctggccaacctctcgcaggccgtgcggctcatgaaccagatccccatgacctgcgtggtccaggcgagccacgcctacgagaccgagcccgcctacggcatcgagaccaacgtcgttaacgctgtggtcgagatcaggaccgagctggcacccatcgttcttatcgaccagctgcttgacatcgagcggcagctcaagcgcgtgcgcgacccgcgccttgcgggccacggcccccgcaccatcgactgcgacctctgtttcatcgaggacgagcaacacgccggccccaagctcacgctgccgcacccgcacctgggcgagcgcgactacgtgctggttcctatggaggacctcatgcacgacccggtgcgctacctcatgcacgccggcgtgcccgtgtacgcccccgaggaccgcgtgggtcacgtggtggccgaggcaggcgagctggattggcagtagggaaggacgcgaacgagccgctggcgcgcgcgaccgtgcgcccggacgtccccatgcagatgtacacctgccttccgcaggtgctggccctgggcctggcgcgctcgctgggcgagaggggcgttggcgacgcgcgcgtgagctggccggcatccgtgagcgtgggcggcacgccagtcctgcgcgttgacgtgcgcgccggctacgacgagggcatgtacgcggcctgcgaggtcgccgcgctcgagggggccgaggcgcttccggacctggtggacgaggccatgcttgcggccgcgctcgaggaggccgccggctcgtgggaggcgtcgcttcgcgcggcacacgtggtggccgggcccctggcgccgctgctggacgagtactttgaccgcctggactgcgcaaaccaggaggtcgaggttgtctatcccaacggccgcgtcgcgacgcgcggcgtgctggccgggatggacgtgtggggtcgcgccgccgtgcggtgcgagtctggccgcgagctcaacatctcgcccgagcaggcgatcatcaggccggcccgcgggtagcgggactggcggcgctggcggcaagggcccgtcgggcgggcctgttggagttgattcgggcgacttgcaactgcgggggacttttgtgtgtttctcgagtggatcgaggctctggaccaggcggaaaagacgcaaaagtctgtcacatgtgccaggacggagcgcttttgtgtgtttgcgagaccagcaagccgccgtgcgaagccattttaataagatattgaactaagaaacacacaaaagcccctgcgaattgcagcggggccaaatgttctgcccaacagggcgtgcactcggcgccgaacggactacccgttgatgtcgcgctgcctgcgggcggcgcgcttctcgttgcgatgccgccagatgagctggatgccgcggacggtcaggtcggggtcgatcacgtcgaacacgtccgtcgcgccggccacgatgtccgcaaagccgccggtgccaacgacggtcgcgtcgggcgcgccgatctcgcgcttgatgcggctgaccaggccctccgcctgagcggccgcgccgattacgatgccggactggaccgccgtctccgtcgtgtcgcccagggcgtgcggcggcaccacgagcggcacgctcgaaagcttggccgcgcgcgagaagagcgccctcgcggacgagagcacgccgggcatgatggccccgccgcggaaggcgccgcgggcgtccaccacgtcgatgttggtcgcggtcccaaagtccaccacgatcacgggcgcgccgtagcgctcccgcgcggaaaccgcgttcgcgatgcggtccgagcccacctggtgcgggtccggcatgtcgatggggatgccgcagtcgcgcgtggcgtccaccagcagcacgtcctccgccatgagcaggtgcgacatcatgtactgccactcctgcgacaggatgggcaccacgctcgcgatggcgacgtccgtcacgctgccaaggtcgaggccaaacatgacaaagtaaccaaacaggcgcgcgtgcagctcgtcggccgtgtccgtgtggtccgtggccatgcgccactggcggcgcagggtcccgtcctcgtcaaacaggccgagcgtggtctgggtgtttccaacgtctacggtaaggagcatgatggccttcccggggtggtcgtggcgtgtcaaggcctaagtctacccgcagcgcgtggcggcctgtgccacaaccgccatttgttctccacaacaacggcggcaggaatctgctacactcctatagcttgacgccctgaatagaaaccagggctaccatcctcgcctggtcggaaaccaggcctaccaaaggagtcccacatgaagcaaggcatccatcctaagtacgtggagtgcaccgtccgctgcacctgcggcaacacctgggtcacccgctccaccaagagcgagatgaccatcgacctgtgcgacaagtgccacccgttctacacgggccagcagaagctcgtcgacaccggcggccgcgtccagcgcttcgccaacaagtttggtggtgccgctgccgcccagctcaagaaggccgaggaggccaaggccgccaaggctgcgaaggccgccgagcaggctgccgcaaagaaggccgccaaggaggccaaggctgccgagaaggccaagcgtgccgcagagtacgccaagaaggccgaggctgaggctgccaagcaggccgccaaggccgctgccgaggccgaggctgccgcggagaccgtcgaggccgccgctgacgccgccgacgcggaggcgcccgctgccgagtaggctcgcggacgtggtgcgcacgccgcgcatcgcaccatagcaagtcaagggggaggtcgacttcggtcggcctcccccttgcgttagggccaattcgtcgcggggccgcaggatcccgcgggtaagaagggcccccgggcgagaagaacgtcccgcccacctgcgcggcccgctgcgcccgctacaccagacgcaggtgcgggtgtgatcccccgtccttctcgcccgcgtcctcttcctcctttgcggctgcctttgcctcgcgcatgagctggacgccctcctcgaggtagttcgtgtcgtcctcgcgagccgacgcctcggcctccgtctcgtagcggtaggtgacgtcgcactcgtccagcaccatgcgcagcgccttgttgcggcgcgccgtcgcgcgcagctcggcgtagttgccggccgcgcgggcctccgcctcgatccggtccgcctcgcgctcggacacgccaagcaggctgggcagctcctcaaacgagacgtggaccatgcggtgctgcacaagcgcgtccagcgcggcggactcctcggccgtctgctgcgcctcgcggtcgaacattgcgtttagctgctcctcgtccgcggccgtgctttcgagcagcccctccagcgagtggccgtcgtcgcgcaggcgctgcaggaaatccgcgcgcaggttgtggcgggcgcgcgccacctcggccttggtgacggactgctccaggcgcttggcgagctcgcgcacgcagagcgtggggagctcctcgcgcgcgagcttggcgttgttgtctgacacaaagctgcgcatcatgatgcgcagctcgtcggcgctgtccatgtcaaagttgcgcttgacccacgcggggtccttcaggctctccattgtgccgccgcgcgtctggcaggcaagctcgagcgcaaactccacgtcctgcctggtggtgtaggggatggtgatcgtgacgctcacgggctcgtacgagctgagcgtgtagaaaggcttgccgtccaccaaaaacggcttgggcttgggcctctgtggcattggccttctcctttgcgttgtctgcgggcgcgtgtgcgctcgcggcgtggttttccctaggataccccgcacggcccgcatgcccaacccgcccatgccgacgccgcggcccgtccacagagccggccgccgcgcgcggcccgcgcatgggtacaatgcccgtgccaacgggggacgggaggctcgacatggcacaggtacaggacgcaggcgcgggcacggcggcgggcgcggcggctgccgcgatcgcgggcgcggccgcgcaggcaagtgcaagcccggcgtgcatgaggacggacctgctcatcatcggcgccggcccggcgggcatcttcacggcgctgggcctgctgcgcaagggcgacggccgttccatcaccatcgtggagaagggcctgcccatcgagcggcggcactgccccaaggagcaggtcggccactgcgtgggatgcgatccctgccggatcaccacgggcttctcgggcgcgggcgcctttagcgacggcaagctgtcgctttcgcacgaggtaggcggcgacttgccggagcttgtgggcgcggacctggtgcaggccaccatcgagcgcgcggacggcatctacctggagctgggcgcggacccgcacgtggagggcgtgggccagcgcggccgcgtggcggacatccggcgccgcgccatccaggcgggcctcaagctcgtggactgccccatccgtcacctggggacggagcgcgcgcagcagatatacggaagaatcgagcgcctgctgcttgacgcgggcgtcaacatcctcttcgagcacgagtgcctggaggtgctggtggagggcgagaagtgcctgggcgcggtcgtggcgcccacgggacgcccgcaggaccagacccgcatcctggcggcggagaccgtggtcgccacgggccggcgcggcgcgctctggtttgacgagatgtgcaccgagcacggcatcagccacgcgcccggccccgttgacctgggcgttcgtgttgaggtccgcaacgaggtgatggaggacgtcaacaacgtgctgtacgagtccaagctcgtgggctacccgccgcccttccgcaacaaggtgcgcacgttctgccagaaccccggcggctttgtgagccaggagaactatgacggcggccttgcggtggtgaacggccactcgtacaaggagcgcaagagccccaacaccaacctggctgtgcttgtgtcatttaactttcgcgagccgttccacgagcccatcgcctacgcgcagaacgtgggccgcctcatgaacatgctgggtgccggccacatcctggtgcagcgctttggcgacgtgctggacggcaagcgcacgtggcccaaggagctgggccgctccaacgtggtgcccacgctgcccgacgcggaggccggcgacatcacggcggccatgccgtaccgtgccatgtgcgagatcgtggagttcatgaaggccgtggacaaggtcgtgcccggctttgccgcggacgagacgctgctctacgcgccggagctcaagttctacagcaaccgcgtggcgatggacgcccacctcaacaccaacgtcgcgcacctgcactgcctgggcgactcctccggctggacgcgcggcctcatgatgtcgagcgtgatgggcctgctcatggcggacgagcttacctcgcgagcgtgaacacgtccgtgtacgtggacgtggcgtcgtacgggatgagcaggaacgactcctgctccgtgtgcgtgcacgtcacgcgcgcgacggcgcgggtggcgtcgtcgccgctgccaaagcccagctgcaccacgatggtgccctggctgtcgtcgggcgtcgtgagcttgaaggcgtaggtgctgtccgtggggtcgtccttctcgcccacgcgcgtgccctcaaacgtgacgcccgagagctgctggtcgccgtcggaggagtccacgtccgagtccggctccgtgtggtagtgtgccacgcagccaagcgtgccggtcaggcgcttggagtccttggagacggtttcgatgttgatggtgagcgtctgcccctgcgcgccatagcagcgcttgctggaggcctcctggctctggaacgtgccggcccacgtgccctcgagcgaggccaggctgagcctgcgcgcgccggagcttgcacttgcctttgcgagctcccacgagccgctcgccgcagcaaagtcaaagcgcgcggtcacggtgcacgagcgtgtggcgtagcccttggactcgctcaggcgcagcgtcacggtctgcgtctgcctcttgcggtcgaacttcgtcttgctgacctcaagctttgcgtccttgtagagcgacgcgagcgactccgcggaggggctcgagctgcctgctgcgtccgcccgcgccaggatcgcgcccacgcccgcgcggatgcgcgaggtgcctacgcccgtggtggccgcgtaggagacggtcccactcttgcgggtggattccggcagccagttgcccttggtgtcgcgcacgtacgtgagacgcacgggcaccgtggccgtcacggaaccgttggagtacctgatgcgcgccagcgcggtaaccgtaccgtttttgatgctgacgctctggccggaggcggacttggccaccagggcctccgtgctgtcgaaggcgcctgccttgtgcgtgagctcgggcgcgttggccagggcgtcacgcctcaccttgcccaggctggggaggtgctggtccagcgcgcccgaagccagcgtgatgacgatggcgagaaggaccacccccgcggccacgcacgccgttgccacgcggtgggcgcgcacggttgcagctagctgccgcagtgcgtgggcggcggggttgccgtccgcatcggcggccgcggccttgggcgaggtgccgccctggtcggcgccgccgggggagggggcgttcttctcgcccgcggccgcgcctgcgacctcgccctcgcggggcagctcccgcggttgcggccgccttgcggtttgctgcgccgtgggctggctgtccatgtgcgtggtcggggcgtcctgcgtggagtccgcgtccgcgccggagtctgcggccgagcctgcgcccggcaggtcctgcgtggtgcccgcctcgccctgcgtgccgtctggcttgcgcttgtctgccatgtgcccccgcccgtcgcgcccgcgtgttcgtgtttgtgggaacagtttctcacagttggctgccgcgcgcggggaggctgggccgcctgccgccgcctgccgtcgccccgtgtacggcgtgtgcattgccacctgcgcgaatagaagtcgcgcgtaggtggtatcctcactacgctgaacacttctgtcgcgctacgccgcgcccccgcgccgcgccgcgaccacccaagggagagaaagatgcgagagaagctcgaaaggctcatcgcggcgtacgcggagctggaaaagaagatgatggacccctccgtcgtgggcgaccccaaggagtacgcccgcgtcgcgaaggagcacgcaagccaggccgagctcgtggccaaggctaaggagtacctgcaggcgcttgacgacatcgaggccgcgcgcgagatgctgcatgaggccgacgccgacgagaaggagatgctgcaggaggatatcgaggccaacgagcagaaggtccccggcctcgaggaggagatcaagtacctgctgatccccgcggaccccaacgacgagaagaacaccatcgtggagatccgcgccggcgtcggcggcgacgaggcggccatcttcgcgggcgacctgtacagcatgtacgagcgctttgccacgagccgcggctggaagatcgaggtgctttcctccagccccggcgaggcgggcggcttcaagaccatcgagttcaaggtcacgggcgagaaggtctactccgtgatgaagttcgagtccggcgtgcaccgcgtccagcgcatccccaagacggagtcgcagggccgcatccagacgtcgacggccacggtggccgtgctgcccgaggccgaggacatcgacatcgagataaaggacgaggacctgcgcgtggacacctactgcgcgtccggccccggcggccagggcgtcaacaccacgtactccgccgtacgcatcacgcaccttcccacgggcatcgtggtgcagtcgcaggaccagcgctcccagatccagaaccgcgcggtctgcatggagatgctgcgcgcccgcctgtaccagatcgagctggagcgccagcaggccgagcagggcgcccagcgcctgagccagatcggccacggcaaccgctccgagaagatccgcacgtacaaccagccgcaggaccgcgtgacggaccaccgcatcggcttcaacagcacgtacaccggcgtgctgcagggcgacaagctgggcgaggttatcgaggcgctcgccgcggcggagcgcgcggagaagctcgcgcagtccgtctgatgccgtgacgggcagctgccttgcgcgggcccgcgtacttctcgcccgtggcttgcagttgcctttgcccagttcacacaacgtgcacgcaggcgcgtccttcgcggtggcgggggacgcgccttgtcgtagaatggcgcggtaccggacggtgtggcgcaggaggtgccatggcggagcaacagacgtggaccatacagaggatgctcgactggacgatcggctacctcacccgcaagggtgacgagcgaccgcgcctttcggcggagtggatgctggggtccgtcacggggctcacgcgcgtgcagatatataccagcttcgaccggccgctgtcgcaggaggagctccagcgcatgcacgacgcggtggtgcgccgcggcacgggcgccccgctgcagtacatcacgggcgagatgcccttccgccacatcgtcctgcgctgcgaggagggcgtgctcatcccgcggcccgagacggaggtcctggtggacgcggcgctcgagggcgtggacgcggcgcgcgcgtgcgggcgagaagcccgtgtgctcgaggtcggcaccggtacgggatgcatcgcctgctccatcgcgagcgagcggcgcggcacgcacgtggtggcgacggacatttccgagcgcgcggcgtccctggcggagcgcaaccgcgacgccctggggctcgacggcgcggtggatgtggtccgctgcgacctggcggcaggcgtggacccgcagtacatgggcgcgtttgacgtgctcgtttccaacccgccctacatcccctcagacgtggtgcccacgctccccgcggaggtcgaggcgcacgagccgcacctggcgctcgacggcgggccggacgggctcgacgtgttccgccggctgctggggcttgcgccgcgggcgctccgcccgggcggcatgctctgcgtggagctgttcgagaccaacgtcaacacggccgcggacctctgccgcgagcagggcggctgggcctcggtcgaggtgcgccaggacctcacgcacaggccgcgcgtgctggtggccgtgcgcgagggcgaccttgcacagggcataggggatgagcgcgagcgcgagctctcgcaaagggagaaggtcatccacgtgaaccaggccgcgcccgacgcggcggccgtcaggcgcggggcgaacgtccttctcgccggaggggtcgtcgtggtgcccacggactccgtgtacggcatcgggtgtgcggccacgccgcacaacccggggctcggtcgcacgtttgccatcaagcggcgcgaccttgcgcagacgctgccgtggctcgtggcggacgcggaggacctggagcgcttcggtcgcgacgtgccgctgtgggccgtcgccctggcacagcggttctggccgggcgcgctcacgctcgtggtcaaggccgcgcccaccgtgccggcggagtacgtgcgcagctcggacggcaccattgcgctcaggctgccggattccaacctcgtgcgcgcgctcgcgcggcgcgtgggctgcccgctcgccatcacgagcgccaacacgcacggcgcgccctcggccacgtccggcgccggggtggaggagcgcatcgtggcggaggcggacctcgcgttcgacggcggccccgcgcccatcgccatcgcgtccaccatcgtgggctgcacgggggaggagccccagatcctgcgcgagggagccatccccacggccgacgtgatggaggtcgcgcgcggttagcgcggcatgacgcgcgtcacatacgcggtgccccgcatggggtatctttgtggtagcaaccgcgtccctaaggagagcagcatgaagatcgcaatcgcgtccgaccacgccggcttcaaccagaagcccgccatggtggagtacctcaagagcctcggccacgaggtcgtggactttggcccgcagaacgacgaccgcgtggactaccccgacttcgcggacaaggtcgcccgctatgtggcggccggcaacgcggaccgcggcgtcctcatctgcggcacgggcatcggcatggccctcacggccgacaaggtccccggcatccgcgcggctgtcatccagtcgccgtacttcgcgcacctcttccgcgagcacaacaacggcaacgtcgtgtgcatgtccggccgctttaccccgttcgacgtcaacaaggccatcgtggacgagttcctcaccacggagttcggcggcggccgtcacgcgggccgcgtgcagaagatcatgcgcgaggacgacccctccttcaagggagtcgacgcctagtcatcccctgcagggtcgtgcctggtcggcgtgctaccattcttggcggcaaagtcatctcgcccgtcccgccgcgcgcgggcgggcgccaggcaacggaggcacgcatggacttcgacaccaaccgattccagatcatcgaccacccgctcgtgcagcacaagctgcacatcctcagggacaagaacacgtccaccaaggacttccgcgagctcgtgaccgagcttgccgtgttcgagggctacgaggccatgcgcgacctgccgctcgaggacgtcgaggtcgagaccccgctcgagaagaccacctgcaagcgcatcgcgggcaagaagatcgcgatcatccccatcctgcgtgcgggcctcggcatggtcgacggcatcctcacgctcgtcccctccgcgcgcgtcggtcacgtcggcatgtaccgtgacccccagacgcacgagccgcaccagtactactgcaagttcccgcccgcgatcgaggaccgcacctgcctcgtggtcgaccccatgctcgccacgggcggctcgctcaccgcggccatcaagttcctgcgcgacgcgggcgtgaaggacatccgctgcctcacgctcgtctccgcgcccgagggcgtcaaggccgtgctcgactacgacccggacgtccgcctcttcacgtgcgcgctcgaccgcgagctcaacgagaacgcctacatcctgccgggcctcggtgacgccggcgaccgcatcttcggcaccaagtagcctcagccgggaacaacaaaccgctcacagggcgagaagaaccgccgacccgatcggcagctcttctcgccctcaccttacgtgagggttcgtgagccgccacaacgtggcgtgaaggtttcgtagcgatttttgaaatgagttcaaaaacgggtcaattccacgtgccacgaatcctgcgaaaatgcgccactaggcgtcctacgtggggcttttggacggaaacgcgaaaatatgcctgtggactttgagattccacacgcctacactttctagcgctgactttgtggtgagtagcgaggtgaccatgaaccaggcgattgccatcgtattgggggccgtctgcggagtggtcggcgcgattccgtctgccgtgctgtttgaacgggccaacaaacggggtacaaaccataacgttagcgtgggcgcggggcttgcaagcacgctcgtctcgttcctgctactatctgcggcaatatacgtcgcgcatcttaaagcgcctgcctacgaggccagctttgtgatcgcaacggtggtggcgttcctcgtggtctggggaatcgagtccatcaggggcttgagggcggctcagggatccgcctcgcctggagggaaggacgaatagtgaacccgctagcaagtttgtccaaggagatggaggagctggttgacagcttcatggcaaaggccgttgtcggcaacacgaccgtgggcctcacccagtacatcttcttcatgctcgtcgcaattgcgatcctcctgatcgtcatgttcacgttcaagaagaagcagtcccagagcctcgttccgcagggcttcttcgtgaacggcatggagttcctcgtggagttcgcacgcgatgacctctgcgtgagcctcctggggaagaactggaagaagcacttcccgttcgtctccgccgtgttcttcttcatcctgttcaacaacatcgtcggcatcatccccggctgccaccccggcaccggcacgatgggagtcacggcggcgctcgccatctgctccttcgtctactacgttgccgtcggcatcaagcgcatgggcgtgctcggctacctcaagagcatggcgcccgcgggcctgccgggccccatggccggcatggtgtgggttatcgagctcttctccaacctgctccgcccgatcacgctcgccattcgtctgttctgcaacatgttcgccggccacatcgtcatgggcacgttcgccatcctggcgacgctcttcgtcgagccgctgctgcagggcttctccgcggtcgcgctcggccaggccgcctgctcgatcttctggattctgctgctgatcatcatctacctggtcgagattctggtcgccgtcatccaggcgtacgtcttcgccctgctgtcggccgtctacatccagctcgtcgaggacgagtagcaacaagtggttactcgcgggccccacgcccgctggtatacgtaggtcaaaaaatcgccctgtcgttgggcgaatgacaaaggaggaatcgtgggagtcatcggttatggtctcggcgttattggtgctggctttggcatcggtctcgcggcatacggagcaactacggccatggcgcgccagcccgaggtccagggccgtctgttcacggtctttattctgggctcggccttcgtcgaggcactcgcccttatcggcttcgtcgtcaccctcatttcctaataatcgagaaagacgaacgacgctgagttggaggcacgtatgaacatcaacatcaaggggctttcgcgcatcgtgggggcatcggccgccactgccgccgcctctgtgttcgcgcctacgctcgcgcttgccaagatgccaagcggtcaggacatccttctcccgaagcccgcggagttcttccccgcgctcatcgcgttcctcgtcatctggttcgtgctcgccaagctcgcttggccctcgatcctgggcatgatggagaagcgccagaagaagatccaggacgacttggattcggcggccgagtctaaggccaaggcggccgaggaggccaagagctacgaggctacgatccgcgaggcccacaacgaggccgagaagatcgtcgcccaggccaagcgcgaggccgaagaggagcgttcccagatcctcgccaaggcacagcgcgaggctgcggacatcatcacgaagtcccacggtgcggtcgagtccgagcgcaagaaggccatgatcgagctttccggctccgttgtggacctttccgtggaaatcgcgagcaaggtcatcggcaacgagctaagcgaggaccagcagcgcaagcttgcggagaagtaccttgcggaagtgagcgtaccagatgagcgctaagcgcaacgaagatgagaaggtcgaggcttactcccgcgccctcatcgaggctgggcgcgcggagggcagggccaatgccgaccttgtccagtgggagcacgcccgcaagttctcgcccgaggtcctcgagaccctgagcgcgatgcgcgatgcggacgacctgaacctgatcgagaaggttggccagcagtatcgggagatcctcgacaaggaggacaagaccgtttcggtcacggtgacgacttccgtgcccatggacgacgtgcttcgcgagaaggttcgcaccaaggccgagaaggacctcaacgcccccgtgtacctcgtggagcgcgttgacccgtcgattctcgggggcatcgtcctcgaggctcgcggccaccgctatgacgcttccgtaagggcccagctcacgaacatcaggaagacgctcgtctcgaccttcgtcggaagtgatgcgaaatgacagacaagattagctcgacggagatcatggacacgctgcgtggcagactgtccaagatcaccgcgacaatcgatacgcaggaggcctcggtcgtcaccgaggtcggagacggtatcgcccatgtctccggactgaagtccgcaatgcagggcgagctgctcgagttcaccagctcctccacggggcgcagcgtttacggcctggcgcagaacctggatgtggacgaggtcggcgccgttctgttcggcgatgtcgactccatcaaggagggtgacgagtgccgcacgaccggccgcgtcatggacatccccgtcggccatgccatgctcggccgcgtcgtcaaccctctgggccagccgatcgacggccagggtgccatcgacacctcgcaccgtcgcccgatcgagttcaaggcccctggcatcatggagcgccagccggtctgcgagcccgtccagacgggcctcatggcaatcgacgccatggttcctatcggacgtggccagcgtgagctcatcatcggcgaccgcaagacgggcaagaccgccattgccatcgacacgattgtgaaccaggccgacacggacatcatctgcatctatgtcgccatcggccagaaggcctcgaccgtcgccggcatcaaggagacgctcgcgcgccacggcgtcatggacaagacggtcatcgtcgccgcaaccgcagcggactccgcgcctctgcagtacatcgcgcctatggccggtgccgcaatcggcgagtacttcatgtacaacgacgccaacggcaaccccgccgacgagaatcaccctggcggacacgtcctcgtcgtgtacgacgacctgtccaagcaggcagtggcataccgtcagatgtcgcttacgctgcaccgtccgcctggacgcgaggcttaccccggcgacatcttctacctgcactcccgcctgctcgagcgtgcgtgcaagctgtccgacaagaatggtggcggctcgctcacggcactcccgatcatcgagacgcaggagggcgacgtctccgcgtacatcccgacgaacgtgatttccatcacggacggtcagatctacctgcagtccaacctgttcttccagggccagcgccccgcagtcgacgtgggcatctcggtgtcccgagtcggcggtgcggcacagctcaagtcgatgaagcaggttgccggtaccctgaggctcgacctcgcgagctaccgtgagaagcaggcgttcgcgcagttcggctccgacctcgacgcgaccacgcagtaccagctcaaccacggcgctcacatgatggagctcctcaagcagaagcgcttctctgcgcttgacgtcgtcgaccaggtcatcgcgatctttgccgccaaggaggacttcctggacgacatcgacctggaccacgtgaccctgttccgcgacggcctcgcaaagtacatgcaggagaggcacccgcagctgcgcgaggagattcgcgaccacaagatcgacgacggcatggctgagcgcatcaagacgcacgtcaagcacttcaaggagcagttccttgccgcccatcccaacaaggtaacgatgggtgacgtcgccaagacggcagagtcgaacgttgacgttgccgcagagaccgaggaagaagagggccaggagcagtaaatggccaacctacgcgaaatacagaggcgcatgaactccatcacgagtaccatgcagatcactcgaaccatggagatgatttccacggcgaggattcagcatgcgctcgttcgcgcgcaggaggctggtccctacaaggacgccatcaccaacatgctcgcaaatgtcgccacggcaggcgcgggctccacccagccgctccttcagaagcatgacgaggagaagagcgtcgtcttcatagtcatcgcctcggatcgcggccttgcgggtggcttcaacgtccttcagcagcgtgccgtcgacaaggagatgcgcgagctcgctgccaagggggtcaagtcctcggtcatcacctgtggacgcaagcctaccgagtacttcacgtatcgcaagatcaagccggtcctctccttcgtgggcgtctcctccgagcccacgatggacgaggccgaccgcattgcgtcgtacgtgatggatggctacatcaaggggaccatcgatcgcgtgatgctcctgtactggcacgcgaagaaccgcgtcgaccaggcgcaggtgaccgagcagctgctgcccatcacgcgcgagaagctcatgatgccgaacaagcctcgtactcccgaagcgctgtccgaggtcaagaacaagatctatcccgagtaccagttcgagccctctgccgaatcggtgcttggctatctgatgccggcctacttcaggaccgtcatcttccatgctcttctcgactcggctgctgccgagcacggcgcaaggcgtcgtgccatgcagtcggcgaccgacaacgcgaaggaagtgctcggttccctgagccgcacctacaaccgcgagcgtcagggcgccatcaccaccgagctgaacgagattatcggcggtgcttccgcattggaggaaagctaatggcagaaaccgcagagaaggtgcgcactcccctggaggaggcagccttcaagcacatgaacaagacggtgggcacgggcaccatcgtccgtatcgtcggccccgtcgtggacgtgaagttcgagggtcaggttcccgcgatctacacggccctgaccgtcgatggcgagacgcccgtcggcaaggtgagcacggtgctcgaggtcgagtcccagctcgccggtggcgtcgtccgtaccgtcgcaatgtcctcgaccgatggcctgcagcgcgggctgagggtcaaggacaccggtcaccccatgatgatgcccgttggcccgtctaccctgggtcgcgtctggaacgtcatgggcgagcccgttgacggtggcgacgtcccctctgacgtccagtactacccgattcaccaccccgcgccagcctttgacgagctgacgacccagaccgagatcttcgagaccggcatcaaggccatcgatcttctcgagccgtacgttcgtggcggcaagaccggcctctttggcggcgctggcgtcggcaagaccgtcctgatccaggagctcatcaacaacctggcccaggagcacggcggcacctccgtcttcacgggcgttggcgagcgtacccgcgagggtaccgacctgtacctcgagatgaccgagtctggcgtcatcaacaagacctgcctggtctacggacagatgaacgagccgcctggagcacgtatgcgtgtcgccctggctggactgaccacggccgagtacttccgcgaccagggacaggacgttcttctcttcattgacaacatcttccgcttctcgcaggctggctctgaggtctctgcacttctcggccgcatgccttcggcagtcggctaccagccgacgctggcgacggagatgggcgagctccaggagcgcatcacctcgacgaaggaaggctcgattacgtccgtccaggccgtctacgtccctgcagacgacctgaccgacccggcgcctgcgacgacgttcacgcacctcgacgcgacgacggtcctttcgcgttccattaccgagctgggcatctatcccgccgtcgacccgctggcgagctcgagctccgcgcttgacccgtccatcgtcggcgaggagcactatcgcgtcgcaatggcggtgcaggagacgcttcaggagtactccgacctccaggacatcatcgcgattcttggtatggacgagctctccgaggagcagcagctcgtcgtggcgcgtgcccgtaagatccagcagttcctgtcgcagtcgttccacgttgccgagaagttcaccggcaaccctggtgtgtacgtcaccgtcgacgacacggtccgctcgtttgcggagatcgtggatggcaagtgcgacgacctgcccgagcaggccttccgctacgccagcaccatcgacgacgtgcgcgagcgcgccaggaagatggaagccgagacggctcacgctgagtagggaagattatggcagagcttaactgtcaattcgtgcgcccggacgggctcctcttcgaggggcccgtcgcgagctgcgtcctcgtgaccgagagcggcgagctcggcgtatggcctggccatgactccgagatcgtccaccttggggacggcatcgtccgcctgaacctgcgcgagcaggacggcggcggcgtcgacaaggtcatcgtgtccggcggttacgccgagattggtggcgacaaggtcatcgtgcttgccgaccacgctcgcaaggttggcgacatcgagccagatgtcgtccgaaggacgaggcagaaggccatggatgctcgcgacgagtatcccgagggcgacaacaggcgcgcgtattacgacaacaagatcaagtggtgcaacctcttgctcaagcacgcagacgacaagtagagacaccgagggttcggagtagcgttggaagttatccaggttgaaggtggccacaaattcacgggagaggtcacggtggagggtgccaagaactcggcactcaagctgatggccgcgaccatcatggcccctggcgtcaccaccctgaccaacgttccgaacatctcggacgttcatgtcatgggcaaggtgctcaagtgcctgggcgcgaagatcaacgtaaagaacgagcacgagctcgagatcgacacgaccggcgtggacaagtgggagacgccgtaccacctcgtggccaagatgcgcgcctccaccgcggtcatgggcccgctgctcacgcgctttggcaaggccgtcgtggccatgcctggcggctgcaacatcggtgccaggaagatcgacatgcacatcctgggcctggaggccctgggcgtcgccttcgagatcgaccacggcaacatccacgcctcgacccccaacgggatcaagggcacgaccgtcacgctcgacttcgcgagcgtcggtgcgaccgagaacctcatgatggcctccgtgtgtgccgagggcaccaccacgatcgacaacgcggcgcgcgagcccgagatcgtggacctggcgaacctcctgaacgagatgggcgccaaggtcaggggagccggctccccggtaatcgaggtcgagggcgtcgagaagctccatgcggtggagtgccaccgcgtcgtgggcgaccgtatcgaggctgggacgttcatcgcgatgggcgggctctgcaaggacccggtcaccgtgaggggcttcaacccgcgccacctcggccttgtgctcaagaagtacgagctcatggggctcgacatcaagtgctttgacgacggctgcaccgtgagccgcaagggtcccatccacgcgaccgacatccagacgctgcccttcccgggcttcccgacggacatgcaggcccagacgatgacccttctcgccctgtgcgacggaagctgcatcatcacggagaacgtgttcgagaaccgcttcatgctcgcgagcgagctgcagcgcatgggcgcggacatccgcatcgaggggcaccacgccatcgtgcacggggtcaagggcttctcgggcgcggaggtaaagtcccccgacctgaggggcggtgcggcgctcgtgatggcgggcctcgtggcagacggcgtcacgacggtgtccgagatccaccacatcgaccgcggctacgagaagttcgtggacaagctgcagtcgctgggtgccaaggcggtgcgctgcgaggtgcccgacgaggacgaggacctcttcatgtagccgcgagccaaacgcaagaaacctgcctgggtgcgcatgcgtgcccaggcttttttcatgtcgggtggcggacctttgatggcgtgcgtggtgcgaactggaatcggctagtgctacgttgggtacatactgccgaaagcgaacctgaacccgccggtgcgggagtttttggagaagagcatggagaacgttgtcgagggtggcgtcgcgaacgcgacccaggaagttgccccggagaagctgcgcgaaggtgcgggagagcacctgtcgaagtcgaacgaggactacatcgagtcgatctatcgaataatgcgcgcggaggggggcgagaagggcgtgcgctccgtggacgtggccgagcagctggacgtctctaaggcaagcgtcaacaaggccgtgacgacgctgcgcaacgcgggttacgtggagcagaaccgctacggccgcatccagctgactgactccggcgtgagctacgcacggcgcgtgtggcgctgccaccgcatgctcaggtcgtttttggagcgcgatcttggggtcgacccgaagacggccgacgccgaggcgtgcctgatggagcacgcactttcccccgatacgcaggacaagtggcttgcgtacctcgagaagcagggaatccaggtggaggaatgagcgagaaggacgtggcgccgtggccgagctgtcccctgtggcacgaggccgcggacgcggacgacgcggaggcggtccagcggcaggaacttgcggacgtcctgagcggacgcgcgcaggcagccgtcgcgctctcgggcggcatggggccgctcattgcggagcagcccttctcgcaggggattccttatgcagaatggaacctttccgactcggccctgatcgggcagctgcacgggatgttccacgcggccggagcggactgcgccgtctcgcacacgcttggctgctctgacgcccagctggacgcggagcttgcgggcctcgcgcgcgaggtcaacgcgggcgccgtgcgggaggcgcgctcctgcgggccgcgctttgtgctgggcgcgctgggccaggtggccgacgagcgcccctccgggcttgaggactcgctgtgccgccaggcgacccagcttgcggatgcgggcgtgcacggcctgctgctggttgcgcacgacgcggcccttgcggccgtcctcacacgggcgatcctgaaggtcgcggggctgccgcttgtggccatggtgccgtttgccggtggcgcggcggacgcgaagccgcggcgggacgtgccggccgagccgcgcacgccggacgggatggcgcccgcggaggcgttctcgcggctggctgccgcgggggcctttgcggttggcgcgagcctcgacgtcgcgggcgccgcgtccttctcgcccgcgcttggcgctgccgccgacgccgcgggccgcggactcgtcgtgcggctgcgcgggagtggccagggtgcgaacccgggggagaagaacgtcggcgccgggtccgcggcggttcgggttgcgacggactccctcgtgcgcgctggctcgcgcgtgcttgggtacgcggggcccgacccccttggcgcgacggccgcgatccgggccgagctcgaccagctttcgggcgagctcgcgttcgaggtcctgtagcgaacggtggccgccgcggccgacggccgcgatccgggcggagctcgaccggctttcgggcgagctctcgttcgaggtcctgtagcgaacggccgcggcgggcgggtggcacgctacgtcgggaacgtgtgaaacgcgaccgtccgcctatggattgtttcccgggaacgtgccaatggctatgcttgttcatgcaagacgggccggtcgccggcgcccgcacgcgatgcggacgcgacccatggcgcagcccgactgtcgatgcgtatagaagggaccattcatgaaggctgtcattcccgccgcaggcctgggaactcgctttctacctgcgaccaaggaaacgcccaaggagctcctacctgttctgaacaagccggttatccaatatgttgtcgaggaggccctcgagcccgagggcgtggacgaggtcgtgatcgtcaactcgagggagaagccccagctcgagtcctacttccgcgtcgacggcggatacgaggacatgctgcgcaagcgcggcaagaccaccgaggcggacctcgtgcacgaggcgtccaagctgccggtttccttcgtgtaccaggacaacccgcggggtctgggccacgccgtccattgcgccgccgacaaggttggcgacgagccgttcttcgttcttctcggcgactacttcgttcccgaccaccagatgtgcgtgcgcatggccgaggtctccaagcagcacaatggcgcctccgtcatcgcggtcgcgcccgtgccggccgaccaggtgagccgctacggcatcatcgccggcgagcacgtcggctcgcttgacgggtccgacgtcgcggacgaggacgagggcgccgtgtggaaggtcacgggcctggtggagaagcccgcgcccgaggacgcgccgtcccacctttacatcgtgggccgctacctgctgacgccccggatcatggacctgctggccaaccagggcgtgggcgccggcggagagattcagctcacggacgccatggagcgcctgcttggcgaggaggagatgtacgcgctggtggtcgaccccacggagggttgcgacacgggcacgccggccgcctgggcgggcgtcaacgcgaggctcgcgcttgccgacgagtccacgcgcgaggcgttcctcgaggctcttggcaagagcgctctaggcgataactagcacctaccttcgatgcgtaacattcactttagggcggacggctggtacagcaggcgtgacgaggggtacgacctcgagggcgtgcgtgcggtcgcggcggcgcttggcgtcgtgtggggcaccatgcacgagggcgccgcgatcgccatcggctacgacacccgccacgacagcgaggacatggcgctcgaggtcgcggggctgattgcgtcctgcggcctgcaggtaactgtgtccaacgcgccgacaccggcacccgtgctcgagtccgccgtggcccgcgacgacgcgtgtgtgggcggcgtgctggtatcgggcggcgactactcgagcgactacggcggcatcctggtgtgcggcccggacggcgggtccgtctcgcaggagttcgcgcacgacgtggacaagctcatatcctcggttcccggagacgcgcgcggccgctatgcccgcgcggacctgctgtcgccgtacacgcgcgacctcatggggcagatagatgcaaaggccgtgcgctcttctcgcccgcgcgtcgtcgtggacagcatgtacggaacggcccagtgcgtcgttccgtcgctcctccgcagcctcggggccgacgtcgtcgagcttcacgttggctgcccggcaaacttcggtggcatccacccccaggccatcgagccctgggttgacgagtgcgaggccgccgtcgtgcgcgagggcgcggaccttggccttgcctttggcggggactgccgccgcctcgcgctgatcgatgcgcgcggccgcatggtgtccgtccacgacctcgggcccctcgtgctcgatcacctcgtgggcgagaagagcctgcgcggccgggtcgttggcacgctcgcgtgctccgagcgcctcgagcgccaggccgatcggcttggcctggagtacacggccgtgcccgtcggcttctcgcgcctgcacgccgagatggccgatggtgacgtgctgcttgctgccgaggagtacggcggcctctcgttccccagccaccttgccgagcgcgatgcgatcctggccgcgctctacatcctcgaggagcttgccgcacagggggccacggtcgaggacctcgtgtcgagggtgcgccgcgaggtgggccgcatggcctacgggcgggaggacatcaccctcgacgtggcgaaggtccaggcgttccgcaacatcctgccgggcctcaatccgcgcacgatggcgggcaaggcccccgtcagcgtgaaccacgcgggcggcctcaaggccacgttcgccgacggctcgtgggcgatgctcagaccctcgcgctcgcagtccatcgtgagggcctatgcgga

SEQ ID NO: 124 - DNA, 21901 bp, Unknown
  Metagenome-assembled genome
gccgtcttgcgcgcgacgctcacgtccaggccgtggatgatgtccggcgtgggggtgtcgtccgcgatgagggagacgacctccgactccgcgaagaccgtgcacatgctggagatggtgaccgcgtgcttccactccaggccctcgcgggagagctcctcgatgggcatctgcagcgtgcgggccatggcctccaggaagcggcccgtgccggcggcgcacttgtcgttcatcacgaagttctggaccgtgccgtcctcgtgcaggtggatgaccttggagtcctggccgccgatgtcgatcacggtcttggcctggggcgcgaggtagtgggcgccggccgcgtggcaggtgatctctgttatggcgacgtccatgttggggatggcgtcgcggccgtagccggtggccacgctcatggcgaggtcgtcgcgggtgaggtgggcctggtcgagcacctcttctataacggcggcggcgccgcgtgaggccttggcgcccgttgcgccgatgacggaggcgactatgttgccgtcgaggtccatcacgacggcgtccgtgctggtggagccggagtccacgccgaggacgtacgtcgtgccgctggttgcgggcgtggggtctgtggtcacgttcttctcccttgcgtcgtgtgcttgcgcgggcgcggcggccggcgcggggtggggcagggtctcgtcaaaggcctcgatgcgcgtgcggagctgtcccgagctctggcgggtgccgtcggtctcgagcttgaggaggggcgtctgggcctggcccgcgaagtccgcgtactcgaagccgtagtagtcgcagaacttcatggtgtggtacacgatgcccgcgtggccgcccgccaccaggcccgagcggccgccgacctcgtccatgcgcatgcacggcgtctgggtgaggagcgcggcggcgtaccagtcgataaaggcgtcgaacgtggaggcgttggtgccgcggcctgcgatgtccggcacggcgcaatggccgcagcccgccgactccgcgcgggcgagctccagcgggggctgcgcgagcacgcgctcgcccgtgcaggtgtggttgaccacgggggcgtggagctcgtggtggagctcatccaggagggactgcggggcgtgggcgcccacgagggcgaccgagcccggcttgggcgcgggcggcaccttgatggcggccagcgcggcgcccacctcgaagctgttgccggaaaagtccgcataggcctgggccagcttgcggagctcgtttgcgagcaggcgctgggaggccggggtcaccacgtgggggatgtccagcaggtagagaaaatcgaggcagtgctgggcgcgcagcacgtcgtagcagcggcgcatgacgtcgcagcaggtggtgagcaccatctggtgcacgttggggctgaggccgcacgcgatgacggacttgccaaagccgcacaggttgccgtgggccaggcgctcggccgcctcgaagctgtccggctcaaccatgatctgttgggcgtcggtcccaaagccggccagcagctcgatgggggcgtacttgcagccgtagcagacgactgggtttgtcatgatcttctccccgactgtagcatctcaaggaaggcctgcacgcgcgtggccgtctgaccctccggcatgttgcggcgggcgcagccgtcgccgtcgagcaccagcgtggggaagccggcctcctccaggctggacttgatgagctgcgatgcgcccatggtctccttgcagccccagtggcagaacacgatggcgccatccgcctgcgtggtgcgcgccaggtggaggaggcgatccacgcggcgctccgcggggccgttgtagctgttgtagaccagacgctccgccatgtgctcgaagggctcgccggcgtcgtggcgccagccgccggggcggaactggtcaaagcacatctcgctcgcgactatctgcgccaggggcgagttgtccacggcgcgctgcagcggcacgctgaagtacggcatggtgtggctccacagcaggttgaggcccgcgtaggggtgcgtcttggccgggatctcctgctggaccaggtccatcaggtggtccacctgcggagtgcccagcatcatgtgcatggagcaggaacgcatcatctcgatggtcatggtggtgtgcatggtgcggcgggcgcgctggggcagggtgcgctccatcacgtcgagcgcgcggatgctgcgcgccacgtgctgggacaggacgcgctggtcaagcttggtgttgaagacgtcctgcgccgcggaggcgagctcgcgaagctcgtccgccacgtagtggaccgcgtcctcgctggggtcgtatggcacgtcgatgtagcggcgctcgcagtccaggtggcgcgccagccacttgaacgtgaggttgttggcgtcgcaggccacggagcagtttgcgatgagcctgggcgccgcgatgacaccggccgccgtggcccccaccagcaccttgtggtagctgcagtaggactccggcacggagcgctgctccgccgccgtaacaaagccctgctctgcctgcgcgccgctgaagaagtcgccaattgcctccgcgatcacggggtacaggcccatggcgtggaagatctcgctcggcatgaacatggacgtgaggaccatgcggtccgggtgctccagcgcgcccaccacgccctcgagcgtgaggcggttgtccagctggcccgagggcaacagctcgcgccgcggcagcagctgcgtgcgcaggcgctccgccttgaagcccgtgagcagaaggcggcgcgccagcgcggggttggtctctatctggctatccaccagctggccaaagcgcgcgatcaggtccgtggagctcttctccgcatccgtcgccatgggctagccctccgagccggcggcgccggcgggggagaaggacgcggcgtccggggttgcggccgcgccgtcagctgcggcggggtccgcaagctcgatcacgcggaagtcgcggttggtggcctccagcgcctgatgcgggccgaagaccacgacggtgccgcgctggtccaggccctgcatggagggcgcgagcgcgcgcacgtcctgcgccgtggtgtggagctcctggtcgcgcacggtggtgcggaagtccgccgggcgcgccatgaagtactgcgtgtcctgcctgcgggcgcgggcgcggctctttacgggggcgtccgtgccggccaccacgctcacgatgtagccgtccagctcatcagcgtcgccctgccagttggccagccagtccgcggcgccggcgtagcgggcgagcgtgccctccacgcccgggtcgcggtacgaccagtactgctgcaggcccgtggccagacggcggaagcccacgccgtaggcgccgcccttgacgcggacctcgttccacaggtagtccagcgtgagcatgcgcgaggcaacctgccaggtgccgacgctgccggcgtcagcgggggaggggccggtgccctcggccacgtagcacacgttggaggggatgacgtagaactcgtcgcgcggctgcggcgcggggacgctcagctgcacgcccgtggtgggtgcgggggagaagggatcctctgccgaggggacgttctcctggcccgcgggaggcgtgggcaggcccagcgtgtcggcctcctgccagaagcgctcgcggtcggcctgcgggcccgtgaagctcgttatcacgttgcgcgtggtaaagatttgtgcgaccaggcgctccaggtgggtgcggagctcgtccttgcgggcgtcccagttggccagcagctccctgaggaagaggtagtactcggccccgccgatgttgttggcgaccatgttgaccttggagtacatgccggatagctgcgccatcgcgctggagtggccgctgttggcaaactgctgcgccagcacgatgcgctgctgcgtgaggatggcgagcatgcggtccgaatccgcaaagctggtgcggagcatgacctccgtggggatggtcgcgagcgcgcggacgttctcttgcagggagcttgcgcccaccacgagcttggggtcggcaaagccaaggtcgctgtcgcggccgtaggtctccgtaaagaacgtgaggccgcccaggttggcctcaatgtaggtgtcaaggtcggacgcggaatgctcgctcgtgtcaagcttgcccaggagctccgccagcacgcccacgtacggcagatccgcaaacgcgaggccgctcaggtcaaagtagtggtacacgtagtcgatcctgcgcgtgggcaggtcgtgccacaggcaggggagaggtgcctcggccttttgcagcggcacctccttgggcgcggggccaatgtccgccacggtcaggcgcggcagcgtggccagggcctccgggctgtccggggcctcctgctccgcgcgcagcgcgtcgacctcgttggccacggcttgcagttggcttgcgtccatggcggccttgcgggcggcaagctcgtccttctcctccgcggcggagccttcctccgtggggaccagctcaacctcgcagcagtggtcgctcttgcacaccaggccgtccagcaggcgctcaaagtagccgtcgtccaggccctggcgcatgtgggccagctcctgctcgtagcgcaggtagtccacggggcggtcgtcgtcgtacagccagctggacatggcctggatgctcagggccacgccgtcgccgtacgggccccagtcgccctcgcgcatgttgaactcgcccagcgccagggaggcgtccagcttgtcgcggccgatgccgctggtcgcgagctccgcgcacgtggactccaccacctcgcggaagcgttgcgccgcgccgggcttggcgcccttgagctggaagagcgccacgggctgcagctggccgtcgaccagcgtggccgtaaagtcgtcgcccaggtccgcgtcgagcaccgcgcgcttgagcggggactcgtttgagccggccagcgcgtcgagcagcacgtccgtggccagcacgcgctcgcgatcagccgcgccgccaatcacgtacgccaggccaacgcttgcgttttcctgcgcggtggccatctttacctgcgcaaacggcgcgcgcacgggggcctgcggcagcagctggttgggcgcgcctgcgtggcggtccgtcgcgtgactgaagcgctcgttaaggaacgcgagcatgtcgtcaatgtcgagcgcgccgtacaggatggtgtagctgttggccaggttgtagtggcgcgcgtgcgtgtccaaaaacttcttgtaggttagctgcgggatctgccgcgggtcgccaccggactcaaagcggtaggcgttgtcgggaaagaggctacggttgatggcgtcaaacagcacgtcgtccgggtcgctcagggcgcccttcatctcgttaaagaccacgccgttgtaggccaggcgggcgtctgggtcgtccggcgcggcggggttgccgtcagaatcctgcagctccaggtgccagccctcctgctcaaaaatgcgcgggcggttgtagatcgccgggtgcagtacggcgtcgatgtagacgtccatcaggttcttgaggtccgccgtgttggtggaggccaccgggtacatggtcttgtcctggaaggtcagtgcgttcaagaacgtctgcatggacgtcttgagcaggttgacgaaaggttccttcacgggaaagcggtcgctgccgcacaggacggagtgctccaggatgtggaacacgccggtgctgtctgccggcggggtcttgaacgcgatggagaaggacttctcgtcgtcgtcgacggcgagccacatggcgcgggcgccggtggcgtcgtggcgcatcacgtacgcgtggccgtcaaactccggcagggggatgaccttcgtgaccgtaaagccctcgtgcgcggtgcccacggccagcgccgggtcggccgcggagtacgggggcacgttcttctcatttgtctgcatggctgctcctgttgtgtcaaatgtctaacgagctaactctacccctcttgccgcaaacttttccgcgcggcggtgttatggtgcaaagcgtgaaacttgcaggtacgtttgaggtttggagcgccgtggcacagcagggcatggtccccttcgaaaaggtggatgaggacgagaagaacggccttggcgctcgcgtgcgccgcgtgggcgggcgcgtcaagcgggccggccgcgccgcggtgcgcggggagtccgccgtggcgcgcggtatcctgctcacgctgttgggtgggacgttctggggcatcaacggcaccctgtccaaggtgctcatgggcacgtacggcgtgcagcccctttggcttgcctgcgtgcgagagctcagcgcgtgctggctgttcctgatcgcggggcacctcacgtcgccggagcgcctgcgcggtgtgctgcacgacggccgctcgctcctgagcatcctgggcatcgccgtggggtcgatcctgttctcgcaggtggcgtacctcgaggcgatcaactggaccaactccgccacggccaccatcctgcagagcctctccgtggtgatcgtgatggtgtacgtgtgcatagtcaacaggcgccgcccgcgccggcgcgagctgatcggcctggtgctggctgtggctggcacctaccttgtggccacgggaggcgaccccaccaagctcgcgctgccgccgcagggcctggcgtggggcatgggctgcgccgtggccgccacgatcctggccatccagccggtgcgcatgatcacgcgctggggcaactttgcggtcaacgggcttgcgtttctcttctcgggaatcattctcaccatcgcgtaccagccgtgggcgcacatgcccacgctggacgccgccggcgtcgcgctggtgctgctctccgtggtgctgggcacgtttggcgcctacgcgctctacctgcagggcgtcaaggaggtcggctccgtgcgcggctccatgctcggcacgtccgagccggtcatggccaccatcagctccgtggtgtggctgggcgccgtgttcacgcccatggacctgctgggctttttgatgatcatcgtgatggtgttcctcacggcgtaggggacgcgcatggcagagtcgcaacacaacgcgggcggcgcatccgccgcgccggaggtgcccgagggcttcaatcttgcgcttgccttggtggacgcggtgcctgtggcgctctttggggcgtcctgcctggtggcgggcgcgcgcatcgggagccccgtgtgggtcatcggggcgtcgctcgcgctagcgggaggcacgggcaaggtcgcctggaagctcgtgatggcgctggcgcaccgcaatgtgccgatcctcagcaggcagatgcgctacgtgatgcccgcggggttcgccctcatggttgctggtgccgtgctggacgccgcggggacgctggggctcctgcgcgtcctggtgcgcatgcccagcctgccgctcgtgctggcgtggctggcctgcatgctgctcatggggcggttcgcgcgcagccgcgaccagctcgatgcacgctccaactggatcgagcagggcaccaacgcgctgggccagcttgcacttctctgcgcgctgctgctggcgtagcgggcacctgccggcagcccccgccgcgggtagaagaacggccatcccgcacgagactccgctcgggatggccgtttttctcgatgtatgtgccttgtctgccgcgctagatgctgttcatgttgctgaggaccgcggagtaccagaactgccagttgggcgggcagtacttcttggcggccgtcacgctcacggtgtagccgtagccggaggccaggcccgccacgtgcgcgcggatggcgctgtcccagtcgataaagccggagctgccccagccccaggcgttgtacggcttgaagcagtacaggcccttgctggactccacgttggcgatggcgggggagtagcgcgggtccacgccgttgtcgtaggcggcctcggcaaaggtcttgccgtgcccggccatgggcgatccggccaggtacgcgttgatgcggccggtccactcttgcacaaacttgtcgcgcgcagtccaggtcacggcgtccgtgttggaggtgtcgctggaggccttgccgttggagttcgagttggagttcgagttcgagctgttattgctgttgttgctggagttcgacgcgttgttgcccgcggtcggcgtggtcacggtagccgtgttgccggattcggtcttgaacgtggtctgaccgtccttctcggccttctgggcctcctccacggccttttgcgcctcggcctgctgcgcggccagcttcttggctgcctcctcctgggcctccttgcgcgcggcaatcgcgtcgtccatggcggatttggcctggtcctttgcggtctctgcctcggccttctgcgccttgagcgtgtcctgcgtctgctccagcttctgctgcgtgctcacgagcttgtccatggcgtcgttgttcttgcccgccacgatgtccaggtagttcatggcgcttatgagctcgttaaagttgtctgcggaaagcagcatgtcgatcacgccgccgctcgactgcgacagcttgtacgacgagttgatggacttggccgcgctctcgcgaagcttgggcagctcctcgttgagctggtcgatcttggcctggttgtcgtccatgctcttctggaccttgttcaggtggtcgacggcgtcgttgtacgacttgctggtctgctccaccttcgcctgcaggtccgagtcctcgctggcccgggcggtcgtcgggacggctcccatcccaacgccaaacaggagcccggcaaccagagcggtcgccgcgagtcgcatgggtgtgcgtgtcatgaatccccgccttcggtaatcgtctgcggtctgcgtgcaacgctgcgtgccaacgcaaccccttcatcttacctacagatgtacgatctcacgcccccttcacatccgcagccgtctgccgacgttcccttgacatggccttttgggcaagagacccgctcttctcgcctgcgtctttaccttgtctgcccgccgtccgccgcgccgcgcccgggcgagaagaacatcccgcccgggctggagcccaggcgggatgccgagtcgtcatacgttgttgaaccgtcgcgcggtcgccgcgcgcccccgtgctcgcgctacttgagcaccagcgtgtcgcacttggcgttgcgcgtcaggaacgtgctgatggatcccagcagcgcgtacttgatgctcgaaagcccgcgtgcgccgcagatgatgaggtcgggctcgatcacgtcgatcatgtcgtccttcagcgtctcgcggatgcgcccggccttcacgatgacctcgaccttctttatcgagtcgatggccttggccttctcgacctgctccgcgatggagtcgcgaaagtccttctcgaggtccgccaccaggtcgacggggtaggtgcccgccgtctccagcgccgtggagtcgatcacgtggccaatgtagagctcggagttgttgttcgccgccacgatgatcgcacggcgcaggacctcgtcctgctgctccgtcccgtccagcgccacgaggatcctgtcataacccaggtcctgatacttggtaaccattgagcacctcccgtgcctgatacctgcagtgaccatacccgcgcatacctgcggcatgtctgcctgtggcaagtctacccaccgcgagccgcgacccgccaaccaaccccgcgagcggtcgccacggcgcggccgcgcggcgctgcctggccgggagggccgtccttctcgcctgtcacaacgcccgcgacgtccccgggcgagaaggacgtgattctcttgtggtgggccgttcgcggcccgcgcagaacgtatgatatagggtcgcaaacgtcaacgggaggtctccttgaacgtaatcgaactactcaaagcggcactgtatggcctggtagagggcataacggagtggctgcccgtctccagcactgggcacatgctgctccttaatcagttcgtcaagctgagcgtcagcaaggacttttgggacatgttcctggttgtgatccagcttggcgcgatcctggccgtctgtgtcatgttctttggacagctcaacccgtggtcgcgcaagaagtccacggccgagcgcaagggcacctggcgcctgtggggccagatcatcgtggcgtgcctgcctgcggccgtgatcggcgtgccgctggacgactggatggaggcccacctgggcagtccctttgtgatagctgccgcgctcatcgtgtacggcatcgcgttcatcgcgatcgagacgcatcgcgagcacaaggccgagcagattgcgatcgagcgctcgttcagcccgcgtccgcagcacttcaagcccaactcgcagcccgtggcgcagagcaaggccgccctggcggacgtggacgcccgcgtgcagagcattggcgagcttggttggggcacggccatcggcatcggcatcttccaggtgctttccatggtccccggcacgtcgcgctccggctccaccatcatcggcggcctgctgctcggctgctcgcgagccgtggcggccgagttcacgttctacctggccattcccgtgatggtgggcgcctccggcctgcgcctggtcaagttcttcctcaagggcaacgcgttcaccggcacggagctcgcgattcttggggttggctgcctggtggcctttgtcgtgtcgatcctggtgattcgcttcctcatgggcttcatcaagaagcacgacttcaagcccttcggctggtaccgcatcgccctcggcgttgtggtgatcgcgtacttcctggtggcgtaccacatcatctagcggcggcagaaaagcgcgagacatggcggtcggctcacgtggctggccgcctttttatatgcctagactcgtctgagcaccacgtatgcgttgaggtcgctgggcgcatcgagcggtagggtagttcttctcttccgcaattgatataacaagcgtcacattttcgcagctagacacctgtttgttttggaaaccttaggatgcataaactcgagtgtgctgggaaaccccacccataacgttaaggtttggtaagcgggtgagaaaaacgtctcacctttgatgtttgatcgcttggcccaatagtccgtgtacgacctgttaccgccaaaaatggcatatcaactgcctagaatcatgcggtttattgagctaatcgcgtgcgctagaatgtcaggttcctcatatcgtggccgcacacttgacccctttgccgccaaaatgtcactgtgcatatagctattcgatattcataccctcaaaagttgccgaaacgtttccagtcgcgaaactcttcgtcatgagcaacgctcacggcggaacaaacgaccgtttggcggcccgttttcgaccgcttgcccattggacaggccactcctctgaaacactttgcccttacgcgacggaagccttgcacccttttctaaagtacgtttcccggaaatccccaacacggtctggagggtgaaggcatgcaagaggcatcagctgtcagcattgctaagcagaagaagaaggagctcgactccagcttcttcaagaagggcatcatggtcgccctgttctcgagccttatgtacggcttctacacggcgttcgtgactgctggtcagaactcgcagctgtggaccagctggaccagcgccatcaaccccgccgccttcctcgcggtcttcatcatcccgaccgtcgccagtgccatcaacgactcctgcagtgccatctgggcgcttgccatcaccgcaaagcagggcaagcttggcgacttcggccgcaccatcaacaccaagcccggcatcatcctgatgctctccgcactcgtcggtggcccaatcgccacggtcgcgtacatcatcgccctttcccaggcgggcaccatcgtcgtccccatcgcggcgctcaaccccgccatcggctcgattctctcccgcatcctctacaagcaggagcttggtccccgcaagattgctggcatcgctatctgcgtcgtcgcgggcctcatgatcggcaccgccagcctcaccggcgactcctcctccaacatggcccttggcctcgcccttgcgttcatcgccgcgcttggctggggtgctgagggctgcatcgccggctatgcatcctgcatgatcgacacccagatcggcatcaccatccgccagtgcgtctccggcgtggtcgagctcatcgtcatcctcccggtcctgtccctcatcggcggcgtcaaccttggccagaccttcggttacgtcggcgcggccatcacggacctccccacaatcctctgcttcatcgtcgcgggcttctccgcctacaaatccttcgcaagctggtatcgcggcaactccatgtgcggcaccgcgcttggcatggcctgcaacggcacgtacaccttcgtcgcaccgctcgtcacgtggatcatcgtcggcctgatcatgggcgtccccggttatgcccttccgccgatcgcatgggtcgccgcagtcgtcatgatccttggcatcctcgttatcgcggttgaccccaaggagctcttcggaaagaaggaggaggcataatgcgcccgctcaactacgcaatgctcaagtacttcacgacggtcgacgaggcaagcgtcgacgacgtgatgaaggacctctcctctgactactccggatacacggcgttcaagcgcgacaagatgcaagaggccctcatgacggccgagaagaacgggctcatcagtgagagccgtgtcgatctggacgacaacggcgaccttcgggtgttctacagcgctgacgccgagcagcgcgacaccatcaattcctacatcaagtaagggggttcgtcatgcgctacaggggagaggaggccatcggcctcatcgagaccatcggcatggttcccgcaatatacgcggccgacgccatgctgaaggccggcgacacggagctgattagctacgagaacgtcgggtccaccctcgtcaccatcatcgtcaaaggcgatgtcgcggcgtgcgaggcagcggtcaaggccggcaaggaggctgcctccagcatcggcaagctcaccgctgcaaacgtgatgaagaggcccgtgccgcccatcggcgatgtcgtctccgtccacgacgtcgactacaactaggaggttggcaatggcaagtgagggcatggacgcacttggcgccatcgagacctttggcctggtatgggtcctcgaagctggcgacgccatgtgcaaggcgggcgatgtcgagctcattggctacgagaacaccgcctctggttacatctccatcctcgtcaagggtgacgtcgcggcgtgcaaggccgcggtcgaggcgggcgtcaaggccgtcgaggcgctgggagccgaggtctacagctccgtcgtcatcccgaggccgcatcccgacctcaagaagatcaccgacaagtacaccgtcgagaagctgcttccctactaagggggtgtcgaatgtctctcatcgataacgatctcctctcgattcaggaggcgcgtatcctcctggagcatgcggcagagtccgcggaggtcctcgagggactgccggcatcgctggtcgacgacttcctgtcccacctgcgcgagcgcctcctccccaaggccctcgagtacgcggagtcgtccttctcggaaagcgactactgctctcccgatgacgagtctgagctcaccaagtgggtcctgagcgacctgctggccgacgtgcgcgcgcagaccccggtccagaagatcatccgctcgcgcaacgggtccgccgaggtgtgcctctccaagggcgtagtcgtgtcgctgctcccggactggctcgcggtccccacgatgctcagccagctcttcatggcagtgcactccaagagccccatcgtcttctcggccagcgcgcgcatccatggcacgtgcgagaaggtcatcgacgacgtgctcgaggtcgcggagttctgccactatcccacggagtcgatcggttacctctcgacgtactgccccgagggtgaggagtgggtctgctcgcagccgtgcgtccgtgtggtcatcgactcgcgcgaggagtcgaacgcccacgacttcgacgctgccggcagggacgtctaccacgccacgctgggcaacaacccggtcttcgtggagtcgacggcggacctcgcggcgtgcgcggacgaggtcgtgctcggcaagtcgttctgctacggaatgcttccgggcgccgagcagagcgttgtcgtggagcgcgccgtggacgagcagttccaggcggagctccgccgccgcggatgctacttcctttcggacgagcaggcagacaggctcgtcggcacactcttcatgtccgacggcacgccgtatcgcgagctcatcgcgaagagcgccttcgacctggctcgtcgagccgacatcactgtccccgagagcacgaaggtcctcgtcgtcgtgaagccctacgtcagcgagtacagcttcttctcgaaggcgaagtttggccccgtcctctcgtactacgtggaggacagctggcgtaccgcgtgcgagaagtgcatcgagctgattctgaacagcggccacggcaacgcactctcgatcttctcgaaggatcccgaggtcattcgccagttcatcctcaagaagccggtgggcagggtcctcgtgaacgtgagtaccggcctcggctgcatcgggtgtcacagcgaccttcccaagacgctcaccgtgaccggttgggactgcgccaccacctcggagcttggggtcacctacggggacttcgtgcgacggcggcaggttggaatcggggagggagacgacgccctcgacctgctcgacaaggcgagctcgtgcgaccacaccccagtgacggtgaagattcggattcccagctccaagggcggagagaagagccgcacggacgagccgaagaatacaggcaaggagccgggagactggttttccggcgtagtacaggcaattcgtaacgattacgaagaggagtgagaatggacatcaaggagtttgcgaaggaactgtccgaggcaaccaaggacatgtccgacgagcagcgcgagactgttcgcaagatgttcgagaaggtggccgaccagctcgacgcgcccgccgctcctgcccacgcgcacgtgagcagcgatgatccctacgacgttcccgatggccccaccgaccgtcaggttcgcctgaaggacaacttcctcaagcaggtccccagcatcaccatgttccgcgctcgcgcggtcaccgaaatcatgaaggccaaccccggcatgcccaagatcgagctgcgcgccaaggccttccgccgctgttgcgagaccgcgcctctcgtcatccaggatgacgagctggtagtcggcgccccctgtggcgcgcctcgcgcgggtgccttctcgcccgacctcgcgtggcgttggctgcgcgacgagctcgacaccatcggcgaccgtcctcaggacccgttctacatctctgaggaggacaagcagtactgccgcgatgtccttttcccgttctgggagggcaagtcgcaggaagagatctgcgaggaccagtatcgcgaggctggcgtctgggagctctccggcgagtcctttgtctctgactgttcttaccacgccatgagcggcggcggcgactccaaccctggctacgacgtcatcctcatgcacaagggcatgctcgacatccagcaggaggccaaggatcacctggccgagcttgactacgccaaccccgacgacctcgataagatctacttctacaagagcgtcatcgacaccaccgagggtgtcatgatctactccaagcgtatgagcgactatgctaaggagctcgctgccaagtgcggcgaccccaagcgcaagatggagctcgagcagcttgctgacatcctcgcctacgtgcccgcccacaagccccgcaccttctgggaggccgtccagtccgtcttcaccatcgagagcctgctcccgttggaggagaaccagaccggcatgtctctgggccgcgtcgaccaatacatgtacccgttctacaaggctgacatcgaggccggccgcatcaccccgtaccaggccttcgacatcgccggctgcatgctcatcaagatgagcgagatgatgtgggtaacctcccgtggccagtccgagttcttcgccggctaccagccgttcgtgaacatgaccctcggcggcgtcacccgtcagggccacgatgcgaccaacgacctcacctacctgctgatggacgccgtccgccacgtgaaggtctaccagccctccatcgcctgtcgtatcaacaacaagtcccccgagaagtacatgcgcaagatcgtcgacatcgtgcgctcgggcatgggcttccccgcctgccacttcgacgacacgcacatcaagatgatgctcgccaagggtgtcagcgtcgaggacgctcgcgactactgcatgatgggttgcgtcgagccgcagaagtccggccgcctctaccagtggacctccacgtcctacacgcagtggccgatttgcatcgagctcaccctcaaccacggcgtgcccctgtggtacggcaagcaggtaacgcccgactacggcgaccccgcgcagtacaagacctacgaggagttcgacgccgcggtcaagaagaccatctactacgtcaccaagtggaccgacgtcgcaaccgtgatctcgcagcgcgtcgcccgtgacgttgcccccaagccgctcatgtccatcatgtacgagggctgcatggagcacggcaaggacgtctccgccggcggcgccatgtacaactacggccccggcgtcgtgtggacgggcctcgcgacctatgccgactctatggccgccatcaagaagctcgtgttcgacgagcacaagtacaccctcaaccagctcaacgagggcctcaaggcggacttcgagggctacgagcagatgcgccaggattgcctcaatgcccccaagtacggcaacgacgatgattacgccgacaacatcgcggctgacatcatcgactacaccgagcacatccaccttgacttcaagacgctgtactcgcacatgtccatcggcaccctctccatctccaacaacacgcccttcggtgagatgacgggcgcctccgccaacggccgcaaggcttggacgcctctgtccgacggcatcagccccacccagggcgccgaccacaagggcccgaccgcgatcatcaagtcggtttccaagctgtcgaacgactccatgaacatcggcatggtccacaacttcaagctcatgagcggcctgctggacacccccgagggcgagaacggcctcatcacgctgctgcgcaccgcatcgatgttcggcaacggcgagatgcagttcaactacctggacaacaagacgctcatcgacgcccagaagcaccccgagaagcaccgcgacctggtcgtccgcgtcgccggctactccgcgttcttcaacgagctctgcaaggacgtccaggacgagatcatcagccgcaccatgctgaccaagttctaatttccgtaacgtctgaaggtcaaagggagccgcacgtcgcggcatgtcacagaagggagaggttgcaatgagccatgagcagggaagcgtggaacgcaaggcacgcatcttcaaccttcagaagtacaacatgtacgacggccccggcgtgcgctccatggccttcctcaagggctgcccgctccgctgcaagtggtgctccaacccggagagccagcagcgtggccacgaggtcatgttcaagaccgccaactgcgtcagctgcggcgcgtgcgccgcggtctgcccggtcggcgtgcacaagatggtcgacggcaagcacgtggtcgaccgcagcgtgcagtgcatcggttgtcgccagtgcgagcaggcttgcatgtacagcgccctgcaggtgatgggcgaggatcgtcccgttgacgagatcgtcgagttcttcgacgaggacaaggacttctaccgcatgtccggcggcggtatcacgctgtccggcggcgaggtcctcgcccagcccgaggctacgctcgccattctcatggcgtcaaaggcacgcggttacaacaccgcgatagagacctgcgggtatgcgcccaccgagacgatcatgaaggtggcccagtacgtggacctcttcctgttcgacatcaagcagatggaccccgtgaagcacaagtactggacgggggtcaacaacgagcagatcctctcgaacgttaagaacctgctcgagaacggctacaacgtgcgagtccgaatgcctcttctcaagggcgtgaacgactcaaaggaggagatcgatgcggtcatcgagttcttcaagccgtatcggtaccagaagaacttcgacggcgtggaccttctcccgtaccacaagctgggggtcggcaagtacgcctccctcggcagggactacgagatcaaggaagacccgtcgctctccgaggacgatctcaaacgcgtcgagggatggatcaagaacgcggacttcaaggtcaacctcgtgaagcactagacggcaatcgagaggaatgtcccatccacggggcacggagaaactagagaggaggaaggcatgcactacgtaaccgaggacgagctgcgggaggcttactcgaaggagccgtttggaacctacgagctcccgaagggcgcccggctgactccaagcgccaggcagttcctgattgatttcagggtcgagtttgacggcggcgaaccgacgccggtagcgggcgcacatggacaggcggccaagggtatggcaagtgccagacagcccctggacctgggggcgctcgtgcacgacgccaacctcctgggcacgaggcttcgcctgctcgcccgcaggtccctgggcatcgacaatgcggtggcccgtcaggccgaggcagtaggacgcaggtggcagggggctacgaccccggcggacctcgtggctgacaagccaaaggccgaaggcacctgcgatccacctggaccgcctccgcagccggccttcgacgccggcgtgcaccccgtcttcttcgagatggcatatgtgcacgcgcagctaggcaggtttacccgcgcctgggcaaatgcccaggcaaaagcggggccggaggacgccaggacgatcggagcctggatcacggaggccgcgaaggtgtgcgaggtacttgaagcagcggtagagagagctggggaggaggtgtagcgatggtcgatcttcaaaggacaaacgagaggctggatgatctgctctcctgcgttgaccaccccaaggcggttaaggagggccagaagctgtattgcggcctcgacttgggcacggctttcatcgtgctcgtggtcctcgacgaggatggcaacccggtcgactgcaagtaccagttcgccagcgtggtaagggacggcatggtcgtcgactatgtgggcgcctgcgacatcgctcgccacctcaaggaacagatcgaaggggagctgggcgtagagctcgaagagtgcgccgttgccatccctccccagacggagtcgctcgacggtggcgtcgttcgcaacgtcgccgagagcacggggatggagtgcaccgcagtcttcgacgagccgacggccgcgaacctcctcatcggcaccaaggacggtgccgtcgtggacatcggcggcggcacgaccggaatctcggtcttcaaggatggcaaggtcgtcgagtgcatcgacgagtccacgggaggcacgcacttctcacttgtcctcgctggtgccaagggcatgagcttcgacgacgcagagctttacaagcgtcagccggagcaccacagcgaggttcttccgatcgtggccccgaccatcgacaaggtgacctcgatcatcaagagggcatgcagtggctacgacgtccccgaggtcatcctcgtcggcggcacggcggagctcacgggcatcgaggaccgggtcaagaagcagcttggcatcgaggtgcacaagcccaaccaccccatgttcgtaaccccaatgggcatcgcgcttggctgcatgctcaaagctaaggagcgccaggatgcttgatatcagggtcatcaaggctccggcgccggggaccatgcagatcatccgcctgaggagcggggcgcgctggagcgaggactttcgccctgctgcggtcggtctcgtgcaaggcaagatgatcgacatggtggtcgcaagcgatatcgcggagaagaccgcgggcgtggtcgtgaccgacgtgaggggttcctgcccgcaaaacatggtgatgcttgccatcgcgggcgagacggcagaggtaatggagtgcctgaccaagattcgagacggaggggaccacacccatgattgtgggtaagctcatcggctcgatctgggccacgcgcaagtacgacgagctcaacggcatgaagctcatgcgcgtcgaggtcgtagccggggatgacgcggggaagcagctcatctgcgtcgacaccatcagcgcgggagtgggggacagagtcatcgtgaccaccggcgcttccgcctacctcttcatgagggatgagttcaacaagaacgccccggttgacgctgtgattgtaggaatcatcgacgaagacgtgagtctgtaaggaaaggaggacgggatgaagaggcttatcagcgcgaaggacgtcgtcgcggcggcagagcaccacaagaacatcgtcgtggacgacaacaccatcgtcaccgcccaagcgcgtgacgtcgccaaggagcgcggggtcctcctccagagcgaggccgaggctgcagccgagcagcacgaggaggctcccgctcaggagcatcacgaggaggttgccccacagcatcacgtggtgaaggagcacaagcatgaggagaaggagcctgccctctcggcagacgagctcgagcacctcatcgccgctgcgttcgagaagggcatttggaccaaggacgacatcgataccctggtggggaaaaagcctgcggccagcaaccccaacattgttcccgtgggcgtctccggtcgtcacatccacctgtccaaggagcacctggagcagctgttcggcgttggctacgagctgacccctatcaaggacctgagccagcctggccagtacgcctcgaaggagtgcgtgaccctcgctggacccaagggcgtcatccagaaggtgcgcgtgctgggtcccgtgcgttctaagactcaggtcgaggtgctcgcgggcgacaccttcaagctcggcatcccgcaggctattcgcttgtcgggccaccttgagggaactcccggcgtcaccgtcatcggaccgaggggcaccgtggttctgaacgagggcgtcatcgttgccgctcgtcacatccacatgaaccccgcccaggcagccgagcgcggcttccacgacgggcagatcgtctccatcaagaccggcggcgagcgtggtggcgtcctggacaacgtcatcatccgcgtcacggagaccggcaacctcgattgccacatcgacaccgaggaagccaacgcacttcacatcaagtgcggcaccacagttgaggtagtcaggtagcaggtagcaaaggcgtaatagcgcaggtaacggacccagggaggaaaaatggcaagcacgactgaggcactcggaatgatcgagaccaagggcatggtcggagccgtcgaggccgccgattccatggtcaaggcagcgaacgtgaggctcgtgggcaaggagcgcgt

SEQ ID NO: 125 - DNA, 1527 bp, Unknown
  Metagenome-assembled genome
gcgggtgggcgctgctcgcggcgggcgacgccgaggcagccaactgcatgacggtgagctggggcggcgtcgggacgctgtggggcaagccagtcgccacggtctacgtgcgcaagagccgctacaccaaggagttcatggacggtggcgactacttctcggtcaacctgtttgacgggacggagcgcaaggcgctgggcctgctgggccgcgtgtccggccgcgacggtgacaagctcgcggagtcgggcctgacgcagtcgctggtagagggcgtgcccgtgatcgaccaggccaagttggtgctggtgtgccgcaaggcatacgcggggctgctcgcgccggagcacttccgcgacccggcggcggaagacaagtggtactccggccaggacgagggcaactaccacaccatgtacattggctacgtggagcgcgcgctcaaggcggagtagcggggcggcgcaaaggtggcgtaaagattgcgggcgggcgccggcgggacgatgcgatcccatccggcgcccgcccgcgtccgttacaactcgcggcgctggtaaaggcccgcgtccgcaaagcccaggtggcggtagtactcgcgcgtgcccacggagctgatcacgttgatgcggccgtagccggcctcgcgcgcgatgttgcaggcgcgcgagaccagggcgcggcccagcccctggtgctgcgaggacgagtccgccttgccaaggtgcgccgcctggccgtacacgtgcacttctcggatcatggcgtcgccggggcgcgtgggcagctcgtccgcgcacacgtccagcgtgccggccgcgagcgcgtcccagctgggaagcgacagccgcaggaagccggcgatgcggccctcgggcgtgacccactgcagaaagtgctcgcaactgacggctgtctggtacgtcacatcgtccagcgcgagcgtgtccaggtcgacctgcgagcgcgcgatctcgcgaaagcggatgtcatgcacgcgaccggccagtccctcctgccggatgcgaccctccaccatctggcgcaggttggtcttcttgttgccaaccaggatgtcgtccgcgccgatgtcgcggatcatgcggctgatgcgcatgtacggcggcgtggccagcgtgtccgccaccagcacgcttagcagctcatcctccgtgtagggccgccagcgcccggcgtgatacagccccaccagctgcgtgcccgccacgagcgcgcaggggtagagcttgacctcgtccggcaaaaagccggggtctgtcacgaacgtgcggaagtctgccacgtcctgctccggcgttgatcccagtaggttgaccatgaggtgcgagtggatcttgaacccaaagagccgtatgagcgagaaggaccgccgtatctgttgcaccgtggtgccacggtggttggcgtccagcacctgctggcgcgtggactggatgccaacctggatcttggtgcagcccagcttgcggaagagcgtgaggctctgcggcgtgatggcgtcgggcc

SEQ ID NO: 126 - DNA, 5074 bp, Unknown
  Metagenome-assembled genome
ctcgtacagaaggtcaagggcatgctgagcgagcgcttcacgaagttcgtggggtcgtcgctcatcagcacgctcgtggaccaggtcatggccttcctgctctttgggtggctgcgccccgtctttgcgaactcggacttcctgcgcatcttctccgcgacgctcatcgcgcgcgtgtgctccgtcaccgtgaactacatcatcaacatgaagcgcgtcttcacggacgaccgccccgaccacgccaagatcgaggaggcgcacgaggagcagctcaaggccgagcccgaggtcgaggacatcgacatcgacgaggacgacgaggccggcatcgactttgacgacatcgtcgagggcccggacgacgaggtgcgcctgggacaggtcgaggtgcgcccgatgcgcgagagcctgccgaggttcatcgcgctggccgccttcgtgctctttctctcgagcgtgggcgtctacattggccacacgatcctgggcgtcaacgagagcgtcgcgaagatcgtgtgtgacctgctgctgttcttcgtgaactactacttccagcgcacctgggtcttcgcgcgccgcaagcgccactcccacaggatccgcatccgcaggccgcaccgccgcacgaacaggtaaccggtagccggcacgctggcgcagccgacacgcggacggggcgcgaggcccagcccccgcgcgtgtgggcgcgcgctacgcccgtcccacggtctccagggcgacgcgcgccacctcctgtggcgcctccttgggaagcacgtgacccgcacccggcacgatcacgagcctggagccgggtatcgaggcgtggatgaggtccgtctcctcgcgcttgatctcgtcgaactcgcccgccatgaccgtggtggggcaggctatcgcggcaaggcccgcggggtctatgtgcgggtggacgaccatcatgtgcaggagctcggccgtcgtgcgcgcctctgccggcgtgggcctcacgagggcggggtcgacgtcgcgacgggagccgtcgcccttctcccagaagtctgcccatgcaaggaggctctgcgcggcctgctccatctggaacgagtcgtccacgccgtcgggcgagaggttggcgccgatggagaggagcgagagcacgatctccgggtggtcgcgcgcgatgatgagcgcctcgatcgcgccgtccgagaacccgagcaggtgcgccttgccaaagccgagcgccgcaagcgcgaccagggcgtcgtcggccatgagttcgtaggtgagctccgccgtgccgcgcgtggacttgccctgcgcgcgcgaatcgacggccacgaccggccgacccgacgtgcagacggcgtcgatcacctggccaaagatgccgtgctcctctccgttgccgtggagcatgagtaccgggtccggcatctgggcggcgtcatcaaggcctgcatccgccgcgcgggcaaacgtgtccggcacgtacgcgaaagcggcaatttttgcgccgtctgtcatgggcacgaggcgcgccgcggcaaggcgtgccgtcggcaggaggtaggggctgggaaagtggagctgcggacgctcgggcatggttgcctccttcgtgtgtttacacgatggtagcccatgcggcgtcgcgcgtcatggcagccgtagggagcttcggcaacgcgggctgcggcaagtcgcggtccgcagccagcgggggagaggtgcacggcgactcgggcatttctcatctatttattgactgtgtatttacgtaaaaatatttccataagagatagcatgcattgcaatacaagatgagggctacagaaattcaagaaagttggtcatcacaacacgagataactccataagtgacactaattgcttcctaaatagcagcttattagcctgttatcagatctattccgtttggcgacagcaacctaccatttaacaactgatgttaaagatagctatatgtaacaaacctgaaatactaagctgtgacgcgttggcgtaacaatctattcatgccttgcataggcgtgggagaggggctgcatgatgcctgagtcaagggagaggaagctcggtcttttggtgttggatgcgcgcgctgtggtgcgtcgcttctcgaagtgcaggacgctctgcgcccttgccggcattgccgttgcggcagcacttgtctccccggtgcaggcgtatgcaacagaggccgttcccacggacgctccgcagggtgtggctgcggagcaggttgctgcaccagacgcatcgctccaggcgacggggcaggcggacgtgaccgtccaggctcccagccaggcaaaggacccctcaaaggcggttgccgactccagtgcggaggctagtgtgcccgcagagcctgccgcgccgcaggctgatgcgccttcgacagaggagacgcccgcatctcaggaggcggcaccgtctgcggaggctggatcggtgcaggcggacgcggccgtaccgcaggcaaaccttgcgcccgttgcacatgatgagaccatgggcaacaaagatgacgttgccgcggctgatgagaagcaggcggatgccgggactgcgcaggccggtgcaacggatgcccagaatgccgcgctgcatgacgcggcgatgaaggccctctcgaaggcgattcgcttcgacaagtccggcaccacgatcattttggacttcaacggtgacggcaagaccgacgacacggattgggcgacctacaaggactggatcaagacgtaccgcgtgttcgacttcaacggagacttctcgagcggctacaacggtggccttcaggtgacgggcggcacgcagctcgtcgcgaacggccacgacaagggccccgatgacctcaacatcggtatcgacgtcgacaagatcaagtcgtactacctcaacaacatcggtcaggcgacttcggtcaagaaccagtctccctttggcagctgctgggcgttcggcgctacgtccgcgctcgagagcgcgatcctcaaggcgatggcaggcgagaagggcatggcatacgacccggcgctccaccagacgccgaacctcaccaacgtcgaggacggggttgacctctcggagcttgagcttgcatggctgtgctactccctccagccggacggtgactacatcaaggacacgcttcccggggacaccgattctgaccgcctgagctgtggcggctggggtgcgatggccgagacgatgtataccgcgtggcaggccgtggccaacgaggcggacgacccctactggccgctcgacgtgccgaagacgtacgagaacttcaggaagcttggcaagttcgtctggggtctgaccgagggtaccaagacggcgatcgcccacgtccagggagtcaactatctgcccgaccccgccattcttcagctggacaagcaggaacacatggtctaccagggcctgaaccagaacgccatcaagctcatcaaggaggcgctcgtcaagtatggcgccgtctccattggctaccaggccgacaccgcgcttcctggcaagccgtcggagtccggctacttcaactccacgtactgggcacagtactgcgacgcggtgaatgacatcacggatacgcatgcggtctgcatcgttggttgggatgacaacttcgaccacaacaagttcaaggccgagaagaacgacgtatcgaacctgaaggacggcgcctggctcgtgaagaacagctggggctcctacgactggctgaaaaagaacttcccggacgccgatccctcgaaggccggtaaggcggcgaactggggcattatggatgcagagggcaaccatacgggatacttctggctcagctactacgaccactccatcgtcactccgtcgtacttcgaggttgacctcgcctccgacggctttgactatgacaacaactacagctacgactatctcatcaacgagtcgcagataccgtttgtgcttcgcacgaaggacaccgggaccgaggtcgcaaacgtctttaccgcaaagggtaaagaggacctggccgcagtctccgtccacacgttcgtggcggactccaccgtccatgttcgcgtgttcctggtgaacgacgatgacctgaggggcaacgaccccacgagtggcaaatgcgttgcggacttcacgagcgaccagctggtctccggcttccataccgtgaggctccccaaggtcattcgcctttcgaagggtcagaagtttgccgttgtggaaaacatcacgtctgccgacgcgaacgacgatgctggtggtcgcgtttcgtacatcgcgctggagacgggtctggcgaaggatgcccagaccgacgacaacatgggctatctcttctcgcatgcgaacgcggacgcgggtacgacgtacgtgagaatcctgacggaggatggctataggtggatgacaccgcaggagcttgctgacaactacgacggaggtcagatcttcgagtttggcaacgccatggtgaaggcgttcaccgcgaacgctccggaggaggcggtgcctcactgcgatgtcgcgacgcccggcaacgcgctgcccacgacgcgtaatgtgccagctcaagcccaggcgggcggtatggttgctcgtcaggcggtggcgcgcgcggctgcctcggaagcactgcctcgcactggtgacgcgaatgatgccgcaacggagacggcgctctttgcagccgccctcgccatcattggcgcgggacttgcgactcgtcgcgcgaggggctaacgacagggtaggcgggctgcggcaggtcgtggcccgcggccaacgggggaagggcgcccggcgattctggcgcttctcctcaaaggaagggcgcccgtcggattgatgtccggcgggcgcccttgtgcgtctggaacaggtggcgttgtcttggggctacttgcccttcttcacctgcgaggggtgcttctcgaagaagtcgaaccgcggcggcagggccacgatcgcgtgctccccgggcttctcgcccagcttctgcgcgagctcgcccggcgtcgcgaaggcgttgtcccagctgaagaagagg

SEQ ID NO: 127 - DNA, 6846 bp, Unknown
  Metagenome-assembled genome
cacgcacggcctcgtcaccgccctcgcgcacggcgtccacgatcttctcggccgactccatgacctcgcggggcagggcgccctggcgctcgaggtctgactgctggagccgctggctcccggttagggttacggtcctcatgctcttctccttagtccttggccacggcctgtgcgagccttgccgcgagcgagcggatgcgcccgtcgtagcggtaggccgccggtcctgcgaagaatcttgcggtgcactgcatgacctcgtccacgatcacgaggtcgttctccctgagggttgtgccggtggccgtgatgtccaccaggcggtccgtcatgcccacgatcgggcccagctcgatgttgccgtggagctggacgatgtccacctgctggccgatgcggtcgtagtagctctgggtgatgcgcgggtacttggtcgcgacgcggacgctcccgcgccagcggtatgcgtcctccgcggcgcccgccttggagcgcggctctgccaccacgaagcggcagccgccaaagcggaggtcgaccagctgtatgaggtcgtggttcgcctcgaagatcgagtcgtagccgcagatgccgcagtctgcgccgccatgtgcgacgaatgcaggtgcgtcctgcgcgcggacgatgacgtactcgacgtcgccgtcgcgcacgatgagcttgcgtcccagatcctggagcttgtccgtgggcaaccccgcctcgcccaggacgcgcacggcgtccgggaagagcgagcccttgggcaccgcaatcctgagcgggcgctccgccaggctcacgtgcgagctcacgacgccgctctcgccctgctcacccaggatctcctggagccgctcgagggagagggcgaagccgcacgacgccacgttgggacggccgaagttggcgagcacggcgtcgtagcggccgccggaggcgatggatgccgtgatgccctccgcgtagcccttgaagatgatgcccgtgtagtagtcgaacgagttcacgatcgagaagtcgaaggagaggcggccggccgcgtcgagttccgagagagccgagacgaagcgttcgagctcctgtgtgccgcgctcctcctcaggtacgcccgcgtcctgcagcagggagtcgatgcgcgcgatgacctccgagccgcccgacatgcgaggcacctggtgcagcgcaagccgcgcgggctcgctcagatccgcggagtcgacgaggtcatccaggctcacgaggtcggactcgtgcgcgtaggacagcacgccctccttgaactccttggagggcgaacagtgcgcgagaagcgccttgagcggcgacacggagccgcacacgatgcgccaggccggtacgtccagggcctcgagtgtctcggccaggagcgatacgacctcgacctctggaagggcgtcgccgtcgtcgtttccgtagtactcgatgccgagctgcgtgaactggcgcggctggcccttgagcgaggactcctccctcaccacgggcgcggagtagcgcaggcgcaacggcaggtcgtccgccgccatgcgggacgagaccatacgtgcgatgggaagcgtcaggtcggggcgcaccatgagcaggctgccatccgcatcaaagagctggaacggcgagtcctcgatgcggctgccgacggacaggagccgcctgtcctcgaggatcggcgtctcgaccggcaggtacccatgcttcgagaagcactcgcgaacgattcccgtgatgcgctccctcgcgagcgcctccgtcggaaggatgtccctgaacccacgtggtgttactgcaggcatctacacgttcctctcgcccaagcggcccttgccgtatgccttcaggatgcggggcattcgctcctgcgcctaccccagatggtgggagtactttatcacactaaagtgtttgggcttccactcccatgaatcggtaacgtcagcgaaacgaagggggaaggagggcgagaagagcggtcagcgggcggaaagcgtccgcgtgatgtctgcgaaggtcgcgccgaggaagtccctaagcgcgactgggtcgagagtgagcgagaggcccctgcgaccgcccgagatgcctatctcgtcgaatagctgggccgtctcatcgatgagcgtggggaactgcttcttcatgccgacgggagtgcagccgccgcgcacgtatcccgtgagcggctcgaggtccttgattgcgatgagctcgagcgatttctcccccgcgaccgcagcggccttcttgaagtcgagctcctccgcgacgggtatgcagcagacaacgtggtcaccggagggcgccacgcagacaagggtcttgaactggctgtcagggtcctcccccgcctcctgcgccatgcggagtccgaggccgcgcgagatgtcgtcctcctcctgctcgtgccaggtgtaggagacgccgccgcgctcgagctcgcgcatcgcgttcgtcttctggatcttctccttcttcgacatcgaaccactatctcccaggtctcacgttaaatcagccgttcttgcgcttctccatgcgcgcgcggtcgcgctcgagcagcggcttgaggtacctgcccgtgtacgactcttcgcattcgcagatcttctcgggcgtgccgtagcagacgatggtgccaccgccggaaccgccctcgaggcccaggtcgatcaggcggtccgccaccttgatgacgtcgaggttgtgctcgatgacgagcacggtgttgcccgcgtcgacgagcttctggagcacgacgatgagcatcctcacgtcctcgaagtgcagacccgtcgtgggctcgtccaggatgtagaaggtcttgcccgtctgctggcggtgcagctccttggcgagcttgacgcgctgcgcctcgcctcccgagagcgtggtcgcgggctggccgaggtggatgtagccaaggcccacgtcgtagagggtctggagcttgcgcttgatgcgcgggatgttggagaagaacgccagcgcctccgtgaccgtcatgtccaggacgtccgagatcgacttgccgtggtacgtgacctcgagcgtctcgcggttgtagcgcttgccgtggcatgcctcgcagggcacgtacacgtcgggcaggaagttcatctcgatcttgatctggccgtcgcccttgcacgcctcgcagcgtcctccggggacgttgaagctgaagcggcccgcgctgtagccacgcgcacgggactccggcgtcgaagcgaacagggctctgaggtcgtcccagaggccgatgtaggtcgccgggttcgagcgcggggtgcggccgatcgggctctggtctatgtcaatcaccttgtcaatgaggagcttgccctcgtcgtcgcggatgccctccacacggcggtacggtccgcagatgcgtttcgcatgctggatctcgtctgcgaggacgggcgcgatcgtgtccgtcacgagcgacgacttgccggagccggagacacccgtcaccacggtgaacgttccgtactcgaccttcacgttcacgttcttgaggttgtttgcgcggcatccaaagatcttgaaggccccgcggcgcgggtttctcctcttctcggggacctcgatcaagcgatgacccgtaaggtaggcgccagtgagcgagtcggggttcgccatgatatcctgcggcgtgcccgcggcaacgacctgaccgcccagctcgcccgcaccggggcccatgtctattacgtagtccgcggcgcgaatggtgtcctcgtcgtgctcgaccacgatgaccgtgttgcccatgtcgcgaaggctcttgagcgtcgcgatgagccggtcgttgtcgcgctggtgcagtccgatggatggctcgtccaggatgtaaagcacgcccatgaggccggcgccgatctgcgtcgcgaggcggatgcgctgggcctcgccgccggagagcgtcgtggcggcgcggctgagcgtgaggtagtccaggccgacgttcaccatgaagcgcaggcgcgccacgatctccttcactatgggggcgccaatcaggtgctggcgctccgtgagcgtaaggtgctcgaagaactcgaggctctcgcgacaggacatgtcgcagacctccttgatgttcttctcgcccaccgtgaccgcgaggtactcgggcttgaggcgagctccgtggcacgtggggcacggcacctcgcggatgtacttgtccaggtggttgcgcgtggtctctgacgtggtctcttggtacttgtcgaacaggatcgagcgcacgcccgagaacttggtgaaccagtacgtgtcgcgcccgtcgcgcgtatggtagtcgacgcgaatcttggtctggcccaggccatcaagaatcgcctcgcgcgtcttcttgcgcaggtccttccagggtgtctccgggtcctcgcccagatgcttgagcacagccgcgaagatctgcggatagtagttggacctgccgaagagcgacccgaagactccgtccacaggaaggttagggtcctcgatcaggctctcggcgtccacgatgcggcgcacgcccaggccatcgcagtcggggcaggcgccgtacggcgcattgaagctgaagtcacgcggctggaggtcgtcgatcgagtggccgtgtatggggcaggcaagcgcgagggagtactgcagcagctcgccctccgtgccctccggcgcgtcgcggtcaggcaggaggtagaaaccgacgcggcccgaggcgagtttcgtggcctgctccacgccctcggcgatgcggccgagcgagttctgacggatgacgatgcggtcaaccacgacctcgatcgagtgcttgtacttcttgtcgagcttgatgtcctcgtccagctcgcgaacctcgccgtccacgcgaacgcggctgaagccctccttgcgcaggtcctcgaagagcttctggtactcgcccttgcggcccagcaccacaggtgccagcacgtaggcgcggcggccctgtccggcctcgaggaccttgtccgcaatctggtccgtcgtctggcgcgagatggggcgtccgcactccgggcagtgcggcgtgccaatgcgcgcgtagagaaggcgcaggtagtcgtagatctccgtcacagtgccaacggtcgagcgagggttgcggctcgtggtcttctggtcgatggagaccgcgggcgacaggccgtcgatcgagtccaagtccggcttgtccatctggcccaggaacatgcgcgcgtagctgctgagcgactcgacgtagcggcgctggccctccgcgtagatggtgtcgaaggcgaggctcgacttgccggagccagagagtcccgtaattaccacgagcttgtcgcgtggaatggtgacgtctatgtcgcgcaggttgtgctcgcgcgcgcccttgatgacgatggagtctgatgccatggatacctcttcggccgcatcctgaaagttcttctcaccttgagtgtatccaagcctaccccaacgagcgcggcgtctatacgctccgtggcaacttcatagaacaaatgtttgcttttctcggcggacggcaccatcgggcgagaaggacagtcttccctctttttttcttccatacgtgggggcaccgtgcaatctgggtaaaggccaactcaaggcacgagcgacacgggcggatccagagggttgcagtcgcaacaggcgagcggtacactcgggggcttccacccgctgcatgctaaagttacatgcgtaacaacatgcgaatccgcacctttaagcagacacaaggaaggtggcacatggcagacagcgatttcgacagggacgccatccaggacgaggtcgatcagatcttcggcaaccgtcccaagcacgagggtcccgagatgtatcagacaaacgaccagtcgagcatcaagcacgtgatcggcgtcatctccggcaagggcggcgtcggcaagtcgctcgtaacgggcatcctcgccacggagctcaaccgccgcggccacaaggtcggcatcctcgacgccgacatcacgggtccctccatccccaagatgttcggactctctgggatgcacgtctacggccaggacgacaagatcatccccgcccagtccaagggcggcatcaagatcatgagcaccaacctcatcctcgagaacgagaacgacccggtgctctggcgtggccccatgctcatgggcgcgctcaagcagttcttcgaggacaccctctggggcgacctcgactacctgctgatcgacatgcctccgggaaccggcgacgtggccctcacggtcttccagtccctccccatcgagggcgtcgtgatcgtgagctccccgcaggacctggttcaggtcatcgtgggcaaggccgtcaagatggccgcgatgatgaacgtccccgtcatcggcgtcgtggagaacatgagctacatggagtgcccggactgcggccgcaagctcgagccctttggcccctcccacctgcaggagatcgtggacgagttcaagatcgccgacctcgggcgcatccccatcgacccggaggtcgcggcggcctgcgacgcaggagacttcgagtccgcccttcccgacggcctcattcccaaggcggtagccgcggtggaggcctagccgatgaccgcaaacgcccacaagcgtaagacgcaatcccgcgcccaacggcgcgaggccctgctcgacgcggcgtcctccgtggaggtcgccgcgtcctatgacgtcgtggtaatcggcggcggtgccgctggcctcaccgctgcaatctgcgcgggcgagaagaacgcgcggaccttggtcctcgagtcctcccgggagtgcgggcgcagca

SEQ ID NO: 128 - DNA, 11261 bp, Unknown
  Metagenome-assembled genome
ttgcgggcgagctcgcgcttgagcttgtacgggtcggccgtgccgtccgcaaaggcggcgtcgatcttgtcgacctcgtccacgggcagcgtggagcacaggcggaagtagcgcggcaccatctcgtccgcgatggacatgagcttgccatacatgtccgccggctcgtccgtgaggcccacgtagttgtggtagctcttggacatcttcttgtggccgtccaggccctccagcagcggcatggtcagcgccacctggggctccatccccatgtcgcgcatgaggtcgcgacccgcgagcaggttgaagatctggtcgtttccgcccatctcgaggtcggccttgaccatcacggagtcgtaggcctgcagcacgggatagatgaactcgtgcagagcgatggactggccgttggtgtagcggttgtggaagtcctcgcgctccaggatgcgggccacgttgaacttgctcatgagcccaagcatcttgtcgagcgtcatcggcttgatccagtcgccgttgtgcacgaccttggtgcgcttggggtccaggatcttcatggcctgggcaacgtaggtctgcgcgttggcctcgacctgctcctccgtgaggggcggacgggtgctgtcacggccggacgggtcgccgataagcgccgtgccgttgccgatgatgagcgtcacgttgtggcccaggtcctggaactggcgcatcttgcgcagcggaaccgcgtggcccaggtgcaggtcggggctcgtagggtccacgcccagcttgatgttgaggggcgtgcccttctcgagcttcttcttgagctcgtccaggggcaccacctgcatggtgccggaaagaatgaccttgagctgttcgtcaacgggtagcaacttgaatcctccttggacctcgcggccggtcgccagcgccctcgacgggcgggtgagaagaaccgcgcgccggtgcttggacagatgcgttaaggatagcgcaccttggccccgacgtttggcgggatggcgcgcaaacgctgcgcactaatatatgtcctcggcggcgcgtaccatgcgtggcaacccgcacggcgccaggcccgcgcgggccgcagcttggtagtttgtacttctcgcctagattccagccttaaagcaacgtctggtcgactcacttataattggtccgtctggaccgatttccctcgggagggttatatgagcattcgcacacgcagggcgcacaggcatgcgagcacccatgcggtgggctttggcatcgcgggcttctttggcttcgtcgcgctcttgacgctggcgctcttcgcgtcgctcggcacggtggtgagcaactggctcaaggacctgcccgactacacctcggccgacgcgtacctcgtggcggagcccacgacggtctatgcgtccgacggcacgaccatcgcggagtactacctgcagaaccgccgcagcgtcaagaacagccagatatccgactacgcgctcaaggccatcgtggacacggaggacgtccgcttctaccagcaccacggcgtggacccgcagggcatcctgcgcgccatcgcggtacagctgggcggcggctccgagggcgcctccaccatcacgcagcagctggtcaggaacaccgtcctgtccaaagagcagttcgacatgacgatcaagcgcaaggtgcgcgaggcgtacatcgccatccagatggagaagatgtacaccaagaagcagatcctcaacatgtacctcaacacgatctactttggccacagcgcctacggcatcgaggccgcgtccatcacgtacttcaacaagcacgccaaggacctcacgctggccgaggccgcgaccatctgcggcctgccgcagtcgccctccgtgtacgaccccatcaagaaccccacggccgccaagaagcgccgcaacatcgtgctcgaccgcatgtacgcggccggcgacatcaccaagaagcagtgcgaggccgccaagaaggaggagctcgtcaccaaccccggcacgctgagcgacaacacgggcaagtacccgtacttcacggactacgtcaagaccctgcttgagaaggactttgactccgacacgatcctccagggtggcctcaaggtctacaccacgatcgacccctccgtgcaggccgcggccgaggactccgtcaagaagaacctcgacagcttcaacaacgacaagctgcaggcggccctggtcgccatcgaccccagcaccggctacatcaaggccatggtgggcggccgcgactacaacacgaacaagttcaacctggccacgcaggccgagcgccagccgggctccagcttcaagacctacacgctgtgcacggcgcttaacgagggcatgaacccgcagatctacatcaactgcaactcgcctctgcaggcctcgcccacgtggtccgtctctaactttgggcacaccgactacgggaccatcacgctcgccaaggcgtttgcggtgtcttccaacacgggctttgtccaggtgatccaggcggtgggcgcgagcaaggtcgccgccatggccaagagcatgggcgtcgacgtggacatccccgcgtacgactccatcacgctcggcacggtgggcatccccgtgatccagatggcagagggctactcgaccgtcgcctccggcggcaagcaccgcgactccgtggcgatcaccaagatcgaggaccgcaacggcaacgtagtctacaagcacaaggacagcgccaagcaggtcttctccaccgccgtggccgacgccgcgatcgacgtgatgaagggcgtcgtctccacgggcggcaccgcgagcgtcgtgtcgagcaccctcaaggtcgaccagccggtcgccggcaagaccggcacgaccgaggacgcccgcgacctctggttctgcggcatcaccccgcagctctccgtcgcggtctggtgcggctacaccgaggagtcgacggtctacgtcaacggcgccaccgcccacccggccaccacgtccgtccccatttttgtggacttcatcaactccgccctggccggccaggcccgcaaggagttcccgacgagcaacgagaccgtgacatacaagtccaacagctcgtggaagttcaaggcgaccgcaagctattccaaccgctcgtacacgagctacaagaacacgggcacctcgtccaacggctacaccaacaccacgaccacgacgaccaccacgaactcgaccaacaactacagcggcacgggcgacacgacgaccgagaccggcacgggcaccacgaccaccggcggaaccggtgggaccggcggcacgggcggaaccggcaccggcacggagaccaccaccgacacgacgggaaccggcgagtagcgcaggcttcgacaccccacacgccaccacgcgagataagagacgcgggcgagaagaacgatcttctcgcccgcgtcttttgttggcatgccttgctatgtctgccggtgcgacgccccttgtgtggtggcgctcccccgccgcgacggttggcgccgcgttggcgctacttcttggcgtcgcgcagcttgtttaccaggttgacgaggtcctgcgcagcctcgccgcagccggagaccacgagcaccgtgtcgttgccggcgacggaacccttgacctcgggcagggacgccgcgtcgacggcggccgccacgcccggcgccgtgcccggctgggacttgatgatcacgaggttgtccgcgcggtcgacgctcaggacgaactcggacaccatacgctggaggtgcaggtcctccgccaggacgtagatgccctccgacagcttgcgcaggcccatgtccgcgatgtcgcgcgagacggtggcctgcgtgcagttgaagccgatggcctggagctcgtcaacaagggcgcgctgggtgcggatcgacttgccgcggacgatgtccctgatggcgtcctgcctgttgttacgtctctttaccatacgccttgcctccacgtgtacgtaggcatgcagcccgcccacgcggcgggctcgttttcgatatcgtgtatcaagttaaattaatattagataaaagtcaacatagatgaataatcggcacgtgagtggcaggaatatttttcaaacggcgtctcacgtcggtttttactaatcgccccgattgccgccccgcacgcattttgcccgccgaggtcgctatgcacggccgctccccatttttgggtatcctccgctagacatgtgcaataagatgggtcacaagtggcacatatgtcgcattcatcgcaccttaatgcatcaagaaggacaagacatgccgtatagcaacagcaaccgccgcggctcgtctggacgcgggtatgcaccgcaggacgcccgcacgtcgcgggagtaccagtcaagccgggcgcacctgagcgagccgcgccgccgcgagagccgctcgccctaccgcagcaaccgcaactaccgcaccatcagcgggcacgacgcaggcctcaacgtccgcaacggcatgagccgcaggcgcaggcagagcggcatcctcgggcgctttggcatcagcaaccgcgagctcgcattcctggtaggcggggtcgtcatcctgatcctgctgatctttggcatcagcagctgcgtgcggggctgctcctccaagtctgcgtccagcagcagccagaccaccacgagcaagaaggccgtcaactccgtcgacaagcgcgtggcagccggcacgtccgaggcgctcaccaagaagctcaagacctcgctcgaccaggccgacgggctcgactggattgccgcgcacgccaacaagtactccgactcgcggctggtcgagctggccatgcgcgagccgacggcaatctccttcgtgaagggggcgctgtccgcaaagtcaaccgccaagtcctacacggacgggacggagaagggctcctatcccctgctgtacgactgggacacgcgctggggatacgtgagctacgccggcagcatcatgggcgtgacgggctccggccccacgacgctctccatggcgtacatgggcctcaccggcaagaacgaccagacgccgagcgtgctcgccaagctcgcgaccagcggcaagtacacggacaaaacgacgggcaccaccgccaagttctttaccgaggtcggcgccaagatcggtctcaccgtcaaccagtacacggcctccgcgagcaacatccaactcgtgctgggcaacggcggcgtcgtggccgtgcagctcaaggccggcttcaccacgccgtacgcgcactgggccctggtgatgagcgccaacagcgacggctccgtcagcatgtacgacccggacagcacctccgcgagcacgcacacctgggcggccggcaccatcgcggccaacgcgtccgacatgtacgcgctcacgtccaccagctcgtagcggggagaagaacgcccgccgcggcagacgcggcaacatggcagcaacagcccagcccccgggtgcccgtgcggtgcctgggggttttgccatgccgcgcgcccatgccgggccacgaccacggcgccgcgcccttctcgcccgccgcaccggcgccggcacgcaaaggggcccggcccccgcaagggaccggaccccacatgctcgaacttctcgccctacgcgggcgggccttgcaccaggctttcgccaggcgggctcccgctacttcaggatgccctccgcggcctcctgcagcttgtcgcgaacggcctcggcctcggcgcgcgtggcacccttggcgaacaggtacgccttgaccttgggctcggtgccggacggacggaagatgaccttgttgtcgtcctccaggcggtactcgatcacgttggcggcgggcaggttctgcggcgcctccttctgcaggccggacacgcgcggcatctcgggcgcggtcgcgaaatcggtcatgccggtgaccttgtagcccgcgatctccttcagcgggtcgttgcgcaggccgtccatgatctgcgccatgcgcttggcgccggactcgccggggaacatggagttgacggtgccattgagatagtagccgtacttcttgtacagctcctccatggcctcatagaggtccatgcccttctcggcgtagtaggccgccatctcgacgcacatctcggtcgcgacgatggcgtccttgtcgcgggcgtgcgtgcccaccaggtagccataggactcctcgaagcccatgaggaagcggtcctcctcgccctcggccttgagctggtcgatctggtcgccaatgtacttgaagcccgtgagcacgcggcgcatctcgaagccgtagtcacgcgcgagcgcgtccggcatgacggaggaaacgatggtcgagacggccaccttgcgcttggggtcctcgccgcggtcgattgccatcttgatgagccagtccatcagcaggacgcccatctcgtttccggagagaaggacgtactccccgttgtgcgggatggccgtacccatgcggtccgcgtccgggtcggtcgcgacgaccaggttgggcttcaccttgtcggcaagcttgagcgcgagctcgagcgcggagcggaactccgggttggggtacgtgcaggtggggaagttgccgtccgggtccttctgctcgggcacgacctccacgtcgttcacgccgatggacttgagcatgcgcgtgacgcactccatgccggtgccgttgagcggcgtgtagacgaccttgtagccctcgggcgccttgaagcccgggacggagaccttctgcaccgcctcgaggtagctgtccaggacctcctccggcgtccactcgatcaggcccttcttgaggccctcctcgaagtccatcatcttggcgccgccaaagaccggcgtcttctcgatggaggccgagatctcgtcagcggcctcgttggcgatctggccgccgttgtcgttgtagaccttgtaaccgttgtactgcgcggggttgtgcgaggcggtcagcacgatgccggcggaggtgtgcaggtagcgcaccgcaaacgacagcgtggggacgggctcgatgcgcgggtacacgtacacgtggatgccgttggcggcgagcacgccggccgcgaccttctggaagtcctcgcccttgaggcgcgagtcacgcgcgagcgcgaggcttggcttgtcgtagtgcgcgttgaggtagtccgcgacgccctgcgtggcctgcgccacgacgtagacgttcatgcggttggtgcccacgcccagggtgccgcgcagtcccgcggtgccaaacgagaggtcgcgatagaaggcgtcgttcagcttctcctcgtcccccgacgcgatgagctcctcgagctcggccttgaggtcgggctcggtgacgttctccttccaaagctggaccttggactcagtttccttatccatgcaagatctcctcgctcttctcgtaaggcggaaaaaccgtctgcccacacgtacctactcaagatgatagccaaagtcgcgcccgcgttttcagccgagcgccaaacgcggccgatatggcggaaggcggcacccgccgcggtatgggaagttgctgatggcgcacattgttccgttggtgccaaaacgcggcgcctaccatgtggcataccatgtgagaagaacagacgaccacgggcgaaaggtgtcccgaatgagcgatttgaccaccacgggcggggcctcctcgcaggccgagacggcagagcaggccgatcgggctggacgggccgagcgggcggaacagggcctcgagttctttgcgacgtgccccaagggcttcgagcacctgctggcggacgagctttccgcccagggcgtgccacgcgtgcgcgcgctgcgcggccaggttgggtttggcggcgggctcgaggacgcgtaccgcgcctgcctgtggtcgcgcatggcgtcgcgcgtgacgctcgtgctcgcgcgcgtggacgccacgtcctccgacgccctgtacgagggcatgtcgcacattccctggcaggaccacgtgcccgccggggcgaccatcgccgtcgaggcgcacggcaccaacgcggcgctgcgcaacacgcagttcacggccgtgcgcgccaaggacgccatcgtggacgtcatcctcgcgcgccggggcacgcgccccatggtcgacgtgcggcacgccgacgtctccgtagcggtgagggtgagccgcgagcgcgcgaccgtgggcatcgacctttcaggcgcgccgctcttccgccgcggctacgaggccgcgcggtctggccgggcgcccatcgcgccgctcaggcccgactacgccgcggcgctgctggcggcaggcggctggtaccgcagcgtgcggcacggcagccccgtgctcgcgagcgtgtacgacggcgccggcagcctcctggtggaggccgcggcgcaggcgctggaccgtgcgccgggactcctgcgcacgcactggggcttcgagggctggggcggccacgaccatgtcctgtgggagaaggtcctgggagaggcccacgagcgtgccgaggcggctgcgggcgcgagggtggtccttctcgcccatgacacgcgtccgggggccgagaccgccgcgcgccatgcgctgcgcgccgccggcatggacgtggagccgacgtttgtggacgccggcgagatggcgaccaggctggggcgggcctgcgcctcgggcgagccgctcgtggcgatggacctttcgtggctggacgagggcgcggtcgcggcagaggccgcggcaatgtccgagtgcgtcgcggctgccgcaggggtcgcgggcaaggcggccacggttgtggcgctcgcgaaggacgccgcgctcgacagcgcgctgggacgcgaggccgacggcaccattgacgtgctggtcgggcaggacgacgcggccatccgcacgttcgacgcggcggggcttccgcgcgagcacgcgtccgtgggcgtgaccgagcctggcggccggcaggtcagcgtgcccgtgctggtggacgcgagcgaccagtttgtgcgacgcctgcagaaggtgtggcgcctgcgtcgcaagtgggccgagcgcgaggatgtgagctgctaccggatctacgacgcggacctgcccgactactccgtgagcatcgacctcttccagggctcggagctcatgcccgcgcgcggcgggcgcggccgctggctgcaggtgtacgagtacgctgcgcccaggtccgtggacgcgacgctcgcgcgcaggcggctgctcgacgtgctggccatcgcgccgcacgtgatcggcgtggcccccgagaacgtgttcgtgcgggtgcgcacgcacggcaagggcggctcgcagtacgcggcggagtccagggaccagcgcgggcaggcgggcggccagggccgcgggcgtcgtgacggcggaaggccaggtaggaggcccggggacggacgcgttcttctccctcgcggcgcgcacctcgtggacgagggcggactcaccttcgaggtgaactttgacacgcggctggactgcgggatcttcctcgaccaccgcgagacgcgctcgctcgtgcgcgagatgatgaagaagaccgtggggtcgaagcggttcctgaacctgtttgcgtacacgggcaccgcgacgtgctacgcggcggacggcggcgcaaagcacacgaccaccgtggacatgagccgaccctcgctcgagtgggcgcggcgcaacatggagcgcaacggctttgtgagcaagatgcggccgcccgagcacgagtacgtgcaggcggacgtgctggcgtgggtgcaagagcaacgccacagcaagaaccgctgggacctcatcttctgcgacgtgcccacgttctccaactcctcgcgcatgcgcggctcgtgggacgtgcagcgcgaccacgccgagctggtcatcggcatatcgcgcctgctcacgcgcaacggatctgcgatcttcagctgcaacctgcgcggcttcaagcccgacgtcgagaagctgcagcgcgccggcgtgagcttggaggacatcacggccgagaccatcccggaggacttccagcgcaacgccaaaatccaccactgctacatcgtgcggcgcacggcgtaaggggcgaagcggcgtggggtgcgaggctgtctttgggatggctttgcccccgcgcggcagactggcgcaaggcatctgtcatatcaaatatctttcttgaacgcgcggcttcccctggtgggaggccgcgcgtatcttcttgacatggcaatctacctcagtcataccacggcactctcgatctggctgcgcgaaggcggctggctcgtccgcgacggcgtcgcgacgcgcggcggttcgctggcggactcgagcgcatccgcgcgcgaggtcgaggcatctgaaattctgcagcgcggagccattgaggcgccggtgcacgtaatcgtagatacattagtcaaaaggcatgtctcaagactgctggttccacatctctggagtggaaaggtacctctgtggtgcttctacaagctatcggatggggtgtttgttagctctcccgagttcactgtcgtgcaagaggcttccatcctcgatagaatcgaactcgcttgggccatctcaagtctttgcagcgggttccggaagcactccagggagactactctgtggaacacgggatttgaagtaaccactccaatcacaagtttgaaaaacgtcgaacgcttcctgaagttcattcccgccgaacacggaacgtcggcaaccgcagctgccttacgatttgcagttgaaggtgcggcgtcgcctcccgagctagcgctcgccatgatttcttgcatgccaaagcgacttggaggttacgcactgccaaaaccgaagcttaaccagtcaatctacctggatgagaccgcatcgaggctgtgtgggaagagcacgatctattgcgacatgctctatccaaataaggttgtcgtcgaatatgacagcgacgagtttcacgctggtagccaggccctacatgatgaccgagcccggtacaacgcattggtatcaatgggctaccacccgatagcgattacaaagaatcagcttcagaacattacctcgctcgataacgctttccgctctatcgcaatcgcaatgggaaagcgtcaatggaacctcgatgcttatagggccggacagcgagaagatctcttgtgtcgtttactcgaccgcgatggaactcttttggaagaagcaatggggcgataaccc

SEQ ID NO: 129 - DNA, 14957 bp, Unknown
  Metagenome-assembled genome
tctgacctgcggttgtgcaggaaatatgagggggatacgcccggatgggtggaatgcgttgacaagttcgtttccacgtcgtaatatttcccccgcttgcaagggaagtcccaattgcaggcgagcttgaaaacggaatggggatgtggcacagcggcaactgcggcggactgtaaatccgctccctctgggttccatggttcgagtccatgcatccccaccattcgcccgtgtagctcagtcggtagagcacttcgttggtaacgaagaggtcaccggttcgaatccggtcgcgggctccatttcaagcaggcatattttgccggtgtagctcagctggttagagcacgcggctcatacccgcgatgtcactggttcgaatccagtcaccggtaccagcgtactaacggggctacggccccgtttggcataagtgttacggccgaaaggttgttcttaaggaggatggcatggccaaggagaagtttgatcgtagcaagccacacgtaaacatcggtacgattggtcacgtcgaccacggtaagaccacccttaccgcagccatcaccaaggttctctccgagaccgagggctgcaaggccaagtacgaggccttcgaggacatcgacaaggctcccgaggagcgtcagcgcggcattaccatttccgtcgctcacgtcgagtacgagacctgggagcgccactacgctcacgtcgactgcccgggccacgccgactatgtcaagaacatgatctccggcgctgctcagatggacggcgctatcctggtcatcgccgccaccgacggcccgatggctcagactcgtgagcacatcctcctcgcccgtcaggtcggcgtcaagtacatcgtcgtcttcctgaacaagtgcgacatggtcgacgacgaggagctcatcgacctcgtcgagatggagacccgtgacctcctgtccgagtacggcttccccggagacgacatccccatcatccgtggttccgctcttggcgccctcaacggcgagcagaagtgggtcgactccatcatcgagctcatgcacaccgttgactcctacatcccgacgccgaagcgtgacaacgagaagccgttcctgatggccatcgaggacgtcatgaccatctccggccgtggtaccgtcgtcaccggccgtgtcgagcgcggcgagctcaagctcaacgacccggtcgagatcgttggcctgaaggacacccagacctctaccgctaccggcatcgagatgttccgcaagacgctcgacttctgcgaggctggcgacaacgtgggcatcctgctccgtggcatcaagcgcgaggacgtcgtccgtggccaggttctctgcaagcccggcaccgtcacccctcaccacgagttcacgggcgagatctacgtcctgaccaaggaggagggcggccgtcacaccccgttcttctctggctatcgtccccagttctacttccgcaccacggatgtgaccggcgacatcaccgagctcaccgactctgacggcaacaaggttgagatggctatgcctggtgaccacatcaccatccactgcgacctcattcacccgatcgccatggaggagggcctgcgcttcgctatccgtgagggcggccacaccgtcggcgatggccgtgttgccaccatcatcgcctagttttttcgacgataatctgggcccggcgccccgaaaggggcgtcgggtcttcttttccgcttgcaagttccctgtatgcgctgatatttggtggttttgtcgagctgagaagtacgaccaatgcgtgcttgacagaatgaaccatcgaatggtagcgtataccatcgccgacgctggggtagtcccgtggcggttatctacaggaggatcaatgcgtacactcgttacccttgcatgcactgagtgcaagcgtcgcaactacaccacgaagaagaacaagtccaacactcctgatcgcatggagttgaagaaatattgcccgtggtgccacaagcacacccttcacagggagacccgctaaaatagggtcaacacaggccagtagctccaatggtagagcggcggtctccaaaaccgtttgttgagggttcgagtccttcctggcctgccagattacaccaccggctatcctccatctaggggttagccggtttctatgaacaggggttttaatggcaaagaaggagcgtcagaagagaagcgcacgtaaggcccgcgcggcagagcgtgccgagctcgaggcaacgcgcgccgcttcgcaggccggctccaaggagccggccaagaaggctgacgcgacggttgccaaggcctctaccaagaaggccgagagcaagccggcaaagaagcaggggcggattcgctcgtacttctccgccgtcaaggcagagatgcatcgcgttgtctggcccgacaagaacgagcttcgcagctattccatcgcggtcatcgtgatgctcatcgtctttggcgtgtgcgtctggctcgttgacacgggctttgtggccgtgctcgtcggctttacgggacttcgggggtaagacatggctaagcgttggtatgtcgttcacacctactccggctacgagaacaaggtgaagaccgacctcgagcaccgtgtcgagtcctttggcatggaagacaagattgtcgacgtgcagattcccaccgaggaagtcaccgagatcaaggacggcggcgctcgcgagaccaaggagcagaaggtcttcccgggctacgtgctcgttcgcatggagatgaacgacgacacctggaccgtcgtgaggaacacccagggcgtgaccggcttcgtcggactggacggcagcaagcccgctccgctgcgcaggtccgagttcaacaagatcatgcatcgcaaccagcccactggcgcgaagcagcagaagcacgtcaccatgacgaccaacatcgagccgggtatgtccgtcaaggtcgtctccggcccgctcgcggacttcgacggctccgtttcagaggtcaacgctgagtctggcaaggtcaaggtcatgctcacgatctttggccgcgagacccccgtggagctcacgctcgaccagatctcgatcatcgcttaggtaccattcgttccccgtatcggtgaggattgcttctcgggggacggtagagataagaacgcaacttccgtctaggagacaacaatggccaagaaggttacccacttcatcaagctccagattcctgccggcgctgccaaccccgcgcctcccgtcggccccgcactcggtgccgcacaggtcaacatcatgcagttctgccaggctttcaacgccgccacctctgacaagaagggcgacatcatccctgtcgagatcacggtctacgaggatcgtaccttcgacttcgtgtgcaagacccctcccgcggcccagctcatcaagaaggagctcggcatcaagagcggctccggcgttccccagcgtgacaaggtcggccagctcacccaggagcagctcaccaagatcgccgagatcaagatgccggacctcaatgccaacgacatcgaggccgccaagaagatcgtcgccggcaccgctcgctccatgggcgtcaccgtcgccgagtagcaagggttccaagcgcgcgggcgtcgtccgtgcgtacgtttagggcgggtcatccgccaacgatgtgggagggccacgccgcccgatgaccacaggaggtaacaacatggcgaagcacggaaagaactacaacaacgctacggctaagtacgacaaggctcaggtctacagcccgaagaaggcaatggagctcgtgaaggagctctcctccgccaagttcgacgagactgtcgaggcttccatccgcctgggcgtcgacacccgcaaggccgaccagaacgtccgtggctccatctccctgcccaacggcaccggtaagaccgtccgcgtcgccgtcttcgcagagggcgccaaggccgacgaggccaaggctgccggcgctgacatcgtcggctccgacgacctggtcgccgaggtccagaagggcaacatcaacttcgacgccgtcatcgcgaccccgaacctcatgggcaaggtcggccgtctcggccgcatcctcggtccccgtggcctcatgccgaaccccaagctcggcaccgtcaccatggacgtcgagaagatggtcaaggagctcaaggccggtcgtgtcgagtaccgcgccgaccgctacggcatctgccacgtccccatgggcaaggtctccttcaccgttgagcagctcgtcgagaactacgctgccctctacaccgagatcctgcgcgtgaagccgtccaccgcgaagggccgctacgtcaagtccgtggccttctcctccacgatgggccctggcgtcaaggttgacaccaccgtcacccgcgacttcctcgcggagtagcgccaaagcctagctaggtaacagttcttgcgccatgaccgggtcggactcgctccgacccggttctttgtttcgcgggaaggcgcgacccgcattgcgacgctgctgactgctgcgagccctcgttcttctcgcccaattttgtggaggggaagagaagaggggagaagaacgcgcacctcgcgcttgacgggcgtgggctgggatgcaagaataccctttgcgcaagcgattgcgcgaacgtacacagcacgtaccgctgccaaagacagcaggtgcccgcaagggctcaaagggaaccctcccgccggccgaggtggtcttggaatgacttcttggaccctgctttggctgcgccaagcggggtcttattttgtgaaggcccgccgcgtcggcggcatgtgcccgaacaaaacaaggaggtgtaacacatgcccaacaacaagaacgtggaaatgctcgccaaggtcaacgaggcgatcgaggcttccaagggtgtcttcttcatcgactaccgcggcctcaccgtcaaggagacccaggacctgcgtcgcaagctcaccgcagccggcgctcacatgaaggtcttcaagaacaacatcgccaagatcgcgttcaagcaggccgagatgcctgaggtcgacgtcgccggtaccgtcgcctacgtgttctacgagaacgaccccgtcgaggccgccaaggtcatcaaggaggagtccaaggccttcaagaagatcgagtggctcggcgccatcgccgacggcaaggccctcacggccgaggaggcaaaggcctacgcagaccttccctctcgcgaggagctcatggcgaagctggtttacgtcatcgcaagcccgctttccggcattgcccaggtctgcgctggtcccgcaaggggtctcgcgaccgttctggacgccatcgcggaccagaagaacgccgcctaacaacggcatcgcactacgcaacaacaagcatgatgggcgcatggaacgcgcccactgacaaaggagaattgacatggctgtcaccaaggatgagatcatcgaggccctcaaggagatgcccgctctcgagctttccgagctggttcacgagctggaggacgtcttcggcgtctccgctgctgcccccgtcgccgtcgccgctgccgctcctgcggccgacgctgctcccgctgaggagaagaccaacttcgacgtcgagctgacctccttcggctccaacaagatcgccgtcatcaaggtcgtccgctccctcacctcccttggcctgaaggaggccaaggaggccgtcgagtccgccccgaaggtcatcctcgagggtgccaagaaggacgacgccgaggccgccaagaagcagctcgaggaggccggcgctaccgttaccctgaagtaactggagcccaatccttttgcaccatgggggaccgagccttcgggcttggtcccctttcttgtggcgcgggaacgcgtgacgcgatatgcggccggaccgcgtaaaaagttttagttcgcggtgggcgagaagagcgggatgcataactcgcaatcacaaacaacccacaatttgaatttacaaagtcgcaggtaaaagggctgttcttctctgctagttaaactggccgataatgtcaagcccgaatgttgacctggaattccaaattcgttaagttattagattgcgacaactgccgcattttatctcgtcgaaggaggaagtgcctggtgcctaccgcaaagtcttcccagcccgcacagaaggagcagcgcaagcgcgttagcttcagcaagatcccaagcgtgatggagttgcctaacctcatcaccgtacagaaggagtctttcaaccgcttcatgaccgaaggcctggccgagtgctttgccgagttctctcccatcgagaacgccgcaaagaacatgcaggtcacctttggggagcaccagtttggcgacgcgccggctgacattgccgagtgccgagccaaggatatcacgtaccaagcgccgctctttgtcgacgttcgctttgtgaacggcgacacgggcgagatcaaggagcagctcgtcttcatgggcgacttccccctgatgaccgacagcggcaccttcatcatcaacggtaccgagcgcgtcgtcgtgtcgcagctcgtccgctccccgggcgtgtacttctccgaggagatggacaacggcgccgaggtacaccacgtgcagttcatccccgcgcgcggcgcatggctcgagtttgaggtcgacaagcacggccacctggtggtctccatcgaccgcaagcgtcgccagagcgcgacgatgttcctgcgcgcccttggcatcgccgaaagcgacgatgacatcatgaacctcctgggcgattccgacgtggtccgctccaccctggagcgcgacgtcgcgaccacgcgcgaggacgcgctgctcgagatctaccgtcgccagcgcccgggcgagcctcccaccgtcgagtccgcgaagaacctgctggatggcctgtacttcaaccaccagcgctacgacctcgcccgcgtgggccgctacaagatcaacaagaagctcggcctggacatcgacccgcagcagaaggtcctcaccgaggaggacatcatcagcgcgctgaggtacctcctcgcgctgcacgcgggcgacaccaccaagaagaccgacgacatcgaccactttggcaaccgccgcgtgcgcaccgtgggcgagctggtgcagaaccagttccgcatcggcatgagccgcatggagcgcgtcatccgcgagcgcatggcctcccaggacgccgatgacatcacgccgcagtccctgatcaacatccgcccgatcgtggcggccatcaaggagttctacggctcttctcagctgtcccagttcatggaccagtccaacccgctggccggcctcaccaacaggcgccgtctgtccgcgctcggccctggcggcctcgcgggccacaagtccggctccagccgccgcaccaacgtgccgacggccgtccgcgacgtccacaactctcactactcccgcatgtgcccgatcgagacgcccgagggcccgaacatcggcctcatcggctcgctcgcgctgtacgcgcacgtgaacgagtacggcttcatcgaggcgccgtaccgtcgcgtcgtggacggcaaggccaccagcgacatcgactggatgaccgccgacgaggaggagaaccacgtcatcgcgccagcgaacacccccatcgaccccaagacgggcgagttcgtggccgttgacgccgacggcaagagctacaggcccgagaccgtcgtcgcccgtacgcgcaacttcgacggctccttcggcgctcccgcgtccgtgcccgtcgagaccgtcgactacatggacgtctccccgcgccagctgctctccgtcgcggcgaacctcatcccgttcctcgagcacgacgacgcaaagcgtaccctcatgggcgcgaacatgcagcgtcaggcagtgcccctgatcaagccgcacgccccgtacgtgggcaccggcctcgaggcccgcgcggcgctcgactccggcgagctcatcgtcgcgaagcacgacggcgtcgtctccgaggtcgatgcggcccacgtggtcgtcgacaccgagaagggtcccgagcgcttcgaccttcccaagtaccagcgctccaaccagagcacctgcatcaaccaccgcccggtcgtgcacgtgggccagagggtcgaggccggcgagccgctgaccgacggcacctccatcgaccacggcgagctcgccctgggcaccaacctcaccgtggcgtacatgccgtgggagggctacaactacgaggacggcatcgtcgtctccgagcgcgtcgtccgtgacgacctgctcacctcgatcaacatctcccgtcacgagatcgacgcccgcgacacgaagctcggtcccgaggagatcacgcgcgagatcccgaaccagggcgaggacatgctcgccaacctggacgacgacggcatcatccgcatcggcgccgaggtcggccccggcgacatcctcgtcggcaaggtgacccccaagggcgagaccgcgctgaccgccgaggagcgcctgctacgcgccatcttcggcgcgaaggcgcatgacgtgcgcgacacctcgctcaagatgccgcacggtgcctatggccgcgtcgtcgacgtggtgcgcttcagccgcgaggccggcgacgacctcccgcccggagtcaacgagctcgtccgcgtcttcgtcgcgcagcgccgcaagatccagcagggcgacaagatctccggtcgccacggcaacaagggcgtcgtctgcaacgtcctgccgatcgaggacatgccctacatggctgacggcacgcccgtcgacgtccttctcgaccccctgggcgtcccgtcgcgtatgaacgtgggccagctcatggagtgccacctcggctgggccgcgagccacggctgggacgtggatgaccccgactccaagaaggtcatcgacggcccgatgtacgtgtcgacgcccgtcctggacggcgccacggacgacgaggtccaggaagccctgcgccgcacgaacatcaacatcatgaacaaggcgctccgcacctacggcgagcacatgcgcgccgagttcgtcccgcagctcaacgagcgcggcaagaccacgctctacgacggccgcaccggcgagcccttcgcgaaccccatcaccgtgggcacgtcctacatcctcaagctcggccacatggtcgacgacaagatccacgctcgctcgacgggcccctacagcctcgtcacgcagcagcccctgggcggcaaggcccagttcggcggccagcgcttcggcgagatggaggtctgggcgctctacgcgtacggcgcggcgaacgtcctgcacgagctcatgacggtcaagtccgacgacaccaacggccgcgtcaagacctacgaggccatcgtcaagggcgagaacgtcccgaagcccggcatccccgagtccttcaaggtcctcgtcaaggagatccgctccctcgcgctcaacatcgagccgatctcctacaagcgcccggactcctctgcaaagccgcaggagaaggcggccgaggagaaccccgtcgacgtgttcgcgggcgcggacagcgcggatgacctgatcggtggcgtcgcctccgattccgagaagggcgaggagaccctgatcggcgacaattccaacgataaggagtagcgaacgtggcagatttcgataccacagatttcgacgcgataaagatctcgctcgcctccgctgatgagattcgtagctggtcgcacggcgaggtcaagaagcccgagaccatcaattaccgcacgctcaagcccgagaaggacggcctcttctgcgagaagatctttggccccgtcaaggactgggagtgcgcctgcggcaagtacaagggcatccgcttcaaggggatcgtctgcgagcgctgcggcgtcgaggtcacgagcgccaaggtgcgccgcgagcgcatgggccacatcgagctggccgcgcccgtctcgcacatctggtacttcaagagccccgcgaccttccccctggcgcgcctgcttgacatgaagtccaaggacctcgagaaggtcctctacttcgcgagctacgtcatcacctccatcgacaccgaggcccgcgaggccgacgccgacgacctcaaggaggagctggcggccgacctcgaggagctcgacgccgagcgcgacgacgagatcgagcgcctcaaggcccaaggcgagggcggcgactccgagttcggcgacgaggagcccctctccgctgacgagatccgtgccggcatcgccgacctcgaggaggagtacgcggacgagaagcgccttcgccaggaggccttcgacaagttcatgacgctggaggagcgcgagctcatctccgacgagacgctcttcaccgagatgaagcgctactactccatctacttcaagggcggcatgggcgcagaggccattcgtgaccttctccgcggcatcgacctgggcgaggaggccgagcgactgcgcgccatcgtcgcctccgacgacgcccagaagcagaagaaggagcgcgcggtcaagcgcctcgagatcgtggacgccttcctcaagggcggaaacgaccccgccaacatgatcctggacgtcatccccgtgatcccgcccgacctgcgccccatggtgcagctcgacggcggccgcttcgcggcgtccgacctcaacgacctgtaccgccgcgtcatcaaccgcaacaaccgcctcaagcgcctgctcgaccttgacgcgcccgcgatcatcgtcaacaacgagaagcgcatgctccaggagtcggtggacgccctcttcgacaacggtcgtcgtggccgtcccgtcaccggccgtggcggcaggcccctcaagtccctggccgagtccctcaagggcaagcagggtcgcttccgtcagaacctgctcggcaagcgcgtcgactactccggccgttcggtcatcgtcgtcgacccgcacctgcagctgcaccagtgcggcctgccctccaccatggcgctcgagctcttcaagcccttcgtcatgcgtcgcctcgtcgagctgggcaaggtcgagaacatcaagggcgccaagcgcgccatcgaccgcggcatgcccgtcgtctgggacgtcctggacgaggtcatcaagggtcgcctcgtccttctcaaccgcgcacctacgctgcaccgcctgtccatccaggcgttcgagccggtgctcgtcgagggcaaggctatccacctgcacccgctggtctgtgcgccgttcaacgcagacttcgacggcgaccagatgtccgtgcacgtgcccctgtccacgcaggcccagaccgaggcccgcgtgctgatgctctccagcaacaacctgcgctcccccgcgtccggcaaggtcctcaccgtgccgtcgcaggacatggtctttggcgtgtactacctcacgaccgagaagcccggtaacgacgtgccaggcgccggccgcacctacgcctccttcgaggacgcgctcacggccttcgacgacctccaggacgtcgacatccaggccaagatcaacgtgcgcgtccagccgagccaggccaactaccacgagggcgagaagagctacttccgtgtctgcaccggcaaggaccagttcgaggacctcgacgtcaccgagcgccccgtgcgcttcgagacgaccgtgggccgcgtgatcttcaaccactgcctgcccgacgactatcccttcatgaactacaagatggtcaagggcgacatcgcgcgcctggtcaacgactgctgcgaccgctacagcaccgcccaggtcgagccgatcctcgacgccatcaaggcgacgggcttccactacgccacgcgcgccggcctgaccatctccgtctgggacgccacgatccccgaggacaagccccagatcctggacgaggcccagaagcgcgtcgacaccatcaacgagtactacgaggacggcttcctgtccgagcaggagcgccacgtcgaggtcgtcaacgcctggaccgagtgcaccgacaagctctccgcggagatgctcgccggcttcagcgaggacaaccccatcttcatgatggccgactccggcgcccgtggctccaagacgcagcttcgtcaggtcgcaggcatgcgtggcctcatggccgatatgtccggcgacacgatcgacctgcccatcaagtccaacttccgcgagggcctcgagccgctcgagtacttcatctcgacctacggcgcccgtaagggcctcgtcgacacggcgtcccacacgtccgactccggttacctcacgcgtcgtctggtcgacgtcgcgcaggacgtcatcgtccgcgaggaggactgcggcacggacgaggccgtcacgtacgacctcatcaagccgggcgagaatgacgtggacctcgacctgatcggccgttgcgccctgcacgacatcgcgaacccggagaccggcgaggtcatcatcgccgcgggcgagtacgtggagtccaaggaccagctcgagcagatggtcgaggccggcctcaagaaggtcgagctccgcgcacttctcacctgcaagtccaagtatggcgtgtgccagaagtgctacggctgggacctctccacccgtcgtcccgtcaacatcggcaccgcggtcggcatcatcgccgcgcagtccatcggcgagccgggtacccagctcaccatgcgtaccattcactccggcggcgtcgcgggcgccgacgacatcacgcagggcctcccgacggtcgcccgtatgttcgacgtcgttggcaacgtgaacgagaagatcctcggccgcgaggccgacctggcccagtactcgggcatcctctccatcacgcccgagcagaccgagtacctgctccgcatcctcgactccgacgatccctccaggatcctggtcgagtggcgcgtcccggcctccgtccgcttcatgcccggcatcgaggaccagtgcgtggtccgcgcaggcgaccagattacccgcggcttcgtcaacttccgcaagctccgcagcctgacggacatcgagtccaccatgcacaccttcgtgaagtcggtcaaggacgtctacacgtcccagggcgtcgacctcaacgacaagcacatcgaggtcatcgcacgccagatgctccgtcgcgtccaggtcaccaaccccggcgactccacgtacctcctcggccagtacgtcgaccgctacgtgttcgcggacaccgtccgcaacatcacgctcgccggcggcaccccgcccgaggcagagcccgtcattcttggtaccctcaaggtcgcgagctccatcgactcctggctgtcgtccgcgtcgttcatccgcacggccggcgtcctcacggagtctgccatcaagggcgaggtcgaccacctgctcgacctcaagtccaacgtcatcgtgggcaagaagatcccggccggcaccggtctgcgcgcgtacgacgacgtcaagctcacctatcacggccagcgcatcgacggccccacgtcgcccatggcaaagtccctgcccgagtgggcgccggacgagctcaagtcgatcgaggagcagctccccaagcagctcgactggatcggcgacgactacggctacggcaacgtctactccaagaacggccgcacgctctcgtccgaggacgccaagctctacctgttcgacgacctcggcgtgtcgcagcgctggaccaacaagttcagcgaggtcggcatcgagaccgtgggcgacctcatcggcaagaccgaggacgaccttctccgcatcgacggcatcggcgccaaggccatcgaggagctgcgccagggcctggaggctcgcaacctcctctacatcctggagccggacgaggacgaggcggacagcgaggacctttcccagctgctcaacatggtcttctcgcccgacgccgacagcgacatcatgcttggcacggccgcgccgtccaagcacacgtcgttcgacgacgagctcatcggcggctctgcggacgaggagtccaaggacgactccaactcccaggtcatcaacgaggacctcggctcgctccatgacctgctttcccaggtcgagaagaacgagggctctgactccgagcagtagccccgcgttcaccggctacgcggctgctgccgcaatgccgcgcgcatagcacgccaaggctcccgggtcgcaagacctgggagccttttcttgtcgcaggctgccgcgtcccctggcgttgaaccccttgcgccgcctgtcaggtcaaacctgaacgcaactgggtaagagaagtgataacgacaggcaagcatcggccgcccacgcgcggcccgtccgtttgaagggggatttcaccatggagttcaaagtcacgcgcaccaagtggggatccatcctctggggcatcgcgatggcgatcctcggcctctatatgttcgtcaacccgggttcgtcggcctacaccatcaccgtggcggtcggctgggtgctcaccattgcgggtatctgcgcgcttgtgggcgccttcacgcactggagcgtcatcctgtccacgatcgacctgtattccggcgcgctgtcgcttctctttggcatgctgatcctggcatggccgcagttctttgtggcgtggatcttcatcctgctgggcatctacatcatcgcggctggcttctccatgctggcgggcaccaacgcactgcacgtgctgggcgtcaacggctccggcgccggcatggctctggccgtcctcaccatcgtgctgggcgtgctcgtaatcatgtcgcccttcaccatggcaaacatcgccatgtccatctgtggcatcgcgcttgtgtacacgggcatcgtgcacatggcggaaggcgcccgcatgccgtcagacaagagcaagtagcgccatcagaggcgtagggaacgaccaaagggcccgttccggcggaggc

SEQ ID NO: 130 - DNA, 2306 bp, Unknown
  Metagenome-assembled genome
taaggggacggatctatttgagcaaattctcctccaatgtgtccaggcaaagctggtggaccctcttcggtcctattcgttgatagaacccacgttaaagccgatgcaaacaaccataagttctcagacgtgatggttaacaaagaggccgttaattatcgtcaagccttggatcaaaagattgaaaaaagatcgggttgcccttaaaagcagatcaatcagctgtaaaaaccaaacgacgaaaagttagtcggaatgatcctgagagcggttggtttcataagggagagcacaaacaagtttttgcttataatgtgtaatccttgaaacaaatccatcgaggactcaaagaacttcagaacactttggaagcatcatttatttaagttagctacatattttatgtacgaaggcagtttatgtacacaagattcttgatgctatctaccaatagtcatttctatatctatagaatcatatttctatatatctataattctatagaagaataatcatcattcttcaggcatatttcgctgaacctgccgaacgaattccatcacaagttttttcttggtatccggcatatcatttatatatttttcaacaagttcattaataacttcatagttctttttgttttcaacaatcccgatttgtttaatcgccatgtgagtatcaatttgtgtttgaacagattttggcgtgtctttagctttcaactttctagtatagtgcattaaaatttggtcgtctggtaaagatcttcgtatggtttcagataccttaggttctatccgttctgggcggaatgttttattcttcctaattttgcctaagccattcaatcccagtgacttttcacccataatatgatctctccttattcattaaatttagtgattcgttctttgatttcgttgacaacattttcgtaaacactcattactcgaatatcatttatatccttagacctatcagtaataccagttcgatcaaatctctttaacctagccatttgtctaatccgttgtttgaacatgttggcttttccgaaactatcaattgcatcatctaagacatcaagatctagattgttcccgttttgttgcaaaaccggtaaaacacctaataaatccaatccgagcttatagtcgtccttcaaattaattaagtgttcagcataggtttcagcgcctgttaatgatctttcttgagtttgtaaaataataattacaaaatcacttgccacaagcgctgaatcagtaaatttatttaactgcggtggaacgtctaaaataatgtaatcatatttttctttcaatgggctgagcagttttgctaggtaagtgtcctgtgtataatcatcagcaaaagtttcatttaaatatttttcatatccttgtaaatcttgatatgacggtagcaaatctaaattatctttaacatgaactaaggccttttgtagattaccgctgattagcgcagtttctaatgtctcttcaaagtctggtttaatatcataaatggcttccatagtggtaaaaagtaaatccgttgcatttgcttggggatcaagatcaacaagtaatgtttttttattatgctttgatagtatgtaagaaatcatcacagcattagttgttttgcccacaccacctttaaagtttccggtagtaatcgtaattgccataaatttatcctccatttattttattcaaaatctatagaaacatagctttatagaattgaatttctatagaactatagtagcttaatattaggaatagtgcaagattagtttaaaaccagttttatagttctatagaactataactttataattctatattatcacaacatttctatagaaatttaatttgcttatttacttcttatccaatgaagattatgatttaagcgtgatcaaaaaaggtcacgttaagtggtttctcaacaaaacaaacaaaaagatcattgcttaaaaatcattccccaataacttttagtcaattatacaggtcactacactttatagatcttttaacgtgtaaatcctgatagtgctgtttttttataacttataagatatttaatcatttttatgcaatttcattctgctattgattttcagtgctttcgacagatacttacttagatatccagaagcgtttatgttactcgaatgttcaacagtaccttctatcgcgtattggttccaaccgaaaactgacaaggagagtacaaggccaaatacgtggtcagtaagcgctatgctagactaaagttaatttagcaaccgaata

SEQ ID NO: 131 - DNA, 1384 bp, Unknown
  Metagenome-assembled genome
aaaagaagccagtaaatttgcctacccgagaagatctcttctcgtggaaatggacgcataagtcctgttagataagcattgattgtggggcgaggagccacgttcttctcgccctttatgcttgctgacgctatgcgaccgttccacttaatgggtttgtacgccattgggttttctggtgggcgtggctgtgcgggggagcatacttggaggtcagggcggtcggcagggggtgcgcggtgattgagctttacaggacggacgactcgggcacgcatgcggtggacgcgattggcgactgggtctgggtaaagctcacgtcgcccacgtacgacgaggtggagtcggttgcgtcgaggctttctggcgtggaccccgccgacatcgccgccgcgaacgatccggaggagaagagccgtgtcgtgtacgagaaggacttctcgctcgtgctgatcgacatacctgtgggcgatgtgcgccacggcgtgtccacgtttgacacgatcccgctgggcatcatcgtgtgcgagcgcaacgtgatcacggtgtgcgcgcaggacacgccgatcctctcgccggggcgggtcggctccgggcaggagctttccacgcgggagcggcgcaagttcctgtatcgcatcctgctgcgcacggcgctgctgtaccagcgtgacctgcgcagcatcgaccggcagcggcgcgactttgaggagaagatcaagaagtcaaccacggaagaggacctcatgagcctgcatgaggtggagaccacgctcgtctactttgcgacgtcgctacgcggtaacggctccgtcctcacgcggttgcagcggtcggggcgccttcaccctggtcagagcacggaggacctgcttgaggatgctgccacggagacgcagcaggccatcgagatggcccagatctaccgcgacatcatgggcggaacgagggacctgctgagctcgctcatggattcgcgcctcaacaacgtgatggagcgcctcacctcgatcacgctcatcctttccatcccaacggtcatatccggcctgtacggcatgaacgtggacctgagctggatgccgcttgcccaggtgccgcacggctttggcatcatctgcggcggcacggctatcgtgtgcgttgtcctctccgttatcctcgtgcgcaggggctggatgtaggggagcgagcagctagacgcagaacccgggcaggacggtggtgaccttcttgtcgcccgtggcggcggtggcgaagtcgaacacgtcgccgttggggcccacgcggttgaaccaggtctggttgtccgcctcggagcagtccgggctgggggagcgcgtccaccagtagcagcgcttgccgttccacttgcggcgcgtgg

SEQ ID NO: 132 - DNA, 64847 bp, Unknown
  Metagenome-assembled genome
tcgcgctgctcgtggaactcggagaggctctttgccgcgacctcgcggaagtcgtcgagggagtcctcgtcgggaagcttgacctcgggaatctggtcgacgacgcgacggtccttgtccatgcccatggtgatggcgcgaccaggcgccacgtacatgtggcgcagctccgcctcgtccaggtcgcggaggtcgcgggtgttgatcctctttcccgtgaagaggaagacggcgcgctcgcccatctcgacggcgttgtcggagatgcgctcgagcatgcgggcagccatgagcacgcggatggcggcgtcgacgtcgtcaccgtcctcgaggtgcgcgaacacgtggtagaactccttgtagaggtcgtccaccgggtcgtcgagctcggacagggtggcggccttcacgatgtcgccctccacgatggcctcggccagggcgccgagcacgcggtacacgaggtgcgccatggacgccagcaggtccagcagctgtccggggacctcgaccttggaggcgcgcttcgcggtcttggcgatgttgcgggcgtggttgctcatgcgctgcaggttgaagtccgcgtacacgatgaactggatcaggcggaggtcggaggccacgggctgctgcagcgtgaccgtctggtaggcctcgtcctccagctcctcgcagcgctggtcgatcttcttggtcgccttcttggtaagcttggccttctcgcggtcgccctccaccagggcgtcgacggcgtcgtggagctcgacgtccacgtccctcaggatcgcgacgacctcctggcgcatctctacgagctgcttgtcgaactgttcgcgcatgggtagcctccctctttcgtcttgtggcctgcggacggcggtgtctagccgaagcggccggtgatgtagctttcggtcctggggtcacgggggcgcgagaagatctccttcgtgtccccgtactcaatcagcgtcgcgggctcccctgcacgctcctgcaggaagaaggccatgtagtcgctcacgcgcgcggcctgctgcatggagtgggtcacgatgatgatcgtgaccgtgggggcgagctccgccatgaggtcctcgaccttctggacgctcgtggggtcgatggccgagcagggctcgtccatgaggaggacgtccggctgcacggcgagcacgcgtgcgatgcacaggcgctgctgctggccgcccgagagggcgaggccgttcttgcccagctggcccgagacctccttccagaggttcgcgcgcttgagagactcctccacgatgtcgtccaggtcggacttggaggtcacgccctggaggcgcgggccgaaggcgacgttctcgtagatggacttggggaacgggttgggctgctgaaagatcatgcccacgcgacggcgcaggtcgacggggtccacaccgggcgcgtagatgtcgttgccgtcgagcgacatgaggccctcctcgcgcgtgccctcgatcaggtcgttcatgcggttcatgcagcgcaggaacgtggacttgccgcaacccgacggcccgatgaacgccgtgatcttgcgcggcgcgatgtcgaggttgacgcccgtgagcgcgtggaagtccccgtaccagaagttgaagtcctcgacgtgaatcccctcgccctgggggttcttgggggcatggcgatagacggtcatgctactttcctcccttttgcctggcgccgcgcttcgagatgtggcgtgcgaagaggttgaaggccaggatcatgatcatgagcaggagcgccgttccgtaggcggctcccatgttgatgccatcgtttgcgagcaggtacaggtggacgggcatggagcgtcccgagtccagcggggtcacgggcaggttgacggcctggcccatggtgtagagcacgatggcggtctcgccgatggcgcggccgatggccagcacgatgccggtcgcgatgcgcgggaaggccgcggggagcacgatcttgctcacgacctgccacttggaggcgcccaggccgtacgcgccccagcggatgaagcgcggcacggagcggatggcgtcctccgtggtcctcatgatgagcggcagcatgagcagagccagggcgagcgccgcggagagcatggacagaccgaacccgcaggcttccacgaacacggcgtagccgaagagtcccatgacgatggaggggacggaggccagcgtatccgtggcgtagcggatgaaattgaccaggcgaccctggtgggcgtactccgccaggtacacggccgcgaggacggccacgggcgtggcgaagagcgtcgcgagcaccgtgacgtagagcgtcgagacgatcgtggggaagatgccgccctcggcgttgacgcccctgggccagccgaagataaaattaggggttatctgcggcgcgccgttgacgaccacgaagccgatgatgagcacaaggatcgcggtggtgacgatgcccgcggcagagaacacgccagtcatgaggccgtcggtcgcgttcttggagacgcgcggcttcttggcgttgtcaagtcggctcctgatgagctgcgcggagctctgctgggcgagaagtgcggaggcgtcggaggccgaggggccctcggcaacggagcgcgcgtccttctcggccacgggcgttgccggacgggaggcctcgcgctcgcggcgctcgctcctgctggtgatgatgcggacgatgcccacgaggccggcggagatgacgtagagcacgacgcccatgccgaagagggcggcgcggtggaggcccgaggagtagcccatgtcgagcgcgatctggctcgtgagcgtggccacggggctcgtgatggaatgagggaagacgggggcgttgcccacgatcatgaggacggccatggtctcgccgatggcgcggcccatgcccaggacgattgcgttgacgatgcccaccttggccgccggcaggacgaccttgtagatggtctgccagcgggtggcgcccatggagaaggacgcctcgcgcactcccgggtcgaccgagttgagcgcgtccatggagagcgtggtgatggtgggcacgatcatgatggcgagcacgagccaggccgtgagcgcgccgaagccgaggccgcccgaggcgttggcgatgatcggacgcagcaccacgagcccgaagaagccgtagatgaccgagggaatgccagccaggaggtcgacggccgtgctcacgacccgcgtgaccctgcgcgtcgctatctgcgtgaggtacacggcgcagcccacggcgagcggcacgccgatgacgagcgcgcccacggtgacgagggcggagcctgcgaggagcgccaggatgccgtagtggccctcggacggcgcccaggtggacgagaagaacccgcccagcccgatgtccgtgaacaccggcagagactttgccagcgtgaacacgaagatgagggccacggcggccaccgcgatgagcgcgcacagcaggaagaggtccttgagcaggcgctccttcacgtacgtggcgtggtccatcagcttgagctcgcgcgcgctcttcgcgagggcctcgtccttgttgggctcgatgtcggaaatgtgcggcggccgatcgaggccgtcgaggagctcgtcatgctcttctcgcccgcgctcgcgttgctcttctgatccgctcacttgccctcacctcccgaggtggtcgacgtggagtcgtcgctcctggcggactggtcccaattgaccgggatgtagcccgcctcctcgatggtcttggtcatctcgtcggagaggacgaacttgatgtactggaacgagaccccctgcgggtcgccgttggtgaagaagtagaggtcgcgcgagatggggtacttcccgttgctcacgttgtcctcggtcgcgttgacgccgttgaccgtgagggtcttgaccgtcgtggtggcgtagtcgctcttgacgaagccgatcgagatgtagccgatggcacccgccgagcggctcaccacgtcgcgcacctgccccgtgccggggagcaccgcggcgctgcggtcgaactccgcgccgcgcatgacgatggagcggaaggcctcgcgcgtgcccgaggcctcgtcgcggttgacgagctggatggcgaggtcggggccgccgagctccttccagttcttgatcttgcccgcgtagatgtccctcagctggtcgagcgtgacgttcttgacggggttggagtcgttcacgatgatcgcgatgccgtcgtgcgcgatgacggtggagaccagctcgtggctcgcctcctcctttgtgaggtcgcggctggagctcgcgatgtccgccgtgccgctgatgacggcctcgatgccagctgaggagcccaggccggacacgaggacctggttgccggtcttggcctcgaacttctccgcggcaatctccgcgatggggagcacggtggtggagcccgcaaccgtgatggtggtcttgccggaggacgtggacttagtgccgctcccgcaacccgcgagggcgagcacgagcacgagcggtatcagggcaaggaggcggtggcgccgtggcgtccgcatgtctccccctctcctcgttgtgaaacggggcccgccgagccggcttggcatggcgtccgactgtggggccgtctgtcaggtcatcgtacgaaatgggcaagccctatgacattaccttatcttaactttcaggcatgtagacattctccccagtctgggtgacggcgtgctgcgtacgccagcggtcgcgggcgagaagaacgtgccacgcggaccgaccgggtcaccccaggtgcgcgatgccccgacgcaggcggtccagcccctcgtccacgatcttgcgactcgtcgcgaagcagagccgcacgtggccctcggacccgtcgccaaagaacctgcgcccgcccgggatgagcgcgagcctggcatcgcgcaccaggaagtcacaaagatcttctcccccaaggcccgtgccagacacgtcgacgtagagcaggtacgtggcctgcgggcgatacgccctgaggcccggaatcgcgttgatggcgtcgacggcgtggtcgcggttgcgcatgaggtgatgcaggaaatcgtccacccagccgtaggcgctggtgagcgcggcggtcgccgcgacctgcgagatggacgtggcgccgcccatcgtgctcagcacgtcggagtgctcgaccacggacgagaagagcgtggggttcgtggtgtaggcgcagccgatcctgaggcccgcgaggccaaaggacttggagaacccgaagacgctgaccacgcggtcgcagcgccggttgcccaggctgtagatgctcgcgaagcgcgcgtcggggtagatgatgtccgaccagatctcgtcgttcaggatcaggaggtcgtgccgctcgcagatcgccatgatgcgctcgaggtcgtccggcgtgtaggtcagcccgtaggggttgtgcgggttgcagaggccgagcatcctggtatgcggcgtgacggcggcctcgagcgcgcccaggtccatgcgacgcgtggccgggtccatgggcaccggcacgggcaccggcgtcgcgccggcagactcgcacgccgtacggaagaggaagtcgcacgggtcgaacacgagcatctcgtcccccgggcgcaggaaggatcgcgccacgacctgcatcgcacgggccgcgctgtcgagcgggagcacgagcgaggggtcgatcttctcccctttgcgctcatgaacggcctggcagaaggcccggcggaactccggcaggccgagcggcggcacgtagggaaagtagccgtccgcgatgtaggcggccatcgcgtcgcggatctgcggcgcgaccgggaagtccgggtccgcggacgtgagcgggatgacgccctggggcacctccgcccagcggtagttgtaggcgcgccgcctgagcacgtcgaggttcacgttgtcgtcgtcaaagtggcccatgcaaacggcacccgccctagcgcgccgtcgcgagcgccgcacccacgcgctgcatgaactcccgcaggaagcgcggcgcgtcgaccgtgagggcaacgcgcgtcgtcttgggcgcaacgttgatcagccgttcgtcccctatcgtgcggccgcgcgttggtccttcgcactcgaccttcatgttgatgggcaggcaccccacgagcgtcgggtcgatggccacggccgcggcaagcgggtcgtgcaggccacagccgcccaggtagggggcgttcttctcgtacgcgccgatgtagtggccgaccatcgccacgtaggcacgagccgcgggcgtgtcaatctggcgccactcgtcgagcgcacgcctggtgaggaccgtctggtgcgtgacgtcgagccccaccatcgtcgcgtccacgcccgagcggaagacctcgttggcggcctccgggtcctggtcgatgttcgcctccgtccaggcgttgacgttgcccggcaccgtgagggcgccgcccatgagcaccacgtggaggcggtccttgagcgaggggtccctccggagcgccgccgcgaggttggtcggggcacccgtcggcacgtaggcgagctcgtccccgtagcggtgcgccgcctcgatgatgaagtcgactgccggctggtcctgcaccgggcgctccgcatccgggatgaccacgttgccgatgccgttggcaccgtggatcagtgcagtggactcgctcaccgcaaagccgtcgcggcccatggcgtgcgggagtcccgcaaagaccggcacctcggggtggcccagcagctccgtcagggcaaggctgttgcgaacgccctgttcaagcaacacgtttccgtacgtcccggtgatgcccacaagctccgcgtccgggcttcccagcacgtaggcgatggccagcgcgtcgtcgattccggtgtccaggtcgaggatgatcttcttcatgtcaagctcccgtgacgtccgccctcgttcacgtctagagtatagccagcaacggccggcgcacggcgggcccacgtcacgcaagggggcgcccatgatctggttcacctcggacctccacctcggccacgagagcctggccacccagaagcgcggattttccagcctcgcggcgatggagcacctcatcatccagaacgtgaacgtccgcgtggcgcccacggacacgctctacgtcctgggcgacttctcgttccgctgcacggtggagcacgcgcgcgagctaagggagaagatcgtctgccgcaaggtgcacctgattgcgggcaaccacgacaaggactggtcgcggcccgaggttaccaagaccttctcgctcgaccctcccctcatgcggatgaagacgccggaggggcaggtcctcgtgctctgccactacccgcttctcagctgggaggccatgcgccgcggcgccgtcatgctccacggacacatccactctggcatgggcgagccggcgccgggctcgtacaatgcgcgcatgcgcgagcaggggatcctgcgctacgacgtgggcgtggacgccaacgggatggcgcccgtgtcgctggacgaggtgctcgcctggttcgacggcgtggagccacgggtgggccaggggctctgacaagacgaggacccgcctccgcaacgcgacggagacgggtcccgcaagtgcaagcagttgacgccctcggctacacggcgtagatgatcgagcaggcgacgcagagtcctccgccaaagaccagcgtgaacgccacgacgggccacacgaacttgagccagtgcgagtactgcatgtcgagcatctggagcgttgccatgaccaggcccgtgggagccaggtagagcatggcgtactggccaaactgataggccatcacgatgatccagcgcgggatgcccacggtgtccgcaagcggcgcgaggatgggcatggacagcacggcgaggccggaggaagagggcacgatgaagcccagcacgaagaagatggcgatcatgaccaggatgaacgcggggccggacatgccgctgaccagcttggacgaggcaaacagcacggtgtccgagatgaggccctggttcatgatgtagttgacgccacgggcgaggccgatgatgagcgacacgcccacgaggctggaggagccgttggagaacgcctcggtaagctgcttctctcccatgtggttcttgccgaagccggcgatgaacatgatgagcaccgcgtcaaacaggaagaacgccgccatctgggggaaccaccagtcgagcttcatgacgccgtacaccatgatcgggaacaccatgacgaagaggatcaggatgatccggcgcttgagcgtgaagtccgggacgcccgcctcgccgtcgctcacggaccacatggcgtcgaacttggccttgtcctcgtacgagtaggagaacgtcgggtcggccttgaccttgctggcgtaccagtgcaggtagatgaagaggcagatggccgccacgacgcagccggccatgcgccaggcgaggccctcggtgaagacgatgcccgccgcgttggacgcgatgaccgaggagaacgggttgatggtggagaaggtcgtgcccacggagctggagaggaagatcgctccgacggtgacgatggagtcgtagcccaacgcgatgaacaccggcgtgaggatgggatagaaggcgacggcctcctcctcgaacccgatcgtggttccgccgatgaccatgaacagcgagcagaagaacacgatggcgaactcacggcccttggtcttcttcgtgagcgcgaggatgccggactcgaaggcgcccgtcgcgcggacggtgccgatgaggccaccgagcaccaggatgaagacgatcacgtccacgccctcgatcgtgccgttgaccatggcctggaacacctgggtgacgccctgcgggttctgcggcaggcgcttgtaggtgttggggaccgagatgggcttggtgatcgagccgttcttgaactgcttgacgtcgatcttgacgcccaggctcttgagcgtcttctgcgttgcgggctcctcggtcaccttgccgctgggggacgtgatctggagcttgccggagtcgctgtcgtacgacagcttggagtaggcgcctgccggaaccaggtaggtggcgattgccgcgacgatggtgaccgcgaacaggatggtgaacgcggttggcacgtggaagcgtcccttgcggcggtggctcttctcgcccgcccctaccgacgacggctcgatggccgcctcgccggcaccctggcgcttggcgtcatggtctctcacgattggtctccttcccttgtggggcggaccccgcgccgccccagatcttctctgcgagaccacggtcgcgcggtgggagaaacccgtgaagccctaacgtggtggtagcggtgggtataacgtgtgagcgagtgcgcctacaccccaactacacccacatctacctgcggcaacttgagctatactgtcttggttctgccaagggtcttgcgacctgcacccccgaagggaccattgccatgtacgtggcgctgttctactactcgctcttcatactgctcgcctgcggcatgacggcggccatctgcctctccgcgtactttgtcacgcgccgcagggcggacctctgcctggtggcgtgttacctcatctactttctggacgcggccatcgtgtaccaggacgacttcgtgacgggagggggcgccttccgcaacgcctcgttcttctatataggccaccccatcctgagcgccatcaccggcgcgggggcgttcggctgcctctggctctacgtgtgcgagcggctcgaggtgcggggccgggcgatgcgggccgtccccatcgcgctgttgctcgtgctcccgcccgtgctgtaccagctcatcccaggcacccagctggcggagttcgcgttcttcttcagccgcgaggtcttcatggggttcgtcctcgcctacgtggcctaccgctttgccaccgcgagcgacgccgcacggatgcgcatggcacgcaagcgccgcgagttctgggtgatagtccttctcacctgcctgacggcgctggagaacgtcgcgtttatcctgctgtttgacccgtcgaggctcgacgccggcttcctgtggttcttcgcggagcgcaacatatcggagaacctgctctttttggcgatggccgtcatcgcgctgcgccaggcgtcccagacgctgcggctgcgctttgaccagccgcccacgcgcgagagcgagaacgtgcagcagtcgatcgacgccgtgctgccgcgcttctgcgagcgctacggcctctccgcgcgcgagagcgaggtgctgcggctgctggtgctgggcaaggacaaccagaacatcgcgagcgagatgggcatcgccgcatccacggtgaaggtccacgtgcacaacgtgctcaagaagtgcggtcaacccaaccgccaggagctgaccaaggcgttctgggcaaggtagcaacaggcacgggcgagaagaacggggccctgggaatggcggcggtgccccctatgcccactcctcccagctgtggccgcagcgctggcacctgtagaggcgcgaccagtcctcggtccccacgcccaggacgtccagcccgcgcagcccgtcgaacggcatgagcccctccgccacgacgcgcacgtccgtggagccgcacttggggcaggccacgccgcggccgtctccccgcacgatgggtgcgggccgcgccgccaggcgcgtctggacttcttgggcggcacggcgaccggagccgctgcgggtcgcggccgcctcgagcgcgtcgtcttccaccagtccgtccaggtcgtcccgctgttgcgcggagaacctcaccccgcggccgatcgcgtagcggaacaggcgcgtggcaaggtccaggtccaccatgccggcaaagtccaccacctcgtccgcggtgacgcgcctgccagcgcgcatggcggcctccagcagctcgcccagcgcctcgtcgcccacctcgaagtagaactccggcacgtcgccaaagtccggcgccgagcccagcgccaggcagcggcgcacgagcgcgtcgcccacatccttctcgtccaccgtacccgcgacgtccgcgaccttgtcccaggggccggcatccgccaggttccttacgtggcacagcagctcgtccttggaccagccctcgtactgctcgtagaagtgctcccaggtcatgtcgcgcctccgtcaaatccatccgcacacgtcgcacgctgcgggcgagaagaacgttacgccattgcggcggccgcgcctagctgttgtagcgccagtggcggtcggtcaggatgcgggcgcacgcgaggccgatgggcaggaacgtcacgatgagcgaggccctggtgagccagatgaggcagttggtcacctggtagttggcgaggtagtagacggcgcggtacatgtacaggcccggcaccatgatcacgatggacggtaccgtgagcgagatgcgcgggtaggtgtagcgcttcctgatctcggacgcgaggagccccgccaccagcgcgcccagcagggccgccgcctcgggcggcatggacgcgaggtccaccgcctccaggcgcagcgtgttggccacggcgccgatgacgcccgcgagcgccgccatcttgacgggactgttgaacatgatggagaagccgaacacgccgcagaagctcatggccagccgcagcaggcacgtgacctcgggcgaaagccccagcggcgcaaagttgtcgggctgcaggtggacgacggtggcgaccagccagccaaagagcgtcgccaccaggatgaccgtcagcgcgtagcacagccgctcgatgccactcttgaagtcgagcttggcgatgtccagcccgctcgtgatgagcgggaagccgggaatcacaaacagcatcgcgccgatgtagccggcctcatgcgacatggcgttgggcaggaggaagctcagcgccaggagcgtgagaaggtacgcaacgcacgccgcgctgaccgccgcgcccacgcaggcaaagtgcgtgatgcggtggtcgcccagcttcctcctggtgaagttgcccacgcccgcgcccacaaacgcgcagagcatctcgatggggccgccgcccagcaggaacacgaaggccgcgcacgcgagcgccgaggcaaaccccacctgtgccggcgagtacgacgagcgcgtctggtactccacctggtccatcaggcggtgcatctcgcggatggtcagctgggaggcgcagttctcgaagtccttcatcagggtctccatgcgccacacgcgctccgtgttcacgccggtggtcggcagcgtcacgatcagcgtctcgtgctggccgtggtcgacgcaggtgcactcgatggtgaggaggctgacgtcggccgaacagaccacgccgagcgcccgcgcgatgcggttcatggcctcgcgcacgcgccagccgccggtgccgccggaaagcgtgaggatgccgacgcgcgcgatgaccgccgtcttgtcggcaagctcggcgtccaccgcccgcatgtcaccgttcctgatggtcttgtgccaccgcaccggcatgtggtggggatggtggaacttgctgctgctcacgacctcggcgagctcgttccactcgtcgtcggtctccggcatctcgtacacggcaatacacttccagtggcgccccgcggggcagacgaatccgttgcggccgtgcacattctagggcgatgggcaaaaacctcaagccactgacacgaagcggcaaacgtcgccatcccgcatgacgcgggcgagaaggacgggcgcccttctccccaaccgcgcccttccgcttcaaaactaataacacgtccgatcccacgtttaaccctccaatctggggactaaacatggttgccagcgttgtttttggttaaacgtggaatcaagcgcagttcttgggataaagatggaatcgagcgcgctaattgcatgactgggagcctctggaacctaaacgtggaatccagcgtggcagtttggctaaacgtggagccttgcgtgctgttttgttttgatatttatgacagcaatgctaaacgtggaatttggcgtcttagtttcctaaacgtggaatttggcgaggaactcccaccggaacacgacgttcgcagccggatgcggcagaagactcgcggcgacccgggccgacgctagtcgcaccgcggttgcgctaaggtagaggcacacaactgggcagcgcggcatgcgccggcgctgccgacggaagggggacccgatggccaagatctgcctcgtggaggatgacgccgcggtgcgcgaccagctcgtccttctcctccagcacgcggggcacgaggtgagcgccgtcacgcgcttcgacaacctcccggaggacatcctcgccgccaaccccgacgccgtgatcctggacctcggcctgcccgggaccgacggccagtacgtggcgcgggcgctccgccagcagagcagcgtgccgctcatggtgctcacgagccgcacctcggagctcgacgagctcatgtccctcacgatgggcgcggacgacttcgtgcagaagtccacgaacccgcagctcatcctcgcgcacctcgacgccctgctgcgccgcgggaaggcggcggcgccctcggccacgctcgaggagggcggactcacgctcgacaccgtccgctcgcaggcgagctacggggggaagaccaccgacctctcccgcaacgagctccgcatcctcgagctcctcatgaggcgcaagggcggcatctgctcgcgcgaggacctgatggaggcgctctggacgagcgaggccttcgtggacgacaacacgctgaccgtgaacgtgaatcggctccgccagacgctctcgcacctgggactcaagggtgcggtcgtcaccttccgcgggcagggctacgccctcaggctggagcgcgcatgaggctctccgactacctcaggagccacgccgcgcgcgtcacgtgctcgctcgtcctcctcatcgcaatcgccgtgctgctcccgcccctcggcgtcggccgcgacggcgtccttctcgtcctcatcatctgcgcggtcctggaggccataccctttgcctgggggtggctgcgccagcatagcttcaacgaggcgctgtccgccctcgcacgcgaggaggaggacgccgtgtcgctcgccaaggacctgccggagccggagtacccggagggcgagctcgcgtggcaggccatccagaacgtggtgcgcgcggcgcaggcggaaagcaacgaggcccaggcgagcgtggaggagtaccgccgctacgtggagacctgggtgcacgaggtcaagacgccgctcgcggcctgccggctcatgctcgccaacgccaagagccccgacaacgcccagctttcgcgcgagctggggcgcatcgactcctacgtggagcaggcgctctattacgcgcggagcacgtcggtggagaaggactacctcgtcagggccgtgcccgcggaccggctagtgaaggatgccgtgagctcgcgcgcccgcacgctcatcgaggcgcacatggccgtcgacctcagcggcctcgcccagccggacggcacggtgcccgagctctactgcgaccccaagtggatggacttcgtcctcgggcagctcatcgacaacgcaatcaagtaccgcgcgcagccccaggcggacggtcgggcgcccaggctgtccttctccacgcgcgtggaggacgccggcaccgcgcgcgaacgggccgtgctcagcgtgagcgacaacggatgcggcatcgcggaggcggacctcccccgcgtcttcgaccggggcttcaccgggcagaacggccggagccaccagaagtcgaccggcatgggcctctacctggtacggacgctctgccagaagatgggtctcgccgtgggcgtgcgctcccgcgtgggcgtgggcaccaccatagagatcgccttcccgcgcgagcgctcgcgcatgctgcgtgacgtcaccgcaggtcaggacagcagtcccgcgaaccttacagaagtgtaaggcggcgtaagccgcatcgatggcacccgcgcgccccctcggccaatatgatgggcagcagccaacaccgcgaccgaaggagcttcgatgtcacgtcacttccaggcggccccgtccgccatctcagcaaacgccagcgcgccggtcctccagatctccgcgctcaccaaggtctacgggggcaggaacgccacgaccaaggcgctcaacggcatcagcctctccgtgcagaagggcgagctcgtcgcgatcatgggcccatcgggctcgggcaagtcgacgctgctcaactgcatcgccacgatcgacacccccacctccggcaccatccgcatcgccggcacggacaccgcgcgcatttcccgccgcggcctggcggacttccgccgcacgcagctcggcttcatcttccaggactccaacctgctcgacacgctcaccgcgcgcgagaacgtcgccctccccctcacgatcggccgcgtccccgctgaccagatcctcgactcggtggagaaggtcgcccaggcgctcggcatctcggacgtgctcgacaagtacccctaccagatgtccggcggacagcgccagcgcgtcgcctgcgcccgcgccctcgtgacgcgtccccagctcgtgctcgccgacgagcccacgggtgccctcgactccaagaacgcccgcctcctgctcgagagcctcgaggccatcaaccgcgcccagcgcgcgacggtgctcatggtcacgcacgacgagaccgccgcatcgttctgcaggagggtcctcttcatccgcgacggcaaggtgttcacggagatccgccgcggcaacgactcgcgccgcgcgttcttcgagaagatcatgcaggtcgtggcggtccagggaggggttgacgatgctcgctaagctcgcctttggcaacatgcgcaagctcgtgcacgactacgccgtgtacttcctcacgctcgtgatgggcgtcgccgtcttctacgcgttcaacaccatctccgtccaggcggacttcctgaccaacacggtatcggagctcctcaagcaggtcggccagatcctgcgaggcgtcacgatcttcctcgcggtcatcatgggcttcctcatggtctacgccaacaacttcctcatgcgccgccgcaagaaggagctgggcctctaccaggtcctcggcatgcgcgccggccaggtcaacgccatcctcacgctcgagaccctcatggtcgccctcgcctcgttcgtcgtgggcatcgcgctcggcgccctcgtgtcgcagctcctgctcttcgtcacggcggatatgttcgccaccaaggtcacccacttccggttcttcttctccccacaggcgctcgcgctcaccttcggctgcttcgccctcaccttcctcgtgatgatggtcctcaacagcatctcgctctcgcgcgtccgcctcgtggacctcatgagctccgcccgcaagaacgagcggcaattcgtgcgtcacctcccgctctcgctcgcactcgcggtggccggccttctcctcatgggctatgcctactggcgcctcaccacgcagggcttccccctcggtagcagctccgaccccggcgcgaccacgaccagcgacttcctcctcacgacggccatcgtggtcgtgggcaccttcgtcttcttctacggcttcgccggcgcgctcacgctcgtgctcgcgcgcctcaggggcttctactggcgcggcctccacatgttcacgacgcgccagatcgcctcgcgcgtcaacacggccgccgtctccatgggcatgatctcgctcatcctgttcttcgcgatgacgtccatgacctccggcatgagcatctgctcgaccctcaacaagatgtacgagaagggcaccccctttgacgcgtccgtgaccgtcgtgggcaccagctacaagggcagcaccatcgactttgcgggtgcggccaagcgcgccggcgtcagcctcccctccgtcggcaagacgtccaccatgcgcctcgccatcgtgtcgaacagcaggggcatcatgaccatcgacacgctgcacgacatgtccaggctcacgggcaggtccattccctcgggcttcgagcacacggtcgcctaccaggccgtctcgctttccgactacaacgcctaccgcaagttcctggggctcaggcccgtcacgctcgaggacggccactacctctacctctgcaacatggaccagctcacggacttcgtcaacgccgcgctcgccaagggctacgccatcaacgcctccggccacaggctcacgcccgcccgcgccacggccatcgacgacgcgtcgtgcgtccttctcaacgactccatcggatcgaacccgggcacgtacgtggtgccggacgccgtcgcggccaagctccccaactacacctggaacctcaacgtcaagtacaaggtctcgaccgagaagggcgacgacgcgatcaagcgcgtgagggacacgctcgcggcggaaaacgacagcctctacgtgtcctccaacaccaagacggagtccgccgtcgagggcaccaccacgaccggcctcatctcgtacatggccatctacatcggcttcgtgctcgtgatcgcctgcgccgccatcctcgcgatccagcagctctccagcgcgtcggacgccgcctccggctaccgcacgctcagcgagctgggctgcccggagcgcacgatctttgggtcgctgcgcgcccaggtcacctttgccttcgcgctcccgctcgtggtcggcctggcgcacagcatctgcgccacggccgcagtgaacaaggtcctgaccacctttggctacgcgagcatcctcgagaacgtgggccttggcctcgtaatcttcgcgctggtgtacggcggctacctcgtgctcacgtaccgcctggcccaccgcaccgtgaagggcgccatcaggagcgcgcgccacgcgctgtagcggaggccgtccttctcgcccatcggtagcgcaacattagagcggggtcccacaccaaggtggagccccgctcacgttttatatggtgtctgtctgacgttgacgcagttccgcaggcgagaaggacgcggcctcccggcagcgcccgccggccaacggctactcgtacaggtgctcgctgaagtagcggtcgccccggtccgggaagagcgtcacgaccgtgccgtggtcgatccttgcggccacctgcagcgcggcgtacagcgcggcgcccgaggacgagcccgcgaacacgccctccttgcgggcgagctcgcgcgaggcgccgtaggcctggtcgtcgctcaccttgatgacctcgtccaccagggacatgtccatggtgtcggccacgaagtcgttgccgatgccctcgatggcgtagggcgcgtgcttgccgccgcccatggtggagcccacgggatcggccagcacgccgtggacgtgggggttcttctccttgaggtagcgcatgatgccggtgtaggtgccgcccgagccggcgcccgccacaaagtagtccacgtgtccgcccaggtcgcgccagatctccggcgccgtgctctcgtagtgggcgcgcgggttggccgggttcttgaactggcgcagggccacggagttggggatctgccccaggagctcctccatcttggcctgcgcgcccagcatgccgtcctcctcgggcgtgtggacgatcttggcgccaagcgcgcgcatgagggtctgcttctcctggctgaacttgcccggcaccacgaagaccaccttgtagcccctccccagcgccgcgaaggcgatgcccaggcccatgttgcccgccgtcgcctccacgatggtggagccgggcttgaggaggccgctcttctccgcgtcgcgaaccatccagacgcccgtgcggtccttgacggagcccgcggggttcatgagctcgagctttgcgaacagctcgacgccaggcttgacgcccatggagttgatcttgagcatgggggtgttgcccacgagctctgccatgctgtcgtagtagtggcgcatgctaggcctccttggctgcggcgattgcctgattgatgtctgccagaatgtcgtccgcgtcctcgattcccacggagaggcggatcagcccgtccgtgatgcccacgcggtcgcgctcctccttggggatggccgcgtgcgtcatcgtggcggggtggcagacgagcgactccacgccgccgaggctctcggccagagcgacgaggcgcgtggaggcgagaaacgcgtgcgcgtcgtagccggaggcgagctcgaagctcagcatggcgccggccccggacgcctggcgccggttgacctcgtagcccgggaagtcgggaaggcccgggtagtagaccttcgcgacggcatcgttctgctggagcgcccgcgcgatgacgcccgcgttcttgaggtggcggtccatgcgcacgccgagcgtcttgatgccgcggatgagcaggaacgagtcgaagggccccagcacgccgcccgtggcgttctggacgaaggcgaggcggtccgccagctcctgcgaggccacgaccgcgagtcccgcgaccacgtccgagtgcccgcccaggtacttggtggcgctgtggaccacgatgtccgcgcccaactcgagcggcctctgcaggtacggcgtcatgaacgtgttgtccacgatcgagagcaggccgtgctcgtgcgcgatgcgcgagacctccgccaggtccgtcacggtcatgagcgggttggccgggctctcgaccagggtcgccgcggtgttggggccgatggcggcctccacgttggcggggtccgtggtatcgaccacgcggaacgtgaggccaaagcggttgaacacctggttgagcacgcggtacgtgccgccgtacacgttggtggggatgatgacctcgtcacctgcggaaaggaggctcagcaccgcggtgatggccgccatgccgctgccaaaggcgaagccggcgacgcctccctccaggtccgcgatgagccgctcgagcgcggccctggtggggttgccggtgcgcgagtactcccagccacggtcctggccaacgccgtcctgctggtaggtcgaggtctggtagatcgggacgttgacggccccggtcacggggtccgtggtgccgccggcgtggatgagccgggtggcgaacgcggtggtgcgggcctggtcggccgtctggttggatgcgtgctgcttggacgtaggcatggtcttctcccctggccccggacgtgaccgctcgcgggccggggcgcgtgcgccagccatgcagaaggtcggccctggggaccgattggtttcaactttggtttgtcttgtggagcgccgcggcgacgtgccgcagctatgggttgggatgggaccctggttcccgccggcgcgcgctgcgcagccagccgctaggaacggtcccggggcgtgttaggaacgacaggcacgcacccagtgaaccagcagtgcgtgtgcgtgtgagcttgcgagtgctgccgtcgccctcacctccaatggtgtcttgcgcctcaagtaatgcctagcgagtaactaggatataagctttatacgaccatcccgatgggatgtcaacgcggatgtcgggattttctcgtccgaaaacatggcggacggggcccggcaggctaacgctggatgtggatgtaaactgtccacggcgcgtggggatgcggaggccgctgcggcacggcgtgcaagtgccttgcatttgcgcaggtaaacaccataggcaacgcacgcttgcgcgcccgcgggcacgtccggatgcgctccgggcgccgcgcaagtacgcctttcttgccgcggtcccccgcaacggggaccatggccctcgaggaggtacggatggactttggcgatcagattcgcgacctgcgccggcgcgagggccttacgcaggagcagctcgcgcagcggctcatggtcacgcggcaggcggtctcgaactgggagcgcggcagcaacctgccggacatcgagacgctcatacgcatcgccaccacgttcgacgtatccctcgacaggctcatcctcggaagggaaggcaacgtgaagacaagtgagaagaacgtggcgacgtcccccgcggacgctcgggacgaggctggcgcggacggcagccgcatggccaggaagctcatccgcgacgggagcgagggacggcgcgcccgcatgaacgtggtgagccttgcgattggctgcgcgctcatcctgctgggcgcgttctgcgtgttcgtgaaggccaactccgtggagtacgtggacgcctccggcatcctgcacgagaacttcttcctgctgccgatggcggcggcgttcgtgcttgcgggactcgtcaccatcgtggcgaccggcgtggtccgcctggtgcgcacgttgcgcgaccgccgcaggtaggtctgccgcgcgggcgttgtccaaccgcctgtacggcccgcccaccgcacccctcttgccgttgcggtcgccattccctaccccaggatgcccgtcccgagcgcacgcacgagcgcgtccacgtccgcgtcggcggtggaccagctggtcgcgagtctcacgacggcgtggccgaggtcgggcttctcccagaagctcgcgagcgcgacctcgggcaggcgccgcgcctgctcgtccgtcagcacggggaagacctggttggtctgcgtgggatgcgcgagctcgcagcccgcatcctcaaacgcgcgcgacacgcggcgcgcctgtgccacggctgcctgcccgatgcgcccgtacaggccgtcctcgaacatcgcctcgaactgcacgcccaggagcctcccctttgccaggagtgcgccgcgctgcttggcgatcgtgaagaagcggcgcacggtgccaggtcgcgggaagacgagcgcctcgccaaagagcgtcccgcacttggtcccaccaatatagaaggcatccgcaagcttggccaggtccggaagcgtcacgtcgttctccggcgcgccgagcgcgtaggccagccgcgcgccgtccacgtagagcctcaggccatgcacgtcgcacgcgcggtgcagcgccttgagctccgcccgcgagtacagcaggccgtactcgttcggctgggagatgtacaccagcgccggctggaccatgtggtcgcggttgccgtccttctcccacagcgtcatgcactcgtcgaggtcggccgccgcgagcttgccgtcgtgccccggcagctccagcaccttgtgcccgtccgcctcgatggcgcccgcctcgtgcacgctgatgtggccggacgtcacggcgaccacgccctcgcacggcgcgaggagcgagaagatcgcaacctcgttcacctgggtcccacctatgaggaagtggacctcggcctcgggcgccgcgcacgccgcgcggatgagctcgcgcgcatgctcgctgtggccgtcgagcccgtagccggcgctcttctcgtggttggtccgcgcgaggcgctccatcacggggtccgcgcatccctcgaggtaatcggacgaaaagtcgagcttctccatggttggcacatcccttccgccccgcgctgcgcgaggcgcctccggcgctgccgccagtcccgttctgtcgctccatggccatgtctgagctcgggaaccactatagtctgcctgcaatcatgatacttcgtgcttataatcatgtttgtaatgacgtttcatcatgatgcggaggcaggtccatggacgcaaccaagtgcgaggcgctcatcgccgcagtcgaaagcggctcgttcacggcggcggcgcgccagctgggatacacgcagtcgggcgtcacgcgcatggtggcctcgctcgagtctgagctgggcttctcgctctgcatccgcaccaagcagggcgtgcgcctcacggagaacggccgccgcatgctgccccacctgcgcgagctcgtgcgcgcccagcgcgtggcggaggagtccggcgcggaaatccgcggcgtcctgtccggcgcgctgacggtcggctcctactacagcatctccgccatctggatgcccacggtgctcaacgcgttcgagaaggactaccccgggatcgacgtcgcgatcagggagggaggcaacaccgagatgggccagtggctcaacagccgcgccgtcgacctgtgcttctgcgcgcagccgtccaagggcacctactgcgactggatcccgctctaccaggacgagatggtcatgtggctgccggagggccacccctacgccaccgccaaaagctaccccatccacaacctggagcacgaggccttcatccacacgctcgccaaccacgacacggaccaggaccgcctcatccgcgaggaggggctccgcgtgcaggaccgctacaccaccaccgacggcttcaccacgtacaacatggtcgaggcgggcctcggcgtgagcttcaaccagcggctcatcagcaagcgctggaacggccgcgtggccgaggtccccttcgagcagccacgccgcatctcgctcggcatcgccgtgcccttcctcgcggaggcctcgcccgcggcgcagcgcttcgtcacctgcatcgagcagctgatgccccgcctgcgcgcacttgccggcgcgtccgcgtagcacgtcccgccgccttcggtggggagtttcggctgcttgcctcgtctgcccataaacgtcagcggattgtaatagcctatctaccgaaaatccgttgacataccaggaggtagacatgacaagtcagacccgggcgcccttctcgcccgcgacgccgcaggacggaggccgccgcgatggatgaccttcgctacgtgtcgcgctacatgcgcggccaccggctcgagatgctgggcgcggcgacgctcatcttcctcgagaccgtctgcgagctcgtgatccccttcctcatggccagaatcgtggacgtgggaatagcggagaagaacctggccctcgtgttcgcgaccggccgccagatgctggtggtcgccgtgatcgcgggcgtctgcggcttcgcgtactcgcgcctgtccgcgcaggcggccatgggcttcggcgccaacctgcgcgacgcggagtacgcgcacctgcaggactactcgttcgccaacctggacgagttcgagtcgtcctcgctggtcacgcgcctcaccacggacatcaccgtcatccagaacgccttcgtcatgggcgtccgaccgctcctgcgaagcccggtcatgctcatcgcgggcctcgtgctcgcctgcgccatgagcgcgcgcctcgccgtggtcttcttcgtgatcatcccgctcctggcggtcgcgctcgggctcatcgtgtgccacgtcgccccgctctacgcggtgctgcagcaggcgatggaccgcctgaaccagaccctgcaggaggacctcgtcgccatccgcgccatcaaggcgtacgtgcgcgagggccacgtggagaagcgcttcgaggccgtcaacgccgacctcgcagacacggccacccacacgttctccggcgcggtgctcaacatgcccgtgttccagaccgccatggccctcgcaaacgtgggcctgctgtggtttggcggcctcatggtcgccaagggccagatcggcgtgggcacgctcacgggcttcatgagctacgtgctgctcatcatgaactcgctcaacatgatatcgagcgtgttcctgctgctcgcgcgcgccatcacgagcatcggccgcgtctgccaggtcctgcgcgaggagccctcgatggaccccaaccccggcggcctcaggcaggttgcggacggctcggtcgagttccgcgacgtgtcgttcaagtacaaccccgacgccaaggccaacgtgctcgagcacgtgtccctgcgcttctcccccggctccacggtgggcatcctgggcggcacaggctccggcaagacgtcgctcgtccagctcatcccgcgcctgtacgacgccacggagggccaggtcctggtgggcgggcgagaagtgcgcaactacgacgtccacgccctgcgcgcgggcgtgggcatggtgctccagaagaacgtgctcttctccggcaccgtacgcgacaacctgcgctggggcaacccggacgccacggacgagcagatcctcgcggcgtgccacgtggcctgcgtggacgagttccttgaccgcatcggcgggctcgacgcggacctgggccacggcggcggcaacgtgtccggcgggcagaagcagcgcctctgcatcgcgcgcacgctgctttcggaccccaaggtcatcgtgttcgacgactccaccagcgccgtggacaccgccacggacgcgcgcatccgcgcggggctcgcacggctcacgggcgtgaccaaggtcatcatcgcgcagcgcgtgagctccgtcatggacgcggaccagatcgtgatcctggacgacggccgcgtgcacgcgacgggcacgcacgcggagctcctcgcgagcgaccccatctaccaggagctctattactcgcagacggcaaccgcgacggagggggacgccaatggcgcagagtaaggcatcgggagccgcgcgccccaggaacatgcggcacacgctcaggcgcttcgtctcgtacatggggcacgccaagttccacatgctcgccgtgaccatcctggtcacgctggcgggcgccggcaacctcgccggcacgtacatgatcaagccggtcgtcaaccgcgtcgccgcgggcgacatgcggggctttgtctccacggtcgcgctcacggctgccatctacggggtcgcggtcctttccgccctcgcgtacacgcaggtcatggtgcacgccgcgcagcacatcgtgttcgacatcaggcgcgacctgctcggacacatcatgcggctgccgctctcgtggttcgaccgcacgcgcaacggcgacgtgatgagctacttcgccaacgacgtcgacaccatcagcgaggcgctcaacaacagcttcgccaacatgctgcaggccgcgatccagacggtcggcacgctcgtccttctcctcgtgcttaactggcagctcacgctcgtgacgctggcttgcgacgccgtcgtggtggcgtacacgcgcttctcgggcaagaggtccaagcgctacttcgcggagcagcagcgcacgctcggcgcgctcgacggctacgtggaggagatgatcgccggccagaaggtcgtgaaggtcttcaaccacgagccggccaacctcgcgggcttccgcagcctcaacgaggacctgcgccgcacgggcacaaacgcccaggcctacgccctcaccatggtccccaccaccgtcgtgatcggctacgtcaactacgccgtggtcgccgtgctcggcgcgatcatggccatccacgggcagacggacgtgggcagcctcgcgagctaccttgtcttcgtgcgccaggccaccatgcccctcaaccagctcacgcagctgggcaacttcgtgctgacggcgctcgccggcgcggagcgcgtgtttggcgtgatggagctcgcgcccgaggtggacgagggcagggtcgtggtgcgccacgcggagcccaaggacgacggggcgagaagtgcggcctcccagcgccgcatggccaccggcgccgcgggctggagctggatcctgccgggcggcggcatggtgccgcttgccggcgacgtgcgcctggaccacgtggcctttggctacgaggagggccagacggtgctggaggacctctcgctctacgccaagcccgggcagaagatcgcctttgtgggctccacgggcgcgggcaagacgaccatcaccaacctcatcaaccggttctacgacgtacgctccggcgccatcacctacgacgatatcgacgtgcacgacattcgcaaggcggacctgcgctccacgctgggcatcgtgctgcaggacacgcacctgtttgacggcacggtggcggacaacatccgctttggcaagctggacgccacggacgaggaggtccgcgccgccgcgcgcgtggccaacgcggactccttcatccagaggctcccccaaggctatgacacgcgcatcacgtccgacggcgccaacctcagccagggccagcgccagctcatcgcgatcgcgcgcgccgcggtgtccgacccgcccgtcctcatactggacgaggccacgtcctccatcgacacgcgcacggaggccctgatcgagcgcggcatggacgccctcatgcgcggccgcaccgtgttcgtgatcgcacaccgcctctccaccgtgcgcaaagccaatgccataatggtgctggagcacggcaggatcgtggaacgcggcacgcacgacgagctcctggcccagcacggcgagtactggcaactctacaccggcaagcgcgagctggactaggcagatcgggcaacgcgggaggcatgatggacgtggcgacggcacgcaacgtggacgcaaacgtggacgtggacgcggttgcgcagacactgctgggaggcgacccccaggtccgcgcagcgtacgaactcgcgcgccgcgcgcacgcggggcagctcgacaaggcgggccggccctacctcctgcaccccgtgatggtggcggcgggcgtccgcggccacggctccacggccatggcggccgcgctcctgcacgacgtggtggaggacgcgggcgtcacgccgcagaagatccgcgcgcagtttggcgacgccgtggcggacgcggtcgcgctcctcacgcacgaagccggcgtcccctaccaggactacgtgcgccgcgtggcggaaagcggcaacgcggcggccatcctcgtcaagctttccgacctcacgcagaacatgaacctggcgcgccttccgcaggcgggcccgcaggacgtggagcgcgtgcggcgcaagtacctccccgcgatgcagacgctcctggccgcgctgtaacgcacgcaaacaacgggcgagaagcccatgcgccacgggccgcaaccctcccgtgcggcgcaccctcaggcggggtgggaccggcgatccggctcccaccccgtccgcgcgttcttctcccctgcctgccgacgccgcagcgcggccacaaggtcacgctgttcgagaagagcgacagccttggcgggcacctcatcagcggcggcgcgcacgacttcaagagcgaggtgcgcgagctcaacctctggtaccagggcgagctgcgtgactggggcgtcgacgtctgcatgggcgtcgaggccacgccggagctgatcgacgggctcgagcccgatgccgtcatcctggccaacggctcctcccccgtcatgcccaagatcccggggatcgaccaccccaagacgctcggctgcatcgacgcgctcctgcacgaggagagggtcggccgccgtgcggtcgtggtgggcggcggcctcgtgggctgcgagatatcgctcgacctcatcaacaagggccacgaggtcaccatcgtggaggcgctgcccggcatcctgagctctggccccgccgtgccactgcccaacaccatgtacctgagggatgccttcgcgctccacaagacgcccatcctcaccaacacgcgcatcgccgcggtggaggacgtcggtgccgtggtggagggaccggacggcaggcagaccctgcccgcggacacggtgatcatcgcggtcggcttcaggcccaacccgtccatggctcccgacctgcgcggttgtggctacgaggttcacgagatcggcgacgagcgccacgtgggcaacatcctcacgtccatctgggacgcctacgaggtcgcgcacacgctgtagcgaccgacaaccaaccacccgcagaggcgcatcacgccacgacgcgggcgagaagaacatggggcctcgactagcatcgcgttccaggcggggcctttgcttagggtagactgaagtcgcaggtacacggcaggaacttgaggagcgacgatgaccgagcagcaccgtcaggttcgcaggaccgcacccgccgggaaccggcagaggcagacatccgccagcgcgaggcgtggccacccacgtgacgcacgctcttctcgcccgcgtgatgaccgtcgcgggggccgtagccaggctcgccgcaatggtaagtcgcttgcggcgttgcttgcgtgcgccgcggttgtcatagttgcagtcgtgatgataggccatgcgtgcgcgaggcctacggcggcccctcagggcgagaagagcaccaccacaactgtggcgcggaaggcatcgggaagcgggcgcgtgagcctctgcgcggtcggagacaacctcgcaaacctcaacacgctcgcgtacgcggactcgtgggcgggcaccacggacgacggcacgtacgacttctcgccgctgtacagccacgtgaaaaagaagatcagctcctacgacatcgccttcgtcaaccaggagacgacgctcggcggcaccaagaagtttggttacctgggttatcccagctacaacacgccggattccatggcaaaggccgtcgtgggtgcggggtttgacgtcgtgaacaccaactcgaaccacacctatgacacctggatcgattccatcaagcacgcccagtccgtctgggcaggctacccaaaggtcaccacgatcggctcgtacgcgagcgaggcggatcgcaggaacgtacgcaccgtcaccaagaacggcgtcacgattgccttcctctcgtacagctacgggcagaacggctaccagcagtccgacctgcccaacgactactacgccgttccctgggacgcggacgcgatgcgccaggacatggcccgcgccaagaagaaggccgactttgtggtggtctacctgcacatggggaccgagtacaccaacacccccaacgaccagcagataactgccgcccaggcttgcgccgacgcgggcgccggcatcgtgctgtgcagccacgcgcacgtgatccagccgctcgcgtgggtcaagcgttcggacggcagcggcaagacgctcgtggcctacggcctgggcgacttcgtgagcggctaccacgtgcccagctgcgtgctttcgggcatgctgagctgcgacatcgtgcgcaagcccaagggtggctttgtcgtgaggaacgtggtctggcacacgctgatcgagcatgccgaggggaacacggacaccgtctacctcgcaagcgactatccagataagttggccgagaagaacgagctgctccagcggcaggcggatccgggaacgtggatccgcagcaagacgcgcgaggtcatcggcgacgggttcaagatcgaccagtaggcgacggcgtgccagcttgcactagattccgaactcccgaaagagctcctcacggtagttggggtcgcgtagtgccttctggatctcatcgcctcgtccggctgccccgagacgagcgccaagcagctcgaagcgtcttatcgccttggcctcgcccttggctatacccctggcctcgcccttggctatacccctggcctcgcccctagcctcgccctccttacgggcctcagcaacgtcttcgcggtacttctcggaccacagcatcatggatcgcctccagacggaactgtcgcgcagcctcctgacagcgtcatcaacgcgtcggacgtactcgctgttgacggtattatcccttacgtagctcaggaacgcatcaaactcttcgccgtagtcgccattcgtgcccctggcgttcacgaagacgatcatcgtgccatcgccgagctccatgctcgagtccatgcccttctcctcgcacttgtacgagtattgatatcgcttccagttgcggtcgaacgggtcgccggtacagatgaagatcaccacgacgcgaccgacggcatcgtagctctggcccttctccatcatgctcccctcgacgagcgacacgtaccgtcgcgcgcgccgggcgatgcctgccatgtgaccgttctgcatctccacgtcatagacgttgccgtccacatcccagacgagaagatcgaccaccccggctcgcgcgtccggtccggcgtccagatactcctggcgctccaccaggctgagcttgctcacctcgatagcccgaatctttaggcctctgtcacaaatgcctgccgctgtttgcggataagacggacgtgcgttggttagagccggggcgcaatggggtagttctatagcgacgcgcaagagcgccgttggcatgacaggcaaacgcgcacacgggaaaggaaccgcaatggagaaggaactgctcgactacaccaccgcaaaggtagacgagatctacgccgcgccctctgcatcggccgacaccaagaaggctgcccaggcgtggaaggacgccatcgccaagggagaggacgcggacgccgcgacgaacgcgtttctcgacgcgataagcgagcaccagaccacgatcgacagcctcatcgcatttgcgagctcggacaaggcaaagcaaatctttggcgaggacaccgccaaggggatggtcgagcacgcccaggcgcgcaagaaggcaggcgcaagattctgcgactgcgcggcatgcaggccgtgccacgagctgctggccaagttcggccgcgaggagccggacgtctacctgtaggcaggcagctgccagacagcgcgttgcacgcggacggtcatcgcttgtgcggtggccgtttttctcgcccaggggcttcagcaacctcgaagcgttgtgccaggttggcgccatgccagccgttggaccgtccgtttaaggccggtttccgccccggctcgtaggctcttcgcaaggcaggcgcaaggccggcccgagcggagggagagccacatgctgaggaacacgagccagcaaagcaagcgcaagttccaggtcgtgggccaggatcaggcaccccacgcagccggcaccgcaccgcaggcggcacccgcgccggacgtcgagttcgtgctgccggcacacaacgaggagcggcggattggcctcgcggtcacgctccttaagcagtggctgcgcggcaacgcgcagtttggctggcgtgtgaccgttgcagactgcgccagcacggaccagacgctcgccatcgcaagccggatgcagaggcaggaccacgcccacgtgggcgtggtccatctggacgagaagggccacggccgcgcgctcaagcgcgcctggctcgcgtccgacgcgcgggtcgtggcgtacatggacgtggacctctccacggacctggacgcgatccaggcgctggtcacgccgctgctcgcgggctccgcggacgtcgcctacggcagccggctctcgcgcgggtcgcgcaccacgcgctgcctcacgcgcgagctcatgtcgcgctgctacaacctcctgctcaaccttgcgttctcctaccacgtgtccgatgcgccgtgcggcgtcaggcgcatgcgcgccgcgatccgctcgcaccggctggacgcccaaatcgcgtccgtgctcccgggcgcggcctgctacgccagcccctcgagcacggtgcgcatctcctgctgaacgctgtgctcggcgttggtgcccacgaccttctccgccacctggcggatggcgtatgggcgcgccgccagatcgccgtactgcggcgcgggagtctgggtacagtaagtactgaaaccatcgcgggccatgcctggcccgcgcgcttgattgtgggagctggaggctccggacccggggaggtgccacgccatggatgccacggaaggccatcacgaacgattcccgtacctgaaccttggggtggcaccgggcgatcaggaagccccctgccagcgctaggcatcccgcctgcaccccgcgacgcctcgcccttctcgcccagtcacgtttgtgcgcccacgatcttgcgggcgagaagaacacggccgtcgcagaccccatcctgggattgcgaggtggagccatgcggaggcttgccacaatgttccgtcacaacgggcccgcagcgggacgcggatcagaggccgcacgccgcgcccgcgcgctcgactggctgcgccaggtgagcgccatgccggccgaggacgtcctgcgccagctgggcacgcccgagggcggtctggacccgcggcaggtcgagctgtcccgtgtgacgtacggctccaacgaagtcgctcgcgcacggcgcaagcccgccatcgtgcggctggcccagagctttgttgaccccttcaacggcatactggccctcatcgcggtcgtgtcgctcttcacggacgtcatctgggcacagcccggcaagcgcgacccgtggaccgtcgtgatcatcctggccatggtggttctgtccagcctgctgcgctttgtgcaggagggccgctccggcgacgccgcgcaggcgctcgccaagaccatccagaccacctgcaacgtggagcgcgcggacgagggccgcgtcgagatcggggtcgatcaggtggtcgtgggcgacatcctgcaccttggcgccggggacatggtccccgccgacgcgcgcgtcacgtcgtgccgcgacctctttgtgggcatgtcctcgctcacgggcgagagcgtgcccctggagcgcacggcgcaggcggcgcccgttgccggcacggactcccgcgccgccggcgagctgcccaacgtgctgctcatgggttcgaccgtcgtgtccggccaggccacggccgtcgtcgtggcgacgggcgccaacaccatgtttggcgccatatccggccagctgggccagtcgcgccacaagacctcctacgacgagggcatccgctccgtcagcacgctgctgctgcggctgatggtcgtgatggcgccgctggtcttcgcgatcaacggcatcaccaagggcgactggctggaggccgcgctcttctcgctctccgtcgccgtgggtctcacacccgagatgctgcccatgatcgtgacgacctgcctggccaagggtgccgtggacctgagtcacgacgaggtcatcgtcaagcggttggacgccatccagagcctgggcgccatggacgtgctgtgcacggacaagaccggcaccctgaccgaggaccgcgtgatgctggagcgccacctggacgtgatgggcaacgtcgaccccaacgtgctgcgctacggcttcatgaacagcttctaccagacgggcgtgcgcaacctcatggactccgccatcatcaggcgctcgagcgacctgtgtgggacggacgtgggatttgacgtggacgccgtcgcgtccgagtggaccctcgtggacgagattcccttcgacttcgagcgccgtcgcgcaagcgtggtcgtgggtgaccgctcgggccacacgctcatggtcaccaagggcgcgctcgaggaggtgcttcaggcctgcacgcgggtgcgctacgacggccatgtggcacccctcacgagcgagcgctccgccgaggttgtggctcgcgccgccggcctggccgaccgcggcctgcgcgtgctgggcgtcgcaatagcccaggaccccgcgggcgtgcatgacctcagttccgcggacgagaagaacatgaccttcgtcggctaccttgcgttcctggacccgcccaagcagagcgcagccgcggcggtcgcggcgctgcgcgagcacggcgtgcagaccaaggtgctgaccggagactccctgcgcgtggcgtgcagcgtctgcaaggtcatcggaatagacgtgacaggcacgctcgagggctcgcaggtcgagctgatggacgacgcccagctggaagccagtgtggagaggaccacggtgttcgcaaagctcacgcccgaccagaaggtgcgcgtggtgcgcgcgctgcgcgcccgcggccacgtggtgggcttcatgggcgacggcgtgaacgacgccggcgccatgcgcgcgagcgactgcggcgtctccgtcgacaccgctgcggacgtgagtaaggaggccgcggacatcatcctgctcaagaaggacctgggcgtgctggagcgcggcgtcgtgacgggccgccgcacctacgccaacatgaacaagtacgtgaagatgaccgcaagctccaactttggcaacatcttctcggtcctggtggccagcgcgtttctccccttcctgccggccacggccgtgcagctgctgctgctcaacttcatatacgacgtggcgtgcaccgccatcccctgggaccgcgtggacgaggaggacctgacgcggccgcgcacgtgggccccaggcgagatctcgagcttcatgcgctggataggccctacgagctccgtgttcgacgtgctcacgttcgcgctgctgttccttgtggtgtgccccgccgccgtgggcggcagctggtcctcgctcgcgggcgaccccgcgcgccaggcgctgttcgccgccacgttccagtcgtgctggttcgtggagtccatggccacgcaggtgctcttcgtgcacctggtcaggaccaggaaggtaccgttcttccagagcatggccgacccgcgggtgtgcgcgctcgacgtcgcggcggtcgcactcgccatcgccatccccaactccccacttgcggaagccctgggcatggccgcgctgcccgtggcctactacggctggcttgcgctggtggtggcgggctatgccgcgcttgtgctggttgtgcgccacctctacgtcagtcgcttcggcaggctgctgtaacacggcccacgcgggcgagaaggacggccgccttcgtccatgcccacgcgcaagagaggccggccgcggctccaaccgcgaccggccgctgcctctctgtcggttggcttgcctagacctcctcggtacccggcttgccggagtatcccttgagcttgccgccatacaccgggaagaagctggagtccccgtagtccttgatcttctccacgtgcttcagggtctccatgtcctcggcagaaatctggaagtcgacgtccgcgttgctcctcatgtgctctgggttcgcggtcttgggcagggtgatcatgccaagctggaggtcgtagcggatgcagagctgcggcacggtgacgccgtacttctcggccatctgggcgatcgtggggttcttgagcgcctcgccgtgcgccacggggctgtaggcctccatcacgatgcccttggcctggcagtactcgatcaggtcgagcggcgtgttggagatgtggcacagcacctggttcaccatgggcttgacctcggtgttgtcccagatgttgtcgatgtcgccctgcaggaagttcgacacgccgatggcgcgaatcttgccggccttgtacgcgtcggtcagcgcgcgccaagcctcgaggttaccctcgtagtagcggtcgtcggactggttgacctcaagccacggctgcgggctgtggatgatcatcatgtcaaggtagtccaggcccatggccccgagcgactcgtcgatgctccgggccgcggactcgtagtccttgtgctcggccgcaaccttcgtggtcacgaagagctcctcacgcgggacgccggccgtacgcatgccctcgcccacgccgcgctcgttggcgtaggcctgtgcggtgtcaaagtggcggtagccgatctccacggcctcgcgcacggcctcggcggccttgtcgtcgtcgatgagccaggtgctcagggccagctggggaacctcgacgccgttgctgagggtcacgttcttctcgtacattgctcctccttcggtctgtttccccatccattctgagggcgggtcgccgcaataacaattacttagaacacataccgtgccatgcagggaacgcatggcaaccctgtgtcacatgctcacaagctgacggcccgcgccgtgcgataatgggccacaagccaacgacggcaggatcagaagggcggacgcatgtacaagctcgttgcaagcgacatggacgagacgttcctcgggtcggaccacgaggtgccccaggccaacatcgaggcgatccgcgagctgcgcgagctcggctgcctcttcgtcccggcgtcgggccgcgcctacggctccgtcatggagtccctggctgccataccgcccgagctcctgcagggctcctacctcatcagctacaacggcggctgcatcaaccgcgtcggcgaccccaagccgctctcataccacacgctcccccacgccaaggtggacgcgctctaccgctacggcatcgccctcggctgcgtgagcatgcacgtctacgaggtctgcggcaaggtctgggcctggcacctccagccagaggaggtcagctacctggccggccacatgggctatgaacccacggacgagcccacgctcgacttcctcgcaaacgtgcccctcgcaaagatcctctactgcatcccggacggcgcggacaggcttcgccaggtcgagaaggacatgccccgcgacctcaaggcgggtacctccacgaccttcagctccggccgctacctcgagttcaaccccgagggcgtggacaagggcgcaggcctccgcaagctggccgagctcctgggcatcgaccttgcccagaccatagccgtgggcgacgccgccaacgacgcgagcatggtcgaggcggcgggcgtgggcgtctgcgtcgccaacgcgcgcgacggcctggaccaggtggccaactaccgcgccgcatccaccaacgacgacggcgtgctcaaggagatactggagaagatcgtgcgtccggccgccgaggcatagcgcccgttcgtaccgatacctgcctcccgtccacaatggagctccattctcaaataatgcaaccgtgcataatgcacggttgcattaaatgacctaccgtgaggttcgcaagcggaagaagcaaacccgacgtgtccaaggccttctacgcgaagaacaatttctggacagtcgtcgtttgcggacactgctgcgtgctcggacacaggagtctcccctatgggcgtgagaccgcctgaaggcaatcggaccctgcagacgtagtagcccgccagctcgccctcaggtatcatcaacccgaggcacgccgattggagacgcaatggacgagaacgacctcctgcacgaccttacgctcatgctcctctacctcacatccaaggacaagaaggtcgccggccgcacgctctcgcgcgcgagcaagacctacgacggcaccgtcctcgacaagctatgtcgcgagggcttcatcgacaccacgcccgcgtcgaagaccgccgaccttacacaggagggcacgaacgttgccgagatgctggtcaaggtgtatggctctctcgtgggcgactttcagcacgagctctccgaacgcctcatggatgccctcccacgcactaacgagccggccttccgcttccgcgtcgagcttgacctgggaggtcgcccctgctggcgcgagatcgtggttccacaggactttacgttcgccgacctccacgacgtgatccaggcgtcattcctctggtgggactaccacctctacgacttccatctcaccaacaaccgcaagaagctgatgctcgcggatccctcctccggcggcgtggactcgatgttcgacaccggacgtgcgttcgaggatgccacgcttacctacctcgatgacatcttcccccgcacgaggactgccatctactcctacgactacggcgacggttgggagcacaaggtcaagctcgtcgagactatcaagagctaccctggcgagatgcccgcgtgcaccgccggcgctggtgatgcgcctcccgaggacgtcggtggccctggcggcttcgatcgtctcctggtaacgcttgctggccctaaaggccgcgagcgtgacgaggcccttgtgtgggcaaagtcccaggggttcgagcacttcaacctcgacagggtcaacgatcgcatccgcaagtggcgcacaggcgagctcctcgcggagtgggatgagcttcatccagacgagctggatggctacgaccccttcatcgaccttccgccaagcggcgacatggagggcggctccaactccggcaagcgcaagggccttggttcaggcaacctgaggctggtcccttagccgcttgcaggcgcatagggcatgcgacggatgcattatccggggccttcctccaagatccaagggcacggggagaagagcttcggcttttgcatcgctggcattccgaaggccgttgagaacgtgctccacccttccctctcatcgttagccccatcggcaatgcctgaagtatcgtaaatgcggccgcaaaaattaacggccgcatttacgcgcgcccgatgtacgattccctgcaagttactaggatagccaagtacagttgacaacccgtccatcagtatcgcaagtatacatatgcatgcaagccgctaggccagaagacatggcctctggcctgcaaatctaacggtaggcacaataaggtgtcagcctccgaccccccgcatctgcctggtgctcggctgcgccgacaccccccagcgtcacttacgcaagagccagcgatagagcggcattacctcgatcttggcacctcccacctcgatgattctctcatcatccgaaagcgtgacgatgaccaacctcttcggcgcaagcctctcgtctgacgcaagcgcgacaaggctcgacgtctcccggtcaaaatcgccctcgtcaagcaccagacaaacctgaactgccgcatcctcctggggtatgtagaagtcgacgtcgattctgttcttcgatgacttcaggaaccacagctcgtcgccgtgcctcctcctgaggtcgcaggcgacagcgttctccaaaagcagcgacttcttgtcaatgaggaatagtgccaagaggccattgtccatgaagtagtacttagatgcgccctcgcgctccgagaacttcgccacgtagtttttcgcgttgaacaggaggtatgcctccacggcgtaattgacgtaggagatcaccgcatcggtactgcagttaaccccagtggccgtcaccgccttgcgcagacgaccgaacgtgacgtcgctcgtcaccgtctccgccacctttttcatgagaaccctcagcgcatgcaggttccgtatcgcgtagcgggcagcaatgtccccaagcagcaccttctgatagacactttctgcgtagaccctgcggttctggtagttcacggattccggcaggcctcccgtctccagataagtctccgccgccgcccggaccttcccgtttaaacgggtagcgtagagcgcctcctcgtcgtgacgcacccccttcgcatcaaggtactcctcgaagctgtagggcatcacctcccgcacgaggtagcgtcctccaaggcgttgtgccatctcgccactgagcatcgacgcgttgcttccggtaatgtagacgcactcgtgcgcgtccgccattctgcgggcaaagcgctcccacccagtgatgttttgcacctcgtcaaggaagtaataagcgcggttgtctgtgagctcggctgccgtctggacaatgtcgttgaagtcggagaggtcgaactccgcaagtcgctcatcctcgaagttcaggtagataatctggtcccatccaacccccgaatcgatgagctcgagcgcacgctggtagagcagagtcgactttcccgccctcctcattcccacggagatgtagttagcgccctcctcgaaaaagtagtcgcgctccacgatctggctggtacggatgacttcgcgctggtcgtaaattacctgcttgataatgctgtggtccatggcatcgtcacgttcctcaggcgcctggttggattgtacgtcgattatagtcgatgatatttctgctgtttgtcgattatatccgacagaatgccaaggtcatcctcgatgtggttcacctactgcggccattacggatgagaaaaacagcggatccttctgagacctcgccggataccaccgcgaagatcgccccgtgggacgatcaacgttcttctcgcccccgccttctgctacagtatcgcctacagttcatcggaggccgctggccgcagccagcacgtgccagagaagatgtcgagtgcgctcggaaacccaaaaggtggccgggcgcattttcatgcgctgccacatagtgaacggacggagcatggccgaatcctggctcaaggtcccccagaccaaactccgcacgcctgggcttctcgccctactctcgctcatcgccatcatgatgccgctggcgctcgatatgtacacgcccgcgattccgcacatgtccgagcacctgaacaccaccgagtcgatggtcaacctcacgctcgtgggctacagcctgttcttctcgatcagcgcaatcatgactgcactcgggccctttgcctggacgttcgcgtcacggttcaccacgcccaagcgcttcctcaccacggcacttctcgtctccctcttcgccggagctgccatggtcttcacgggtaccgcaagcccgttcctcttcgcgctcctgttctgcgtgttcgccgtttgcgaggcggcccagcgcccgctcacggtcaacatcctcctcacgcagcaggacgagtgcgtgggcaccgcgtcatcgctcatcaacttcatcctgtcggcggcgggaagcctcggcatgctcgtcgtgcacatgccggcgcccaactacgtggtcgccctcggcgtcaccatcgcgctcagcatggccgtctcacttgcgggttggttcgcgctcctgcgctccccgatttcggttagggggcttaggtggagagggcgatgcccccaggccagccgattcgttttcgtcatcgtacgaatccaccagctcgtccttttcgtgtggcgcaaaaccgtacgattatcgtaatcgtacggtttgattcgtgcgatttgtaggcgcactctacaccacgaggaacaacttcgaacagggcgagaaggacgtggcaccctcgctcgctcctcaccaaacagggtgctccgcgtggaccaagacgtggaccatttgtggaccaaaagaaagcagctcagagacgatgcctctgagctgcgagtttatggtgggcgttagaagatttgaacttctgacctcttccgtgtcagggaagcgctctccccctgagctaaacgcccgaatgttgtgccgctggggttgcagcagttggtaactctacgggaatgcgaagccaagcgcaagcgaaaatgccaagcagacgatttctccgcaaatggcgcctatcgattgccagccagggcaggctgccggcaggaaagccgttcttctcgctcgcgttgggtcgcttgccgtgggttacgcgtccttggagaagtatgccacggcgatggcgccgggacccacgtgcgtgccgatggtcgcgccgacggtggtgatgggcagcgcgtccacgatgccctcccagaggtcgcgcgagtcgcgcacgtacttgcgcagcatcgcctcgccgcccgcggtgcaggcgagcgagaagggcatggcaaagtcgatggggtgctcgtccacgagctggaccaggaggttcctcgcgttcttggagccgcgcgccttgccgagcagctggatgctgccgtcggtcatcgtgacgaccggcttgatggagaggagcatgcccgccgcggccgccgccgacccgatgcgcccgccgcgccgcaggtattcgagggtgtcgagaagcccgagcatgcggacgcgcgaccgcgcggcctcgaggcgtgacgcgacctccgccgcgggcaggccacgctccgccagcatgagcgcgtactccacgagcacgcgctgcccgatgcaggagttgagcgagtcgaccacgtggacgttgggccgcccctcggccgcgatgcacgcgctctgccaggtggccgagaccttggacgacagcgtcacgaccacgacgtcctcccccacggcggtcgcggcgtcgtaggcctccgcgaacgcgccgggcgacacggccccggtgctgggcagcgtgtcggactccaccagcagctcgaagaaccgctcgtgcgtgaggtcgaccccgtcgtggtagacggtgttcccaaacgcgaccgtcagcgggagcacggtgaggcttgggttgggaaagtccacgatgtcggacgcggaatccgtgatgatgcgaactggcatggctgtcccctcccccgggcggcgcccggcggcagtagtggttgcgtaacttatgacatttggtatggcgcggcaggcgcggctactcgatcttctcgagcgacttgagcacctgcttgagccacccgtagcagcggcggcgctcctcgggagtgatgtcggcgctcgcccgttcgaccacatcgtcgatgatccggtccatctcgagcgcggcctcgcgcccgcgggccgtgagcgtgaccggcgcgcggtacctggagccgcgcccggccgatgccgtcgcatcgtccgtgaggtcgcgctccaccaggccgctcttctccaggcgcgacacgatgcgcgtcaccgcggcgcggtcctgccgcatcagccgcgcgatgtccgcctcgtgcaggccctcgggcgagtgcgcgaggtagtacaggaccatggtgtcggtcccgcacaggcccagcgactccatcttctgcgtcttgatgcggccgacctccttgttgagcgcgtacaccaagcccacgaagttctcgaacctgtcgttggccacgttcttctcccccaccttgccgcgcggagcggattcccgccccgtacgggccaggcgacccggcggcatcgcagccgcgtcgggtcgcctgtcacttgttgacgtgtcaacatattagcaccgtggccgggagaggcagccacagccgcgccgtcaacacatcgcacacattgcggcgccgcataacgcacgacgcctgggcgagaattacggctccaacaggtcggacccgtcctcgggccgcgccgcgtcctcgggctcgccctcgccctcgccgtccatgccgtcgcgaacgttcttgacggtcttgccgatggcgctccccagctggggaagcttgttggggccatagatcaggagcagcgcgaagagcgcgaccataagaaggtgatctggattcatggttgcctgcctttctgacgtcgcggcggtcctccgccggtcaagtcaagggtaggcctcgcctatgtatacgtaaaatacaagtgttggcacctatccatatgcagattgaatcggtttacgagacctggggcatggcccttgtcccgcagccctcgtcccatagcgctttcgcaaaacttttacgaccgcctacggaaccaaacttgactgtagtaactttttacatgttgaaaccatatgccacccgccctcgcggcggggcccaccatgccggaaggaagcaccgcatgaagctcctcaggaagcgcgcccagcaaacatccgagtcggtctggctcgccatggtcctcgcctgctcgggaggcctgatggacgcgtattccttcctggggcgcggcaaggtcttcgccaacgcgcagaccggaaacctactgctcctgggcgtcaacatctccgagggcgcgtggcagaacgtgccgcactacctctgccccatcgtctgctttgcgcttggctgcgccatcgcgcacgaaatccgcctgcacaagggccgcggcatgcactggcgccagatcgtcgtggtggcggaggccgtcctcctggcctgcgtatccctcatgccggcaagcgccaacctcctggccaacagcctcacgtcgctcgcgtgcggcatgcaggtccaggccttccgcaagctgcacggacgcccctttgcgaccaccatgtgcatcggcaacctgcgcagcggcacggcggcgctcgtcaactacacccacgagggcaagcgtcgcgacctgcgctccgcgttcctgtactacctcatcatcctcacgttcgtcctgggcgccatcctgggcaacacgctgctgggcgcgttctcgctccacgcgatcgcggcaagctgcgtcttccttctggttgccttcgccctcatgtttgaggaccgcgagcaccacggcgagccctcgccgcagggcaccacggacgagaagaactagccccctcgccccgcaccgtcactcgtgcgcgatgcgtggtcgctcgtgcgcgtcgcttggcaactcgttcctaccttccgcaaaatatccgataactttggcgccccaatgggtagaaggctccccgattggcgtgggcggcacccgtgccgccccgtacggaaggcgaggagcatcatgtataactttacgttccatgtacccaccaccattcactttggcaaggggcagatctcgcacctggccgaccttgccaactacggcagccgcgtgctgctctgctacggcggcggctccatcaagcgcaacggcatctacgacgaggccctgcgcatcctgggcgaggccaaggtccaggtgttcgagctcgcgggcgtggagcccaacccgcgcatccagacggtccgccgcggcgtcgagctctgccgcgacaacgacatccagatggtcctcgccatcggcggcggctccaccatcgactgcgccaaggtcgtcgcggccggcgccaagtacgatggcgacgcgtgggacctcgtgctgcacccggagctcatcaagtcggcactgccgatcttctcggtcctgaccctttccgccactggctcggaaatggatgcgtttgccgttatatcggatatgaccaaaaacgagaagtggggcactgccggcgaggcgctcaagcccacgatgtccattctggatcccacgtacacgttctcggtccccgctcgccagacggccgcgggcacggcggacatgatgagccacaccttcgagaactactttagcatggatgatggcgcctacgtgcagaagcgcctggcagagggcctgctcaagaccatgatccactacggccccatcgcgctcgagcatcccgacgactacgacgcccgcgccaacctcatgtgggcggccagccacgccatcaacggcctggtgggcgacggctgctcccccgcgtggtgcgtccaccccatggagcatgagctctccgcgttttatgacataacgcatggcgagggactcgccatcctcacgccggtctggatggagcacgtgctgtccgacaagaccgtcaagcagttcgcgacctacggccgcaacgtctggggcctcaccggcaccgaggacgcgcccgtcgcccgcgaggccatcgcccgcacgcgcgagttctttaccgacaccatgcacatgcccgcgaacctccgcgccgtcggcatcacggacgagaagaacttcgacgtcatggcgcagaaggccgcagacggctgcaagggatccttcgtgccgctctccaaggaggacatagtcgagatctaccgcgccgctctgtaacgcatcgcgccgcgcaccgcattcgcgcaagacataggcaagacacatgcaagcgcccccggcccaggaacgtcctggtgccgggggcgcttttcgctctctattgcggcatcttgcatttggctttacggagcgagaagaaccgccgtccttctcgcccagctttgccttatctgcagctagcggccgcgtgcatggcgccagccgcctccgcggcgtgcgcgccagccgcgggctgcgtgacgcccgaagagccccctggactccatcgcgtccgacccgtcccccaccaccacgatgaggaagagcagcccgctgatcgcgacgaacacgaggttctcgataaactctggcatgaagtccatggctgccgcctttcttccgggcgccgctcgcgcggtcgccgccctgcttgcaaccatatggtcccatctgggcgtccgcgcagccatcgaccccgcttacgggtggcttactcttttgtaaggttcggacgcggcacggtttcgcttccgttagtgcgagtcattttggcgtgagccgcaatcctagatgactcaggccccagcacggggtaaaataagaacaccagcggtgcccgtcctttggttaaggggaacgcgggcggcgcggggttactttcctaggggtccagtgcctgctgggcccctagaaactcctcgtcatccgttatctcgcttatgatcctgtcgcatttccctcgcctccgcgactatgtcgagtatggcttgggcgatgctcgcgcagagcgcgatggccttcaggactttcagaactagttgcatgttcataggcaaacgccctcctttcgaaaggcgccgcccgcgtacggacaccgctggtgtgagggcgattctatcacacgcacaggctgcatgttgctcatcaaaaaacgctaccttgcaggtaaatgcaagatagcgtttaactttttgttgcaacctcgcttagccgcgcacccgcgcagccagccggcagaacccgctagaaccccaaactgtcgttaatcaaaatcgcgtgcatgcggccgggatgatggctgaagcgcgtgatcagaaagttgcagcagatggtgtcctcggacttacagtccgcgcacgcccccgtcctgcggcacggcgtgttgatgtcaaagcgctgcgcgttgatgggcgccgccacgttgcgggcgcgcttgatggccgcgtccaggtcgccgcagaccttgttcatcccaatcagaaagagcacgtgcctgggcccgtaggcgatggcactcgtgcggttggagttgccgtcgatgttcacgatgacgccgtcgttcgtgatggcgttcgcgcttgccacgtacacgtccacgtcgtaggcggccagcatggcggcgcgacggtcctccgccttgtcacggtcgataaagttgtagtttccgctggtcagggcatcgttcaggccaatctggtgcgcggtggcgcagccgcccatcgtgacgctcgacccctcgccaatgtaggccagcgcctgcgccagggcgtcctcgcggctgaccgcgtactccgcggtgatgttcctgcggccaagccccttgatgacggtctgggccaaaagctcgttgcgcttgctcacgtttgcgtccatggcaacccctcacgtagcacgggcgacgcgcctggcgcgccgcacttctcccctgctacgatactacgcgcgcgagcgtccgcacacgtcgaaactccccaccaatcgccccacaccaacgcgggcgagaagaacgatttatcgtgtctcgataatttattattgcaatgcgatgcgctccactctatgctcatgccaacggcaacgcaaggaggtcgcaatggaactgaggaagctttccgtctggctgagggcgatcgtcgtgtgcgcagcggcatgcgggctcgtgatctgtgcggtgatcgtgccagagctcggtcaggccatcgtgcacgactacccggagttccatggctggtacgccccgtggctcgcgtttgcctggctgtttgccctgccgctcttcgtggcgctgacgctggtgtggaagcttgccgcaagcattgcatcagacaggccgtttaccagcaagaatgcaaggctcctcaagctcatctcgcagctggccgcaggcgacgcggcgttcttcctcgtaggcaacgtggcgctctggctcatgggcatgaaccacccgggcgttgtgctcctctcgctcgtggtggtgtgcgcgggcctcttcctggcgctagccgcggccgcgctgtcgcgcctggtcgggcgcgcggcggagctgcaggagcaaagcgacctcacgatctagggagcgggcatgagcggaaggatcgtcttcaacatcgacgtcatgcttgcccgccgcaagatgaccgtcacggagctggccgagcgcgtcggcatcacggtgcccaacatgtccatcctcaagacgggcaaggcgcgggccatcaaggtgagcacgctcgccaagctgtgcgaggcgctggactgccagccaggcgacatcctggagtacgtagaggacgagaaggacgagggatagcaaggcgagaacttctcccaaacccgagcaactcgccagtcgaatctcgggaaatgccacgctcttgcatatctcaccttactactgacaacctactgacaagtactgtttactactgccaagcccgcttagggtgcatttctcccttggagtcggctttcgcgccgcagccggtttttcgcatcataatcatcgccaaagacctctcaacaactcctcatacctctggtgcgaaagctaccgttcagatggtacgaacgttcacgttgaggccaacaccgccaagatgcctatcattaggagtcatgtagccgccttgtcctctcggacatggcacgtttgacgggagttggccatggcagaaccttaccttgtgcttggacttgatccaggcatctccagctgcggattcgctcttcttgacatgaataaccacaagattctcgagatggggtcgcacctgtttgacgccccgcaggagagcgataaaaaagtcagccttgccgtcaaaaggcgcaatgcccgaagcgctcgtcgaaacaatctcaggaccaagaaccgtcagaagcactgcatggagctactgaaggaagcggaccttgttccccaagacgccaccaagcaatggttccagtccgcaaagggcgatcgccccctgctcgagctgcgttttgcggcgctcgagcgccctctcaccaatcgtgagtttgctcaagtcctctatgcgctctcagcgcgcaggggatatatccctcacggcgagggtcgcatcagcaagatttccgacgtagacacgagcggcacctctgatgccgagacgggcaaggtcctcaaagctatcggcgagaacaacaaactcatggcacagggacacttccgcaccgtaggcgagatgctctacaaccagggcaagtcgcgcaacaagagaggctcctacgaacattgcgtactaaacagccaaattgtggatgaggtccgcgccatcttccagagtcaacgttcgtatcagaacccaattgccacccaagagcttgaggatgcctacatcgaaaaccttacatgggagaagagaacgcttgaccatgacgccaaggtctacgcactcgtgggcaagtgcgtctacttttccaacgatgagaatcgggcggcacgcgcagacctctcgtcggagctttgcaatgcctacgagcgtctcaagcacctgcgcatcgtgaacgccgacggcgacgagactgctcttgcccccgagcaggtcgaggcctacatcgccattctcttctctcccgagcctcttaagggtaagaaggagaaggtcacatacgcgcgtatccgcagggatctcgacctctccgcgcgcctcttcttcaagggaatcgacccagaggacgaaaaggaccacgagccatatgccccgaaggcgtggcgtaccatgcgcaaggtcctctcccccgaactcatggaacgtctccgaagcgaccgcacgcttgccgacgccgttggtgaggcgctcacctatgccagcaccgaggacagcctcctctatcagcttgacaatcttgaccttagcgatgaggagcgcaaccagattctgggtcttcccttctcgggcaagatcttcaagggctatggctcgcgatcgctcaaggcactcgatatgcttatcgacgccttcgaggagccagaggttaccacacttgccgaggcggaagagagctccggcctcctgggcctgcgcatgagcgatagcggtactcgctacccactcctgcctccgtacagcacctatgacaaggagaacaggaaccccgtcgtcctgcgtgccatgggccgcatgcgccgcatcgttaacgcaatcatccgcatctacggtgtcccagacgagattcatgtcgagcttgggcgtgaccttaaacgctcgaagcatgagaaggacctcatcaacaaacgcgaccgcgagaatgaacgcaagaacaagcaatggcgcgcgcagattgcagaggcgcagggaatcgatccagacgaggtgcgcccaaagctcctcaagaagattgccctctgggaggagcaggacaacttcgatatatacaccggtcacaagatcgagttcgaccgcatgatttccgatgacaagtactgtgagatcgaccatgtgctcccctactcgcgcacttgcgacgacagtcggaacaacaaggtgctcgtgctctccaagtccaaccaggacaagcgcgagcgtaccccatacgaatggatgacccaggacgcacagaaaggcgcacccagctgggacgagtatcaagcgcgcgtcatcgcaaaccaccacatctcgcccagaaagcgcagatacctacttaacaacaatctcggtcccgaccaagaacgagacttcctcagtcgcaacctaaacgatgatcgctacatgtcacgtgcggtcaagaattaccttgaggactcgctcatctttcctaaagatggaagggtgaggcacgttattgccgtagctggcggcgccacgggaagccttcgtcacgtgtggggcctaaactttggtgcaaacaataccaaggaccgttctgacgatcgccaccacgccgtagacgcctgcgtcatcgcagcatgctccgaggcaaccgtgcaggctgtcgccaaggcacacaagcttggagtagagacttacaagcacatgcgcgaggaccgactaaagaacacacagccttggcccaccttcgccgacgaagtcatcgctcgcagggagttcatcatcccaacacgcatggtctctcatggcgtcacaggacaagcgtttaaggacaccaactaccgctttgtcggcttgactaatgacaccaagaagctcggtgtcctctattacaaagggaagtttaccaaggagggcaatttcgtcattggcgacgacggcaatgcacgcctagtcgacggcatggctttcctgcgtctttggctcgatcccacagcaaagaaggggaagggtaaatggtacgcagagcccgtctactatgcagacattcccgccatcaagaacggcacctatatacccaaggcgggaaaacgtggagttgcaagaattgtatgggaaccgatatcgcaggtagcacgtaacactaaaccgctcgttctattccgtggtgatgtcattagcatgggtggccatactgtaagatattggtcttttagcatcaatacattaaccttaaggacaagggacttaatcaccggagctgagtacaagggcttccctaccatcaaccaatggagcagagattcgtatccaaagaagatccaagaggactgccttggccattgctataaagggttggtaccaagctcactagaagactaacgtcagctgaggcccaatgtcagggagattcttgtgggatgacgtatccacgagaacctccctgttctcgtactgcttttcggttaactcaataaccgtcacttctcctgcttcgggaaggtttgcacgaagtcgtgataggtgcgtctcggcgctgtcacgggacagaagcacacgcgaatacacgctgtactgatccatgtgatagccatcttgtatcaggaacttcctgaacagcgcgtaggacttccgctcacgcttactaccagtgggaaggtcaaacatcacaagaaggcgcatggtcctcatcaccctactcctgttctacgtaggcaagcggaacgacctccggcaaagaaagcaacgcatagttcgcagatttaaccgcagccctcaaggtgtcgaactcaagctctatagcatgttgaacggacgtgagctgtccatccacgagcacctgcaactcaaacaccgatgctagccgagatttcttctgtggatcgagatccccctcgagccccatttccctcaccatcaagtcaacgacgggacgaaatggctcgatgaggtcatcaatcaggttgaaggcgttcaaattattcgagtgatgaagaccacgagaaacgagccacccaccggaaacgccagcacgaccgatacccgcacgcagaactgcgtaaccatagtcgagtggcggagtcacaggtccgtcgcgacgagttccctcagagacgtaatgtcggaagtataccgaggcggccgcagactccatattcgagctgtcgcctgaaaggacacggcttgcgaacctccgcacgacgcttccatctttgccaataagatcaagaacctttgcttgattcttaatcttttggataacaatacgctgccacaagcgcttttgcagcggctttgagatagccagctgatcctctacgattgccgcgtgacgagaatgggcaccaagaggaagcaggaggccattaggcatgtggtcgtcaccacagagcatcaaaccaatccctgcatcaacaatcgaagagagagctgacgtcgtaatctgagcgcgatgtgtttcgatgataatgacccatatgtcctctagtggtatagagacggtgtcgccattgtgttccaccagaagcgctgagttacgcgttgatacctttgccggattttgaatgcatatcgtccgttttggcattgctaatcccctgctccacggtaagatattgttgtctaagcaagatgtaccaactggggagttgagatcgtgcgtagacaaggggaccacttagtggttacccgcaaggtgagcccgccgatgattcgtcatcggcgggcgatccttttttggtggcaagcgacagcatttttcagattttagagagaaccgggcggatcacggtgcccaaaatcccgtttccaaattatgccttggccccgtttcccctgatagacaaggaaaacggggccaaggcattgtaccaactggggaaatgagatcgcacgaagacattgccatgtgtcgttacccctgttccttgattgtaccaactggggaaatgagatcgcacgaagaccttcacgccgtatgggaagcgacgcttcatattgtaccaactggggaaatgagatcgcacgaagaccctttgcgcgaaggaactcgctgtgggggtattgtaccaactggggaaatgagatcgcacgaagacatacctcatcgagcctatgatgggccacgtattgtaccaactggggaaatgagatcgcacgaagactcaagccagaacgcgacatcgcgccccgcctattgtaccaactggggaaatgagatcgcacgaagaccctctatgattaccaaatcaaggggttcttattgtaccaactggggaaatgagatcgcacgaagaccgtgtacgtgattgtgtacgtgtctaccacattgtaccaactggggaaatgagatcgcacgaagacaatgcagttccatcgctgcacttgccatcgattgtaccaactggggaaatgagatcgcacgaagacagagagcctgatgctctcgatcgtgccgtcattgtaccaactggggaaatgagatcgcacgaagactaaagctcgcgcccgattccgagcatgaagattgtaccaactggggaaatgagatcgcacgaagaccttgattagcgtgtaaccgctagtcgttctattgtaccaactggggaaatgagatcgcacgaagacgaatagacttggtaagttcgtccaccgacaattgtaccaactggggaaatgagatcgcacgaagactcgtcctcgaatgggttgtctatcgtcgggattgtaccaactggggaaatgagatcgcacgaagactcttcgagtacggacgcagcaattcgccatattgtaccaactggggaaatgagatcgcacgaagactagtgacctctggcgagtggcgcggcaggcattgtaccaactggggaaatgagatcgcacgaagactcactggcatgaatgcgtattcgtcaagctattgtaccaactggggaaatgagatcgcacgaagacgatgcggcggtctatcgcgtcgagcctgcgattgtaccaactggggaaatgaggtcgcacgaagacgatgcggcggtctatcgcgtcgagcctgcgattgtaccaactggggaaatgaggtcgcacgaagactctgtgcctgatctccagccgtcatgatgccccagttctccacctgagctatacagaccttgcgccatgaaaaaacgcttcggaacgcgggcgccccgaagcgacaaaagcattaaatgcttttttagtcaaactcaatatacctcaggagtcgagaatccatcaacctgtccagcgtacacatcgaacttcattttgctcgccagtacaaaagcgggcccgcgcgcgtggtgcgggcccgctactgggtcgtgacacttactgagccgtaagggttacttggacttgggaagcacttctcccttggcctttgcctctgccggggtgtcggggtcgctcgagatcgggtcggcgttggcgtcggagccgcccatgccgtacgtggggcgcgcggcctcgtactggatctggcgcgccagcttggtgatgtcctcgggcttcacgttggcgtagcggtggcacgcgcaccagtggttgggcaggacctcgaccaggtccgggtgctccacctcgcaggcgcccaccttggcaaagcaacggctcgcaaagcggcagcccgccggcgggtcgatggggctgggcacgtcgcccttgaggatgatgcgcttgcgcgaaaggtgcgggtccggcgaggggatcgcggacagcagcgcctgcgtgtacgggcagagcgggttgtggtagagctcgtttttgggggcaatctccatcagcttgcccaggtacatgacgcccacgcggtcggatatgtgcttgaccacgttgaggccgtgcgcgatgaacaggtacgtgagccccatgtcgtcacgcaggtcctccagcaggttgagcacctgcgcctggatggacacgtcgagcgcggagaccggctcgtcgcacacgatgagcttggggttcacggcgagggcgcgcgcgatgcccacgcgctggcgctggccgccactgaactcgtgcgggtagcggttcttgagctcggggcgaatgccaacgcggtccagcagctcgtccacgcgggcatccacctggtcggccggcaggatgttgttggtgatgatgggctcgctcacgatctggctcacggtcatgcgcgggttgagcgacgcgtacgggtcctggaagatcagctggatgtcgcggcagtacttgcggcgctccttgggatccaggtccgtcacgtcctgcccctcgaagatgatgcgcccgctcgtgggcttgagcagccccaccagcatcttgccgatggtcgtcttgccgcagccggactcgcccacgaggccaaacgcctcgccgcggtggatctggaacgacacgtcgtcgacggcctggacaaaggacgtgggcttgccaaagaagctcgtggccgccacaaagctcttggagaggtgctgcacgtcgagaaggacctcgcccttggtcttgtcacgctgcggcgccgcgccctgggtctgggtcgcggccgccgtggcctcgttcttctctgcggtatcgctctgcatgggctactccccctctcgcttgtctgcggcctgcgcggtgggcgcggccgtgggctcggccgcggtggcctcgccgtcgtcgtacaggaagcagcgcacgcggcggccaggcacgcccggaacgtccttgagctgcgggcgctccttgcggcagcgctccatgcagcggttgcagcgcgtgctgaaggggcagccgctcggcatgtcgagcgggttgggcacggtgccggggatggtgaacaggcgcttggactcgtcgtcctccacgcgcgggatggactccaaaaggcccagcgtgtacgggtgcaggggcttctcgaagagggccatcttgtcggcctcctcaaccacctggccgcagtacatgacgacaacgcggtcggccacctcggacacgacgcccaggtcgtgcgtgatgaagagcacgcccatgttgagctcgtcgcgcagctggtagatcaggtccagaatctgcgcctggatcgtcacgtccagggccgtggtgggctcgtccgcgatgaggagctcgggcttgcaggccagcgccatggcgatcatgacgcgctggcgcatgccgccggacatctggtgcgggtagtcgcgcgcgcggtcctccgggctggggatgcccaccaggcgcagcatctccacggcgtgggcccacgcgtcgttcttcttcatgtccgtgtgggcctggatggcctccacgatctggtcgcccacgcggtagaccgggttgagcgaggtcatgggctcctggaagatcatcgcgatcttgtggccgcgaacgtcctccatctgcttctcgttgagacccagtaggttctggccgtcaaacgtgatggagccgccggccacgtgacccggcttctggaggagtcccatgatggagagggacgtgacggacttgccggagccggactcgcccacgacggccaggatctcgcccttctcgattgagaaggtcacgccgtcgacggcgcgcacgacgccacggcgcgtggggaactcggtcacgaggtcctttacctctagcatcgccatgctatcgcctcctcgacttggggtcgacggcgtcgcggatgccatcgcccagcaggttgaacgcgagcacggtgagcgtgattgcgaggcccgggtagatcatggcgtgcggcgcctggaagatgtagttgcggccacggcccagcatgtcgccccactcggcctgcggcggctgcacgcccaggcccaggaagcccagggccgcggcgtccaggatggcgctactgatgcccagcgtcgcgcggacgatgatggacggtgccacgttggggagcacgtgacggaagatgatcttggcgtcggagtcgccgatcacgcgcgcagcgctcacgtagtcgttctccttgacggagaggatctggcttcgcacgatgcgcgcgtactcgggtatggagaccaggccaatggccacgaccgccttgtcgattcccttgccgagcgcggccatgaacgtgatggccagcaagatggacgggacggccagcagcacgtccatgcagcgcatgatgacggtatcgaccttgccgcccttgtagccggcgatggcgcccagcgtcacgcccaccacgagcgagatggacacggacagcagtcccacggtgagcgacacctggccgcccacgatgacgcggctaaagatgtcgcggccctgctggtcgcagccaaaccagtgcgcggcgctcggcgcggcaaacgactggctcaggtcctgggcgtacggatcgtacggcaggatctgcggaaagatcgcgctcagtatggcgagaagagcgacgagtgcgatgaagccgaggctcaccatggcggtcacgttgtgcgagagcgagtaccagacgtcgtcccagatggactcgcccttctcggccgtgggctttacggtatctgcagttgcctctgccatgtctatcacccctcttccttcgtgtacttgatgcggggatcgaggaacgcgtagatgatgtccacgatcaggttgatgatgacgaagatcacgccgatgagcatgaccgtgccctggactatggggaagtcggacttgaggatgctgtccacgatgaacttgccgatgccgggccaggcaaagacggtctccgtgagcatggcgccgccgaggagactgcccagctgcaggccgatgaccgtggtcacgggcagcatggcgttcctgagggcgtggtgcttgtgcacgcggtgcggcgtgaggcccttggcgcgggcggtgcggacgtagtcctcgttgagggcgtcgagcatgctcgagcgcgtcatgcgcgtgatgatggccatggagtagagcgagagcgcgagcgccggcaggatgatgtggcgcagcgcgtcgacaaaggcctccatgtcgcccgagaggagcgtgtccacgaggaagaggcccgtgccgcccacgggggcgagcagcgggttgatgcgcccgcccgagggcagccagtgcagcacgcccgagaacaggatgatcatgaggacgccggaccagaagatgggcatcgagattcccacgagcgcgagcagcatgctcacggcgtcgatcggggtgcccttgtgcacggcggagacgacgccgagggcgatgccgatgacggaggcgagcacgatggccacgagggcgagctcgaccgtcgcggggaagcggctcatgatctccttggtgacggacgtgtgcgtgtagtacgagacgcccaggtcaccgtggaggaatccgatgaggaacgagaagtactgctggatcaggggcttgttgaggcccatgctgttgcgccaggcgtgcatctgcgcctgggtggcgtgctcgcccaggacgacgggcgccgggtccggcgagaagacgtgcatgaggaggaagacgacgatgctgagtcccagcagtaccgggatcgcctgcagcagtcgcttcacgacgtagcgaaacacgttcttctcctcctttctttaagaaacataaaaatcggtaggacatgaaaacggggccagagccgcttggcgcggtcgtctggccccaggcagagcgctcgggcgctaggccgacttggtgcagttcttgaggaaggtgaccgccgtcgggtggaagacgtagcccttgacgcccttcttgtggcacaggatgttgatggagtgggagacggggatccagacctgctggtccgcgaccatcttctcgcactcgtggtagacgtcgtcacgggcggagccgttgggggtcttcaggcccttggcgatgagcttcttgtagtcggcgttgtcccagcgcgcgacgttcatgctgtagtcgtcggcggcgagcaggttcatgaagttgtccgggtcgccgttgtcgccgttccagccgtagaagcagacgtcgtagttgcccgcctggaccgtggtcttgtaggaggtccagtcgtactggtcgatggtcatctcgacgccgaccttcctgaggtagccctggaaggcctcggccagcgcggtgccgcccttgccgttgtacggacgcgggttggagtaggtgatgcacttgaccttggtgatgcccagggacgcaagctccttcttggcggcgtcggcgtcgtaggcggtctgcttgatgtccttgtcgtacggggccatccacagcggcatgacggagttggcgtaggtggcgtacttcttgtacaggctcttgacgacctcctccacgtcgatggccttggcgaaggccttgcgggcctcggcggtcttgaaggtgtcggactgggtgttgaacgccatgtagttgatgttcatgccgtcgaacttgtccaccacgtcgccgttcttggtgacctggtcaacgtcggcctcgtccacgccgtcgatgatgtcggcctcgccgttggcaagcgcggtgacgcgggtcgaggactccgcgatgaagcggaagacgatgttcttggccttgccagcgtgctccttgtcccagtagccgtcaaagcgcttgagcttgatgtcggagttcttggtccagctcacaaagctgtaggggccggtgccgacgggatgctcgttggtgttgcccttctcgattgccttgggggagacgatgggcgacgccatgcacatggccaggttggccaggaacgcggagctcacggcgcggagcttcatgaccacggtgtagtcgtccggggtctcgatgctctcgatgccggtgccgtcggccttggagccaaaggtgaacgcggcgtacggcatgtcgtccgtgcggtcgggctcgagctggcggccgatggacttcttgacggcggcggcgttgaagtccgcgccgtcctggaacttgatgcccttacgcagcttgaacgtgtaggtcaggccgtcgtcggacacgtcgtaggacttggccaggccgggctcgacctcgcagttcttggccttgtacttgagcaggttctcgtagatctgcaccatgaccttcgcggactcgccgtcgtcgatgtaggcggggtcgaggccacggggatccgcgccctgcgcgaaggtgatggtgaagtcaccggagccggagccggagccgctcgcgtcgctcgcgcgcttggagccgcagccgaccatggatgcaaaggcgctcgaagccgtgacggtggccatggccttcacgaacatccttcgtgacatttccgctttgcttgacatgggcaatccccttccggtaagcggtcgggcggtgccaacgccgcccctcccgcagggcgagtccttctcgccgcaatcagtacggttacacatgtctgtgacatacctgtttcatgccttaaaattggttatcaaattggcgataagttttcttgtacgaaacatttggaatgtttccgcggtgaaacgactattgatgcccaccgttgcaagttttcagcatcctatgccatgcggacgagaagaacgaccacgtccgggccgcatccccaccaaggcgtcgagtgttatcgaatactccgctcgcccatacacgtgccgcccgcgccatggagcgccgcagtgccgtaaaatggtggttgcttacgtacggcttaagggagggacgttgcccctccttacaggacgataaagggggcgaaccgcgccatggagctgccaagccacacgctgtatgccgacctcaagaacttcggccgcatctccaaccgcgacgcggcgctcgcgctcttcgaccccgaggcccgctacggcgagctcaccatccgcagccgcgccctgaacgaccgctcgttcatctcgcgcgagatcgtgcacgcgcgccccggccagtacggcgtcgagtgcttccaggacttccccacctcggtgcgggcactctggtccgtgctccttgcgcgccacggcggtggtgacgccggatgccacgcgcttctcgcccactacacgggctccgcggcagaaaagatgcgccgcgccgtggccgataccggcggcgacgccaacctgtacgccaacacgatccagaagctgtcggtcgagcccggcctcacggacgagcggcgcggccagctctgcctcatgctctttgtggtgacgggctgcctgggcagccccggccccgccatcggcatcgtggacgacttcgcgacggaggcgttctcgctggggctcggcaccatagagacgagcgtgggcccgggcttcgcgcgcgcggtcaggccttcggagcgcggcgttcagctggggctcctgcgcatcctggacggcgtggcgcagccgccgctactggcgctctcgctcgcgccggagggcaccgtcataggcgcgctggccaccacccccaacgccatcaccaacgtggacgtcgacgtgtcccgcgagcacctgcgcatctatcgcaggggcggcacctggtgggcgcagggcctgggctccaccaacggcacaacgctcatatccggcgacacgcgcaagacgagcgtgatagagccgccgcgcgcggaacgaaagcccggcgtcacgtacggcccggtaaagataaccaacagtgacacgctctgccttggcgccacgaccaggttcctggtcctgcgcatcgcggggccgcacgcgcagcacgacgcgaaagggaacgaatagcatggcggacgagaagaacggccccctcggtcggctcgaggtaatcgagttcgaccagtttgacacgtcgtttgccgtggaccccgcggacgagggcaacgcccgccgccgctacatgacgctcctggcggaacccgcctcccccggcgggaccagccgccacacctcctacgcggaggtcctgcacgtgcgcaacacggaggacgagtactttgccctcaagcggctgcgccccgtgccggccgaccaggacgcgctcaaccgccgcgggcgcgaggcggcgctgttcgaggagtaccgcaacatgctcgcggtgtcgcagctgcagggcttcccgcgcgtgtacggctacggcgtcacgcacgagggcgacccgggcatcctcatggagtgggtgcagggcaggaacctgctcgaggcacggcgggagggcctcctggcccagcgcgaggacggcggcgtcgaggccaccacggtcgcggcggtggggctctccgtgctgcaggcgctcgcctccaccacgtgccttgagggtacttttgtgcaccgcgacctctcgccgcgcaacctcatggtgcgcgtgcccgagggccaccacggcaccctggaccccagcgcgctggagtgctgcgtgatcgacctgggcagcgccctgtacatgcgcccggacgaggccacgttcaccgcgaccatggacgtgtggagaagcgcgacccccgagtacgccccgcccgagatgctggccattagcgaccgcagctacatgcgagcgaggcgctcccccaagatcgacgtgtacgcgctctgcagcgtgctgtacgagctgtactgcgggcacaccccctaccgcctgtgcgaccgcccgacggaggaccccctcaagatcaagacggccgaaagccccgagccgctctccgcgcgccagccggaagagcagccgctggtggacgccatcatgtccggcatcgccgcggaccaggacgcccgcccggacgcgctcgcgctctttgggcagctggcgcgctggcagcgccaggcgacgggccgctccgtcgagctgcgcgacggcctgacccccgcgcacgtggtgggcacgcgcctgtggaccgagcgccccacgcccacgcccgccgcgcccgccagccaggcgcccgactccgccaccggcaccgcgcccgcgcgcaggcgcagcatgtcgcgccgcggcttcctcatcggcgcgggctgcgtcgccgtggccgccgcgggaggcgccatcacctacaacgcgctgcgcccccgcgcgtttggcgagaagagctggaccgaaatttcggacctcgcctccaagatcgcagccgcatccagccggaaggccgcgctcgcactcgcggccaaggcgggcctcgccaccaagggcggcagcatccgcacggacctgaccaaggagatcacgctatccgacggcacctccgccaccgtgcaggtggtggacttctggcacgacgacgtgtccggcggcaaggccggcatgacgtttgcctttacgcagcccgtcgccaagcgcaacatgtccggcaccaggatggcctcgggcggctgggagcagtgccagatgcgctcgtggcttaacgacgagttcttctcgcgcctgcccaaggacctgtccaagcacatcaaggccgcaagcaagttgaccaacaacgcgggcgccaccaaggtcgcgtccagcgtgacggccaccagcgacaaactctggctcttctcggtagaggagcttggcggcaaccgcagcgccgccgcgctcggcaaggacttcatgtacgtggcggaggtcatcggcgcggagggcacgcagtacctgctgtggagcgatcaggacgtgagcacggacgccatgtcgaacaccgccacgcgccgcaagtggaacggcaagcgctgctactggtggacgcgctcccccagcccggactgctccgaggcggacaaccagacctggttcaaccgcgtgggccccaacggcgacgtgttcgactt

SEQ ID NO: 133 - DNA, 4996 bp, Unknown
  Metagenome-assembled genome
aacccctcaaaatgtgacggttagtgaccagttaagttttgtcagcaatcaaaagtgactgaaaagataaaagatggccctcaaaaggaccaaatcatacaaattttaaaagtagagattattcaggtatatatttatctgttaaaatactttgtttagaaggtaaatttttcccaaaggaaggggtattttcttccttaacgggcatagaagtacttttttcattctcaaactttggtaagaataatttagaagcagcgttaaattgatgttttacaattagataaccctttttcaccaaactcttcaaaattttagtaacggtcttaacagttacgtctaaatattcagctaattcttcacgtttaaaaataatgtaactatcgccaaacttcttatcaaagaaatctttattattcttacttgccttcattcgatcacaaagaagcgaataagttagaatttcattcgcaccctttaaatttgaatctttgaagtaatccatttctactttgataaacataattacatatctccttttaggagtaagaaaaaagggtaacaagttatttaacttgaaacccttttaactttgcaattatgtatcactcttgcattaatccaattattttcatatacttaaagaagtaggaaacgcatttccgaaacctcaagtaaataacaaagattggcgttaaaaggcttcaagtggtatgtgcacttgttagctggttgtagaagtttatggcaggacttccacgatcaacgcctttttttcgtactcgtatttaattgacataattataactcaatgaaaatatttacacaacctatctaaatagccgtttccaaaagttctctctcgtcttattagagggctttttattttgctcgtttatatttatatctggcttgtttttgtcgtccttagaatcgttctcacggctttgtgtggtgccgttcttgatattttgttctgacttttgattttcaagtaatttctgactgcttaaatttaattgttgttgctggtctaataatttttgaaattttgcaatttgttgatttttggtctgtaattctgttctagcctgttctaaatctacacgtaattgttttataatttcattatcattgtttagattgtcattctgtttcatgccggttctattgtaatgttctacaatagcctttatatttatttcattaaaattatacttgccttgctcgtttttctttggttgcttatcctttggtaattctcgtattatttgataaatacgcccatttgtaacctgtaatctttttgcaatgcttgaaatagtctccatttattaattcactccattacttcactaattataatgtgtaattttatttatagtgctagattagtctatattgattacttctacaatagaattattcaccggcataaacaagcaatgcacgagaatacgtttatatcacgtcataaaatccatattttattagatacaaaaaaagcaccacccaaattaatgagcagtgctttcgatatgcaattgatgtaacctgaacaaataaaaagtaggcttgactgtattctaactgattaatttttaaatacaacaaaaaagccacccgagctatgagtgacattctttgtcgacaataatctcattcagtttagaaaagagaagatcaactatattttagcttatcttctttaaattgcaataaaaaaacgtcacccgattaagaatgacgttttcatatagtgtgtaaaacggaatacttacaaaactaggttttaattacattttaactaattgataacacaacgcaagctatacggaaaatcttttactgatgttaatattccacgattttgataataaagtgtcgcaagctcgacaataataaatttatatctatcgtctgaactcatatcgttattacatgcgttgtttagatacgcctttgcactgttaatataatcagttaataactggtcatcatctgtaatatctaagaagctgacttccaataatcaaattatttaattaaagttcatgatgtttgctctgtcggtctccaaccgcatgaataatgccccgttgtaccaaataatcatccttacgcctagcaataaacagcggtgttgattcttcgacaacgttactaaattcaaggccgtaccatttgacaggtgaagccgtgatgttctgcagataaatccgcccaccaattagtcgtttgtcgagggcttttaattgatcactcacgaccaggtcagccggctgttcgttaataataacaaacttaaacccacccacttttcgattcttcatggttgagtattttggcacttgcggttcaagtaccccttgttcaacaagattatccacaatttgatgcaaataaacaccaacgctctgctcttttcgaaagcccagataaagctgcacattgacaatgttcttagtgcccagcatatcaaccgtatagttactttcgtatggcacgttggtttcgttaaccgttacaaaccaatagactttggcccgcttgggatctttatccaaaattgaatacattgtgttgcgtttgatgtgatagttacccttaatcttagtcatataaaccagattggttgtaaacaacgggatctgctcatcagcactcagttccgcgagttgatcgcgatagtccaataatgacacgtactcacttgcccgctcatagtgttcgcgacgcttattgccaaagtaccaaacccacatcacatataagattgccaacataatcaaaagggttaaataaccgccgtgaataaacttcaccaaactggcaactagaaaaattgtctcgatggcaccaaagaaggtggcaatggttagtgccagcggccggttcaatttggtcgtcaagaactcggataaaaggacggttgtcatcaacatcgttaccgtgatcgctaatccataagctgcttccatgtgttgcgaactttgaaagtaccagacaacgcccaacgtgaccgcacataagatccaattgacattggcaatatagatttgatttttgacattgctgggatgcttgacaaccaaccgtggcaaaaatttaagcccaatcgcttcatcaaccagcgtgtatgatccggtaatcagggcttgggaagcaataattgcagccaaagttgccacgacaattccaaataatcgccagtgaccaggtaacatttcataaaatggattaatatcagacatccgtttaaaagcgtcatcctgagcgtgattaatcacccaggcaccttggcctaaatagtttaaaaataaagcaccgtaaaccaatggccaagttgcgtaaatattctttcggccaacgtggcccatgtcagagtacagtgcttcagcaccagtcgttgccaggaaaacactcccaagaataaagatgccaactttattaactggactgaagagtatcttaattgcataatagggagaaatagccttcaatatcattggataattgattagattaacgattccaaagacagccaaaaagccaaaccataaaatcatcactggtccaaaggatttcccaatcacacctgttccaaaacgttgaatcataaataatacgagtagaacaactgttgtgataatcaagacgttatgttgagaattactaaacaccacagggccaaggtgttgtttttttaatccctcaatggctgaagtcacagttactgcaggagttaatgttccatcggccaaaatggccgccccaccaatcaaggctggccaaattaaccattttgaattttttcgaaccaatgcatataaagcaaaaattccgccctcacgcttattatcggcttgcattgcaatgacaacatacttcaacgttgtaatgatcattaatgtccaaaaaatcaacgagatcgatccaatcacgtaatcgggagaaatatttcccattttaccggcgtcaccaatcaatgcattcataacatacaatggtgaagtgccaatatcaccgtacacaattcctaaagtaacaagtgcccccgcaaaagaaatcttttccagcttcttgtccattgcgacaatcctccaagaatataaatttaatttgaacaagcattaatattagccggtttcataagaaatgcaacactagttttaactggcttaacctttgacggtcatttagaagctgtttagcatcttttaagaagtagcctgataaagactaatgaaacaccatcatgagactagtgttgagcttacgctcacagttattacgccattggcaaccgcttttcaagacatacaggacagcgcagaacacctcgtagaggtcatattttcgaggcttggttcgcttagaaactgtttgagatctggtttaaactttgatatacttttgcaaaaaaggaagttatcatgcctaattatcctagtaatatcacccgtcagcagtttgcgcaaaactccgcctgaaaggctcctgctgaaggcatgctcatgatgcaaaatcattcggctgacagcccccgtctggaagacttttttactcaaattccgatagcaattttgagtaaaaaacgcgaagctttgccaaaaagtggctagccaaccggctaaccattttggcattgcgcagcgaacttgggggtcaagggggagcgttagctgtcccccttgcaagcaccgcagctgccacaaacgtagtcttgtggctagcatgcgggttgcttgccaatcctatgttattcgattatcattaggaggtagtcagcctgcggctgatccgacttttgatatctcgaataacattgcccgtagggcaacggaggtgggacttgtgaacgaaccacaaaatctggctagcacaaaaaagacgactcaggttcatcgtcaggctagcaaacaaattaattttcgggtgagtgaaccggactatttaaagctggcgcgttccgcgcaaactttaaatctgtccg

SEQ ID NO: 134 - DNA, 13779 bp, Unknown
  Metagenome-assembled genome
actgcgggtcgtaccttctcctcgtcgtcctgctcatggtccgaaagctcccttcgtgcctctcggcacattgtcgggctttcggtagctccggctcaagcgtgtctaggattggccagccacatcagttcttcgcttcgcacgtcttcgtctgaatgtttgccgagggatttagctcatcggtttcaccgtgttttccacgaaggagatctcttcctcagttaggctgtagcgctcatagagcaactcgtcggtccaagggtggtcataggtgaggtcagggacgaaagcgtatacgtctcgtgcggcatcttgagtggacttgcgaagggagaccagaaagcgaactagtcgagtgcgcaaataggatgcatatgaatccgcttcatccttactgttaaacagtcctgccacaagataagtctcagtgcaagccgttccaggacccgcaatgatgggcttagacaaaaactgagtttccgtggcggcgctagttccctggacacgtgtcattaagaccttccaggcgttgatccagtctgcgtttctaagtatttcggaacgctcagtccaaagtattttctggttagcaaacagcttaatgggacctgtgagcccctcggggcttttgcgaccgccagaatagttcgtcggcaatccaaaaggcttacgggatgaaactcgtctgtcgagcgtgggttcatcctttgcacgtaccttttgcaatatgggcacggcttcgtttctacgcacaagaacgtcgaactcgtcaagataacgggctacagcctctccaacaggcttgccatccgccatggtctgaatggtgcaggggccgtcctacgagcgatcccacaggaagtacgagatgccgccacgtatcttcacgttcggaaagggctcgtacagcttggggaagtccacgagcttgcgcaggtggtggtcgtggagcatgcgatcgcggtaatcgtcgagtcccttgccgccgctgaaccagcgtgacggcgtaatcatggagacgtaatcgggtttgaggtccatggccgtctcaacgaactcttggtagacagggctagcagaagtcccgtgccctccatcgtccttctgatatggcgggtttcctactatggcgctgaactccacggctcctccgaactgattgtcccaatagcttccacgggccaccttacgcatgaactgctggcgcttgttggccatcactttgtcgaggtcctctacgtagcgcatgttgatgcgtatgctcttgctgtagcctacgagcgttcgcttcgtgatcgccttggccatgggcgtcttgcatatgacgaagatgcggttgcgcacgacctcgttccacgccttgcgttgttcctccgggcttgcgtcggaaaggcggtcgcctatgcttgcgcggaacattgagtaggtcacgtaaaggggatagagccccgtcttcgagttgatttcgagaatgtgggtgctcggctctccaaagagggtggtctgccttgtggaggcggctttgtctccgaagagcgtcgtctggcttcccgagctagcctccccccagaaaacatggcgggtgacggcgcccctgtcaacgaaacgtggctcgtcgagctccgttgtgtgggtctcgtcccagaagtcccagccgcccagcatgtcggacatgtgcatgttaacgacacgccacggggtgagcaccgtctccttgtccgggttcttgaagtacccgaagaggtgcgcaatctcctttacccgttcggtgggtggaagcgtgtcggcatgcctcgtcacgttgcggatgcgcctgcccgctgccacgaagacgtcctcgtcgtagtacctcatgaagcgacggaacaccctcttggtaactcccttgggcatgaactcctcccaggagcgctcgtcaacgagctcaacgaagcgcgcgaggtctatgtcctcgtcgtagggaacgtcggccccgtagatgaggagcggcatcctgacgctgatgccagtgaggattgagattgccgcctttcggttctccctggccttcttgagcttctctaggagggccttctcctcggctgtgagttcgcgcttgggcttcttctcggtgcgctcgacctgttcacgctcctcgtccgtgagcccctgatcgttgatggggatgtcggtcggggtcttcgagggcttggtcgcgccaactatcttcttaagcttctcgaactcgcttaggtcgcctttgctgaggttcaggagctcttggttgtagaggttcggatcctcgaagccgttcttcacgacggcgtcggcccaggcacgcttgagctgacgcaagagcttgccggtgtcgtagcgctccattctcgacccgctgataccgatgaccgggcagaagttgagaaattcgccgagagcggcgcggtcgccgtcgcttgtgcggccggccttggcagagaccgaaacggccttggcgaccatcttgagcgtccggtctggagcgaagtcgaagacgtaggcgcgctccttcgccttgccacccatgtcgcagggggactgcacgcggaatatggtctgcaagtagttcgccgcactcgtcgagtagctgccagcgagcatgagaacggcggtccactcgcgtacggttacgccggtcgtaagccggccacacgagagcgtaatcgtgtatgttccggcatcatcggcgttccagatggcgctctgcacgtgctcgagtgcgttgtcactctcctcgtcaccgtcacccgcgacgttcactatgtcgaactggccgctgccgaagacggggtgttcgagcatgagggtcttcagcgccttggcggcccgcacgccgggaaccatccaaagcgtgtgccggaagaggcgccggtagtcgtcgcgcgagtatgggtagttgctgctcgcatcgctcttgcagagcagattgagaaagctccgaacgtcatcttcgtgcacgaaccgtgcgtcatcgcttacgcggaagaactcggcaaagttgaacgccttgtcatcgagggctacgtagccctcgttgcggaaaacctctccgaggtcataggtgtagatgcagagctgcggaagatcctcgtacggattcgagtcgccgaagtgcagcttgtcccacttcgacttcgcatcctgctccatcacgtagtcccacgtgtaggtctcgtcgtcctcatagtcatcgaggatgttgaagggtgtgcccgagagggagagcaacttcgtgggcccgtccggcttcaggacggcttttacggtgccgtcgccgagcgatgtcttggtgccctcgtgtgcctcgtccacgattacgaggtcccataccgtgttgaacacgtcttcgttcttggcgaacttcccgccaacggcgacggagccgcgcagatcctgtatggaggcgaaccatacgaagctgtcattaccgtctaggagctcccggagcgtatagccatgctccttggagccgtaacgatagccgtcgccctcatggaatatcttcccgaagtccttgtaccagccatcgtccaccacgggtctgtgcgtcatgatgatggtgcggcggaatcccatctccttgacgacctcgagcgccgagagcgtcttcccgaagcgcatcttcgcgttccagagcatgcgcttggaacgcccaaactgcttcacggttcgcttgatggcttcctcctgctcggggcggaagacgattggcatctcttcggcggtgctcgtgccggataggtttttcgtcccgcctttgacggccgagatggccctcttgacggtatcgagatcgacctcgaaccattcctttcccgttgtcctgccgatagccttggccgggataccggagttcttcaagacattctggacgtcgtagtctctgaaatgctcgaggcgtatgccccctgcgtccttgttaaggacctgtttgactgcgagttcggtgtagaggagcgtgtactcgacccccgccgtgcccgtgtacgagttgatgcgctcgcgggcggcctcgttaagcgggtgtgagttgggtggaagacggtctatggggagctcgctcttgacggttgcgtctcctaccttgatgcgccccgcgtgtgcgcggtcgtggatggtgaaggcatagatgcacttgtaggaggctacttcagcaaagcccatttgcggctgcgtctcattcgccatcgtcatcgcacttcctttacgagcctcttgaactcgattgcggtaccacccgtgcagtcgcgccagtcgcgtacctttaccggaaggggctcggtcggttgctggtctgcaaagatttccagcgtttgctgtggggctggtctggtggcgtaggggacactcaggctaatgccatccatctggaagacgttccacgctacgcggtttgccaccttgtgccggagcctgggctcggcgggctctccacggcgccataggagccattcatcgagtgtggcgagcaggttctcgcgagcgagaagcacgttgtcgccttggaggtcgaagccgtacgtggcctcataggcgcgtacgacccatttctcgaacagctcatcactgtcttcggcgttctcacacacgacgcgcagcttcctgtcgagcagccccattcgccgttcgacggggatgatctcccccgtggcgacgtcatagcgactgacgaggtaaggagcctcactgcaggaaacctctagaacgcgcttgtcgacatagcgctgccacgtttgacggccttcgaactcgatgcgttctgggttgacgtcccacccggtagttgggttcgcattagagcagattgcaccttcgtgtccgaaccaggcttcatcgaccttgttgttctgcgcgcagcaaacccacgaaggtgtaaaaacctccgcgttgtcacgtgtgcgtttgacctggtcgtcgagcgtcttgtcgaaccgaggtctgataatcccctcgaagtctcccgtgatgcgttctggcgtgatctcgtcagaggggttatagcctctcccataggaggcatagccggaggttgcccacttgatccttgctcccgttgtcttgtcgcacaggagaagatcgagcgtgcggcggtctctttccgccagctcggattcatgtatgtctttgagttcctccaacagtgtgccgcctatgctgagcgaattgcttgccggacaactgccggctcattaaaaccaattctatcaggcggtaatgaagccgactcgagagagacagagaaaagaagtcataggcagtctggaaggaagctatccagacggacgcgtgattacagcagccagggtatgtaagactgatgcttattgtgaatctcgaagcttaggctcaactctcatcgtgcagcagaagaatcattcactggcaagtgaaatgtaggatgacaaccgctgagaataatgacagtgccaacagtgtcatgcattggccgactgaatcggacgtatatctcaataatcggaacgataccgtcattaaccagagagccaagcgagacgataggagcgagcgatgcgccaggtaaagctggtcgtgatggagaacacagacgagaagaggacgatgtcgtggggagaggccagtgacggtcatcgcgtacgcgcgcgagaccaccatgggcaccgtgacggagttcgcgtacggcgagcgcatctgcttgacgaccttcttcttccgtcccacgaagacgtacggcctggatgacgtcgccgaccgcgtcgccacgagtggcgataattgcttcctgtgtgacatagccgacgccctcaagttctgagggatcccgtacaagcgagaggaccgcacccgcccgtttgtggtgtagccacggccgagggggggcaagaagaatgaggagattggtcatgccccgtgcatgtgactcgcatcaagctcgcagcaaacttgcacgcagctcgcacgtggctgacggcaagctgtcgcgtggctcgcatccagctggcaccaatctggtggcacgcccgccacgctcgcggcaagctggcccgaaagtcgcacgtgctcgcgcgacctcaccagcgaccgccacgccaccgagatccaccagcggcccatcctcggcgcggaagcccgctccgcgccagcacgcaaccgaccgcgccgcgtaccagcaagcgacacagacggcgcggacgacctcaccaaacctgcagggccccggccgcgtcgctgccgcccgcggcgtccccgtaccagcgtgcccggtactcctcacgggtcatcagcccggcagccacctcggccatgtcttgctgcttctcgctcgcggtgtcttgcacgacgctgtcgtcgtatatgaccgatacgtcgccctcctcgagcaagctcttgcccatgcgcctctcgcaggccatcacggcacgcgacacgtccaccagcgccccctgcaggctgttctcgttcctgcggatgttcctcatgagcgccgagttgttgctcgacacctccgtggccattttcacataccccacgttgtcgaggtcgaagtagttggtccccagcccgcagaggtcgcccagcacctgcagggccagccggaacgccttgccctgcgcctcggtcctgagcgccggcgcgaactcctggatcgtgtcctccgtgctcatgaccttccggaacaccgtgcagtcgcccttgccgaaggggatgggcacgcgcctgccgtcggccgtcctctcctggtcgaacatcacgtcggacaggaacacgcgcatcttgcccgcgtccacctcgttgatgagcgcgtcgtaggcgaggtccaccgactgcacagcgtccacggcgtccgcgaacacgctctggccgtagggcgagaagtccaccctcgtgttcggcaccgccggccgcacgatgccgaacgtcggtcccacgcaccccgtggccacgtcccccgcgatgcccggcaccgccacctcgcgcccgtcccggtcgaagcaccccgtgcggatccggtacgcgccagcgtcgccccacgacgtgcatctgcagctggtcgagaagcgccccgcgcgagaagcacctcgtgacgaacgcgcactccctcacgccctcgctgtcccacgacagcggcaccaccatgcgcgcgtcgtagtgcctcacgcgcgccaggcggcgccccgcgtccatccacaaggcgaacgccccggttcccagcccgaatgcccgcaccacggtctcctgcgccctgccccagaagttcgtggtcgagaagagcgaggccagccagtcggtgcactcccggctctcgcaggcgaccacggtcttctcgtccagaagcaggctgccccactcccggcacacccgcatggcgggcattatcgtgcgcctatgcacctggtacacgcgtccgaacccgtcggtgtccctgtagtcgtagaactcgcccacggcccgcatccagcggtcccactcccgcacgtgcgactccatgtcctccagtgtccgcgtcgagtatcccgctcccctcagatacgacctcacgcactccggcacccagtactcgtccgtctcctccatgctcatgctggcctccttcaatcgaagtgagaagaacggcccgataatcgcgcgccgtcacattcctacgccagccttcgcctctccgactaaggggaataagaagagagagctcagacaggcgacaaaaacgagaggctccccatgtcgaagaagaaagcaagagagatcatcgcgccccaagaggttatcgagcgcttcgtcgttcgcgcccgcagggtcaaggcgcactccctcgtccaggacggttcggtcgagaagtacgccaagacgcagatgaccgtcagcttctcgatgactaatggggccgccacaatcaaggacgtcgtcgttccggacgaggaggtcttcgagtccctcacgacgcgccttcgcccgttcatcgtgaagagcgagccaatctaccttcccaaagttttcgatgccatcaggtctttcatgtccgatgatgccctgggggagaaggacgaggacctcgagaaggcactcgtctccgcagagcaatgcttcgagcaccgcttccgcgaacaggacgtcaagacgtatgcccttcaactcctagacgaggcgggaaaccccgagtccggatacgtctcggacgccaccatggcgggttcctggctttacacggacacggtgcatgcagacccacacgacgagaaggccgtaggcaagaagttcggctaccgtgcgcgctacacggcagcctcgcccttcttctgcgagcttgcgattctcgtcgtcagcatgctcagcatcgtgaaggcgcttgtcgagaaggactatctgtcggtctctgacacagcttggtcggagccagtcacctatgcggaggcagaggaggcggcgggcgagaaggtcgtggacggttccatgtacatcttccccgcgggcacggttcccccggatggcgcaagtcttgaggacattcccggtggcgtcaaggccacccccatggtcctctgtcttcttggcgatcccgagggtcgtgcggttctgaccgtgtatgaggagagcggggagcccatcgcgtcgtatccggcataccgaaggctgagagacgacaccttcgtgttcctggtgaacgacgttctttcgcttacggttccacgtggcatcctctctggctccccaagctccattccagtcttcgaggcaaacgagggaagagaggtcgaggcatattcgcttttcaggagcttctcgtccccgcaccgtttggaggtccgattcaattacgacggcagggaacagaggttcatgctctatttcgagccgcaaccagccgaagacggcgagccgtcgccaaggggtggcgagcagtaagcaggcgagaagatccttccactatcgagaagccccccacgccccgcacagcacgtcgtccatcatcgcgtaccgcaccgcgtcgatcgagtggccgttcccgtccgggatctcgtccacccaggttccgtcgcggtcccgctcgaactccttcagccggaactcctcgtacgccagcagacaccgcaccgggtcgatcacgatctcgcgcagcccggccagccactcatagctcagccgccgcatgttcgacttcctcgccggccgcacgcgcagccccagctcgcgccgccacatgactatcgacgagcgaatcatgcagatcctggcgaacaagcagcgaatcttcgacgccttcgccgacaggtcagttgcggccgagcaagtcgatcaggccttcagccgggagacgatggaccagatcgtgcgggatgaactcaggaagtacgccggcgcgcggcagggaagaactgctcccatcgcaacgggcgcggtgcctagcagcccagatgttcgcaacctactcaactaatcgaactacattaattggggggatcaaatcgtcgcgtttgtatgtatctgggcttcgattcccggcttccgatgcggctgagttcttcccgtacaacttcgcgcggcactcgtggggaacttgccgaatgaggtcggtacgcgcccatcgccctatccgggtcgaacatcgtgcggagaggagcatgcgtatcttatccgtatcaccccgtcgatgagtgggtcgtggagggaggttcacgttctgtctgtaagacaccatgtagttaggacatcagtgtcgtacactctgacagcgagtaacaggggtagtgttaatcgcagcaatcgatgctagagctcaagcggtcagtcccaactccccgctcactccgttctactccgctttagtccgttccactcctcacctgcctccgaggaccgccttgaagagagaatagtattgcggtgggtcgcgcgtgctgtcaccgcaatccggcagggccttccccaagcagccacgccagaagctcaagagccccaggaatgcccctaccgtcttccggttggtcgcctgagcctcgcgctgacagcgccacattgaactcggcgcctgcgagtacctgctccaccatatcgtcatctgccatgatcgtgggtcccagcagcaagctctcggaagcctcctcagttgcattgcggtagtcctccccaggagcgtcgtcactcaaatccaccagatcgccgcaccacctaccgccccattcctcatcaaccgtccccatcgcgaagaggagcacggtggggtcgatgcgcgtaaactcgtacctcccgtgccgtcggtacacgttggagatgggtccctgcctcctgtcaacgaactcgtgtctcgtgcggttcacagcgtagcgtcatctccttacgcgcaggtcgaacggcccggtatacggctcgtcgaatacgtcgcccactcctcgaaatggagatagtcaccgtatttgtggccccgggcctcctcaaagcgccccgttacgttctcaaaacgtttcagtatgtcctcgtagggatagccgtcgaacttcgcgaacaacttgtgcgagcgctcgtcgtcgaaggagccttcagtccagtagtcaccgacgtagatgaccgtgtcgccatgccaaggacccgcaatcatcgtgcatgccgcgtctgtcatctgctgcccaactgccgcagagcatcccagcgtgaagtcgatgccctcaaacggatcgtcgtctatgtactcgcgtttatcctggcttgcccagatgtagcactggatcgtccttctcgccccgcgtgtcatcggctcatcgtccgctgacattttcttacgggtgccaaggtggggaaagagactggtagaatgcactgctgacacgtgaggcaaggggaggaagatccgatgtcgcgcatagcatgtctctgcggcaacgacgtccgcgaaaacaactacaagaacgtgtggaacttcgtagcagactcgctcatggacgagctggccgacagccaggcattcttcggcctcgagtaccggcccggcgagaaatcggaagtttggcactgccaagagtgcgaccggctcatccttttcgatgatggtggcatctacgttacgcgctacatgagaagggtctccgggggcaagccgcccgttgggcccgacgcccgtcgaggcgtgctctacaacgatgagctcttcttcgacgagatcgataggtacctctcggagaagaccaagcgtggcgaggcacccgactatgagttcttcgatgcccagtacgcggaaggcaacccactcctcacgtcccgcatcatgcgcagggaggcattcgacaacccctcgagttccttcggaaactggtatcgggcagagctctccaagacgtcgctcgcaatcttcgaccagaatgacgttgcgtacgcctgccctttgaagcaatggctcgtgagccccgaggacatggccgagctcgcatagcgcgcgacgccgacctggcccatccggccggcggccatggcgggcgcgacgggctgggcctatcccaccacctatcccaccacggcgatgcagcccgcgacgacggcgctcaccacgccaatgagcgccagcggcacgcacccgtccacgaacgaggccagcgcgcccagccggtagtacagcacgtagcacacaaggctcacggcaaagcccgccacggcgagaagtgccaccagcgtggccgcgcccgcctctccggcgcggcccagagccagcgcgcagaacgcctccatgccgagccacgccacgaagagcacgagctccgtggtgggctgccgctggaacgcgcgctgcgtcaccgcaagcagcgcgaagtacagcgcgaccgaccccagcgcgaagccgacgggcgcccacgcgggtgcgagccgcgccgcgccgccgcaggttcgcgtggcgccccacacgccgcagacgacggcgcccaggatcgaaacgacgcccaccacgcgcagcgggccctgcgcctctcccccgccgaccttgggccagaagaagatcgcccaccacgcgaggtacagcacgcagcacgcggccatcagccaatggccctgcctcatctggtcaaacgcgacgtcacccatggtcgacctcctcgggtcactctgccggcgccacgtcgggcgcccgcacgcccatcatagcaacgtggcgcgcgtccttctcaccttccgaggcagccgacggggatgacgtagacgccgtcgctcctcttgtacgagcgctcgcccagccccacgaggaccgcaaggaactccggctcgcgcgtgcgcgccctggcgtttctcatcagcttgtccctcatgcgcagcaggctttccgcggcctcgtccgccttgttctcgcccagcttcacctcgaacgcgccccacctgcccgcggcgtcctcgactatggcatccacctcaagcccgttgtcgtcgcggtagtagtgcaccgggtcccgcgaggcctccggcaccgcgcgtgcgtagaccgagaggtcgcgcatgcacaggttctcgaacacgagacccagcgtctgccagtcgcccttgagcgagcgctcgttcatctggaggagcgccaccgcgagcgagggatcgaccagatagcgcttggggctcgtgcggaagcgcttgggggagcgcgccggcggctcccaccccttgatcggcagcagcaggtacagggattcgagcagtgccaggtagttcgatatggtcgcgggcgagaccacgtcgtccccctcgacctcgccatacatgtctcgaatcatcgtcttcctggtcgtggcctgcccaaggttcctggcaaggcttcctaacaggcgcctggcaacgtccgggttccctccttttgcggcaacgctctgctccgtggtcgcgtccacatagtccctcgctatgcgcaatgcgcgtgacggcttgacgccaaccgcctcgggccaccctcccctgcagcacagcgccaccagtcggtccacgtccatctcgcatgacgcatatgcgaactcaccgtcaaacaagcttgacagagacacctcgcccgtcgagtccccagattcctgcagcgacatcggcagcattcgcaccctgccaatccgtccaacgccgctatggtggaccttgtcctttgccggggtggaggaacccgtcagtatccagaggcccttcttgccgccggcgtcgtcaacctcgtggcgcacgacgtcccacagcgacggcacaagctgccactcgtcaatcacgtgcggtgcatccccgacaagggcagccttgggatcggattgcgccatgctgaggttctgtccctcgtccagatagatgatgctcttggcatgcttgcgtgccgtccaggtcttcccgcaccatttggcaccagtaatctcgaccgcgccgtaggtctcgaggcactcatcaacctcgtcatcaacaattcgaggcaaatatcccgtgggcacaaccggcatcctcgaggacctcccataccaaacacagcatcgtctacctgctcatatagcattcccctatctagtatactgtcgtaatccgcatttctcattgtcagattccgcgattttcgttgtcactttccgcgtttctcgctgtcagattccgcgaatctcgttgtcactttccgcgcgaagccgacgaaaaaagggcggtgccggcagctgccgacgtcgccccataaggcgagttttctaacgagaaggacgaggccacgtgtctgtggcccggccctgccgcgcgcgctactggttgcgcagcatcttggtgaaggacgtgtccgagtggcgcgcccacagcacgtagaccagcacg

SEQ ID NO: 135 - DNA, 12157 bp, Unknown
  Metagenome-assembled genome
ccatgctcgatggagtcgacaccgttccgcagtgcgaccttgagtccctcgacgccctccacatgggctgcgaccttgtagccaagctcgtgggagcgatcgcagaccgccttcgccatagcggggtccatccggagcaggccagcctcgccccttcgggtgccatcgagcacgccgcccgtgatcatgagcttgacgagatccgtgccctgcttcttggagagctcgacatgtgcgagcgcctcgtcgatggatgctgctgcgatggcgaccgaacccgccatgtgaccgcctggcaccgagattccctcgttggcggcgaggatgcgtggtccaagcgttttgccagatgcaatctcgtcgcggcagcgcgtgtcgaagtcgcccagtccgcccacggtgcggatggtcgtgacaccactcatgagctcgatctgcgcgtactggcgaacgaggcgataggccaccgctcgggtgagcccgttgctcatgatcttcgtgaccagcgccgcgctgtcgcgctgcttcttctgcggtttgccgtttcccgccaggtgaacgtgcatgttgatgaggccgggcatgaggtagcggccccttaggttgtggacctcgcaacccgcgtatgcgctcttctcggactcggggacgatggcctcgatgcgactgccagaggtgatgagggccatgccctcaatcggctccatgtccttggtgccatcgagaatggttgccccgacgtaggcgacgtgcgtgcggctggtaactcccatgcgtcttctcctccgtgagcaagtggtttaagctgcgattctatcaaaacgatgcgctcgggtcggtcaggaacgtgtcgtccggtacgatcctcttgcatggggagtttcgcaatgatgccggcgtgacgtgagtcttcgttagaacaggcagctctcgattacgtctttgcccagcagttcgtccatccatttggcagggatggcgtccatgccgtagacgattcccgcgaggcctcccgcgacggcggctgtcgtgtccgtgtcgtcgcccaggttgacggcgagaaggacgcagtccgcgtaggtagaggtgttgccgaggcaccagagcgcggcgcgctcggtatcccttacgaagccgccagagcggatgtcgctctcgggcgcgcctatctggttcgcagcgacttctgctggtgtcgcgcccgcaatcagcttcctggctacgtgcaccatccgcacgcaggcatcgcacgaggtgtggtgcgcgtgggtgatggcggagacggcgcggacctcgtcgtcggtcgcgtcggtaaaggccagcggcaggattcgcatgagcgatccattcccgttgtctcgtccgcccgcctggccgtgaccctcgtcgagggcgcgagccgtgcagccgccaatgtcgaagaggccgtccactgtgtaggctccctcgtggtaccagcgttcgaacctgcggcgcatgtccgcaacgtccacgcatcccttctcgcggaggctgtcgcacgtggccagtgccatggacgtgtcgtcgctccatgtgccggcgggctggttgtgactgccgtgcccgaccatgtccgtgcaggtaaacgacccacgcatcctgaactcatagggcacacccagcgcatcgcccacggcctggccgtacatgcagtcacgaagagttgcccttgccttcatggatgtgcctcgattctggaagccgtctttctcgcccgcgggaaccttgggcgagggttgcgttttgtcgctattctagcgttcgcgtgcacggtaaccgggacgttgcggttgcgctcgcacagcgtttgcggggctacaatgccacaagccgcggggctgcgggctggcagcaccaacggcgcagtcgatcttgaagggaccctggtggacagcctcatctttagcatcaacgcgaccttccccatcttcctcaccatgctgctgggcatgttcctgcaccgggtcggaatgatggacgaccggtttgcggactacctcaacgccttcgtgttcaaggtggcgctgcccgttctgctgttccaggaccttgcgacacaggactttgccgcggcatgggacgggcgcttcgtgctgttctgcttccttgccacggccgcgagcatggcggcgatcgtgctgctggcgcgcctggtggtgcgtgacgtgccccagcgcggcgagtttgtccaggcgagctatcgcagctcggcggccatcctgggcatcgccttcatcaagaacgtctatgggagcgcgcccacgagcatggcggcgctcatgattctggggagcgtgccgctctacaacgtgtttgccgtggtggtgctcacgctcacggcggagggggacggctcttctcgcccgtccgtggggacgatggcccgcaaggcggtgcacggggtcgtcaccaaccccataatcctgggaatcgccgctggttttgcgtggtcgctcctgcgtctgcccatgcccaagattctggcgtccaccgtcaacaacgtggcggtgctcgccacgcctctgggccttatggccatgggggcgcagttcaagttccgctccgcgcgcgggagcctgggcgtcgccaccgtgtcgagcctcgtcaagctcgtgggactcgttgcgatctttatgccattggccatccatcttggatttcgcaaccagcaactcatcgccctcctcgtcatgctgggttccgcctctacggtgagctgctacgtgatggcgcgcaacatggggcatgacggcaccctcacctctaccatcgtgatgatgaccacggtgggctgcgcgctcacgctcacgatgtggctctggatgctgcgcgccggcggcttcgtctcctaggggagaaggccctctgtggcattgcgggtggagcgacctatcgcgtgaagatgacgctccccgcctcggtgggatggtcgaatatcacgacctcgcgcgcgtccgtacggaagcgcagcagcttggccacgatcatcacgtcgcccgtggcggaaagcgccatgaacgcacccagtatggtgaccggcaggttgcctatggcgatgccaatcacgaagggaacgactcccaggagcacaaggggtgcgagtccgcctgccacatatgggccaagctcgaggggctgcttgcaggtgcagtagggcatgaggtacttccacatgacgccgaactcgatgtcgtccaggcggttatgcgagaagatcacccatgcgagtccgtgcaccagctcgtgtacgaagataagggcgaacgcggtaagaataagcggcagctcaaggtccacctcgaacgagtcggttgcagaggtcggcgcaaaggtgcggtacaaccagaaggtgagaaacaccaacgggactgccgcgacgagcgtggccacgtttgcggcgacgggtctaacggtgaggttctcctgcgcatagcctgcgacgctcatgcggttgcacgtgtcccgaaaacggtcgagcctacgctgttcggccgcggagagcttgcggttaccgttgcttgaatgttcggccttggtgcggctcatggcgtcgtcctttcccgggcggcagcgaactgcctagagtatagatggcaaggtcgtacctttgtgtaagccttagctcacggctgagatttggcggcgagggatgcacgaccgcaatggtctaatggcgcgaccaagggagaagtgcgatggttgcggaagacgatgagatgttcgagaagcgcgacgggaacccgcgtgcggatttgacgggggaggctgcgggtctgcgttggcttggcgagtcggaacccgacggcggcatcgtgtgtgcgagggtgagcgaggcgagcgcgcaccgactggtggaggagcgcattctggagggcagcccgactcgtgagaaggctcgtcttgccggggccgcactcgcgcggatacacgccgcgggtgccgagtggtatggctgcccgccgtcgggttggcatggcgatggctatgcgatagcgaactcggtaacgagcgtagtgcctgaagagtcgagcggtgaggccatgacttggggagccgcttgtgcacggtggcgcgtgatgccccatgtgcgcacgattcgcaatgctgggctgctggacgcccagggcgtgcgtctgctcacacacgtggccgaccgcatggctgccggcgatttcgactcgccggagccggggctcgtacagaagagcgggcgtcgttgctccagaatccatggtgacctgtgggctggtaacctcctttgggctgcggacgggacacgtgcggctgccacgggtgcagcgctgatagaccccatggcttccggcggccatgcggagacggaccttgcgatgctcgcgctctttggctgcgcgtacctggacgaccttgttgcggcatacaacgaggtgtcgcctttggcggaaggttggcgcgaacgcgtgggcatccaccagctggtgccggtgcttctgcactgcgtactgtttggggaatcctacgttgaccttgcgcttggcattgcgcggcgctacgcgtaggatggtcttctcgccatatgcgtagcgcctggagacggggtgacctggctagtcttctgcggaccctttgttgcgcatcgcctcttgggcggctcgtcgtgtgggctccagtgcctctgtcagctcctcctccgtcggcaggtacgtcacgtaggtggatgcgaagaggcctttgccgtccgcaagagccgagtactttgctaccgtccggtcggagctcgagcagaggataagccctatcgtcgggttgtcgccctccggtgcgtacttggagtcgaagagtcgcacgtagaagtccatttgtcccacgtccctgggattgagaggatgagtcttgagctccacgagcacgtggcacctaaggttgatgttgtagaagacaaggtcaacgtagtagctcgcggtctcggcatcgaggcggtactgtctgccgacaaaggcgaacccacggccgagctcaagcatgaactcttggatcctggtcacgagcgcctgctccaaggtcttctcgtcgaaatcggtacggtcacccaggtcgaggaagtcgagaacgtaggggtcctttatgagcaggtcggctgacgtcttgggctcgctggtctggatctcgctgcggatgtgaccgcgcttgtcatcgggggtcttcaggaggcgctcgtagtaaaacgtggcaatctggtggtccagctggcgaaccgtccaaccgtcctcggcggctgcgtgcatgtagaactcgcgtcgcttcgcatccgggatgcgcatcagcctgcggtagtgcgaccagctcaattcgcgacacaacgtgtctcgaattggaaatgccttgtaaaaggacctcatgttgcgcaagtttgtggcgtcgaaccctcttccaaactccgccgtgaggcgctcggaaagataggctaccaggtgttttccgtactcggcccggtcgcccgttgccacagcgatctgcctgccgatctcccagtaggcgcccaccatggcagaattgactgcgcgctccacgtgcgaacgtgcttcctcaagggtggttcgaactgatgcgtagatcttctcgtccgactgattggaatcgagctgggagttgcctgcttcgatgttcttcgtcatgctaacgcgccccttcgtgtccaaggatgcttcttggtgcatgcgtgtcgggctttacgggtgccgacgacaggggcgcgtgcctgcctaggggaggtaagtgcggtgctggatggatcgccgcccgcctgcgtgtatcactggggacttccgcgcaggctcttatctgctcctataccttgggaacagtatatcatgaatgagaacaaatgttctagtaaatgttgattgatttacctatgagcgacgtgcgtcaaggcgggccagaatgatggccaagatggcctccagtgccgcgaggcccgccaggaccatgatgaccgggggcaggccgatggcgtcgcctgcagcgcccaggaacggctcggccacgccacccacgcagacggcgatgccgtatgaaagtcccgaggcggtgcccaggtggcctggtacgtagctcattcccagcgcgacggccgaggggtagaacaggtccgtggatacggccagcagcatggccaggattacggccagaacgagcggttaagcgagaagatcgcggtcagcacgaccgtggccgttatgcacccgactatgagccggtgtgtgccgacgcttccggacacacgtccggagacaagcgtcgcaacgcctcccgctatggcgaaggcggagatgacaagcgagctgagcgcggcgttctggcccagcacgcccatcaggaacagcgggatgaacgccagcaggccatacgagagtatggagcggatcgagagcactcccattagcagtccgaagtggccccaatgttcctgcgtatgccccgcgacaccgctggactggtgtgccacgcccagggccttgaaccgctggttgaaggccaggagcacgatggagcagactatggcgggaaccaggaacaccagcgtgccgtgcatgccgaaagcggtcaggaacgccgaggtcaggatgggtcccacaaagaagcccatgttgccgcccacggcgaatatgctcatgccgctggccttgctgctgcctgccgccaggttggcgatgcgcccgccctcgggatggaacattgcggcgcctatgccggagaccatggccgatgccacgaccaggcggtagtcggtcagaaagccgatgccgcacatgcccaacccggccaggaaggtgcccagcgccatgaaccaggggcgtgccttgtggtcgcccatccagccgaacaggggttggatgacggcggatgccacattggacgcaaagatcagcatcgtggcggcggtgtaggagtagccgtttgacgccacgaggaaggggagcacggccgtgagcgcaccctggttgatgtcggtgcacaggtgtccgaccatggtgaggtagttggccaggcggtcgcccttctcctctgacgactcgtgcttctctattggtgcttggctcatggatgccgattccttacttgcgcggcgtctttttcttcttgggtgcgtagtcgcggtcgtagtcagggacgtccatgtgagagatctcccacaggtacaggctggccacgctgccgtagggggagtagcgcctgcggtagcgctcgaacagcgggcgcgtgatcttgcggtggtggtagaccatgcgcatgccgcgctggatggcaaggtcgccgtaggacagtatatcgggacggccgaggttgaagaggaggagcatctccgcggtccagcggccgatgcctggaagcgagctcagggcctggattgcctcctcgtcgggcatgtgctcgacggcgtccaggtcaaactcgccgcgcatgatgcggttggcgacacccttaatgtattcgaccttcttgaacgtggtaccgcaggattgcagctcgtcctccggtgccgcgcagacggcctgcggggtgacctcgccaagcttgtcccgcaggcgcgcccacacggtagcctgtgcggcgctcgagacttgctgtcccacgatgtgatgcacgatgcccgagaagagcgtgccctcctccatcgggcggtatatgtgccccaccgcgtcgatggccccggccagcctcttgtcgtgcgacttgaggtagtcgacctcggtatcgccgtattcgaagtagcgcgtcatggtcttcttgcccccagcgcctgcgccgcgtttgggatgccttcgagcgcggttcccgtgcgggggatcttgaactctggcttgagcgcgtgctcgtgcctgagcagcgcaatctttcgctcgatgccgccgccgaagccggtcagacttccgtttacgccgaccacgcggtggcaggggacgatgacgcccagggggttgcgtccgactgcaccgcccacggcgcgcggggattggtggcgccccgtttgggcctcgatccgtcgtgcgatgtcgctgtaagttgtggtctgcccgtaggggatcgcgagaagtgcctcgcgaacgagcagctggaactccgtcccacgcgcggtgagcggcagctcgagggggtcgggtttctcgcccgcgaagtaacggtcgagccatgtgcgtgcccgcacgagcgtgggtacgtcgtccccgcgctccaggtttgcatctgccaagccgtagccaaagtggcgggagttgtcgaaccagcagccggtgatgcccctgccgtcactcgtgacggtgagggtccccacgatgggcgtgtggtattccgtgaagaacacgattcctcccttgagcggcgtcgggcatgattgcgaacgtttgttcgtggtaatcaccaattatatatggcgcaacgccgcttgtcaccaaaaagattggggtgctcgctgcgacgctgctatagttagccttggataacaatattgagctggcaggggagaagagcgtgcacaccgggtcgacaacctttcgggtggatgatgacggctttgaggccacgctctatcggcccgaggaggaccgctatcccggcagggtcctcatctttgtgggcgggagcgacgggacgtatgacctgcccaagatcgtcgcccaggcgtacgcggatgccgggatgaccggcctggcgctggcgtactggaaccagcccggcctgccacgggcgatcagccgtgttccgctggagtacgtgggcaaggctgccacgcgcctgcggtccctgggatacgcaaaggtgggcgcgtgggggatttccatggggagcctcctcgcacttctctgcggcgcctacctgcccgagcttgtgagctgcgtgatcgccgtgagcccgggggacgtctgcacgcaggcgatgacccgcggaaaggcgctccccggatcggcgttctcgttccgcggcaaggacctgccgtggatgcccctggactaccacaagggacgcgtcgtgcgggactttatccgcggcggcagcctgagcatgaggtcctgctacgtgcacaaggaccaggcaccggcagatgccttcattccggtggagaagatcgagggccccgtgctgctgcagactccggaaagcgacagcatgtggccgtcgcgcgagtcgtgcgacgccatgatggcccgcctggacgcggcgggctttgcctacccgcacgagtgcgtgagctacaagtatgccagccactttctggtgcccgcgaagctgcgctcggcgcgcctcttcagaatcgagcgcaggcacccggaagagtgctgggaatcggattggaagtcgcttgcggacgcgttgcagttcgtgggggagtgctggtaggcgacagggtgcacggtgctgtgcggctagctcgtgccgccgacccgctttgcctcccgcaccagctgccgcaggttatgcgagaaacgcgtgcggtcctcgctggtaaacgccgcgggccccttggtcctgccgcccgcgcggcggaccttcttctcctcgtgccggatgaacatcatggagtctatggtcagcgggttgtacacgcgcccgcgcacgccgatggcccgtgcgccgcgtcccagcacgatgtctgccaggccgatgtcctgcgtcaccaccacgtcggccggcgtcagcctctggacaatggcgaagtccgcggagtccgcacccacgcccacctgcagcgtattgacccaaaagccgcgatccggatgctcggggtcgcgcggctcgcgtgggtccgtcgcgcggatggagcgctccaggttctgcgtggagtttcctgcgatgacgcagggcacgccctcgccacgcgccacggccagggcctcgcgggtcacggggcaggcgtctgcgtcgatgtagagtacggtcatcatgcctccgtagcttgttcttctcccatggagcgccttgcccttgttggatcagagccctgcgtacagatcgtttgcactcacaaggcgaaggtcgttcctttgggatgccttctgccgtgttgccgcactgacgtcgcgcttcgagaagagcaccaagtgagttcgcgtgaacccccttagcagcgtcgaccgatgctccagcgtctggatggcgtcactctcgttgaacgagttccgccacttgcactcgcccaccaagagctcgtgctcgatggcattggtggccaccacgtcgatgtctgcctgttcgtgcgcggaggggtccgtgccccaccactgtccaaactccaacgccgcaaagggtagctggccagccgcgctctgcctcatcacccattggaggcagatcttcttgaactgctttcccacgtaggtgtcgaaggcctgtccctgggtcgcgtacttcgagacggcctccccggcgccctcctcgatgctgccgaggtatctgctgacaaaccgataccagtatgcgaagaagggatccttgatgtgccagcgcgcgtctctggaggatgccccgccacccaggggaacggccttctcgatgatgccaaggtcgcccaggattctgaggtacctgccgatggagttctggtttatgccggcctgctgggctatgcgcgaggcggttgtggcacctgccccaatggcgtcgagcgtcgagttgtacagcgcgggctcctggagctcctcgcgcagcagcaccagcggctcctcgtacagcatgccaagccggtcgaagcacaggtcgcgcacgttggccgcataccccctgcctggctctatctgcgcgaggtagtagggggtcccgccaaaggtggcatagtaggccacgagctcctcggggcttgcgcccgggagcatgcgcgccgcgtccaggtagtcaaacgggagcagccttatctgcatggtcctgcgaccaaagaggggactcttgctgcccagcacctccgtctccatgaagccctcgttgctgccgcagaggactatctttgcgcttgtctgcagaaagccgtggtcgattgcgacctgcagggccgagggaagcgatgggtctgccattgcggcgtagggaaactcgtcgaagacgaacacgaagggatccgtggcctcccagctggcagccctctccgcaacaaacgagattgcgtcatgccaggttccaaaggcgggaagcgactccggcatgtggaagaacgcgtacgcggtggcactgaacagctcgaggttctgccgcgtggtcttctgctgtgcggtaaagaagagcgtgggtttgttcttggtgaactcgtcaataagcgacgtcttgcccacgcggcgcctgccatagatgaccgccatctggaagctgtctttacggtacatgcgctcgagtgcgtcgagctccctttcgcgcgcgacgaacatggtgactcctgccccggcggattagtgattacgtacgatatagtaccgtactatatcgtacggtacgatgtagtacggaatttatatcccgtgaggtgcacatctgggcgagaagaacggcctcaggcggttcgaactccgcctgggaccgcatgggttccaacgtcatcgcgccgtccgctacctcacgcggtcggtacctgccaggggcttctcgcccgggcgggccttggggccaacgagctcatggggctggtacagctcgtccaggaagtcgacgtcctccggcgtcagcctcacgtcgagggcacgcaccgcgtcgtccacgcggttcggcttgctgcagcccacgatgggcgcggccacgcccttggcccagtgccaggccagggccacgtccgccatggggacgcccaggcgctcggccagctcgtgcacgcgctcgaccacgggcatgtcgatctggcggtcgtggtcgtacttgtttctcatcgtgttgtccgtggtggagcgcgtggagtcggagtcccaggtcgggcgcgtcagatggcccgacgcaagcgggctgtacggggtgatgctcacgccgtactggcggcagacggggatcatctcgcgctcgtcctcgcggtacagcaggttgtagtggcactgcatgctgctgaagcgggtccagccgttctggtccgctaccacctgcatgttgtggaactggtacgcgtacatggcgctggcgcccagcg

SEQ ID NO: 136 - DNA, 1466 bp, Unknown
  Metagenome-assembled genome
aacgccgaaacgccagaattatctggtttgccaaaggttatgttgaatacgaagttggtaactttctcgaacccggtgaacaggtgcaaatgctgacattatcagcggaaatgggtagcgaaattccaatgtcaaatgaagattggccctcagatatcacatttacgttggatggtaaagagctgggcacttggaccagtcccggcgactttgcggacacccgtggtaagttcacaccattatggacaccagcaaaattcaatcagtatggtacccaagtcacgctaattgtctcgcacgaaggaacttggatttctgggcaaaaaattagcggcaccacgattgacgatctcaccccactacctagtcggatgaaattgagaattggtgtcgctcaggatgcgaaaaatcaaggtggctgtacaatttttggtaaaggatttgggaactatgatcaagagatgtatttgacgttgtattgctcgtgaaatagattgctattcggatattcttaaaacctcataaaaatatttgttccaaaatggatttcttatcaatcagtccaatgatccactctatcaatacgtttacttatttgttcattaaaaaagctatccaaatcaactgtaccatttcccggtattagtcctactggtatgatatcttttcctgtgaacttttgaaccaaatcatcatcttgatcagaaacgattctaggataaagaatgctaacagctgacacaattgatttggagaagtcaattatgctatgattctttgcactctcataacgtttcaaggtaaaagcatacttctcgcttgtctttatttgatctaaatatgacgcaagttggtcccacgcatcatgttcaacatttcttaatctacgatattttgtgtctaaaaccagcatcccaattaaggttttgctaccatctacatcacttgtatcatataaatcaaccctaatatcaggccagttatgacttccatttgtccaaacaggaacatttttgttagccgaaattctctgattataaataattctaattttcaagaggtggtgattttctgaacttgaaacacgatcaccaaccatcgtgacggctgtcccatctttaagctcatcaaagcactcacggcctttattgaaaatccagccatcaattggcttgaaccctatgttttctaaggattttatggcttgaatatatccccatatttcatacaaaagatctgttcgatgccagtaatattcatactggcgatgaaaagctgtcagctttgaggctgctagccttaatttcttaacaaattttgttatgaagatatatttatagggttctggtgcaaagtttactcagggagagtgcatcctgtatcatgaattgaaactggaggttttcagatgactgatcattttaaaggacggcaattcaatcaatcagtgattacttttgccgtag

SEQ ID NO: 137 - DNA, 1357 bp, Unknown
  Metagenome-assembled genome
ggacagcagctaggacattatacggcattgaaaccatgcatgcgatacacaaagaaagccgaaagaagccaggcctcttcggcttttcagcgtatcaagaagtcgaccaattgttagcggcataggttacaaccactaaacacagtcactttgatctacgcttaatttcaactttgcaccagaaccagataaacgacatcatgccatgagtggaacggaactcatcaaagcagagtcgcgtgggtagccggcgagccggtcggagtttgagattttggtcaatgatccgttgaaccgaggaagctgagattccgataatacgggcgatggttttgactggcaaccgttcatgcgctaacttcatgattcgctctgtcatgtgagcggcgatcgtgtggttgggttgcacgagtggcgtcttggcactgactgtgtggtaacagttatgacagcgccatcgtttgaggacgcgcacgtgggccgtgtaaaacccgttagggtgcaaggcctcaaagccacacagtaggcaccgggttaaccggtaagtcagctcggcatcaatcacatgatactggcggcgacgtaccccgttgccgcgatattcatgacgaacaaaggcaacttttatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttcccaacaccagaaagtgtagacccgattatttcgatatttagaacattgaagcacctgagaaagctttggtttatacggtgcttcagtgtagccctctattgaccggtgactaatcgcggtattttagtagcttagaatccaaagtaagctcattgctgtcaatagaatggtacaacagacttaacggtttttaaatcgtatacaaagtctcattaattcgccaacttttagagtaatcaggttgattcagttgttagagtactctagatagtatggtatgttatgcaaacaccattttagcaggaagggacaggtctttttccgcatttgttgggtggtaactttaattatgcaatctaggctggcgacttgattctcaccatgtttatcggaatggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaa

SEQ ID NO: 138 - DNA, 2154 bp, Unknown
  Metagenome-assembled genome
ctgcagaagatctacgacgagacctggggcaaggacgtctacaaggtcgtgggcgtcaagtccgaccaggtcgtctatggcggcggcaacatccactgcatcacgcagcaggagccctctgcctaggtcaagtaaaagccaaccgtaagctggcatgccggagcgggcgcgggcgagaagaacgcggccttctcctccagatccattcccaggtggggcgtcccgatggggcgccccgctccatatgcggacaagccgacgcgtcaccgcaccaaccgcaccaccgcaccaaccgtcagccacgatcatgctcggaggcacgtcatggccaaaaagaagctgcgcctagtcgacgtgatgctttcgataatctgcgtggtgttcaccatcgaggcatgcgcccccgccgccgcgattggcaactcctccgtattctggtggctcttcctgttcgttaccttcctcatgccgtacgggctcatcgtggcggaactcggcaccacttacgcggagggtgccggcgtctacgagtgggttcgcgacgcgctcggccgccgctgggccacgcgcgaggcgtggtactactgggtcaactacttcacgtggctcgcgtccatatcggttctctttcccaccaccatcggcgccgtgttggggcgcagccttccatcctgggtgtccgtggccatcgagcttgcgtttatctggtttgttgtgtgggtctccatgcgcgacgtgggcgacctgtccgggctcatgaacctgggcgccgtcatcaacgtggccatggcggtgggcatcggcggcctcggcatctggtatggcaccacgcacggcttcgcttcacccctcacgccgcggtccctgctgccaaactttggcgacccaaccagcatcacgtacctctcggtcatcatctacaactacatgggctgcgaggtcgtcgccacgttcgtggactcgatggagagcccccagcacgacatgcccaaggccatcgtcacctccggcctcacgattgtggtcatctacctcttcgtttccctcggcatatcaacagccgtgccgcacggctccatcgcgctcgactccggcatcacggacgccgtcgcgatcatggctggcaagggcagccccgtgttcatgctcgtgagcgtgggctttctggtctcgtgctttgccaacatgatcagctggtcgcatggcgtgagctccgtcaccaaccgtgccgccagggagggcaaccttccgcaagtctttggccaggaggacgagaaggaccgccaccttggctcatgcctcgccacgggcgtgtgcgcctccatcctcgtgatcgcgggtcccatcctggacgacctgggcatcggcgtgttctacacggccctctcgctcgacatcgtgttcacgctcgcggcgtacctgcccatgttcccggcgttcctgcgactgcgacggatcgacccggaccgtccgcgtcccttccgcgtgcccggcggacgcgtgctcaaccagctcttctgctgggtgcccgtggcggagctcgtgctgtccatggcggtgtcgctcgtgccgctcgacggtaccgctccgcagctgcgcaagctccccctgctcgcgctcacggttgccgtggtgcttgcgggcgagctcgtgcgccacgtgagctacgcgcgcgccacggcccgtgccgaggtcctgggcgtgccgcttcccgcggcccagatgggcccggactgcgagcgcctccagctccgccgccacccgcgcgcctaccacgtagacagccccgcccgcgaccggcgcctccgtcgcgactacatttggcgcgcgctctaagccccgccgcccgccgcggcaacgggcccgcgtccttctcgcccgcgtgcccttgccaaaagccgacgccgcgtcaaaccttgctcgccagattgcgcaaaatgcgccacaaatggcataggagcgggtatcatctagacacgtcagtgcggagttttcccagggttttgcgcggccttgcggcgcgggctcgggaggagcgggtgggcccttgaatccagtcatcgtcattccctcatactgggcggaaagcgacgcccccacaaggattggcgaggtgggcgtctacgatcacgcgacgcccatcacaaagcccgt

SEQ ID NO: 139 - DNA, 1608 bp, Unknown
  Metagenome-assembled genome
ttttgaccttaatgagcactttactgatgcttcgatcatgtttggtgatcgcttaacgaaacttttctaaatttggggcgcacttatcccttggtgttaaaaaattgattttttggttaaaccaacaatgcggcatgctggtcaactcaaagcttgaatccgagctaacaattggtaaaacaagtttcgataaacgtgatggtaacttaatttcaactggattttgcgcccgctatgaacgacttttccagcaattttaaacagccataagcgcaacgtgccaaccgataggccggcctgggcggccggtaagagctgtttcagaaagctcaccaggttataagctaacagacttaagatcatccgagcatgattggcgataaaactggaactatccgttttgtcaaagtaaaaaccagttttagcttccttaaggtagttttccatctttccccgttgatgataagcggcaaaggctgtctcagcgcctaattcggtaaaattagtcactaaatattcgtgctggaagcgtaactcgccggcaagacgggtggacttgataaaaatttttcgcgaatgatcccaggagccggcttgataggtcgtggtgtggtagtgaatttcagtttctgaccacggttgatcatcgccaatttgaataaagctttcggctaaatgagctagttgccggtttgtttttaaccggactaagtagtgagtctgataggcttcacaggttgtatataattccggcgtggcgaagccactatcggcgcggaccatgatctcctgacaaggcaacgtgtgttgataatgttttaataaaggcgttaagaacggtttgatttcagtactggtatacacattccccggtcgtaactgagctttaagaaagtgtccagtctgcccgtcaaacgccaccagcggatgatagccacgagtgccatagtgggcattgaaggctgtctgttcttggttgccgtaagtatcggcatgagtagagtccagatcaatgactaattcagtttgattggttcgaagttgaacttggtcgagtaaagcttggttaacggtctgaagagaagtcagggtctgctcgtcaaagcgttgccagaaacgagatagcgaaggttgtgacgctaattgtggttgtcccaataaaagcttaaaaatgggatcatggcgtaaattcttcgccgccaagtcggcggcatagccagcaatcaattgtaagatgacctgttccagcaattgaaaattagcgtaacgataataatgccgttggtcatcgaaggtaaccaactgatcaactaactgcgaaaatcccagcttaaccatcaattccttgatcaagattagcccggcatcagtagaaagttccccaccagtatgtgaaatatggattttaggattgaaattagctcgcttttccggtaaagttttcatgagaagaactccttttctttgatttttgtttttttggtgaattaactatatcaaaaagggggttctttttctgcacttaatgggtgaaaataaaaaatcgctgttaagtttggtggttccggacttaacagcgataaagaaacttagtaagaataatttggg

SEQ ID NO: 140 - DNA, 6034 bp, Unknown
  Metagenome-assembled genome
ctgttcctcaccaagttcgccaacaaggtcacgatggtcgtgcgcaaggatcacatgcgcgcacaggcctcggtacagagacaggtcgagaatagcgagaagatcgacgtgatgtacaacacgtccgtgaagcgcgtgtccggcgacgggcttctcgagtcgatcacgttcgtgaacaacgtgactggtgccgaggtcaccaaggactacgagaagggctcctttggcgtgttcgtctttgtgggcagggttcccgccagcaaccttctgggcggactcgtgaatcgtgacgaccacggctacattgtcaccgatgaccgcatggcaacgaacgtgcctggactcttcgccgctggagacatcaggcagaagccgctccgccagatcatcacggctgctgcagacggtgcgattgcagcaacgagcgcggccgcataccttggccagcctgtggagggctaggtatcagctactattcagactcttacaaaaacgtgataatatatcttatgtaaagtaagagaagctcaaaacttagggcctctggtacgctccaacagtggacgcgccagaggcccttccctaacgagacgttttgagcccgcaccacgagagctccaaagccatgacgacttaggagtcgggtccttcgttcgagcgtccgttgcgcaaccgcctcagactcttgcggacgcgcgaggactttggccgccagttggacgtgagtgagctcccgagcagctgccagagctggtcctgagtctcgtcgtggccctcggtgttcatgatcagcagcaaactgtcgagcgcctcgagcttcaccttgcctgtcgggatgacctccttgccggcacggtcgatcagcacgacccgcacggagttgggccaggagacctccgcgatggtcttgccctccgcgggcgagcctgcgcccacgacaaaggtctccaaggtcttctcgccctcctgaaggcggcttggcttgctgggacccatgttgcccagaaggcgcgcaagaaggtgctcgtagaacgggtcgacgcgcaggaggtttgccgtcacgtacgagaggatcgacacgatggagacggacaggagcgcatcgaggctgcccgtgagctcgaacgacaggacgacggccgtcacgggcgcgcgtacgacggacgcgaagagccccccgatgccgagcacgatgaagttgttgaggtactcgggcggcagacccaggaagctgacggatagctttccgaagaggcatccgaagagcgcgcccatgacgcagagcggaaagagcgtgccaccgggggcgcccgagccaaagcagagcgtcgtgaacaggtactttcccaggaggagaagcgcgaccgtgctgatggcgagctcgttctggtgcgcgagcctctcgacgatggcgtcgccgccgcacacgaggtccggagcgacgaagatcacgatgccggaaacgaggaacgggatgatgagccgcgtgtacggggcgtgcttcgtgatcttgtcgaactgctcggtcatggcgaacatgcctttgttgtgcgctgcgccgacgatgccgcacaggatgcccaggacgatgacgaagaggtagctcctgtgcggaaggtccgcctggaagacaaactgaaggatgggcttgacgccgaggacctgcgacaccacgaagtccgagctgatggccgccgccatgacggagacgatcagcgggccgttgaactccttgtgaatctcctcgattgcgaagagcacgccggtgagcggcgcgttgaaggcggccgacatgcccgcggcggcaccgcaggtcgtgagcagacgctcttctcccctttcgcgccccatgaccttggagacggccttgccggccatgccgccgagctggacgctcgggccctcgcggcccagcgagaggccgccgagtgcgcagagcgtgccctcgacgaacttggtgagaaggacgcgccaacagggcatgtcgatcctgcctatgacctcggcgtcgatctgagggatgcccgagccctgcgtgtagggctccaggaccatgagcctgcacaccacgccgcagatgacgacgagaaacgcgaaccacagcggcagatagagccagttattggatatcacgccagccgcgaggcgaaggatcgcctcggcgtgcgagagggccatcctgtagagcgagacgaccacgcctcccgcgagacccacgagcaggccctctccgatcatgtatacctggaagcgcctcgagaggcgcctcgtcacgacgttgttgcttgaatctgccatgcgctattcgacacttccacgttgcttaaaactgggttttcgttcttctcgtgcataaatatagggcacccgctggatcaaatccaacggatgcccgattgagtgacgatgtcgtgacgccccgtttgccggcatgctacttgaccttgatgagcgtgaagacgtcctggtcgtacgacttgccaatctccgtgcgcggattgaggtagcagagctcgaggatgaagccgaagccgacgacctttgcgccagcctgctcgacgagcttggccgtggcgacggcagtgccgccggtcgcgacgaggtcgtcgatgatgagcaccttatcgtccgcgctgagggcgtccttgtggatctggagctcgtccgtgccgtactcgagtgcgtaggactgggagtagacctcgcgagggagctttccgggcttgcgagcgggaacgaagcccgcgccgagcttgtacgcgacgggtgcgcccacgaggaagccacgggcctccgcaccgacgaccttggtgatgccctcgtccttgaagtggtccgcgaggtcgtcaatggccgcggcaaaacccttggggtccgccatgagcggggtgatgtccttgaagattacgcctggctcgggatagtcgggaatgtctacgatcaggcttgcatagtcgctctctgccacggggtttcctttccctttacgttgaagcttccaactagggaattttactcctccatctgcttgaaggtgttggagatctgccgcctgatgagggtgtcgcgcacctggcccgtgagggcgagcatctcggagaaggcctggccaaactgcttgcggctctcgtccgtgagctccatctcgacgccgccgcccttcttggcgtacacgacgagcgcctgctcgaacatggcactctcgcggttggctgccgtcacgtactggcggaggttcttggggccgatgccaaagtggcggagctcgttgcaggtcctgatgagggggaagtcccgtccgtccaccaaggcgcggccgtgcggcgactccttgagtgagatcacgcctgcctcggacagctggcgcacgaagctgaccggcacgccgaggagctcgggcatgcggtctatggggtggagcttgttcgccatgtcctcgtcgtccggctccatgttggcatagggcgtgccggcaaggtccgcctgcacctctcccccgtcaagatgcttcttgatgacggagaggggcatgaagcggttcttctgcaggtagagaatcgtctccagacgatggatgtccttttgcgagtacaggcggtaacccgagggcgtgcgcgaggggttgaggagcccctcgtcttccagataccttaccttcgagatggaaaggtcggggtattgtgcctgcagacgcttgaccaccttgccgatggtgaggtatcccgcatcgggcatggcttagttcccggtctcgatcctggcgttcttcctgttggtgtggaagatcatgcggaacgtcccgacctggatggtcgagccgtctttgagcatggcgcggttgacgatggcgccgtcgacccacgtgccgttgagcgagccaaggtcctcgatggtcgcgaagccgctgccaaggcccgagaggtcgagcttggcgtggtggcgagagacagtcatgtcgttaaggaagacgctgttgctggggtcgcgcccgatggtgacgatgtcgtccgtaagctcgaacgtggagcccatctggggtcccttcacgatggtgagcgtaggattcccaggcgcagccccgcccatgaggtcgggagaggtggcgtcggttgcgggcatgcggaagatctttgtggctcccgcgtcgttgttcttggtaggctgcatgtgcctttctcccctcgatgtcgtttattaatacatcatacccgttttgccgcgactgacgccaccgtgcggaaacctgtgtgattggtgccgttggcagaagtgccgcgggcgagaaggacggggctaccggcacgccacgcagtccatctcgatgagcgctcccagcggcagccgcgagacctccaccacgctccgcgccggggcgggcgtcgtgaagtagcgtgcgtagacctcgttgacggcgtccaggtcgtcaaggtttgcgaggtagatggtggtctgcgccacgtcggtgagggtgcagtccgcctccgcgaggatcgcctccacgagctggatgacgcgctcggtctgctgggcaacgtccccctgcatgatcttgctgttgtcgttcgggtcaatcgcaagctgcccagatgcgaacacgagcctgcctgcggtcgtgccctgggagtacggccccacggagtcgggaacgtcaatcgcgtttattgcatacttcatgcctggccgcccttcgcgaaggagccgaggcggcgctccttggccgcgtgcaccagccgctcgagcgactcctcgaggacgtccctcgggcacgcgaggttgaagcgctcgaagccggcaccctcctcgccgaacacgtagccctcgtcgaggaagaggagcgcgtccttctccataaaggactggagctcctcggtggaaagcccccacgcgttgaagtcgacccaggcgaggtaggtgccctccatggggtagaccacgagttcgggcaggtaggtgcccatgaagccgcgcaggaagtcgaagttggcgctcacgacctggatgagctcctcgagccagtcgtcgcacttggtgtacgccgcgatggtcgcggggtaggcaaagcagttgagctcggacgcgggtacgaggtcgaggcccttgcggaagcggtcgcgcacgtcgtcgttggggatgaagatcgcggatgcctggcagccggcgatgttgaacgtcttgctgggcgccgtcgctaccaggacgtggtcgtactcccccacgtccgccacggacatgatggccgtgtgctcgtggcccggcatgatgaggtcgtcgtgaatctcgtccgcaacgacgatcacgtcgttgcggacgcagatgtcgagcagctgcctgagctccgcggggctccacacgcgtccgacggggttgtgcgggctgcacaggatgagcatggtgttggcagggtccttggccttggcctccaggtcctcgaagtccatccggtagtacggggtgccgtcgtccagcgtggtgcggacgagcgggttcctgacgatcgtgcgtccctgctccgtgattgacttgaagaacgggtagtacacgggcggctgcacgatgacgccgtcgcccggcttcgtgagcgagcgcaccgcgttgaagagggccggcaccacgccagccgtcggcacgatccagtggctttccgcctgccagccgtgcctgcggcgctgccagctcacgcaggcgtccaggaactcgtccgtcgggtccgtgtaacccaggacggcgtcctcgagccaatcggaaattgcctgtttgatttgcggcgggttcttgaactccatgtctgccacggagagcggcacgatgccaaagcccagctcaggggccttcctgtacatgtcgtcccactttgcggaacccgtgcccgtgcgattaaggcgcgttgtgaagtcgtacttcatgttgcctcttatcctcttaatcgtcgcctcccggcgactttagtcctgtattacgggcaaccggatatgggacattgttcctgacggcgggggatcgcgtgatgcttgcgccttgggacctcgatctcttc

SEQ ID NO: 141 - DNA, 3045 bp, Unknown
  Metagenome-assembled genome
ctcgttctgcgacatgccgcgatcggcgagctcgagcacgagcttcgcccttgccttgttggccatcctgtctcctttcctcggtcggtggccttggaatggaggctaggtggcggtgctggttgcgagattgatatatcgatacggggtggtgcacctgccgagagcggcggtgctctttacgcgaacggtggtgctaatcgcggagaataatcatctgccacggcagattgtctgttgtgcctatcgcttgcctcttcctaagagagcgtcggcgaactcgtcggacacctccatgtcgttgtgctcgaagttccaggccttctccctggaccagctgactccatccttctcgtagagggcgcctactatatcggtaagctcccccgtcgcatagtctgtaatgtaaccggcagcaataccgattggctcgacgtcgctcattgcagctagaatctcagtattgtctgcccgtggaacgtgaagcctcggactcttcgactcgttcatgtagatcattccgcactcctcggatggaaactgacgaaagcgcctctaccttcatcgccgactctcatggagccatcttcaacaacgtaaagcgtgtcgttcggagccgtcaccgtaacgccgagcctgtccgcaagttcctgggcgatgcagctccccttgctgtcaatcttacccgttgaacaggcaagcagtcgcacgtcgccgccgccgtagtccttcctgccgcgaatgaccctcgccagcgtcctagcatcaatgtcggagttaaagcactttaccgacgcgctgcttccgtggcacttggttgaacggcgggacgaaatcagcccgccgttcaactgcgccttgaggtcggccaccttggcctcccactcgcggcgctcgcgctcgtacttcgccttcgagatgccctcctgtccgtggctgtccttgatggactcgccgccgtcgtccttgggcttctcatcgggctcggtcttgggctcctgctcgggctcggtcttgggttcctgctcttctgccatgtgcctctccaatccacggtttgtttgtgcgcttccctgcgcggctgtggtggcctgtttgcgctggccgggcgtcgtggcccttttacgctggccgggcgtcaccgtggatggtctgacggcggtaacgggcacgaaaaaggccgccccgaagggcggcccaccaacgaacgattggctaggagcgttcgaagagctcacttctggaacgcgacgtcgatcaggtcgtacatcctttccctctcgtccatcactctctccccgtgctccgtgagcccgacgtcagcgcggcagtgcttcaataccgcatcaggtatggcgtcgcatgcgtcaactgcttcctcttcgctcatcgagtgccagtcattcacatgaacgccaacgttctcgaacatttctatctgctcgtccgagagtcctatgtcagccctttttgctgccacctctgcccttcattctcttttttgacttgaatacactacatatcttacccgtagcagggtcaaacgcgactatcgtcccgctctttgagcggtattttctgcttgggcgtccgttgtcgtcgtactccagctccccaattgacacggggtttgtcagcgcgtcgattatttcggcatccgttatccctctttccgccgcccttgccttcgcgtgcgcagtcatgtcccgttgaacggcgggacgaaatcagcccgccgttcaaccttccctagccgcggaggatcacgccgacgaaccccatgacgaagccgacggcgaccgcaacaaggaggtaaggccacatcatcctcaggtagtctctgaccatttcctgtctccatcccacgttcgcatatcgtctccatacgtgtatgcgtctgtcagcgtgatgtggtatagtgcttttagtagcctgacttttactccttttggggttagagccaggctactcttttaccaagatgagctgctttccatgacctatcaggaatgcacttccaagatttctgctccgaactgtccgctcgacaaacttgcgcgcctgatcgtcagttatggttgaacggcgggacgaaatcagcccgccgttcaacagagtctcgaaccaatctcgatactctgcctcgacggaacacacgcgccgtcctctccatctaggtcgcgcaccacgaccttgtagtgaagaccaagtatattgacctcacctggaaccgtcatcgcgtctccaattcccatgagagaggcccaccgtctccgatgggcctccgctttcgaactgcaatgagaatcaccagttacaggcgctccttgccagcaatgttggggccgccgatacaggcggcccctgcagggaatccggaattgagcaccggagtctcctcaaccaaggcgttctcctcactgaactattccctactccaagtattccacaactcgttgactctagacaccatttccttttcctcggttgtcaacctgcttgcgcctagtttcgaactctcagactcattgtgcagatatccatgatgcacatgcatgccgattcccttgtggttgaacggcgggacgaaatcagcccgccgttcaacatggcatggcggaggacatcgagaagatagcgagcggatttgtcaaagacggcgtgcttgactcggtgaccatgcttacggcaatgaaatgaggtcagtgacaagcctcggttcctcaccgggggccactgacctcactgagattataccacactcgcggcctggcggaacaggcagacgcacgcgtgtcggcattactttgatgttgttgatgttggcggcccctcctagacgaggtccacggcggcgccgaaccgtatgccggcgcccatgcccgcgacggaggcggtgagggggtactcccatcccctcccctcggactttacgcgactgccgggcgtccggtcaaccatgtgcgcgagcctcgcgtcgcgcgccccgcggcgggaccgcgagagggactgctcgcgcgtcctgcggggcacctccctgcccga

SEQ ID NO: 142 - DNA, 2130 bp, Unknown
  Metagenome-assembled genome
gctacgtgtcgtaccgcggcacggacctcacgctcgccggctggcgcgaggacttcatgctgagcttcgaggtcacgggcgcgcagctactcgcaagggactacctggagcgcgcgctgacgcgagccgcccgcgcggatgccgccgtgctcgtgggcggccactccaagggcggaaacctcgcatcgtacgccgtggccaacgtggcaccggagctcgcggcgcgcgtcctgcgctgctacgccttcgacgcgcccagcgtggacgcacgcgtggccagccgcgacgcctgcgacgtccttggcccaagctacgtgcgcattcagccggaatacagcgtgatcggccagctgttcgaccgcccggacgagccccgctcctacgtgcggagcttcgggaccggcctcatgcagcacgacccgctctcgtggcaggtaaccgcaagcggcttcgtccgcgcggccgggctcgaccccgacgcacgcacctttgacgaggcgcttgacgactggatgtcgcccgttggccccaaggaccgcgagagcttcatccgggaactgttcgacatactcggcgcgggcggccctctgctctcggacgtcacgtcgcgcgaggggctccccaaggttgtggcggcggcaaacgccgcgagcgagaagaacaagcgccttgccctcaacctcgtcgggtcaatcgtgtcaaagcaggttgacaggacgcaggccgtggtgcgcggcgcgtacgccgatgcagtgaaggccgcgcgccaggcggcagccggcgccgcggagaccatagcgagcgcgctgccccgccggcgcgagggcgacgcgcgctccgcggagagtcgcgactccggctgaggcgccccgcgcaattgccccttccgtaacacaacggatgctttattgcggtaaagtatctgccagaacggaagggcggccgcaggggggcgaccatggacgaggcgcagcaacagagacttcgcgcggaggaggagaggctcttctcggcctttgggaccatccgcaacgcggacgaggcgcgagccttcctgctggacgtctgcagccccaaggagatcgcggacctcgcgcagcggctgcaggtcgcgacgcttctggccggcggcgcgtcgtacgtggcggtgtcgcggcagacgggcgcgtcatccaccacggtcagccgcgtgtccaagtgcctcaacgggtgcgcgggcggctaccggatggtgctcggccgcatcggtgacggggacgtcaacgcggacggcgacggcaattccggcggtggcaccgccccgggcgcggtgtccgagtagcctcgcgggccccgcgagctttgcgcgcgcgtgttccaaacgttacgtgcttgtagcattttttatggggacgcgcccgtgagcagcggcttcccttaatataaggtttggtaaaggcgggcgtcgcgccacgcgcgtgccccgcccaagcgcccgtcgcgcagcgcgaccggggcgcgatgccaagtcacatacccgtcagaacgtgttgcaagccggcgcgcgtccagcccgcgggcaaggtccgcacggcgcgcccaagaaaggatccgatgccatgcccaacatgatcgacatcgtgcacctcgacaagtactttggcgacctgcacgtgctcaaggacgtgaacctctccgtaaaggagggcgagaaggtcgtgctcatcggaccgtcgggctccggcaagtccacgctcatccgctccatcaactggctggaggagccctcgggcggcgaggtccgcatcaacggcgagctcatgaccaagaagaaccacctcgagctcacgcgcaagtacacctccatggtgttccagcagttcaacctctatcccaacatgacggtcatgggcaacctcacgctcgcgcccatcaagctgcagaaggtgagccgcgaggaggcggaggagaccgcgctcgcgagcctcaggcgcgtcggcctggcgcacaaggcggacgagtacccgcagaacctctccggcggccagcagcagcgcgtcgccatcgcgcgcgccctctgcaccaagcagcccatcatgctgctggacgagcccacctccgccctcgaccccgagatggtgagcgaggtcc

SEQ ID NO: 143 - DNA, 64043 bp, Unknown
  Metagenome-assembled genome
tcgcgcggcacgccaacgcgctggcggagcagctgcgcgacggcctggtggccctgggatacgagccgtacggccactcggcctccaaccagcagttctttgcggtcacggccgagcagcaggccgcctttgagcaggccgtgggctgcgagacgttctacgtgctggacgacggccgccgcgtcgtgcgctttgtcacctcatgggcgaacgaggagcaggacgtccgcgacctcctggccctggcaaggcagatcgcctaggccgcggccgaggtcgaagcgtcggtcgtggtcgcggtcgagcttgtggccatagtggaagccgagcccgagctcgcggctgtcgacttctgcgcggcggccgccacgagcttggcgtaagccttgcgcccagccttggtgagcgacgcgccgtcggacgagaagtacgcgtcgtgcccggcggacgccttgtaccagtccacgaccgtcacgttcttgcggcccttggccgccgccttgatcgcagcgttgttcgccttggcgtacgcggcctgcgagcgacccgtcaccacatagaccgtcacctttgatccgatggcgtccaggagcttggcgatgtccctctcgtcaaacggggagccgtcgtccgggtccaccaccacgacgtcgcccgccgtaccggcctttacgtaggccttccagctcttggcgcaggcgtccgcgtcgcgaccggacgcgcagtcgatcatggcctgcggcatgagggcgctgagctccttggacgcggcggacgtggtcgcgtcgcccagcaccacggcgctgtacgtggtgttctggcgcgttggcttgacgtagcccgtggtcttgacgatgaggtcgatcaggttctgggcgtactgcgggcgcaggtgcgtgccgtcgtcccagaaccagtcgtcgtgcccggacgagtaggagtaccagtcgatcacgcccacgctcttgtgcgcgtcggcaaagctcttgagcaggctgttgtttgcgtcgcaccaggccttgggcacacggtcgttcacaaaccacagcttgcgcttggtgcccacggccttgtagatggcgtcgaggtcgctctgtgtgatggcaccgtttgacccgatggagaagattaccgtgtcgcccacgacgcccttggcgctgtacgacttgtacacgtcgagcgcggccgaggcctgccgtcccaccttggcgtcgatgatcccgtacgggaaggccgcgttgaaggcgtcctttgcgccgagcgagacggagtcgccgatcatcaccacgtcgtacgtgccggacgtgagcggcttgaggagcgtggccgagctcacgcgctgcgcgccgggggcgcctcccacggccgcctgcgcgggcacgagcgcgaggcccagcaccgccaccaggcacacggcagccggcagcaccgcgcgcggcgtgcgcgcgagcgcgtggcccagcgcggccaggcggccctgcggggcggcgtcacgctggcgctcgcgggggttgcgggcggcgccacgcggggcagcggcccgaccggacgtgcgaggcgtggcctcgcgacgcatcgggcgagaaggacggccctccccctggcgacccgccgcgaactccgcgcgagtctcggctgcggccctggccgcagccgccggtgtgacgggcttggcgagcgcgcggaaccactgcgccacgctccccttgcgcagcggctcctcaaccaggcggtagctgagctccgccaccacgagcacgagcgcgagctcgagcacgacctgccacgcgggcagcgccgtggtggcgttgcgcggctgcagcagctccacgatgggatagtgccagacgtagatcgcaaacgagcgcgagcccacccacgcgagcggcttgacggaaagcacgcgctccgtcacggtgccgtggggcaccagggccgcgatggccacggcgctgatggccgagcacagcaggatgccgccgtagtacgagaaggacgagtacccctcggtcgtgaccatcagccagagcagggccaccacggagcccgcggccgcaagctccgccaccgggcgccgccacgaggggccgccctgcacggacgcctggctcttctcgccaaacggccacacgaacgcgagcaggctgcccaacagcaggctctgacagcgggcgtccgtgccgtagtaggcgcgcgacgggtccgcctgcggcacgtagagcttcgccatcacgacggcggaggcgatggtgcccagcgcgaggccagccacgattgcggggtgcccgcccagccgcgcggcgattgcctgggcacgggggctgcggacggtgccgcgcgcggggtcgccgcgggtgccgcgtgcctgcgcgcgcgtgcgcgaggccctcatggcgagcagcagcacgacgggccacacgaggtagaactggaactcgatcgcgagcgaccagaagtgcgtgaggggcgagggcgcgcccgccgccgcgaagtacgactcgtgccgcaggatcttggcccagttgaggaacatgaggagcgctggcacgatgtccgggcgcatcttggtgagcagctggtggttgaaggccgtgcagaccgcagccgtcacgataacgaaggcgatgcacgtgggcagcaggcgcttgatgcggcgcagccagtaggagccgaggcggatggtgcccgagcgcgacagctcggagagcagccccgccgtcgcaaggtagccggaaagcacgaagagcacggtcacgcccagcagcccgccgccgcaccagctgaggcccatgtgatagaagacgacgcccagcgcacagatggctcgcaggccgtcgagcgacgtcacgtagcgcttgcccgacgccgggtgctccggctggcgctgctgcgccggacgctgcggcggctgcgaccgcgccggacgctgcgactgttgcggacgccttgcctgctgcctcggccttgccgaagcggcaaggcgcgcctccccgttgggttgcgccggcctgccctgcctcgtgcttccgcccgccatgtgcctaccttcgcgtcacgcgcatgcaactatccacataccataaaacgaagacattctagcagtctagtgggcgcaatccagcaggtcagacgcgttatgtggaacaagtttcatgcaaaacggctcgcgcatggcgcatgtgagcaccgcatcgcccaaaagtcgcgattgcagctcccacccctcgagcacctccgggtgcttgcgggggtccacggcgagccccgtgcccatggccttgaggatggcctcgcgacgggtccaggcgcgcgcgtaggcgatgcgtccctcgcgcgtgctgccgtcgcctatggccgcgagctcgtcagcgtcgtagtacttacgggccaggagttcctccacgtggcggtagcggccgggaacctcctccacgtccacgccgacggcgggtcctcccacggagcccatggccagcaccacgaggccggcgtcgttggagaggttgaactccggcgcacccgaaacgctcggcttgccgtactcgcccagcgtgaggtcctcgtccgcgcgcacgcccagcaggtaccgcgccagcaggcccgtgcccagcgcctcgagccggcgcgcctcgggacccatgttcgcgcgctcgcgatagcgcggtgcgatgacctttctgcaggcatcctcgagccccgccagcgtggcggtctcgagcacgtgcaccacgaccttctccaccgtctgccccctcacgcgagcggaatgtcgcgcatccagccccagcgcggctccgccgtcacaccgtacgcctcgtaccagagcgcgagcggaaccgtgcgcacgccgcggtccgcgctgtccatcaccatgccgtcgcccacgtagagtgccacgtgcccgtggcggagcgccgcgggactgtacgggcagctggggaccgccacgatcatgcccacgcgcagctcgccgggatcgctcagcttgcagtggcgctcgtagagctcgcgggcgtcgcccgcctcgcgtcccaggccggaccacacgaagacgtcctccacccacgcggcgcacgagtccgccgccgtccacggcatgcccttggcgtgcgcgaccacgctgcgctgcccgcgcgtcgcgtccatcaggcgctcgggctcatgaccagacgtcacgttcagccggcgcgcctcgagtccgcggtcggcaaggacggcgtccagccgtcgcacgcgcgggtccacaggccggacctcgtcgacgcgggacatgctcttctcgcccacgtgctagcggtagcgcttggcgacctcgatgaaggccgccttgccgtcgacgtagtccttgaaggcgatcgtgggatcctgcccgtggaagctcgcgcacagcccgcactggtcgcagtccgcgatgcacgggtacgtctcctttatgtaccacaggcggtccatgcgagaagagccctcgatgctgggcggttcctttgccatgggtgcgacgcctcccctagtggcccttgatggactcgaggaactcgcgggcgcgctccgtcttgggatggtcgaagaactcgttggggtcgccctcctcgaggatctggccgtccgccatgaactccacgcggtcggacacacggcgcgcgaagctcatctcgtgcgtcacgacgaccatggtcatgccctcgcgcgccaggcccaccatgacgtcgagcacctcgttgatcatctcggggtcgagcgcggacgtgggctcgtcgaagagcatggccttggggtgcatcgcgagcgagcgggcgatggccacgcgctgctgctggccgccggagagctgggccgggaccttcttggcctgctcggccacgccgacgcgcctgagcagctccatcgcctcggcctcggcctccttgcggtcgcggtgcagcacctcgacggggcccatggtcacgttgtccaggatcgtcttgtgcgcgaagaggttgaacgactggaacaccatgccgatctccgcgcgggtggcggcaagctccttgccctcctgcgggagcggcttgccgtcgatcaggatctcgccggagtcgatggtctcgagccggttgatcgtgcggcagagcgtggacttgccggagccggaggggcctatgagcacgaccacctcgcccttctcgaccttgaggtttatgtccttcagcacgtggagatcgccaaagtgcttctgcacgtggcggagctcgatcatgggcgtgctatcctgcttgacttcgggcattgcctgctccattcgaaagattgtgcctgggacgcgtcggcgctagacggggttctcctgcgcgcgcgtgacgaccttggtgccgctctggcgcgccatgcgcaccgcgagctcgttgattgcgtagttgatgaggatgtagatgatcgccaccacgaagtacacggagacgagcgagtcgtagttgctgatgaggaccctcgcgttctgcaggaggtccgggaagctcacgacgtacgcgacggacgtgtccttcacgacgacgaccagctgcgagatgagcgacgggatgacgtagcggatggcctgcggcaggatgatcttgcgcagcaccttgccctcggtcatgcccagcgagagcgcggcctcgcgctggcccttgggcacggcgttgacgcccgcgcggaagacctccgcgagcacgcccgacgccgtgagcgagatgggcagcgtcagcatccagaacgcgggcatctttatgccgtagctggggatgaccaggaagaagaagtagatcagcagcagcgacgggatgcccctgaagaagttgatgatcacgcggaagatgccgctcacgacgcggttcttgctgatgcggccgaacatgaacaggatgcccagcgccagcgcgatgacgccggccgtgacggcgacctccgccgtgcccgcgaggccctggagcaggaagcgccaggtgctccactggccaaagaagtaccagtagctcgcgtcgaactgccccatctggtatagcctgagcacgacccacacgagaatcgccgcaatggcgatggacgagatgatggtgccgacgaggatcttccgcttggtctttggtcccggtgcctcgaagagcgcatcgcgcatcgagacgcttcctgacgacgcgctcatctgaggatcctcactctcttgtcgatggcgttacccgcaaggccgatgaggaacgcggttcccgcgtagagaagggcggacaccgcgaacggcaggattccgcccacggacatcgtgttgatgtacgagacgagccccgtgagctcctgcgggttgagcggcacctgcgagccgatggccgtggtgagcatgacggcgaccagcaggttggtcatgggcagcacggccgatcgcagcgcctgcgggatgacgacctgcctcaggatctggccaaagctgagccccagcgagcgcgccgcctcgatctggccaacgccgatcgtgttgatgccgctcatgaagttctcggacccaaacgacgcggcgaccaggatcgtggtcacgatgacgcaggtcatctcgttccacacgatccccaggtacgggaaggcgtagtagaagatgataagaagagaaatcgtggcgacgttcctgaacacctgcacgtagaagtcaccaagccggcgcagaggcgagatgggacacacacgcgcgatcgtgaccaggagcgccaggaccatcgcccccacaaacgagacgacggtcatctcgagcgtcgcggcgtacgccttcacgtacataccgccatacgtcgagaagagctgctgtaagctcatgcacacctcccgcaataagcgcggaggccaccgtgcgtgcacggaggcctcctcgtagcactagtctgactgtaccctcatgcggcgcgcggcaacgcaccatcatcagtgttggaacagtcacgaaacgtggtcgtccctagtcctcgatcgcgggcggcttcggggcggtcttctggccgatgcggtcgcccaggcagaccttccagagcttctcccacacgccgtcgtcctcgacctgctgcagccaggcgttcacgaactttgcggcgtcggagtccttgggcaggccgatgccgtagttgtccttcgggccgatgagctgcttgagcaggcggtacttgcctgggtgcgagatcatggagcccatctgcatggtctggtcgatgatgtaggcgtcaacgcggtgctgctcgagggcggcgcgcgcctcctcgtcggtcttgtactgcttctggaccgccttgggcacctcctccttcacgatgctcgggccggtggagccggactggacggcgaccttcttgcccgcgaggtcgtccacggtcttgatgtccgtgttcgaggcgagcacgaggatgccctggcgcgaggtgaagtacggacccgcgaagtcgatcagcttcttgcggtcatcgttgatgctgtacgtcgcgaagacggcgtcgacctggtcgttctgcagcacggactcgcgcgtgtcggacgtgacctgcgtgagctcggtcttggaggaatcgcccaggatgtaggcggcgagcagctgcgagaggcctgcgtcgaagccgcggagcttgttgtccttctcgtccagatagctgaagagctcggaggtttggacgccgccgacgcggagcttgccggccttcttgaccttggacgcccaggtgttcgcgctgatggtcgcgtcgtcggcctgcttggtgctctgctttatcagcttgtcgtacgcgtcctggtccagcttgccggacgtcttggacgaggaggacgagctgctggaagaggagctggagccgttggagccgccgcatgcggcgaggccgagcgccgccgccccgccaaagccaagcgcgagggcctggcgcctgctgaacattgccttgtcaaggggattctggattgccatgtgggttccttcctttgggattccctccgcccggtccctcccaaggtgccgggcaacgcacctgcgcggacggcccgcgcgactttggttgaatcctagctgtttgctaggaaatatgtcaacctcgaccacgccccgccaaaaggctgctttgagctgccgctcagcgcgctaacaggttccttctacccagatttggcacggttcttgcatatgccgtttgccataggcggttatcggcaccgccgatagcactggtgacggacccgtggcgacagctgccgttcaggcaccgccgcggccccggaactacaatgcaaaggtcaaacgtgctgttcgtaaggggttcaaccacatgcagggaacagagaagtcggcggtcttctgtccgctgatacttgggtgtcttgtcgcgctcgtgctcgtcacgctcggctatgtcgtgctcgacggcgcgctcctcgcgcgtgcgtccgcatcgggcgagaagaacggctcccccgtgcggcgggcccttcggcacgtgaggcccagcgtgatcctctggtccctcccctacctgggcatcctcaccttcctctatatatggtgcgcccgcgggctctactccggcgccacgggctcgctcgacgtgccgctccgcgccacgctcgcctgcgccgccgtcacgctgccgcacctgcgcatcgtctccctcgtgcggagccgcctgggcgagcgcgccgccttctgggtggggctcgtcgcgaacgtcgccctcatggcggtcgccgtcaacttcgcgcgcatcgccctcgagtgcccctggaacgccgactggcaggacatcgccctgcagttcgtggccatcgagtacgtgatcgtccttctcggcttcctcacgctcttcttcctcttccagtgtcgcggcggtgccgtggccgtgggcgtcctgctcatgctcgtgctgggcatcgcgcagtacttcgtcttcctcttcaaggacgccaacatcacgcccgccgacctgcaggccatcggcaccgctgccgaggtcagcggcggatacgtcttcacgatcacggccgccgtggccaaggcgctcggctacgcggcggcgggcgtcgcctgcgccgcctacctcgcgccgctcgagctccccgcacgcgaggccgctaccgagcccgtccaggcaccgcgccacgccgctcccaccgccatgccagacgacaagggcacgggcaagggcgccggctctgccatcgggcgcgccctcgagcgcccagccaccaggcgcacggcgctcggcctcctcagcatgggcggcctcgcggccttcgtgacgatccccggctacggggcggactttggggtcagcctcaaccactggaactcgatgtacagcacttctcgccagggcttcttcccctgcttcgtgaaggagttccaggcccgcctcatccccgtgcccgccaactacaacgagcaggacgccaagtcggtcgagaaggacctggtgtcccagtacgcaaagcgcctcggaacgggcgcatcctctgactcgggcaccgcgcgcaaggcggccgtggcccagttcaagaagaagcggccgaccgtggtcgtgatcatgaacgagtcgttctcggacctctccgtgtacaagagcatcagcgccgccggctacgcgggccccacgttcgtgaagacgggcctcaccaacgcgctgctgcgcggcgactcctacacctccatctttggcggcggcacctgcaactcggagttcgaggcgctgtgcggcgtcaacctgcactacctgggcgccaacaagtacccctacacgcagtgggacttcaccaaggtgccgtgcatgccgcgccagtttgcggccctcggctacaagacgtacgccatccatcccaacgaggccaccaactgggaccgcaagcgcgtgtacgagcagatgggcttcgacaggttctactccatcacggacttcgtgggcgcccagacctaccacaacggctacgtgagcgaccgtgccacgtaccagaagatcctcaccctgctcaagaggggctccacgccggagttcatccacaccgtcacgatgcagaaccacgggcccttcaccacgggcaccatccccacggcggacgagctcgactacgagcccgagggcgccagcgcctccgataacttcatgctgaacgagtacctgtcctgcgccacggagtccgaccgcgccatcgagtggttcctgggcgaggtcggcaagctcgaccgtcccgtggcggtgctcttctttggcgaccaccagcccaagcccgcgagcccctacgcgaccctgggatacgaggacgagtcctccatccagatcgcggagcgcatgtaccacacaacgtacttcatgtgggccaactacgacgtggccggcagcgaccagacgagcgagaccgaggacctgcccgtgagcgccctgggagacgagctcatgtaccgcatcggcgcgcccatcagccggcgccagaaggccaacctcgcctcccgcaagagcctgcccatactgagcctcatcggctaccaggacgccaagggcaactggcacgagttcacggacgcggacgacgagaccatcgcctcgcccagccagaccaagaacgccagcgcggccaggcacatggacagcatgatggcctacgtcaactacctcaggttcggcagcatcgtcaactagggccggctcggctagggccgccacacgtccgcggcaaggcgcatgcggctcccgtcgcgctcgagcacgccgtcgtcctccatgcgtcccagctcgcgcgacatcgcgctcctgttggcgcctatgaactgcgcgagcgccgtctgcgacatgggcacgcgcgcccagccctccgcatccgtgggctgctcgcgcaggaacacgatcaggcggtcgcgcaggctcttctgccccaggatcctgaccttgcggttgaggaacacgctctgcgtcgacacgatgcgcagcaggttgcccaggagcctcacctcgggccccgttggcgactccgcctcccagagcggccgcacgtccagcagcactacctctgacctgcacatcgccacgagctcgatggggctcgactccacctccgcgcaggcgaaggccgcaccaaagacgtcgcccaccgtgaagcgcctcacgctcacgtggtcgtagcgctcgctgtcgaacgagccctccacctcgcctgacatggggattcccaccaggcggaacggctcgccaaacggctggatcacgtcatcgcgctcgaaggtgtggcaccggcccctcatcaggccgagcatgcgcgggatctcctcgcgcgcgatccccctaaagagcggccccgccgccagcgtgtcgatgcagtgctcgtagcgcctccgcgcgtccatcctgcctccagcccgcgccgccaaggacggcgccacgttcttctcgcccgcgtgagccgcccgcggctacatcctgattgcaccaaaacgttgccattgcaacacctcgaatgtagccgtagcggaacaaaagcgcaagccgcgtcatgggtacattacgcattggtaagccgcacgcccggcgccgcgggacgcccgctcgggagcactagactttccacgtcgccgtcgcgacgcacacgatcaaggctggcccgtccggcgggccgaggcagaaaagagggcccatgcagggcaacaagaatatggacgagaagaacgagggtcttggctcggagccgcgggcccaggtgcccgtgtaccagcgcggacccgtcatcatgcgcggcaagatggtgcccaaggacaccacgaaccagcacctcctgacccccagcgcggacacgtcgtggctgcacactgacccgtggcgcgtgctgcgcatccaggcggagttcgtggacggctttggcgcactggcggagatcggccccgccgtgacgatctttggctcggcccggaccagtcgcgacgacccctactacgtggccgcgcgcaaatgcgggcagctggtggcgcagcagggcgtcgctgtcatcacaggcggcgggcccggcatcatggaggccgcgaaccgcggcgccacggagatgggcggcagctccgtgggcctgggcatcgagctcccccacgagcaggcgctcaacgagtgggtcaacctgggcatgaacttccgctacttcttcgtgcgcaagaccatgttcatgaagtactcgtcgggctcgatcatcttcccgggcggctttggcaccctggacgaggcctttgaggagcttacgctggtgcagacgggcaagtcgcccaaggtgcccatcgcgctgtttggccgcagctactgggaggggctgttcgactggctgcgcgactccatgctggccgacggcaacatctccgccgaggacctgaagctgttcaagatcacggacgaccccgtggaggccgcgagcatcgcgctgagccagctcgagggcgcgtagggcggaatgacgcgaagcaaacgccagggcggcatcgcaaaacgtgatttgcgatgccgccctcttttgcatttgcgcaggtaatcagcatgagacaccaaatcgcacatcgcgttttgcaatcttgggccaccacccgtgtcagcctcgctcggtcacgacaacgtggacgctgccgtcatacggcacaccgtcaaacgtcacgtgcaccttcgcacggccgcaaccgaactcctcgcgcacgtcccatgggaagggcgcgtacgcaccgcctggacggtccgtcgcgcatatggtcgcatcgtactcgtatcgcttgcgcacggttgcctcattttttccgataaagtcgagaacgatgctaaacggcaggtgatgcacacgttctagacatagaatgtgatgtcaccatcgaaatactccgaccagtagtcgcatatcgttctatggtttaacgctatgaagctcattacatacgaaagttcgtgcttgctcaggccacttccgttactcgcgagttgacagccaccagaacgcgtcagccaaatcttcgttccgttccgcgtaggtttcccacgagagacatgaacatgcaccggctcgccattttcagctgtccaaaaatatatagtgaaccctctgaacgaaaagagcttaggcatacgactgcgattcctcgtaagctaggtgcatgatgagaggtgcattatcgtgcacgaactggtcaaggtcagaaagctccttctccgtaaacccctctacaccagtccattcatatgaaggcaaaatgcatctcgccgagtcgaagccaccttcgactggccgttccacggaaaccttcacggtattgtcgggcaggatgttcgagaacgcgaccaccgtcccgtcgcgcagctcagcataatcaaaatacatgtgtgcctcccctcgatggaatcatacccacgagacgcgaccgcgccaagatgcgttttgttcgcggctaacattgcacgacacgacagattcttccgagataccaaatccgtttctggaagacccatcgttttgcaaacccgcaggtagacgagttgacccccggataccagaaacttttctggaatccgggggcctcaatcgcgatgtcggtcgccatgcagcgccaaccggggacgctgccgtcagccgcagcggcgtctacaccagaagcgacgcacccacgaggccggcgtcctccccgcacgtcgcctcgcagaagagcagcgcgtccgggtcgagcacgtagcccttcgccttctggtacacctggtcgagaaacgcggggttcttgagcgcgaccgagccgccaaagacgaagacgtccgggtccacaaccgcgttgatgttgttgacgccgcgcgcaaggcactccgccgcatggtcaatcacggccagcgcgtccgcgttgccggcgtctgccagcgcgaacaccgcgggcgccgtcacctcgcgacccatgcgctcgctcgccatgcgcgcgatggccgtgcccgagctctggtcctccagcgcgccggggttcatgcccgggcgcgccaccggcgcgtcgcacacgatcatgttgaagacctcggtcgcgagcgagtgcgccccgcccacgatcttgccgtcctgcacgtacgcggcgcccacgcccgtcgagacggtgatgtacaccacggacgagaagttcctgcccgcgcccacgagggcctctgccagccccgcaacgttggcgtcgttgttgaggtgacacgggtggtcgcagcgcctccggaagaagtcggccacagggaagccctcccagccggggaggttgggcggggtcaggatctggcccttctcgaagtcgagcggcccggggcagccgatgccgatgccctcgtagtcgagcccccacccctcgatggcgtccacgagcctgccgaggttctcctcgggacccgcgctgtgcacgttggggaaggccgtcctcttgaggatgttgcacttctcgtccagggcggccacgcgaagctgcgtcccgccgatgtcgatgccgatgcgcacggtcatggtgcgctcctctcgtcaaatcgttgccacgcccgcgcgacgctagccctccggccagctcacgacgagctccatgtcgccctcgaagtcgaggtcgccggagccggccggcgccacaaagtgggagccgagcctcaggtcccagctgcccgccggcgtcgtgaccttgccgccctcgccgtgcaccacggacacgcacacgaagtcgtgcgtctgcggcacgcgcgccggggagccttcggccacgcgcacgcgctccacctcgaagttggggcacgttcccagcacggtcacgccgtccttctcgggcgccgtgacgtcgccgctcttggggagcggcaggctgaagtcgaccacgtcgagcgtctgcggaatgtgcagctcgcgcttggtgccgtccgcctggacgcggtcgtagtcgtacacgcggtacgtgacgtcgctcgactgctgggtctcgagcaccacggtgcccgcctggatggcgtggatggtgcccggctcgatcatgaagaagtcgccgcgcttgatgggcacgctgtacaggaggtcgtcccagcgaccctcctccaccatcttggcaaactccgcgcggtcgtgcgcgcgctggccgaccacgatcgtggcgcctggcttgcagtccagcacgtaccagcactcgcgcttgcccaggctgccgttctcgtgctcggcggcgtaggcgtcgtccgggtgcacctgcacggagaggttctggcgcgcgtccaggatcttgatgagcagcgggaagcggtcgcccttggcgtcgccaaaaagctcgtgctcgtcctgccacagctcgctcagggtgcggccgtcgtacgggccgccctcgatggtgcagtcgccgttggggtgcgcgctgatggcccagcactcccccacgtcgccgtcggggatgtcatagccgtactcgtcgtgcaggtagcggccgccccagatcttgttgtggaacaccggcttcgggaagaggagcggctgagcccccgtggcctcgttcttctccattgatggtcctttccgtcgcgggacgcggcgcgcgccggtccctcgcctttgtctgatggtatcatccgcgattccgccgcctcccacaacgcatttccagatgcgtaggagagaagaacacgggcgcccagctggtggacgcccgtgttcggaggttcttcctggtgggaggcgcggtgccttgccggcgaagcgctacttctgcgcggccgcgagcttctggtagacgtccacgaggtcctcggccatgatgcggacggtctccgcctgcatcagctggtcctcggcgtgcaccaggagcagcggcaccttggtggagcccatcttctgggcgtcctcctgcaggagtcccatgtggaccttgtggccctcgaggtaggtctgcttcccctcctcgatgagggacttggccgtctcgaagtcaccggccttggccttctggatcgcgtcgatgaagttcgacttcgcacaaccaacggtcgagatgatctggaagcaggcctcctccatgtcgggctcctgctgctcgtccttctcctctgccatgtactagccctcctcgatggccttctgggcgtcggccaggatcttcttggcgttcatgcggccgtagtcggccatcgcgatgacgcgcacgggggtcttgccctccgccgcctccttggcgtcgcccagtgcgtacttgatctggggaccgagcatgaggacgtcgtagtccttcacgtcgtccagcgcggggccgagcggctcggcgtcgatcgtggcgtcgatgccctgtgcctgggcctccttgcgcatcttctggacgagcaggctcgtggacataccggcgttgcaggcaagcaggatcttcatgtctaccatttcctttcttggaacggcggggccttcttcggctcccatatcacacgttaggacaaatgggggggtgaggcaccccgtgacaccgccacgaggtgcctcacaaagggggaatgggaagtcgacgtcaggaacgctaggcggtctgagccgctgcctttgcatccgcgtccttctcggcctgctcggcgagctccatctgcttcttctgagcgcgctcggagaccttcatgaacggcaggtagatgagcatgccgagtgcgaactcgatgacctgccagatgatggccacgacgccggcggtgccaccgccaacggcgaggaagccggagatgaagaccggggtcgtccagggaaccatgacgacgcagggagcgaggatgtgggcgcaggtgagggcgtaggtgaggccgatgaacagatcggggatgaggacgaacgggatcatgagcggcaggttgtagacgatcgggtagccgtagatgacaggctcgttgatgttgaagatgccaggcaggacggcaagctttgcgatgtccttggaggccttgctcttggagaacaggaaggtgtcggcgaggagcatcagggtgcagccggagccgccgatgagggcgaaggtattgatgatctgcatgttcatgtagtgatcggcaggaatggtctggccggcggcgtacatggccatgttctcggtgatgaggatggtgaggataggctcagcaaggacgccagagatcgtggactggtgaatgccgaggcagaagagcaggttggcgagcgtgtagaccaggatgatgaaccaaggaccggcgttcacgaagcccttgaggggcgcggcgatgcaggtgttgatgagcgtcatgaggtcggtcgcccagagggcgtggagaagtgcggcgacgacgccgaagatggtcagcgtgatgagcatcgggaacatggtgttgaacgtgtcagcgaccgcgggcgggatgccctcgccgaggttcacgcgcagcttctcgttgttggacagcttgatgaagatggtggtggcgacaaggccgatgatgatggcgccgaacaggccgttggtgccggtgtaggtcttggagaaggcgccggagacgttgtcggagccgacgctggtgagctggtagcccttgggggcgaccttcttggcgatggtgtcgtacttgacagtcttggtcttggtggtgtcagaggtgctggtgtaggtgagctcggtgatgtcggagatgcttgcggtggcgctgctcagggtctgcggcatcatgatgcagagcgctgcgatgccgacaacgacgcacgcgatggcgttcttgaagcgcttgttgcgtgccaggcagtagccgatgatgccggcgagcatgatggtcgcgacgttcagcgtgccctgggtgatcgcgttgccccagtactgggcgttcgccagtgcgtcgcccgtcaggaacagcgggaagacgacgttgttaatcaggacggcaatgcctgccagaatgtagatcggcatgaccgtggcaaagccatcgcgcagcgaacgcaggtgaacctggttgccgatcttggcggagacttctgagaacttgtctaggaagctctgcttctcctctgctacttcttctgccatgattcctcctcgcggggaagctcccgcatattcacaggcacgggacgccttgcccatgccttactacctactaggactcgaagatcgtgtgggtagtcgcgactcgacgcagccagtccgcgctcttcttgtagtggcggctgtagttgtcgtcgaggttgacctccacgaatccgtagcggttcttgaaggcgttcgaccaggaccagttgtcgatgaccgcccagtagtggtagccacggcacttcgcgccgtcctggattgccttcgcgatccacttcaggtggtcgcgcacgaactcgacgcggtagtcgtcctggatcgtgccggtggcgtccttgctggcgttctcgccctggatgccgatgccgttctcggagacgtaccactcgaggtcggggtagttctccttcatggtcatcgcgaagtcgcagatgcccttggggtagatctcccagccgcggctcttgttcatcactgcgtcgggccagacatactcctccgcgaacacggggttgccgaactcgtccgtcttcttggacggggcctgcaccctggccgggtggtagtagttgaagccaagccagtcgacgggaccctgcttgatgacctccgcgtcgccgggacgctggccaaggtcgatcttggcgcggtcgaggtcgtccaggatgtcctgggggaactcgcccttcgtcacgaggtcgagccaccagcggttgtcgacgccgtcgaccacgcgaaccgcctcgaggtctgcctcgctcgggttctccttggtgtagggcggcgtgaagcagttgatgaggccgatcttggcgtccttgcgtacggtgcccgcggcctgcgcgagcctgaactcgtgcaccgcgagggagtgcgccagcgagatgccgtactgcacgcggcgcgcctcggcgaagtcgtgatggaacgggtaccacacggcgttggtgaagcgctgctgcggctccacgatcggctcgttgaaggtgaaccagttcttgatctcctggccaaactcgtcgaaggccgcgcgggcgtagttggcgtacgcctcgatgacctcgcggttctcccagcctccacggtcgaacaggtaggacggcatgtcaaagtggtacaggttcacgaagacgtcgatgccggcagccttgaaggccgagaagagcgcgtggtaatagtcggcacccgcctggttgagcttgccgttcttgtccatgaggcggctccactggatggaggtcctcacggagtcgaggccgaggtccttgaagatcttgatgtcctcgtcgcgacggcgcgtgaagtcgttgccggcgtaggagcccacgaggttgtagaagcccgtgatgtcctcgttgctccagcggtcccaaaggttcggcagcttgccgtaggcctgccaggcaccctccgtctgggggccggacatggccgcacccaggaagaagtccttaggaagctgggtcggaagctcttctccgctcatcttcatcacttccccttctgtcgtttgctcgcgtattaattgacatgtcttttatcacgtcaatctatgtcttccataaatcctacacgggaacgatttttacgcaagacccgtttttggaaacaggccgagcggtatatatatgtccttgagcggtaaaagacatgtcttctgctatactttatgttgctagtcgaagggagcagggcatgctgaagtacgaagcggtgatcaacgacatcaccgacaagattgcgtcgggcgtctacaagccaaacgacaagatcccgaccacgatggagctctgcgaccagtacggcgtgagcaagatcaccatcaagaaggccatgaacgagctcgagaaccgcgggctcgtggcgcggcggcgcggctcgggcacctttgttaagagcctgacgccgtccaacctgcccacgaacgagttcatgagcaagtccgcacagatgcagggcttcacgcgcgagcacgacaaccgcgaggggggcaccgtcagctccgtggtgtacgagttcaccgtggagcacccggacgccgaggtggccaagaagctctccatcaacccggacgagtttgtgtaccgcatctgccgcgtgcgctgcctcgacggcgtgcccctggtgatcgagcacacgtggatgcccatcaacctcatccccgacctgaggatgaagaaccttgagggctcgatctacggctacatagaggacacgctcaagctcaagatctcgagcgcgcaccgcgcgatcagggcggtcatcgttcccgacgacgagctggagaagctcgatgtacccaaggggagcccggccctcgaggtgaaccaggtgggctttctggacgacggcgtcgccttcgagtattcggtttcgcgccacgtgcgggactacacgttcttctcggtgtcgacgcactagggtgcggggctgctacgcgagcggcgtcatctgcctgggaaggccgccgtcgagcgcgatgggctccgccggccccacgagcgggcgcacgtagcgctcgaactcagcggtgacgcccataccatcgggcgcaatccacgcgctcgggacgggcttgacctggttggcgacctcgctcacgtccacggtgcggtagcgcacggcgtaggggtcgtcctgcgtgcgctcgagcgagcacatgatgcccgtggcgccctcgagcgcctcgcgcacgcccatgcgccccagctcgaaggcctcgtccaggtcggtcttgctggcacagtggctgccgcagcgctgcagcgtggagagctccaccgcgcgcgtcttgcagcccaggcgcgccttcacgagcgcggcgaggtagcggctcgcgccggagagctgcgccaggtggccaaactcgtccgtgccggtgccgggggcgacggtgccctccgccacgaggcgcccgtccggggtgcgcaccccctccgacgtcgcgaccacgacggtgttcttctcggcgagaagtgcctcgatccttgctatgagcgcgtcggcctcgatggggacctcgggcaggagcacgaggtccgggtgggcgaggcaggccgaacccgcgagccagccggcgtcgcggcccatgatctccacgaaggtgacgctcttgaggtcgtacacgtccgcgtcgcgcgcgacctcgctcacggccgtcgccacgaggcgggcggcgctgccgtagccgggcgtgtggtcaatctgcacgaggtcgttgtcgatggtcttgggcacgcccacgaagcggacgtcgctcccctcccgggcaccgtagcgcgcgagcttggcgatggtgtccatagagtcgttaccgccgatgtagagcacggccgagacgcccgcggcctcgacgcgctcgagcgcgcgggcgaagaactccgggtcggcctcgggatcgggcagcttgaagcggcagctgcccagccagctggcgggcgtgtcgcgcaggagccggagcgcgtcctcgttggggacggcctccgcgaggtccacggtgcgaccgtcgaggaagccctggatgccgaagcgcatgccgacgggacgcacgttcttctcgcccgcgcccgctatgacgccggcgaggctcgcgttgatggcgcaggtggggccgcccgactgtccgacgaggatgcgcttctgctgggacatgactctcctaacgttgtggttggcacgagtatagcgcggcgggggcggcggccgtcggctggcggcgcgcgttggcgcgcggccgaagtgggtagaaggcaggtaacttatggtggccgcgggagcggcggtttggaggaagcatgctgaaggacgtgaaggttggcccgtacctggcgccgatgccggtgctgatgatcgcgacgtacgacgacgatggcaccgtcgacgtgatgaacatggcgtggggcggcatctgcgacacggacaaggtggcgctcaacattggagcgcggcacaagacgtccaagaacatcgccaagcgcaaggcgttcacgatctccgtggccgacgaggcgcacgtgcgcgaggcagactactttggcatcgcctcgggcaacaccgtggcagacaagttcgagcgcagcggcctcaccgcgaggaagagctcgcgcgtggacgcgccggtgatcgaggagttcccgctgacgctggagtgcgaggtcgtggaggacgacgaggtcgtgagcgggcaccgcgtggtcggcaagatcgtgggcgttctggcggacgactccgtgctggacgcggacggcaagcccgacatctccaagctgcgcccgctgacgtttgacacgttccacagcggctactacgcgctgggcgagaaggtcggccaggcgtggagcgacggcaaggcgctgggcgagtaggccccgccgcgggccgggctgcccctaccggatggatgcccccagctcgcgggcctgcggcacgtccgtgacggcagacgcgtccaggtcgtccgtgtggagcagcacggcggtgcccaggttgcgccagcccatgcggagcatgaggtagtcgaagtgcgccagcagctgcgcgggatgcgcgccgcccgccgcaaccaggagcgctcccgagcggccgttgccgtggagctcgtccggatcgcactccgcgagcgcccagagccggtcgaacgcgttcttgagcaggccgctgtacgaccagaagaagagcggcgtcgcgagcaccaccacgtcgcaggcgcggtacgccgcgtacacgcgcgccatgtcgtcgcgctgcgtgcaggggtgggccgggtccgccccgccgtgcaggcagcccacgcagcagtggatgtcaagatcgcgcaggtcaagcacctcgacggagttgcccgcgccgcgcgcgccggcgcagaacgagtcgatcatcctctgggtaaagccacgcgggcgagaagagccgttcaacaccagtatgcgcgccatgctacctcccgggttcgccgtcctcgacaggcccattgtcgccgatgccggctgcgtccgccaccacgacgccctcgcggcctcgccactgcgcggggacgtcgcccgcggtcacgagcgtggcggcctcgagcggcgcgtacgtgatgaggctgcgcttgcccagcttgctcgcgtccgccagcacgtaggggcgggcgcagcgcgcgagcgcggcggacttgacggccgcctcgccgcggtcctgcaccgtgaagcccgcctcggccgtgacgccgttggtgccccagaagccgagcgtgaagttgtagcgcgcgatggcctccgtcgtgtccgggccgctcagggccttggtcgcgtccacgagctcgccgccgagcacgatcacgcgcaggcccttggccgcaagcacgagcgccgtcgacactgagttggtggcaaacgccgcgcgcgtgggcgcgagcagggacgcgagcgcctcgaccgtggagcccgcgtccaggtacacgaagtcgtccggacccacgagcgtggccgcgagccggcagatcgcgtccttctcgcccgcgtggaggccatagcggtcgggcagcgtgaggtcgcgcgtgaggtgcgcgcgctccagcgccatggcgccgccgtggaccttcaccaggcggtgcgcctcgtgaaggcggtcgaggtcgcggcggatggtggattccgacgtgccgagctcggtcgcgaggtcggacaccgtcgcgacgccgcgctcccccaccagcgccgcgatgcgcgcctggcgctcgtgcgcgagcactagcgctcctcggggtagaccacgccccagctgcggcgcaccttggtcatgacgtccatcacgtcggaggcgtagcccagcagggccgccttgctcgcgtcgccggccacggcggactcgaggtcggccatctcgtagcagagcgcgtagccctccacgccggcgcggacctcctcgcggtggccgtcggccgtccagacgatggtcgcccggtccgcgcgcgggtagtccataacctcgatgtagcagcggtcgaagctgaggaccgcgcgcttgggctgcttggagtggagcgtgaggctcaccacgcccagctggccctgcgcgttgcggcacacgatgccgccggcctcgtccacgccagtcttagcgaggttgcccaggctcacgacctcggtgggcgcgccgtccatgaagagccgcatgagcgagagcgcgtacacgccgatgtcgagcatggcgccgcccgcgaggttgatgttatagaagcggttggtgaggtcgccgtactccttgtagctgccaaagttgagctgcgccaggttcatgcggccaaactcgccggcgcgcacgcggcgcaggagctcctggtagaggggcatgtgcaggatcgtggtggcgtccatcagcaccacgtggttgcggctggcaagctcgcgcgcctccgcaagctcctcggagttgagggtgatgctcttctcgcacaggacgttcttgccggccgccagggcgccgcgcaggtagcggatgtgcgtgttgtgcggcgtggtgatgtagacggcgtccacggcggggtccgcatagagctcctccgcgctctggtacacgcgctcgacgccgtagcgctgggcaaacgcctccgccttggagcgcgtgcggttggccacgccgtggatgcggcggccggccagcgccatggactgcgccatctggttggcgatcacgccgcagccgatgacggcccacgtgagctgtggcgccgtaaagacgtccgtcggaaacggctggtctgccacggcggcaaacgcctcgctcgctgccacggccgcgtcgcgcggacccggtgccgcgtccttcttgcctgcgttgacctgcggcgttgccgcctgctgcgtagcctctgacatggctccgcccttctggcgcacctgtgcgcctctgctcgatagtgctcgaaactgctctccactgcttagtattgcgcgtttttgcacatttgcaagcattttcgcgcaaacgggcgagaagaacatcccgcgtggccctacgcctcggccggcgacgctagcatggtggctgaaagacgccgccggggatgggagtggccatgctacagctcgacgtggacgggaccgaagtaatcctctggacgccggagccggcgcccgcggaggcgctgcccgtcgtctacctgcacgagttcaagggcgacggccgcgacgtgtgggaggcgtgccagacgctgggctgcccgccgttcgcgctcgccgtcatacccacgcccgactgggatgacgcgctcagcccctggcccgcaccgccgacgttcaagggcgcgcagccctacgcgggcgaggccacggcgcagctcgactccctcaccggccgcgtgatgcccgccgtcgaagaggcgctgcaaccggcgcggccgtccctctccgcgcttgcgggctattcccttgcgggtctctttgcggcgtgggcgccgttcgtgacggacgcgttcccacgcgtggcgtccgtctccggctcgctctggtacccggacttcgcggagttcgcccgcgcgcacgagccggcgtccaccctggagcgcgcgtacttctccgttggtgaccgcgaggccaagacccgcaacgcctacctgcgcacggtggaggaccgcacgcgcgaggtcgagcgcacgatcgcggcgcgcggcgtccagaccaccttcgagctcaaccccggcaaccacttcaccgacgaggcgggacgcacggcacggggcatcgcctggctgctctcctgaggctgactgccccgtggcagccccgccctcgcaatcttgggcaagcggtgcgacccgtgttaaatcccgtttgcgcggcgccatgccactgccgcacccgcgggcggctgctagactcttcccaccacaccacgcagccggaaggaaggccaaagccgtgaccaccaacgcaagcagcgcgcccctcgtgaggcccgccacgcccgcggacgcggacgccgtcatcgcgttctacgacgacctgatcgacgagatcggcagcctccccacggcccccaactgggagaagggcgtctatcccacccacgactacctgcgcgagtgcatcgccgctggcgagttcttcgtggcagagctgccggacgccccggcccctgcggacgagaagggcactccccgcctagccggcgcctgcctgctgcgcctgggacaggacgaggagtacgaccgcatcccctggaaggtagctgcaagcccggaccagatcctggtcgtgcacctgatcgcgagcgccacctgggcggccggccgcggcgtcgggcgcgcgctcctggaccacgcctgcgacgaggcccgccgccacggctgcaccgtcgtgcgcctggacacgctcaccaccaacacgccggcccagcacctgtacgagcgctacggcttcgaccgcctgggcaacttcgacctcacctaccccaccacgggcacgatgcccctcgtcatctacgaactcggggtgtaggagcgggccttgcgggccacggtttggccccaaagcccagtgttcaggaaccaatgccgccatggcaccgccgcagccgcaaaagtccctcagatatgcacgtcttcctgcggaatgttacaattcacccaggcatttacccgtcggcgggaatttttgcaccacctaccgacaagtcgaagccagatgaatgtgtactcgataggaggacatccacatatgaagcgagaagtcatcaccctcaagagcaaggccctgggcaaggatgcccacgtcatcgtctacggcgagaagggctaccccatcgtcgcgttccagactcaggacaagaaggcgaccgagctcgaggacgagggcatggtcgacacgctggccgagtacctcgacggcggaaaggtccagctcttctcggtcgataactttgacgaggacagctggtccaagctcgacggcgacaacgccgagcgcgcccagcgccaggaggcctacttccgcttcgtgacggacgagctgctgccccgcgtgcacgaggtcaacggctccaacctgcgcccgatcgcgtttggctgctccatgggcgccgtccacgccgcgatcgcgctgttccgccgcccggacctcttccagggctgcatggcgctttccggcatctaccactccggctacttctttggcgactggatggactccacgctgtacgacaacgacctgctggcctttctgcccaacatgcccgaggaccacccctacgtccagacctaccgcaaccgctcgatcctgttctgctgcggccagggcgagggcgacgagtttgcgcaggacgagcgcctggtgggcgagcagctcacgcgcctgggcgtcgaccactggtgcgactactggggcgcggacgtcacgcacgactggtactggtggaagaagcagatgacgtacttcctgcccttcgtcctggaggacgtgcagaaggaggttgcaaaggagcccgtcgcgccgtacgttgcgccggcaaagtccgccaagcccgcagccaaggcaaaggcagccgagaaggtcgaggctcccaaggcagcagccaagcctgctgccgcggcaaagcccgcgaagccggcagccaagcccgccgcaaaggcaaccgcaaagaaggccgagcccaaggccgctcctgccgccaagtccgctgctgctcccaaggccaccgcgaagaaggccgcccctgccaagaaggcggagcccgcagccaaggccgctcccgtgaagaaggccgcaaccaagcccgccgccaaggccgctcccgcaaagccggccgcgaccaagaaggccgagcccaaggccgccgcacctgttaagaaggcggctcctgccaagaaggctcccgcagcccccaaggccgctgccgtgaaggcagagcccaaggcggccgagaaggccacctccgcacctgccgccaagaagcctgcagccaaggcaaccacggcaaagcctgccgccaagcccgctgcagccaagcctgccgcaaaggcaaccgcaaccaaggctgccaccaagccggctgctaaggcacctgccaagaaggccgagcccgccaaggccgaggcgcccaaggccaccgcagccaagaagccggccgatgcccacaaggcaaccgcaaagcccgccgccaccaaggcgaccgtcgcaaaggcaactgccaccaaggctgcttccaagaccaccaagaccagcgtgaggtcctcccgcaagaagacccgctagtccgcaatccgcggtagcaagcaagatctgttccgagccccacgcctcgtccaaaggcgcggggctcgttcttctcgcccgcagtatcacctggcgcggcacgtccttctcgcccgcgtcccttctttccgccaggtcacacgcccgcaacgcggcactgctatcatcgtcgcaaccgcctcgcgcggagcgaccgccagacaaccgccagattggagcagcgtgaacttcgtatttgtatcgccgcagttcccccacacgtactggcagttctgcgaccgcctgcacaggaacggcgccaacgtcctgggcattggcgacacgccgtacgaccagcttgaccagcgcctcaaggacgcgctcacggagtactactgggtgccgaacctgggcgactacgccagcgtcttcaaggcggtcgcgttctttagctacaagtacggcaaggtcgactggatcgagtcgaacaacgagtactggctcgcgcaggacgcggcgctgcgcacggacttcaacgtcaccacgggccccgggcgcgagcggatgctctcgctccagagcaaggcggacatgaagctgggctacgcgcgggccggcgtcgcgacggcgcggcaggtgcggctcaccacgctggaggacgcgctgcgctttgtggagggcgagggcggcgtgggctggcccgtgttcgcaaagccggagcgcggcgtggggtcggccggcgcgcaaaaggtatgtgacaggcgggggctcgaggcgctgctcgcgcgcatggatggcaccccctacgtgctcgaggagtacgtgacgggcgacatctgcagctacgacgccatactcgactcgcgcggcctgccacttttcgagaacatggaggagttcccgccctccatggcgcgcatcgccaaggaggggctcgacctctggtactgctcgctccccaccgtcgacccgatcctgcggcagctgggtcgcgccacggcgtttgccatggggctcaggagccgcttcgtgcacctggagttcttccggctcgaccgtgaccggccgggcctgggcgccaagggcgactacgtgggactcgaggtcaacagccgcccgcccgggggctacacgccggacatgatgaactttgcccactccacggacgtctaccaaatctgggcggacatggtgacctgcgaccgccgcgtggtgccggagtcccaggaccgctacttttgcgtgtacgccggccggcgcgacggccacgcctacgcccactcgcaccaggacgtgctcgcgcgctacggcgacgccatcgtcatgtgcgagcgcatgcccgacgcgctctccaacgacatgggcaaccagatgtacacggcccgcttcaagacggcgagcgagaaggacgacttcgtgcgctttgtgcaggagcgcgcgcagcaaggctaggccggcagacgaccgcaacacgaaccgggccacggcccacggacgcaaggaggaaccatgcaggtacgtcgcgcggaggagaaggacatccccaagatcatggacctgctggtccaggtgtgcaacgtccacgcggacggcaggcccgacctctttatccacggcgccaccaagtacacggccgacgagcttgcccggatggtccacgacgacgagcggccgatctttgtggcggacggtggccccaacgagggcgtgctgggctacgcgttctgtgtgcgcaaggactggggcggcaacaacaccccggacatcacgatgctctacatcgacgacatctgcgtggacgagcaggcccgcggcaggcacgtgggaaccgcgatctacaaccacgtgatcgacttcgcgcgccgcgagggcttccacaacgtcacgctcaacgtctggagctgcaaccccaccgcgcagaagttctaccaggccatgggcatggtgccccagaaggtcacgatggagcaggtcctcgaccagtaaccaaagtagctaaggccaggaagaacgcccagggggagaaggacactaggccttcctgggacggtgacccttcatggtcgcctcgagcatggtgtgcagcgcctcgcgcacgtttggggcgaggcgcacgtacatctgcaggtactgctcctcggtcgcgcgaatctcgtagtcgcgcccgcgcgtgccggcgggctcgccctcgtaccccaggatgtcgttgggcgtgcagcgcagcagccgcgcgaggttcagaacgtggtcggcacccatctccacgcggcccgtctcccacgagctgacggccttggggctcacgccgagcgtatccgcaatctgccgctggctcatgccggcggcatccctgcacgcacgcaggttgttctggtgccttgcgcctttggctttagcactgtcgacgctgtcgctcacgggtgccgacgcccctcccctcgagctccgtgcatggaaacggtccgagcagcgtgcctcgtccttctcccagaacgaagccctggtctcgcagaacgagtgctgtttcacgaatcctattctcaagagacgcgagcgccgcacgtctagcgtcgctagcttcaaaagcaaataaaacctagaatctattctcacgagacatatggctgccaagtctcgtgcagaatccactgccatccatcccgacgcacgaagggaaccgccatgagcaccaacggagccgacgagcgaccgttcaacgagcccaagccggaggacatattcctcctccaggacgacggcagggtcgtcacctacacggagctgtgcgagctcgcgggcgagcggcccgagtccgaggccgacctcgactgggtcatggtggaccagaacgccataccgttcatgctggacctgcccaagaagcagaaggagtagccgctagcggcgccgtttcccgcggcgccggcgccgcaacgcggccggcggcctggcccacggcccgccccatgcaaaggcttcgtgttcttctcgccccgtgacgcatcgccggggcgtggttggctatcgtttttgactattaccaaccatgcacgcaacgcaacacgggaggccgcgcatgcagctccaacagctccgctacgtcatagcgatcgccgagatgggttccatgaactccgtagcgcgcaagctcttcatatcgcagtcgagcctgtccgtcgccgtgaaggagctcgagggcgagcttggcatcaggatcttcaaccgctcgagcaagggcatcagcctcacctcggacggggtggagttcctgggctacgcgcgccaggtggtcgagcaggcggacctgctgcgcgagcactacacggagcgcaactcgtcgcagcggcggatgtccgtctccacgcagcactacgcgtttgccgtgcgcgcgttcatcagcttcctgcagagctggagcgaccgctcgtgcgacttcagcctgcacgagacgcgcacgagcgagatcatcgacgacgtgcgcacgttccggagcgacatcggcatcctctacctgagccactacaacgagaccgtgatccgccgccgcctggaagagggctcgctcgtgttcacgtcgctcttcaaggcgcggccgcacgcctttgtgcgcgacggccacccgctggcgtccaagccctccgtcacggtggacgacctggccggctacatgcgctacgactttgagcaggggcccgagggctcgctctacctctccgaggagccgctgagcgagctggcccacacgcgccgcgtgaccgtgagcgaccgcgccaccatgacgggcatcctcagccactgcgacggctacctcatctccacgggcgtgcgctcggacgagatgttcaacggcatcacgtccgtccccatcgagaccgacgaggtcatgaacgtgggctacatcgtgcacagccagcgccgcctgagcgagctcgcgcgcgcctacgtccgcgagcttgagaagctcatcgtgagctttgacgagcccgaggacatcgtgcccagccgcgccgcgctcaagggcgtgggcgccatcggtcaggacgcgcgctaggtgccgggcgagaaggacgcggcgcccgtggccgcgggcgtgggccagggtgcagccggagccgccggcgccgacccgtttgccccgctcgagcttggccgccgcggcggcactggcagcgcccgcctgcgtctgcgcaaccgctttgtgctcgcacccatggcgagcgcccgcgcggagaccgatggcagcgtgagcgagcggctggtcgaccactacgccgagcgcgcggccggcgggtactggggcctggtcgagtgcggccaccacttcgtgagcgcggacggcagggccacagcgcgccaggctggcatcgcgagcgacgactgcgtggacggactcgcacgcgaggccgcggccgtgcaccagcacgacacacccgtgttcgtgcagataagccacgccggctcggccacgagctggtgcctcacgcgggagcaggcgctatcccccagcggcatcaactgcccgggcgccaaggtgggccaccccctcccccgtcccatggacgcggacgacatcgcccgcgtggtggaggcctttggccaggcagcccgtcgcgcgcgcctggccggcttcgacggcgtggagctccacgctgcccacggctacctgctggaccagttcctctcgcccctcaccaaccaccgcatggacgcctacggcggcccgctcgagaaccgcctccgcatcacgctcgaggcgctcgacgctgtgcgcgcggaggccgcaggcatggtcgtctccgtccggctcggcggctgcgactacctgccgggcggcactaccgtggcggacgcgtgcgaagcggccgtccttctcgcccggcatggcgcagacatgatctccgtctccggcgggatgtgctactacacgcggcggaacacgctggagccgggctggttcgcgggcgtgtcgacccccgtgcggcaggcgctcgccgcggcggggctcgacgcaccggtcatgctcgcgggcggcatccgcagcgtggacgacgcgcgtcggctcatggcgcggggcgcatgcggcctcgtgggcatcgggcggccagctctcaacaacccgcgctgggcgcggcgcaacctcaagccacccgcaagccagtccgcgcactagccgtcgagcgagaaggaccgcaaccccagccgcaagacaaccgctaacatggaaggcccgcggggcagcggccccgcacccgcacccaaaccagaaagttgcaacgcatgtcagacagcatgagaccggacgaggttcccgaggtagacgtggccgtggcggacgagggtcccaacggccaggggtcgctgggcaggctcgtaccctggcccgacgacgagagctacgccaacatcgacccagaggacgcgctcgagctcttcctgggctgggtggagtcgcgcggcatcacgctgtgggaccaccaggaggaggcactcctggacatcgcctccggcgaccacgtgatcctgggcacgcccacgggctccggcaagtccatggtcgcactgggcatgtgcttcatctccatctgcacggatcgccgcgcctactacaccgcgcccataaaggccctggtgagcgagaagttcttcaacctcgtggagctcttcggccgcgagaacgtaggtatgatcacgggcgacgtaacgctcaatgccgacgcgccggtcatctgctgcacggccgagattctggccaaccaggcgctgcgcgagggcgccaatgccgacgtgggctgcgtcgcgatggacgagttccactactatggcgaccgcgaccgcggctgggcctggcaggtgcccctgctcacgctgccgcacgcgcagttcctactcatgagcgccaccctgggcgacaccacggacatcgcggcgtcgctcgagcgcatgacggagcgccccgttgacacgatcgccaacgcgccgcgccccgtccccctcacgtaccgctacgtggacaccgcgctcgagcagaccgtcaagatcgcgctggacgcgggcgaggcgccgctctacatcgtgcacttctcccaggaggccgccgtcaagagcgcatcggccctcgcgagctttggcgtgtccagcaaggagcagcgcgcccgcatcaaggaggccatcgcgggcacgcgcttcaccaccacgtttggcaagacgctccgccgcctgctgctcacgggcgtgggcgtgcaccacgccggcatgctgccgcgctaccgccttctggtggagaagctcgcgcaacaggggctgctgcccgtcatctgcggcacggacaccctgggcgtgggcatcaacgtgcccatccacaccgtcatcctcacggcgctgtccaagttcgacggccgccgcatgcgccacctcaacgcgcgcgagttccaccagatcgccgggcgcgctggccgcgcgggcttcgatactgagggcgtcgtgatcgcggaagccacggagtacgacatcgagaacgcgcgcgccctggccaaggccggcggcgaccccaagaaggcccgcaagatcaagaccaagcagcctcccaagggcttcgtgggctggaaggaggccacgttccagaagctgatcgaggcggagccggaaaagctgcgcccgcgcatgcgtgtgagccactccatggtgctggccgaggtcgagcagggcggggacgccttcgcgcgcgtgcaccagctgattgcggattccgcccagccggacgacgagaagctccgcctggacacccgcgccaacgaggtgttcgcgaccctgatggacgcgggcgtcgtcgtgcgcgacgtggccgaggacggcacggcctcctactccgccacggtcgacctgccggaggacttcgcgctcgaccagccgctctcccccttcctgctcgcggcgctcgagctgctcgacccccagagcgatacctacgccctcgacctcatctccatggtggagtccacgctcgaggacccgccccagatcctgcgcgcgctcgagcgccaggcgcgcgacgtcgcgatggcccagatgaaggccgacggcgtcgagtacgacgagaggatcgagcgcatccaggacgtgacctatcccaagccgctggaggagctgctctccgcggcgttcgagcgctactgcgagaaggtcccctgggcgcgcgactacgagctcagctgcaagtccatcctgcgcgacatggtcgagacggcctcggacttcaagggctacgtgcagcgctgcggcatcgcacgctccgagggcctgctgctgcgctacctgtccgacgcctaccgcgtgctctcgcgcaccgtgccggaggacaagctggacgaccgcctgcgcgacatcgtcgcgtggctcggcctcgtcgtgcgcaccgtcgactccagcctcgtggacgagtggtctgccgccggcaccgccgcgcccgacgcccccgccgcgcccacggacgcgcacgaggtcgtgcacgaccgccgcggcctcacgctgctggtcaggaacgcgctcttctcgcgcgtgcgccttgccgccattggcgacacggagcgcctcggcgcgatcgacgcggactggggctggcgccaggcgcgctggtcgcaggcgctcgacgcctaccgcgaggcccacgacgacatcctcttggacgcggacgcccgctcctccgccttcctctccatcgacgagtcggacgagaagggcgactcccatggccgccacgtctggcatgtgcgccagatgttccacgacccggacgacgaccgcgactttggcatctccgccgacgtggacctcgacgccacgcaggaggagggcgaggccgtgttcagccgctaccaggtgggctttgcggaggacctgcaggcgagcgaggccggcgcgtagccgcacctggtcgtaccaggcccgcggcgcccagcgtcaccgtcgcgcaaccggttcccatgtgccacgcatggataccgtgaaaacgcgacgcaaggattccgtttcccatgcgtttgggccgacggttcccttgcgccacgcatgggaaccggacgaaaaacggccgttttcggcccaaacgcaaggattctgcccttgccgacgcatggattccggaacccttgcgtgcaaaaaacgcggttcccatgcgtcatgcatgggaaccgcccatcaatcgcttctctattcctcagacaccgctgccgcggcccatcgtgcccctaatgcacgagcccgatgcctcgcaggatcccccaaatcagacccacgcccagcaccagcagcacgggcagcgtcagaagacccaggagcacaaggcccacgaccaggaagccatacagcagccatcccagaacgcggagcccaaaccctatgagcttgatcatgagccacaggaaccccgcggccaccaggcagctcatcagactggccatccctcacacctccaagtcacgcggacggcaccgtgccgcccactgcgaaagagatacccattctacagggccgccaacgccatccgcacgcgcgcgccaatccaccacaacgcccccattcgccccagccggcggcttgcgctagcattggtccgtaaaacacgcgaatggaggacacgatggaccagaacgacagggcactcgtcgacaagctcaaggccgagctcgcgcagcagggccgcaagaccgcctttgcggaggacgccgcgcctgcagcgcccaacgcgaccgatgccgcggcaaccgcgcaggtcacgagctcgtccgaccccacggccaacctcaatgcgcaggcttccgcgggcgagaaggacgcggcctcggaggctgacttcctctcggccatgaacgccttccgccgggccaaagcctcgggcgaccacgacgccatcgcggccgcggagcgtcacctgcaggaggtcgtccgccaggagatgcgcgacgtcgagggctgcgaggaggccaggtagccgtagccgctcctagtggcagccgcagccctcgccgtgctcgtggtcgccgtgcccgcagccgccatgcccgccgtggccgcagccatcgccatgctcgtggccgccacaggtcacgccgtcaaactgcggcagcgtgcccgccaggaaggcccgcatggcctcgtccgcggagccctccgcgcccgggtacaccttgatgccggcacccgcgagcgcgttcatggcgccgccgccgatgccgccgcaaatcagcacgtcgacgccgccctgggcgagcagccccgcgagcgcgccgtgcgagacgccgttcgagcccaccacggaggacgaggtcaccttgccggcctccacgtcgtacaccttgaactgctcggtccttccaaagtgctggaagacctgtccgtcctgataggtaaccgcaaccctcatgatcttctcccctttgtcctggggccagccgcgcagggggttcgcggcggcgggatggaactcgacgtccccaccgctcaccacaaggcgcttcccgttcaccacggcgtcggcaagcttgtgccttgcctgctcgtagatcccggcaaccgtggcgcgcgccacgcccatcgcctgggcggcgtccgcctggctcgcaccctcgaggtcgatcagccgcacggactcgagctcgtccagcgtgagcgtgaccgtggcctcggcgttggagcccgcgccctccggcgcaaaccccacgtactccggcatcagccccacgtacctgaccttcttgcggcgtcccgccatctggtcatccaatctcgcgtgttctatttctgacatatgtcagaaatagatagtacacctccagtcgcccagcgcaagggggattcgggacgggcgcccgtctgacggccgcccttggctcggggtctcatccagtacgcccgtccttctcccccggggagcctcgtcacccgcggtcgtcgtagccagcctcgcggcgcacaaaggtgccggcgtcgatctcgtcaaaggcctgcaccagctcgtcgtccgtgttcatcacgatggggccaagccacgcgatgggctcgcccaggcggacggagctcatcaggagcacctccgccggctcgtcgcccgcctggagccgcacctggtcgccctcgcccacgcgcgccgcggtcttcgtgcccacgtgggtgccgctcaccgtcgcctcgccctgcaaggtgaagagcatgacggagcgctcgccgggcacgtcgagggtcacgtccgcgtgcgggtccaggtggatgtcgtagtagtcgagcggcaggtatctgccctcaaagccgtgggcctcgccgtagtggccggccagaaggcgcagcgtggcgccacccaggtcaaactcctggatctggtcgcgcgtgatgccgtggtagaacggcggcgcggtcatcttgtccttggcgggaaggttcagccacagctgcacgcccaggaagcgccgcgcgcggcccggcatctcggagtggaacgcgcccgagcccgccgtgagccactgggcctcgccgtccgtcacggtcgccttggtgcccaggtggtcctggtgcaccatggtgccctgcgcaacgtacgtcacggtctcgatgccgcggtgcgggtgcatggggaagcccgccatgtagtcgtccgggttggtcgagtcaaacgagtcgagcatgaggaacgggtcccactcgcgcgcggtccagttgcccagcacgcgcgtgagcttgacgcccgcgccgtcctgcgcgggaacgccctctacggtcttggtcaccttgcgaagcatgtctgcctccttttatagaatcatcaacataaaagcttttactgacgagaagaacgcgccctaccggttggcgtccctatacgcacgaatcagcctcgccatcgtgcgctggtcatccgggccccacgccgcaaggcgctcgtgaagcgcctggtagttggtggggcacacggcccgtgccaggccctcccccgcaggcgtcaggctcacgatggcgcggcgcccgtccgcagggtccctcccgcgcacaacgagcccgcgctcccgcaggtggcggatcaccacggggatggtcccgtcgctgctgaggacgctctcgcgcagctcgcccacggtgagcggccccttgcggagcagcgcctccagcaccgcaaactgcgtggtcgtcaggccgtgctcgcgcgcgacggccgccgtctgccggtcaaggtcctgcaccagccgatgcaggccgatcaccagctgcgactcggtcaggctcatcccggccgcggtcttgcccttgccttccgtcacgatgcgccccctccaaaggtcgtcgttcttctcccttgcgttgcttttacctctacgtagaggtttttatacgttactagcgcactaccaatttcctccacaaccgcctggcgcgacgcacgcgcccctccgccgcccaaagtgggaaactagccacaggaccaggcccgccgggccgatactgcccgccgtgcccgcaacgccagccaagggaggacgcatgcgagaaggacgcctcaacctcttgatgtcgctgtttgccgtgttcaacgacaacgaccgcgacgacacctcctatgcgctggcgcgctactttctgcagaactttgaccggctggaccagctcaacatctacgacgtgatggactcgtgctacgtgtcgcgctccggcgtcaggcgcttctgccagtccatcgggttcgagaactttagcgagatcaaggccagcagcggcgagtgggagctcttccgccactacttcctgacctaccccaggctggaggggtcgggcacgcacgagctccgccgcgacctcgacgcgctctacggccagatcgacgggctcatgcgcacgcgcgaggtggacgtggtgctggacgcgctgcaccgctgcgaccaggtggtgctcttctcggcggactcgtccagcatgagcctggtggagttccagcgcgccatggcggtggagggcaggatcgtgcagctgataaccgagtcgagcccggcggcggacgcggtgcgcgagctgggccccaacgacctgctgctgacggtctcgacctcgggcgccttcgtgcgcaggcaggagtcgcaggtgcgggactcgggtgcgttcaaggtctacgtcaccgcgacgcaggcgccggagctcgcgcggctgttcgacaccacgctgctcatggcgcaaagcgtgcgggaccccagccccctgcaccggctgtacgcctcgtacggcgtggcgtacctcttcgaccggctgctttctgcctacgcgcaccgctacgacccgcagctcgcgccaggtggcacgccgactcagacggacggaggccacgcgcccgccgacgcctagcagccgcggccggtccccgtggttcaaaagctggagcgttccatttgttgaaccacccgcgacgccccgtctgccataccgtacaggtgcaggcaggaggcgtcggaaggactgacatgcaaaccgcaaccacgttggcaaaccccatgagcatcaagggctacctggacagcatctacgtggacgaccccaaccgcatcctcctcaagctcaactacatgggcgagaagatcagcggcctcgtgtcgcgcgtcgaccatgacgcgcacgcacggagcgacgcggaccacgactacgtgacgctcgacgtgccggccgagcagcgtgggaagctcttctcccccaccgcgggcaggctggtctcacccgagcacgcgcgccagaacgagtccgcgcgcgctgcccagggacgctgcgtgtgcatccgccccacctacggcatgctgtacgcgccggtgacgggccgcatcactgcgcagctgccctcgcacaacgccatcggcatcatgacctttgatggtgtgcagatcctgctgacggtgggcaacgccccgcagcgctaccagggcaaggcgttcaggcagctggcgtggcagaacgactcggtccacatgggcgacccgctggtggcgtgggaccgccgcgcgctgcgcgacgagggccaggacgacctggtggtcatgaccgtgacgaaccccgacgacctggcctccgtcaccccgctgcagccgcgtgtgccgtgggcaaccagggtgcgccccgaggcgcaggtcatgcgcgtggagtttcctgacgaggggtagcgacccccgcacctcctaccagcggagcgagaggcacgtgatggagccgtcgatcttctcgaactccgtcatctcgacctcgatgatcttgtagccccaggcctcgagctgcgccttgacgcgcgggtagcccttagccatgaccacgtagtcgttgatgcgcacgcagtcggcgccataggcctcctcgtcgggcacctcgaagaggttgaactggccgcggtggtaggcgggcttggtcttgaactcgccgctcacgagcaggttgccgtcctcgacgtaggtgccaccggtcttgaggtgcaggatgtgctcgacgggcacctgctcggaggtgtagccccactcggccaggaagccggcaaactggcggtagccctcgtcgttggtgcgctgcgagtggccaacgtagtagtggtcgtcgaccatcatgacgtcgccgccctcgagcgtgccggggtcagtgatgaccttgatctggtcgtcagtaaagaactcgtgcagcgtgggaagcatgagcgcggcctcctcgcggcgggtcggcgcgccggggcggtcggagatcgcgcccttgggcgtgatgacggccgtgtcctccacgaagacggaatcggggtagtcctcaagcgcgggcaggaccgtgacctcgaggccggcctgcttgagggcctcgacgtactggtcgtgctgctccatggccttctcgtagatgggcttgcccttgttggtgaagtcggcgatgccgtcgattaccgagtgggacgggcgacggacgattgcgtgggtgaagtttgctgccatggtggaacccctttccgttgctgtgacgttggcaccgggcctccgggcgtacgggacgtccttctcccccgcgctacgccaggtcgcggtagtggaagctcttctcgcccgaggcgtacggcgccacaatgtcgccgtggctcacaaggcggtacttgtacgtgaccaggccgtccagccccacggggccgcgcgcgtgcagcttgcccgtgctgatgcccacctcggcgccaaagccgtagcggaagccgtcggcaaagcgggtggagcagttgcggtacacgcccgcagagtcgaccatctgcatgaagtactcggccgccgcgtcgtccgtcgtgatgatggcgtccgtgtggtgcgagccgtagcggttgatgtggtccacggcctcgcgcacgccgtccacgaccttgcagctcatgacgtagtcgccgtactccgtgctgaactcgtcgtcggacatgggctccacagtggggatgccctccacgtgggcgagaagttcgcacacctcggccgtgccgcggaggcgtgcgccgcgctccgccaggccccgggccgccttgggcaggaactccgccgcgatggagcggtccaccagcagcgtctcggccgcgttgcacacggcgggatactgggtcttggcgtccaccagcacgcgcacggccatgtcctggtccgccgcggcgtccacgtacacgtggcagacgcccgaggagtggcccatgacggggatcttggtgtgctccatgatgtagcgcacaaacttgttggagccgcggggaatcagcagatcaacgtcctggtcgcactgcagcagctcgtcaatttcgctgtggagctccgcctgcagcaggcagccggcgggaaggcccgcctccaccacggcctcgtggatcacgtcgaacagcacgcggttggtgttggcagtctcgcgcccgcccttgagcacggcgcagttgccgctcttgacgcagagcgagctgatctggaccagcgcgtcagggcgcgcctcgaagatgacgccgatcacgccgatggggcaggtcacgcgcttgagctcgagcccggcgtccagctcgcggtcgaggagcacgcgtcccactgggtcgggaagacccaccagctggcgcaggcccgccacgccgtcgcgcaacttgccctcgtcgtagcgcagccgcttctggacggtctgtgccacgccggcctctgccgcggcggccatgtccttctcgtttgccgcaaagatctggtccttgtgcgcctcgagcgcctgcgccaccagctcgagcgcatggttgcgctgctcgatggaagaggcggccatggccggcgcctcgagcttcatctggtggacctgctcgcgaatgtccatgtgggctcctatcggggtatgtacgcgggcccgggggccggcgctggtggttgggggtattgggtagaagtctacccgactgccccgcgcgcgataacctcgggtagaatctacgtagctcggccgcgtgccgggccaccggacgtcccccacgcaaggagtgaacatggccaggctcaagtacgaaaccgcgcgcttcgaggcatcgtacgggaccatcgcgcagctgcccgagcccaccgcgcccgaggtgtcgtttgtgggacgctccaacgtgggaaagtcgtcgctgctcaacaagctcatcggccgcaagtcgctcgccaaggtgtcaagccagccgggcaagaccgccaacatcaacttttttgacgtggacggcgtgcgctttgtggacctgcccggctacggcttcgccaaggtgtcgcaggcggaaaagcagcgctgggccaacctcataagcggctacttcgagcaggagcgcagcttcaacctggtggtctcgctcgtggacatccgccacgacgcgcagcagctcgaccgcgacatgctggcctacctgaccgaggcggacctcccctacgtggtggcgctcaccaaggccgacaagctcagccgcagcaagcaggcgcagcagaaggccgcgctcgcgcgccagtttggcatcgaccccggccgcatgctcgtgacgtcgtcccagtccggccagggcatccaggagctccgcaagatgatcgaggacgcctgcctgtaagctacgagcccaggacgtcgtgcacgtcgcacaccacgatgcggtccaccttggcgaccggctcccagcggtagcccgcggccgcggactcgaagcacaggtacagcttgccgccatagaggtccatctcctcaagcatgggcggcagcacgaacgtggcccaggactggtcgttgcgcaggtcgtggctccacgcgccgccgccccaccacatgacgcgcaggcggctgtcgcggctgccccacgactgcgagagcaggcagaggtcgcccacgatgcccatgccctggacctggccgttgatgagcgcgccgtccacggggtcgaggatgtcgccgctggtcttggcgacccgcttggcgaggtgcttgagcacgcgcgacttgcgcacgttgatcatgccgagctcgtccacgtcccagccctgctccgcctcgagtgcgccgtcgttgcggatgcgctggatctcgcccaggacctcgtccttgtcggcctcgcgcaggccgccgtcggactcgatgtcgaaggcctgtatggtcgtacgcgacttgcgcgcgccggtgaagtcgcccacgtacagcctgccggaatagaccgtcaggaacgacgcgtggttgagcgtgcgaacggggtaggtgcgctcgatgcggcacggggccttggcccgggagtcgtcgtacttctcccatgcgctgagctcgatcgaactcacggtggcgcagccgttcttgccctcctggtagccgcatatccacaggcggtggtggcgcgcgtcgtacgcgaggccgccgacgtgcggcttgccgctgagcacgatcacgccgtcgagccggcgggtcttgcggctaatgcgatagatcacggagttgtgcgcgtgggcgcggcagtacgcggacacgagcaggtactttcccgcgacgcagacgccctgcggcgtcatggtcgtgcagctgcacaggttgttgtccgcgtccagggtgcgcgtgatcttgaggccgggtatcacgtagctttcgcgcgcgatcttggcggcgctggcggtgccgctcgcgcccacgccgtagttgcggagcacggtgcggaagtcctcctcggagaagacggcgtcggcgttggtaccgtccgcgctcgaggtggggcccgtcggcagcggatgcgccatgccgtacgcaaagaagcagcacgccgccacaaaaagggcgcacagcacctttggccacgttcttctcgcccgcatttcgccccctcacgcacatcgacaacgtgcaaccgtagcacgcgtgacggccacggctgccgcgtctgcggagccgctccaactcgccacaaccctgcattatctggcgggtcgccgcgcggcggttgaaccgtaagcgccagtgcacgcaactgtaacggaatcgtcagcttgctgcatacgcaggtaagcgccccgtcgggtgcgcctagggcgccgtggggcgtggaatcatgtaagtggaacgtaacccagtgaggatgggaggtcaccatgtcagcaacgacgctcaaccgtcagaccagcggattccttcgcggcctcggcatggtcgccggatacgggggcctgagcatcctgggagcggccctcgcggtcgtggccctggcagcgctcgcggcgctgtagcggaccggcaacccaaccacacaacaagcctatcggaacccccgcgcccgccccgcgcccctacctcgcgcggggcgggattctgtttcggggccgtccgcgcccaacccgggagatttttcgccacccgtgcacgcaatcggggtttgagggtgtttcgatctcgcctcagaggctcacacggcttgccaaagccgccgtcgggtcccccaaagcacactcaaaccctcctcctgtccatttggaggggattgagggcgcttcgaacgcgtccgcaaggcgaggcgacgcctccaaagtacactcaaaccccccttccggtgcacgcgggccagtaaaacttccgccgcaccaccggcccccgcccgccgcgccaaccagcccgcctccggaagcgccacatgccagccgtgcaccagccactaggatgtatgaaatcagaaactaattgcatccatctgccacaggctggcaacaaccgcagcttaaggccacaaggtgaggagtcgcatgccgcaggcatccacgcagcaaacgtccgcaaacacgcaaccgtctgaggccggccgcgaggagcgcctcaggtactcgcgcctcctcgcgcagcgcttccccaaccgccgcgccgccatgagcgagatcatcaaccttcgcaccatcctgtcgctcccgcgcggcacggaccacttcatcagcgacgtccacggcgagtacgaggccttccagcacatcctcaacaactgctccggcgtcatccgcgagcagatccgcgtcatcttcacgcccgagctcgacgcccaccagcaggccgacctccgcaccctcgtctactatccgcgcgagaagatcgagcgcacgcggctggacggggccctcgaccgccagtggtacctcgacaacctgtatcgcctggtcaggctcgcgcgctggatcgccggcaagtacacgcgctccaaggtgcgcaaggccatgcccgccgagtacgcctacatcatggacgagctcatgcacgccacgcgcgacgaggagaaggtccgccacgcctaccaccagtcgatcctcgagtccgtggtggacaccggcgcggccgacgacttcatcgaggcgctcgcgaacctcatcaagcggctcgccgtcgaccgcctccacgtggtgggcgacgtcttcgaccgcggcgcgcacgcggacaaggtcatgcacaccatcgagcaccacccctccgtggacgtggagtggggcaaccacgacgccgcctggatgggcgccgcctgcggctcgctcgcatgcatctgctcggtcgtgcgcacctgcgtgcgctacggcacgctcgccgccatcgagagcggctacggcatcagcctgcgcgagctcgcgctcttcgcgggcgccacctacagcgccgacgacgccatcccgcccttcgagaaggccatcgacgtcatgctcttcaaggtcgagggtcagacctaccgccgccacccggactggctccgcgccaacgagcgcgtcctcctcgacaagatggacctcgaccgtggcaccgtacgcatcggcaatcgcgactggccgctcgccacgcgcgacttccccaccatcgacaccgctgaccccttcgcgctctccgcgggcgagaaggacgtgctccaggggctcgcggccgccttccgcgacgcggaccgcctccatcggcacgtcgcgttcctgtacgaggagggctccatctaccgcgtgtgcgacggcaacctgctccttcacggctgcgtcccgctacgcgaggacggctcgctccaggacgtgatgtgcgacggcacgccgctcagcggcagggcctacctggacttttgcgaccgcatggcgcgtcgcgcctggacccgcggcgaccaggacgccctcgactggatgtactacctctggtgtggcgcgcactccccgctctccggccgcgtcgtcaagacgttcgagcgcgccttcgtgagcgaccgcgccgcctgggcggagccgcgcgacccctacttcgacctcgccaaccgcgcggacgtgtgcgagaagatcctggcggagttcggcctcacgggcccggagtgccgcatcatcaacggccacacgcccgtgcgcgccgccgcgggagagagccccgtgcgcgcgggtgggcgccgcatcatcatcgacggcggcttctgcgaggcataccacgagaagtgcggcatcgccggctacacgctcgtctcgggctcgcacgacctgcgcatcaaggcgcaccgtcccttcctgggcatcgaggccgcactggacgacaacgcggacatcatgagcgaaagcgacgtcatccgccgctacgaccaccaggtcctcgtgggcgagacggaccgcggccgcgagctccgccgccagatcgcggacctggaggacctgcttgccgccttccttgacggcagcatccccgagcacctgtagcggcgcccggggatgcccgcccgcaggcgcgccttgcgcccgcgggtcttaacttgtatgtcttgcagctacctgacggccacgaccttgtagcccgcgtccgcgacggccttctcgagcttcttgttgctcacgagcgggcccgcgtccagggtggcgttcttgtcctccagcgagacgtgcacgttcttgacgccgcgcacgccctcgagcgcctcggtcacgtgcgccacgcagtgctcgcacatcatgccctcgatgtccagcgtcttgcttgccatatccgtacttccttccgtatctgccgcggcatcctccgccgcgacgccttccgtcaccttcgcacgcgtcgcgctcgcggcgcctgcggtcttgccacttggcttccacgcgaagagtctcagcgcgttggagaccacgaacacggagctgaagcccatggccgccgcgcccaccatcgggttgagcgtgatgcccaccggcgtgagcacgcccatggccacggggatgcagatggcgttgtagaacagcgcccagaacaggttctgcctgatgtcgcgcatggtcgcgcgggaaagctcgatggcggtcgccacgtccgccgggtcggagtgcatgagcaccacgtccgcggagctgatggccacgtccgtgccggcgccgatggcgatgcccacgtcggcgcgggccagggccggtgcgtcgttgatgccgtcgcccaccatggccaccttgtggccggcgcgctggagctcgtgcaccttctgctccttctggtcgggcagcacgcccgccacgacctcgtccacgcccacctggtcggcgatgacctgggcggtcttgggctggtcgcccgtgagcatgatcgtgcggacgcccatctggcgcaggcgcgccacggcgtcggcggaggtcgccttcaccacgtccgccacgcccaggaggccaagcgccttgccgtcacgggcaaagaagagcggcgtcttcgcggccgcggcgagcgtgtccgccgtgccggcgagctcgcccaggtccacgccctcctcggacatgaggcgcgcgttgcccgccagggcgcgcttgccgtcgacaacggccctgatgccgccaccggccacctgggtgaagtccgtgaccgtggcgtcagcggcaacgccgtcgcccacgtagtcgcagaccgcctgggccagcgggtgctcgctcttgcgctcgagcgccgcggccacgtagagcaggtccttctcgcccgcgccagaagcggtcgcaacgtcggtcacctttggcttgccttccgtgacggtgcccgtcttgtcgagcacgacggtgtcaagggaaccggcagtctctagcgagtccgcgctcttgatgaggatgcccaccttggcgccgcgctccgtgcccaccatgatggccgtgggcgtggcgaggcccagcgcgcaggggcagctgatgaccagcacggagaccgcgtggttgaaggccacggcaaagttggccgggtcgagaaacgcgacccacgccaccagcgtcacggccgcgatcgccatgaccacgggcacgaacacgcccgcgatgcggtcggcctggcgctcgatgggcgcctttgagttggtggcctcgtccaccaggcggatgatgttcgcgagcgtggtgtcgccgccgacggcggtggcctccatcttgaaccagccgcgctcggacaccgtggcgcccgtcacgcggtcgcccacgcccttctccgcgggaacgggctcgcccgtgatggcggactcgtccacggaggcctgaccctcgcgcacgacgccgtcgacggggacggactcgcccgcacgcaccaccaggacgtcgcccacgcgcacgtccgtggtggggacggtctgctcctggccgtcgcgcacgaccgtggcggtcttgggcgccaggttcatgagggcggatatcgagctggtggtcttgcccttggcgcgcgcctcgaagtacttgccgagggtgatgagcacgaggatcgtgccggcggaatcgaagaacaggctgttcatcatcgcgctgtgggccgcggccatgtccatgcggccaagggccgcggccatctgatagatgcccaccacgctgtagccaaagctcgccgccgagccgatggcgatgagcgagtccatgttgggcgcgaggtggaagagcgacttgaagccgcgcacgaagtagccgcggttgacgaagatgacgcacatggccagcatgagctgcgtcacggcggaggccatcatgccctgcatgcccgcgaggccggggacctcgggccaaccgagcatcgggcccatcgcaaggtagaagagggggacgccaaacacgagcgaccacacgagctggcgctgcttggcgagcaccgccttcttggcacttacctgcgggtccacgaactccggctcggccttgccggcgacggaagccgcctggctgcgcggcttagcgccgtagcccgccttgtcgatcgccttgacgacggcctccacggtcttggggtttccgtcgtactcgagctccatcgagttcttgagcaggttcacgtttgcggcggacacgcccttgacggcggccgccgacttctgcacgcgggcctcgcaggccgcgcacgtcatgcccgtgatgtcgaaggtctccttcgacggggcggttgcggtacccaagcttttcacctcccggcggcgcctacgcgccgaacttcttgagcaggtccatgatctcgtccacgacctccgtgtcgccctgctggatgcgctcgaccacgcaggtgtgcaggtggtccttcatgatgatgcggctcacggccttgatggcgctttccgccgcggcgagctgcgtgagcacgtcgccgcagtagcggccgtcctccaccatgctcttgacgccgttgagctggccgatcgcgcggttgaggcggcgggtcacgtcgcgctgcagctcttcggagcgcggcgtgtgcttgtaggccacgccgtcggcgtcggcgccggtgccgcccgagcacgccgggcagcccggcgtcacgtccttctcgccctgcgttgtggctgcctttgcctcggcctctgccacgaccttgggctcctgcgtcagctccgccatgatgacctccaaacacgccgcgacacgcggcggacgatgttgcctcgcaagcccctttgataccccgtgggggtttgctgtcgcctaagctatacccctaaagggtatttgtcaaagcgagaagaacgggtgcatcgcgcgcgacacatccccttcacatcgggcccacacgcggccgccgccccgcgcgccgggggcgcgccgcgccgccagcccctataatcagtgcaatcgacaaggcatcccaaggagcatgcatggcttttctccccgtcaacaggcaggacatggcagagcgcggctgggaccagtgcgacttcgtgtttgtgtgcggagacgcgtacgtggatcactcgtcgtttggcatggccatcatcacgcgcacgctcgaggcgcacggctacaaggtgggcgtgatctgccagccggattggcgcgacgagaagagcgtgcaggtccttggcgagccgcgcctggcgtttctggtatcgagcggcaacatggactccatggtcaaccactacacggtggccaagcgccgccgcagcgaggacttctactcccccggcggcaagatgggcctgcgcccggaccacgccaccgtggtgtactccaacctcatccgcagggtctaccgccacgtgcccatcgtgctgggcgggatcgaggcgtcgctgcgccgccttgcccactacgactactggtcaaactcgctcaagcgctcgatcctcctggacagcggcgccgacctgctgatatacggcatgggcgagcgctccgttgtcgaggtggcggacgcgctggactccggcctccccgtggaccaggtcacgtggatccacggcaccgtgtaccgcacgcgcacgacggaggacgtggaccggccgctcgcgctccccacttgggagcagatgcgcgcggacaagctcgagtacgcccgcagctttggcatccaaagcaggaacctcgacccgtttagcgcgcgcacgctggtggaggaatacccccacggcgtatacgtggtgcagaacccgccgaccatgccgctcaccacggagcagatggacgagacgtacgagctcccgtacgagcgcacctaccaccccatgtacgaggccgccggcggcgtccccgccatcaaggaggtcaagttctccatcgccaacaaccgcggctgcctggggcagtgcagcttctgcgcgctcaacttccacgagggccgcatcatccagagccgcagccacgcctccatcctgcgcgaggcgcgcctcatgacgcaggacccggacttcaagggctacataagcgacctttccggccccacggcagacttccgcatccccgcttgcgccaagcagctcaagagcggcgcgtgccccaaccgccgctgcctggcgcccgagccctgccccaacctgcgcgtcacgcacgaggacctggtccagctcctgcgcgagctccgcgccatccccggcatcaagaaggtcttcatccgcagcggcatccgctttgactacgccatgctcgaccacgaccacaccttcataaaggagctggcggagtaccacacatccggccagctgcgcctggcgcccgagcacatatccgaccaggtgctcgagatcatgggcaagccgcacaaccacatgtacgaggacttctgcaaggagttcgagaagtacagccgcgccgccggcaaggagcagtacgtgctgccctacctcatgagcagccaccccggctccaccatgcgcgaggccgtcaagctcgcggagttctgccgcgacctgggctacaaccccgagcaggtgagcgacttctatcccacgccgtccacggtgtctacctgcatcttctataccggcgtggacccgcgcaccatgaagcacgtctactgccccaccaacccgcacgagaaggccatgcagcgcgcgctcatccagtaccgcaaccccaagaactacgacctggtggtcgaggcgctgcacatcgcgcaccgcgaggacctcatcggctacggccccaagtgcctggtcaggcccgacggcccgtggcactccaaggaggattccaagggcgagaagaacaacggccacggcggcagccgcaggcgctccggcggcaagggccgtggtggcaacgccggcaacggcggccgcaaccacggcaagtcccagggacagggccagcctcgaggcaagggtcagggcggcaaggggccgcgcgccaacgcagcgggcggccgcggcgccggccagcacgcggatgcccagcacagcacgtacgcctcacgcggacgccaccccggcaagagggcgcaccgcggcggtaaccagcacggcggccagcgctagccgagggcggcgctggcctgggggccgtacttctcccccagggatgctcttctcgcccgcgcctacgcccgcctgatggcgtcgcgcagcgtctgcatgtccaggtccacgctcgcgatctcgtccgcgcagcgcttcagctcctgcgtcagcagctccgggttcttgatcgtcttcttgtacttcatcttgtgctcgagcgtcgcccagaagtccgtggccacggtgcgaatctggatctcgctcgagggaaggaacgcggccgggccgctcgtgaaccgcacgttcatgtggtagctccggtagccgttgggcttggggtgcctgatgtagtccttggtgcggagcacctccacgttgggctgctcgccgatccagcgcgccgcggcgtacacgtcgtccccaaacgcacagatgatgcgcagccccaggatgtcctgcacgttcgtggcgatggcgtcggccagggacgcgccgctgccgcccttgcgcgcgatcttctccaccaggctcgccggggacttgatgcgcgacgtgtggtacaccacgggcttcaggtcgtcggagtcgcccgcggtcgcggcaaagccctccgccagcccgtcaagctgcgccagcgccgcctggagccgcgggtagtccgcgccgtagaactcctccggcgtccgccccgccacgatcgcgcctccgttgccggagccgccgttgccgttctggccgtccatcacttcgcatccccctcacggcgccgtccgcgccggaatccgcccttcacaaaaccggagatcgcgttcgcgcgcgacctcgcctgcgggtcgcgccgcgtcggcagcgtcacggtcatggtgaccccgctgccgtcgggcttggcctccgcgcgggccttgccgccgtgggcgcgcgcgacggccgccaccatgctgagcccgatgccaaagccgcccgcctcgtgcgtccgcgcgcggtctgactggtagaaccgcccaaaccagaggccgacctccttggggtccaccccctcggtctcgttggagacggtcagctcggcctggtgcaggtggtgcccctccaggcgcacctcgatctttccgcccgcgacggagtacttgaaggcgttgtcgatcagcgcccccaccatgcgctgcaggtactgctcgttgccacgcacgtacacgttgggctccacgtcgcagctgagcgggtggccctccgtcagcacgcgcgacttaaaccccttggcctcgcgctccaccacgtcggacaggttgaccatgccgatggtgcgctcgtcctccgtcgccgcgcgcgaaagcacgatgaggctctcggtgagcccgctcatgacgcccacctggtcctttatgtcgtcgatccactcgttctcgcccacgtccatggccagcacgtccgcgtcggccgaaatgatggagagcggcgtcctcaggtcgtgccccgcgtcgatcacaaactgccgctggctctcgtgcgcgctcacgatcggtcgcacgatgcgcttcgacaccagcatgaagatgaccgtcaccaccacgacgccacccgcgtacaccatcatctcgtccgtcacgctgtcgttcagcgccgcgatctgccggtcacggtcgagaaggacgacggtcttcgtcccgtccgcctcggactgcacgcggtagcggaacttgcccacgtagccgcagtcctggctgcgtgccagcgcccgctttaccagggtggcggcctcgcttgagtcaacggtcgcaacatggtccaggttcgcgtcctccacggtgccgtccgcgttcacggtcgccatgaggtagcgcatctcgtaaaagccctcgatcttgctgctcgagtagccggacatgtccttgggcgtctcgccgtcgttctcgatgatctggtcgatcgccttgtccgcgtccacgtccacctgcgctcggcgcaccatgtacgtgcccacgaacatcacgcccagcagcaccacgagcgccgctgccacaaagagcgtcagctgtatgcggagcctacgctccacaggactcgaccatcctccagccgtcgtccgcggagccctccaccttcacgtccgagcccagcgcctcgagcttgccgttgaggtagctggcgtacagctccacctcgccgtcgagcgccgcgccgtcccacacgcggtcgctcagccagctcgtgtcgaccttcttgccgccggcgtgggcgagaagtgcggccatctgggcctcacgctggttcacgctgagcgagccctcgcgggtcgaaagcgtggagtcgtcctccccgatcaccaggtcgccaaagcacaccttgggcgaggcgcccgagcggtgccgtgcggccgcgcggatgcgcgccacgagctcgcggctgtcgtacggcttggtgatgtagtcgtccgcaccgtcctccaggcccacgaccttgtcgtccacctgcgtctttgcggtcagcaggatcaccggcacgtcgtttccctccgcgcgcacgcggcgcagcacctccagcccgtcgaggccgggcatcatgatgtcaagcaccgcaacgtcaaagtagccgcccttgagcgccgagagcgccgcggggccgtcgtgcacgacctccaccgtgaggccgttcttctccaatatcacctcggtcgcgcgcgccaggcgcacgttgtcctcggcaagcagaacacgcatgggcatcccatccataatcgcagttgcgcggggcgccgaccccgcgtgggcaggcccgcgcccgccgcatggttatggtacccaaccgcccagcgttaactcactcgtgccgctcgcccgcggcatcgcccgcggtggcgagcccgtcggccgcgccaatctcacaaagccgcccaaaagcttgcggctgcctgcagcggcggccgcacttctcgcccgtgactacttgttggcgtgaccctcgatcaccatgttctcgaagcggtgcgacatgaactcgtttgagaagttcgcgtccacccactgctcaaactggttgcggggagggatgccctggtcgcgctgggcgcggcgcgtaaagcacgccagcgtcatgaacacgtcgagcgcaaggtaggcggcaagtacgaacacgaagatcacctggcggcgcgtggtgggctcgccgatgaggtcgagcagccacggcgtgatgacggaggaccagatgaggccgatcagcccccagaagaacaggaacggccacgacacccacttggtgatgtgcccgggcacggtgctgtagtcccacgagacggcgcccatgaacgtctccatgccccagccggttatctgctcaagaagcccgcccaccaccatggacaccagaaagacctcccaccacggggcgtggcggcgcatcagctcgcgcgacacgagcgtgagcagcacggcgcccacgccgtacaggggcgagaagggcccccataccaggccgtagcgcccctgcgtgagcccctccgtcacgaacatccagacctcttccagcacgaggccgcccacggcccccacgatgaagaggatcacgacctggtaccacgtgatgcgcatgtgctccacgcggtcgttgcgaacgatcttctcgcgctggaatattgcggaaagctgcgcgcgcgtgagtcgcagcggcttgccgatgagcttgcggtaccccttgaggcggtaatagaagtccagctccttggcggcgtcgcgcacgtcctgcggcagctcgcggtcctgcgcggcccattcgatccgcttgccgcgtcccagccacgacacaaaccacttgatgacaaacaggacgcccctgaccacgagggcaagcagaaggaggctgacaagggaccagaacataggctcaactccagtgtaggtagcgcgcgggcggtgccgcggggcagggcgctagcgcgtctcgacggtgcggcgcaggcccacgagggcgagaaggacgccaaccagggcaagcacgcccagcatgagccagacgtgtgcgaggaagggcgccgtcgcggtgtactcgggaaggttgtggttgacccccagcacgccggggtccagggggaagttggtgatgtagtcctgcaggcgggcgatcagcgtgtcgaagaacgggatcttgacgccgcccacgggcgacttggacatctcgcgcgccacggaatcggtcacctggctcgtgacctgctgcgacacctgccccatgatcttcttgaccgaggtctcggccttccacggcagcgtgtcgatgtcgaagatcgtgccaagggcggaaagcccccagcgcacgatggtggtctcgcgcagcgggcggatcgcgtcgggcaggccaaagagcgtctcggacatgatgagctcgtagatgaggatgaacggcgccacggtgagcgcctgctgcgacgtgtgcacgatggccgagactcccagccccagcatctgcgcggcaaacgtgatgaggaagagcgtgaggaagtactccaccatggtcggcgcaaggatcgccgccacgtccgttggccactcgatgatgtaggtgctcatggcatagaggatcgccgtttggagaagtgcgtggacggcctgccacgccacgttcgcgagcacgaacgagtacgggttgaggcccgagaacttgtcgcgctcgagcacgtcgcgggcgtcgcagatgcagaggatcgagtcgaacaggcccatccagaggcagcagcacaccacgatgaagaagccgatcttggcgttctcgtaaaagtcgaacatgcggtagcggatgacccacgacgcgagcgagctgatgatgagcgcggacgccgccatcaggagctcggacttcttgttgaacgactcgcgggcaagcatggcgacctgctcgacgaagctcagactcatcagcacatgcctccaagggcgtcgggatggtcgcggcgccattcctcgaagcgacgtatgaacgggacggggtccttgtccatgagggtgtatatctcgcgcgtggagcgcgtgtcgaagtactcgaacagcttgtccggcgtgccgtagaagcagaccttgccgtgcgcgaggaagcagatcttgtcgaacagctggatgttctcgtagtcgtggttgatcacgaggcagctcatgcgctcgtcgtgcacgagggcgtgcaggacggccacgaggttgccggagtcgccagggtcgaggcccgaggtgggctcgtccagcagcaggccgtcggggtacgacaggagctcgcacgcgaccgagacgcgacgcttttctcccccggagcacttgcggatgagcgtcttgctgacgcccgtgagctcgagctcgcgcatgacccagtcgatccgctccttggccttggggcccgggaggtgcttgacggcgcgcgcgtagaactcgagctgctggcgcacgcggaggttctggtgcacgaggttctgctgcggcacgaagccgagctcgccctcgaagatgacccggcccttggtggggcgcagcgtccccaggatgatgctgccgagcgtggacttgccaccgcccgagctgcccacgatggccacgagctcgccacccttgatggtgaggttgatgtcgtccagcaccttcttgcggccaaagctgcggctcacgtgcgagagcacgatgttgccgccgcgcgggccggccgacgcgtccgcgtgcgcgccctcctggagcatgcggtcgcactcgtctatctcgtcctgtgcgtcctcgcggcccaggcgcagcgcctgggtaaagtacttgcgggcggtgtcgtagctcttctccacgaacatgcccgtgccgtagcagagggcgagctggaaggccgcgtccgcgttgccgttctctatcgcgaggtcgaaccacgccacgccgcgcgcgacgtcctggtcaaggtatttgccgatgaggtagtagtagcccaggtcccacatggccgtggtgttgcccgcctgggcggcgcgctcccaccactcgcgcatgaggtcgtagttcttgggaacgccgttgcccgcctggtagcggttgccaagcgagcgcatggccgtgcggtcgccggcctcggcacgggccttgagctgggcgatctcgtcctccgcaaggtccgtgtcgtcgtagtcgcgcccgggggcggccattgcgtccgagaagtgcctgccgcgctggccctgagcgagggcgggcttcacggctggcttggtcgcgggagcgggggccgttgctgcagcgggctcgggctcggccttgggctctggctcttgctccgtcttgggttccagcttcgactccgccgccggctccggctttgccttgggcttgggctcaggctcatgctccgtctcaggcttggcctgctttgcggcctttcccttggccgacttggcgtcggacccctttggcctcatcgcgaccacgacggccgcgtccttctcgccctcgccggcgttcggggacgcctccactctcaccacgaggttggggtacctctcctccgccggctcctccgcggggacttccgatgcaaccggggagtccttctcgcccgtcgcctcatggtcttcgggttcggcttcgtcctcggtcgaggcgtcatcctcggccttgtcgccaccctcggccggagcatcgccctccgcctccgcatcgccctcgctcagcgcatcgtccttggccgaaacctcgccctcgtccggcgcctcgtccttgtccgcgggctccagcttggtcgtggcgtccttctcgcccagcgccacctgcatcaggcgctcgggaagcaccaccttgtcgggatcgacggtctgctccgccgtctcgggcaggatgtactccagctcctcgtcgggctctggtgcgtcctttgccagcgtcacgtcggcatagtcgatgtagccggtctggcggcggttcgcgcggcccccgtcgggaagtcgcttctggccgtccgcaccggcagacttggacttgccgcggccaaggccgaagagccacccgcgccgcctgggcgccggtccctgcgggtcgttcttgccccaaaagacctctgagtcagtctctggacgtttgctgcccatcagcctcgcctagccagcgatcagcgagacgaggtcgcttgcggatttgagcagcgatatctcgtcttcgaggttctcgtatgtgtcgtttatgccggaaaggagcgacagcagctcgtcgcgcttgtcgttgaggtcgtcaaaatgcgcgtcgccctgcgccttgacctgcttctcgcagttctttgtgacgctctgcgcgctgtccagctcatcgagcagcttggacaggtccttggccgagcccagctttgacccgtccgtggggatgaccttctcgagcttgtcgcacacggggatgagcgcgtcatcgcacgagcgcttgcccacggcggccagcgtgcgcgccatgcgcacgtcgtcacctatgatcggcaggcgcgcggggatgccccacacccaaagctgggtctgctcctggatcttgtccatcgacttggtgagcttgcgcgccgctttgatggcggagctgtactttgccttcttggcggcggtggtgagcgccgcgtagtcctcggtcacgtccgccgtggcgtcctgtatcgcaaggtagctgcgaccaagcagggcaaggtatacgacgagaagggcgaccaccacggctatgacgatgttcctggtcctatggctcttcttgggtccctgcgaggggtccgccttcacgggaatctcgtcgctcgcaaggcccagctggaaaacgcgcttggccatgtaccctcctcctgtcaccatcgtccgccgcaacggcttgcccgcaccacgtgcgcgggtggaagtattctaccccctagcctagccctcgagcatgaagcgcggcgtgcggccctcgcgcgtggcgcaggccagctcctccagggccttggccacgccgtcctcgtcgcagcggccaatgtggtagcgggccgccgctgccgcctccggcgttgcgttggcaaccgccacggagttggggacagcgtgcatgatggccaggtcgttttccgcgtcgccaaagaagagcacctcgtccgcagtgatgcccatgctgtcgagcaggagcggcagcgccgtgcccttgttgaggccgtgcggcaccacgtcgcaccagcgggcaacgggctgcacgatgtcgaactcgggacagagctccatgccgcgcgccttgatcttctccaacacgtcctggcccagcgggcaggccaccgtcgccgcgatcagcttgtcctccggcacggcgtccgccagcgtgggggcaaagcggaagtcgcgtgcgtagggcgccacctcctccgccgtggcgccgatgcaccaggcggggttgctcgcatccgtcttgaacgggtaggccgtcacgaagcagccctcgtagccgcccacgtagtccgccaggcgctggagcgccgcgttgtcgatgtagctcacgtgcttgagctggccgtccaggtagaccttcttgccgttgctgaggatgcccgtctggaaggcggagtcgctgccgccaaagaagcgcagcagctcctgggcgtcgcggccggtggcggggccaaactccacgcccgccgcccgcacctcgcgtatggcgtccagcgcacgggggctcacccgctcgcagccaaacggcagtagcgtgttgtccatgtccgtaaggacgagcttgatcatgtgcatcctccatcgtgtcgcttgcgccgcatcatggcaaaaatcatactattgcacgtaaacgggcgcggaatcctctggcaaagtcgcatattggcgcagcgggaccgtgcgcagcagctacgcagggaggtctcacaggtgctcatgccgcaggacaaggcggaacggcttcactttacccagtcttatgcaggtggcgagggcgccgcatgggcggagctcccctactggcagtgggacgtggagcagtccggctgcggtctctgctccatgaccatgtgcgtggaccttcttacggggcaggagctgacgccggcggacgtgctggcgcactaccagcgggacggcatggacgagtgcgccaggagcctggtgggcggccgcaacctgtgccccaagctcaacaagtacaacgagcgcacctttggcgtgcgcgcaagcgacctggagcgcagcgtggacgcgtttgcggaggccctcgcgcagggcgacgtgatctgggcgtccagcgcggacaggcagggcacgcacccctggcactttgccgacggcacgcagcagcccctggacgagacgggcacgcagcaccaccacgggcacatcgtgtgcatctggcgccacgaggacggcgccttcctggtgaaggaccccatcggcccgcgccgcctctgcaacaacgtgcgctacacggacgagcagatggcgctctggctggcaggcaacgaccaccagcagtaccgcgtcacgctcgcgtcgggtgccacggcgtaagcacggccgctacaggtcgcgcttggtcaggatctcctgtgggatgagcccgcatcccaccaccacggcgcgcgcgtagtccgcctcctccggcgagagcccctcgcacaccagcgacatgtccggcacgtccagcttggactggcctgttgactcgttgtcctccgggtccgggaagcgctccatcgcgcggtccaccatgagcctatacgcgggcgagaaggacgagaacttgtacttctcgcccagctccgccttgagcttcatcatgaggtccacgcccgcgcggtcgatgtcgccccagtacagcacctcgaccgtgtccgcgcccagcgtgtcgagcaggagcgagagccggttgtgctccagcacgggcgtgccgccgcccagcaccacggcatgcacgcgctcgcccaggatctgcgtgcggccgtcctcgtacatgaggtcgtgaacgtccaggtaggggtcgaggttctccgtcaccagcacgcgcatgtgcttgcggcggcgcggcgcgtggtacaccaggtcgctcttgggcatgggacggcggcgcacgatgtcctccatgcccatggcgcgcagtaggcggaacccgtcgctcccgtactcgaagaacttctcgtccccgcccatctggtaggcaagctg

SEQ ID NO: 144 - DNA, 7228 bp, Unknown
  Metagenome-assembled genome
tcgcgcaggactttggcctgcacggtaagctgggcaaggacatcagcacctccacggtgggcgtcatcggcacgggccgcatcggagcgaccgtggtgcgccacctttccggctttggttgcaagattcttgcgtacgacccctaccccaacaaggaggtacagaagtacgccacctacgttgacctggacacgctacttgcacaggcagacgcaataaccctgcacgcgcccggcctcaagcagaactaccacatgatcgacgcggatgcgtttgccaagatgaaggacggcgtggtcctggtcaacgcggcgcgcggcatgctggtggacacgcaggccctggtggcggccgtggagtctggcaaggtgggcgcggcggcgctcgacaccatcgagaacgaggccgacctctattaccgcgacctcagccgcgacgtcctgcccaaccgcgaccgcagcgtgctgatggcgttccccaacgtgatcgtctcgccgcacatggcgttctacacggcggaggacgtccgcgcgatgatcttcaactccgcctccgcgctgctggcgttcagccgcggcgaggacaccccgttcgagatccgcgcgtaacgcagccctcgtgccagagtcggacgcgcgtcaatttgcgcgttctagtaacaaataaagttagctgaatgatgcattcgaacacgtgccgagtgcatctctatatttcagtgtaaatgggctcgttcagacagtatttcgggaatgccggagacacctcggtcaacttcagcttctccagcatcgcctcccagctgagcgatacccagaagaaggagaagttctacatctacgtctacaccgacgcacctgatggagacgggccggtgacgaatagcgctacctctacaaacaactcgggtaagagcacctcagacacccgcaccgcggatgtgacgcatcgtaccctgaatgtcacgaagaaccattcgaccgagcagtttgatagcgatacgaaggcaacagagcactggagctcttcggtcacgctgccggaaggcaacatcacgtccttcacctataccgataccatcgaggatgcgaaggatgagaacggcaacgacatgggcacggatagccattacgctatcgcggccgagctcgagaaggagcttgcaagtaccgtcgtcaatggaacgaagacggattcgggtcatctctacatcaaggccgatggctacaacaggtactactatgcaggccatgctcaggcaggctccttctatcacagctactatgacagccaggatggcctgacacaggatgtagatatcaaggtcatctactatgacgccaatggcaaagaggtctctgccacagatacgacgacccatgtgaagagcttcaaggtcactgtcacgataaaggacaatgcgcagatccaggctcagaccatggagcttgagagctacaagacgcatgtggaccactcgagcgctgcagaggggtctacctggaagatctccaatacggctgccgtaggcgataagaaagatactgccacctttaactttggcaatccgaagaagctcgacaagcaggtgaagacgggcaacaagtatggtgctgatgtctacaagagcggtgatgcagcgcttaactacgacaaggtcaatggcatcctgacctatcgcctgctgctgagcacgactgagacagattcggacaagaccatcattgtcaccgatacgttgcctgacggggcaacgctcgtggatggctcagtacacgccagcttctttgcgggagagaacaaccagccgacgaccaactacaatgggaccaacttcaacggggatcagaagccccaggtctcgacctctcagaatgacggcaagacggtcatgaccgtcaccatcccgaactacaagtactacgacgacggcaaccatcagtactgcaaggttgccatctactaccagctgtctgtgaaggatgacccttcttggaacagcagcatgcagaagacgtatagcaatacggcaaagtggggcagccactccgcttcgtccaacacgaccatcaagcgcgatgcaacaaagatcgccaagtccggtgagcagctggacaagaacggcaatgccgtgaagctcgactcgagtgggaagcccatcgtcacgccttccggcaaggtccgctactacgtggaggtcaatacaggagcggaagatctcgaccctaactcggatgagctggagctcaccgatacgctgaatgcagacagtgccctcgagcccaagctcgaccccaactccatcaagctctatgcgtatgacatcacgaaggaccaccattacgatccggagaaggaagtcaagaactaccgcgtgaagtacgacgagaccacccacaagctcacggtggagctgcctgacaagacggcctgtgtcctggtctacgaataccagctcaataacagctttgcggacggcaagacagtctcgaacagcgcttcactttccggcaagttcagttcagacagcaatgtgacgctcaaggaggttgattcctccgctactgccgagaaggcgcaccttgtcatctacaagacagacgaagatgacttccacaagacgcttgaaggagccacgttcgagcttgactactgggacaacgctagcagctcatggaagaagaaggatactcagaatgagttgacgaccgacaagaatggcgccatcacctatgacctggaggagaactccgacagcctgaagccgagcgtgctctaccgcctgaaggagacgaaggcccctgacggctattcctgcaatgctgtgcgctacttcatctggagagcgtctggcgttacggcggataccgcctacagcgactccaaggcagcaaacgcaaaggatgattccggcaacgcgattcagcgctccgccattgagttcttcgatcatgctggcggcgacatgtacattacggacaagtacacccgcgtcagcgtgcagaaggactggacaaacaacgacgggacggaggcaactgtcccttctggcgctagcgtgaaactgcagctctatcgctcggcaaagacgatggacacaagcgatgcagtgaagatcactgtgactggcgagggcaatggattgaacgctggatggaagccgaccatcaacctcgacaactcgtctgatgggtcacgctacatcaagaagggctcggacttcgtcttcaccatcggaggatggagtggcttgcagttcgcggtctatatcaatgggtccagcacgcctacctatacctatacgtatacgaacgccgatattcccgtgacgattcatgatgtggaagcagatacgaccgtgcttgtcagggtgacgagtgcagcaaatgcgcctcagagccttaccaccaagtcctggcaggatccgaaacagattctggacgactcctccaagaccgccgtgggcggccccgtcacggtgagcgcgacggacaactggacgcacaactgggacaacctggctcaggacgatggcaacggttacaagtactactacaccgtgcaggagcttggctacacggttgacggcaaatactacgacgccagcaccagcggcaagtacaccgtctcgtacagcaacaacgctggcattcagacgggctccatcacggtgacgaactccatgccgaagtcacacgtactgcccaagaccggcggctcaggtacgagcggaatcacgctgctcggcgtgacggttgccctcgcgtctgcgggcgcgcttctcgcccgtcgtgctaggaaggataaaggcgccgagtaagcacggtgcctgacgcgtaagaggattcaccccgagaaccgacggtgctcccggggtggattgcgtttctcgtccagcttgcgagacggctgatgtggtggggctagtagaagagggggacgcggtcgcggaggaagtcgtccagggtgcaggcgcctgaggagctgccgcccacgacgatgcgccttgcctgcgggtgccgcgcgaggaacttggccatgccgccctgtcgggactcgttcccgcccttgacctcgattgcggcgatcgagccgttcctgaccgcgacgaagtcgacctcgtccgcgccctcgcgccaccagaagaggtcgaagccctcctcgggcgcacgcgcgagaaggcgcgcgccgacggcggactccacaaggtggccgcggcgggcgctgtccgcggcgtagaccgaacggccgagcccgtctgtcgccgtcatgagcgacgtgtcgtacaccatgagccgcggggagcccttgcggcgcgtgacgggcttctcgtcgtactttggaaggccgcacagtatgcctgccttgccaaggaggtccaggtagtgggcgagcgtggtggtgttgcccgcgtcctgcagctgcccgagcatcttattgtacgagagctcctggccggagtacgtggcgcccagccggaagagcgcccgcatgagcgcgggcttgcgcacctggccgagtgcgagcacatcctgcgagatggtcggctcgattatggcgtcgcgaacgtaggcggcccagcgcttctcgtcctttgcgaagcgcgccgcaccggggtacccgccaaagaagaggtagtcctccaggctgtagccaaacgcctgggagcactcctccaggctccagtggggcgacctgatgagctcgaagcggcccatgagggagtccccgagtcccctgtgcagcagcagggaggaggatccgctgagcacggcgcgcactggcgttccgttgcggcggtcggcgtcgtacagggccttcacgactgtgggccaatgcgggaccttctgcacctcgtccaccaccaggaccacggggcgctccccgccgcccgtcatgttgcgcgcctgctgccactctgtctgcagccactccgcgctggggacaatcgcctcgtccgagctcacatagctgtgctccaggtctatttggtccagcgcctgggcgagcatggtgctctttcccgtctgccttggcccgacgaccacctggatgaggggattctcgagctcgctcatgcgtgatgcgattgtctgcacttggtgcctctggaacatgccggcctcccccgtacttctcaacgtactgagtaagtatactcaacgtattgagtaaatttactcagtatactgagaagtgcaggtagacggcacaaaaacgacgggcgagaaggacgctctgccttggttggcacgtccttctcgcccgtttggcgatgcttgttgtggcgccgcggcgccgacgcccgctgcggcacccgcgctagtacgagacctggcagcggatgccggcggcgcgcacgcggtccgcgatggcgtccagcgtgtccggcagggccttgcggatgttgggggccggcgtgtcgcgcgcgatggtgtagatcgtgacgtactgcggggcgatgcgcttgacgtcctcaagccactccgtcacctggtcgtacgaggtgttggacacgttgcggtcgccaaacatgccctccaggaacatggtctggatgatgacgtggccgtcgtagcttgcgtatgtctgcacctggtgctcgatggagtaggaggcggccagcggccggtcgatggcgcgggccaggtcgtcggagtgcgcgtccagcttgaggatgttgtcgtccaccttgaggagcgcctcgcggacctccggctggtccgcgttggtgccgttggagagcacggctacctttgcgttgggggcaaactcgtcgcgcagcgcgatgacggcgtccacggcctgcggaaagatggggctcagcgtgggctcgccgttgcccgcgaacgtgatgacgtccggcaggtcgtcgtccgcggccatgagctcaagcgcctcgcgcagcgtgtgcgtgagctcgtccatcgtggtgaacgggtccttggtgcggcgcttcgcgttgaagccaacctcgcagtagatgcagtcgaacgagcagattttgccggtgcagggcatgaggttgacgccgagcgagacgcccaggcgtcggctgcgcaccgggccgaagacgggacttggattgaggaacgtggccatggtcttctcatccaccttaaagcgtttctggtttcgcctgaattgaccagtgattgatggtcatcttgcgaatgaaatctaccttaaattctaaacttcactaataatagcacgccgtttgacccgcaaacgcgtaatattgccgaaaagttacacgcgcatggattgaaacgtggtatgtcataggtagcttcaaggcgaacagtccatcgcgaggggcgatggtcgacatgttgggagattgaaatgggtcgtttcactaacccgcgtgacgtgtactttggagagggcgcccgtcatgaggtcaagaacctcaagggccacaaggccatcatcgtttccggtggccacagcatgcgtcgcggcggcttcctgcaggacgtccagaaggacctggaggacgctggcttcgaggtaaagctgttcgagggcgtcgagtccgatccttccgtcgagacggtggagaagggcgcggctgccatgcgcgagttccagcccgactggatcgtcgccattggcggcggctcgccgattgacgccgcaaaggccatgtgggtcttctacgagtatcctgacgagtcctgggacgagatcatcaagccgttcaacttccccgagcttcgccacaaggcgcacttctgcgccatcagctccacgtcgggcaccggcaccgaggtcacggcgttctccgtcatcaccaactaccagcagggcatcaagtacccgctggccgacttcaacatcacgccggacgtcgccatcgtcgaccccgagctcacctacagcatgcccgccaagctgtgcgctcacaccggcatggacgcgctgacgcactgcctcgaggcgtacgtctccaccgcggcctccatgttcacggacgccaacgcgctgcacggcatccgcgagatcacggagtggctgcccaagtcctaccagggcgaccatgaggcccgcgcccacatgcacgaggctcagtgcatcgccggcatcgcattctcgtctggcctgctgggcatcgtccactccatggcgcacaagaccggtgccgccttcgagggtggccacatcatccacggctgcgcaaacgccatgtacctgggcaaggccatccagtggaactccaagg

SEQ ID NO: 145 - DNA, 39682 bp, Unknown
  Metagenome-assembled genome
tgggctttgggagccgtacgtaaaaggaaaggccactaagacatgtcagatcttctgaaccagatcatcacccccgaggtccgcatggtcctctacctgatggtcgcgtgcatcgtgatgctctacatcctctccatcgtgtacgtcatccgcgacgcgcagcgccgtggtgcggagccctggtggctgtgggcgatcatctcgatcatcccgatcgtcggccttctggcgtacgtgatcctgcgtccgagctcctacctggtcgaccgcgaggagcaggacctggacatcgcgcttcgcgagcaccagctctcgcactacggcatctgccccaagtgcggcgcgcccatcgaccgcgacttcgttgtctgccccatctgcaacacgcaggtgcgcaacgtgtgccccacctgtcaccgtccgctcaacgcggactggaaggtctgcccgtactgccgcacccgcatccagtagcggcagggacatttcccgaaccccaaaggacgtcagcgcaaccacgcgccggcgtccttctctttaccttgtctgtggccgtgcggccggcgtatgcatgtgacgattggacccggcacggggtgtccgcccccttggggtagaaggacgcgcgaccgcccttgcgtccttattggatggaatgggcaaccatagtggccattttggcccgttgcggcgccagagtgtggtacaaccgaggggtaaccaagcaggaaaggcacacgcggcacatgcacgctcgttttgcacgtcgaactaggactatgtaggcacctgtccctttatgagtcgggctcggcttgtgacaggtgccatggagcccgcatccgtaggagcgggctatttttatgcatagcggacgcggcacgccgcgtataccaacggaagaggttatcaagatgaaggcactgttcaacgacggccatgtggaggacgttcccgaggacgaggagctccacgtcatccgtcactccgccgctcacatcatggcgcaggccatccagcacctgtacccggaggccaagttcgcctttggccccgccaccgacaacggcttctactacgacatcgacctgggtgacaagaaggtctcggaggacgacttccccgcgatcgaggccgagatgaagagcatctgcaagcagaacctcaagttcgaggtgttcgagctccctcgcgccgaggccatcgactacatgaagcagcgcggtgccgactacaaggtcgagcacatcggcgacctgcccgaggacgcgcgcatcacgttctacaagcagggcgactacgtcgacatgtgcgtgggcccgcacatcctctacaccaaggcgctcaaggcgttcaagctcaccggcgtgagcggcgcctactggaagggcgacaaggacaacaagatgctcacccgcatcaacggcgtcgccttccgcaacaagaccgagatggacgagcacttcaagctcctggaggaggcggagaagcgcgaccaccgcaagatcggccaggagatggacatcttcatgatgaacgaggccggccccggcttcccgttctggctgcccaacggcatgcgcatccgcaacgccctcatgcagtactggcaggagatgcaggacaagtacgggtacgaccaggtgcagacgcccatcatcctctcgcgcaagctctgggagacctccggtcactgggaccactacaaggagaacatgtacacgacccagatcgacgacgaggactacgcgatcaagccgatgaactgccccggcgcctgcctcatttacaagagcaagccgcgcagctaccgtgacctgcccctcaagctcgcggaggccggcatcgaccaccgccacgagctcaagggcgccctgcacggcctcttccgcgtccgcgagttccagcaggacgacgcgcacctcttcatccgtccggaccagatcacggagcaggtcgaggacgtcgcgcacctgatcacggcgtactacgcgcagtttggcttcccgtatcgcgttgagctctccacgcgcccggacaactccatgggctccgacgaggactgggagcgcgcggaggagggcctcaagaaggccctggaggacatgcacgtcgactacaagctcaaccccggcgacggcgcgttctacggccccaagatcgacttccacctgcaggactgcctgggccgcgagtggcagtgcggcaccatccagctcgacttccagctcccgcacaacttccagctggagtacgtggacaaggatggcaccaagaagcagccgatcatgatccaccgcgcgggctttggcagcttcgagcgcttcatcggcatgctcatcgagcagtacgcgggcaagttccccacgtggctgtcgccctgccaggtcaaggtccttcccgtgtccgagaagacccgcgactacgctaacgaggtcgctcagaccctgcgcgacgccggcgtgcgcgtgaaggtggacgaccgtgacgagaagatcggctacaagatccgcgaggcccgctccatcgaccgcgtgccctacatgctgattctgggcgagaaggagaaggaggccggcaacatcagcgtccgcgaccgcgcgaccaacgagaccacgcagcgcgacctggccgacttcgtgaaggacatcacggaggagattcgcgagcgccgcggctaatccgggcccacggaacccaacggtatgacgagggtcgtcccactctggtggggcggcccttttgcgttgtgtcgcgggccaaggcggcgcgtccttctcgcccgcgtgggcaccgcgcgatgcggtacagttgggacgttgaccgacgaatcttggggatgcctgcatgactgacgcgacgcttgacgggggagaaggacggggcgactcagcgggggaggccctgcgggacgcgtgccgcacgtttgcgagggcgctcggcggcaggagccgcgcgtgggtcgtggctgcctcgggcgtcgcggacgtggcacgggagctggggcttgacgccggctccgtcgcgactccgcttggaggcgtgccgctggccatgacggacgtgcgcgtgcttgccaggcgaagggatgcgaggccggctgacgagcgcacgccgctcgtgctggacgtgagcctgacgtctgccctgggatgccccgcgggaaggctcggtgcggacgtggcgctggcgtcgctcgatcgcgtggtgcggcgccgcgactgcggcatggtcatggtcgggctgcgccgcgaggcattgcagggccgcaatgggtgcgagggcctggctgacgcggtggcagcgctgccagcgccggacgatgccctggtgtgcgagctggcccgcagcatggccgactacgaccagaggcgccgcacggcaaacgacaacgcgcaggtggccgcggcgttcctgcgctgccatccggccgttgcggaggtgcgctacccgggcctgaccgacgatccatcgtatgaggccggggccgccaaccttgaggatggctttggcccgctggtggatgcgaagtttgcgcagggcgtcggacgcgaccttgcccgcgattggcacgcggagctttgcggcagctatgtgccaggcggcaccgccagcagcgcgcgcgtgttgcaagatgactctggtgcgctatggctcagggtcgagtgcggctgtggcgacccgaaagagctcgtggtcgcgctggaggcacttctcggcagcatgggcaaacgggtctgattgacacgcgggttaacaagagcggccgcctccgcgatgggaggcggccgctcatcaagtctcgtatgagccaacctgtgctactggccgtcgtgcgcgtacgtcacgaacgagaaggccttgcccctcttggtgacgccgccctcctcgacggactccacgcgccaggcagggtcctcgtccaggttggggaagaacgcgtccgcgggcagcgtgacgtcgaacttggtgacgtaggcgcgcgcacagtgggggagaagcgcgcggtacacggactccccgccgatgagccagacgcgggaggggtcctcgcccgcgacggccgcgagcgccgcctcgggcgacgtgacgcccacgacgccctcgggaaggctcgcggggtcgtgggtcacgacgacgttcctgcgtcccttgagggggcctccggggaagcttgcgagtgtccttcttcccatgacgacggtgcaacccatggtgagctccacaaagcggtgcatgtccgccctgctgtggacgagcagctgtccctcgaggccgatgccccagtcgtcgcacaccgcgactattgcgttcatgcgcttcctttcgcctggctgcctagatcgcgatggggatgtccttaacctgcgggccgtgctcgtagccctcgacgatgaggtcgtccgtcgtgaagtcgtagaagtcgtgcacgtacgggttgaggtgcaccttgggtgcggggtaggtgggcctgctgatgagctccttcacgatgtccacgtggcggtcgtagatgtgcgcgtccgcgatcatgtgcacgagctcgccggcgtacatgttgctcacctgcgcgaccatcatgagcaggatggcgtactggcacacgttccagttgtttgccgcgagcacgtcctggctgcgctgcacgaggaccatgttgagcgtggggcggtcgtcgcccgggtgctccgtcacgttgtagatggcgttgtacgcgcaggggtagaggtgcatctcggacaggtccgcaaaggtgtagaggttcgtcatgatcctgcggctgaaggggttctcgcgcaggtccttgaggacgcggtccatctggtcgtagtcgccgtcggcgtagtggctcacctggcccacctggtagccgtaggccttgccgatggagccgttctcgtccgcccactcgtcccagatgtgcggcttgaggtcgtgcacgttgttggacttgcgctggtagatccacaggacctcgtccatgcagctcttgagcgccgtgcggcgcagcgtgagcgcggggaactcctcgcgcaggtcgtagcggttgcacacgccaaactgcttgatggtgtaggcgggcgtgccgtcctcccagtgcggtcggaccttctggcccttggtggtggttccgttgttgatgatgtccttgcacatggcgatgaagatgtcgtcagccttgctcatgtctggcctccgttcgcgagttagctcaggtgggatgcggttgcggtgcctgcggcgggcatgcggtaggcgccctcgcccaggccgtacgcgccgtcgtcgtaggtgtcctcgtcctggtcatgctgctggtcgttctggtagtagctgcccgatccgccgtcctggtacgcgcggtcgacgacgtagcccacgaagccggtcacaaaggagccgatggcgctggacaggaggagaaggacgatcacgccgaccgcggcgatcaccacgggcttggcgcccgagttcgagttgtcgggcgaggtcgtggcggaggcggtctctatcacctggggcaccggcgccaggccttgctgtgcctgtggctgtgcggcctgtggctgcggtgcggtctgtgccggctgcgcgtcttgcgcctggctttggtcttcctgcatgggcatcctcccgtggtcgctttccgccctatcatagcagctcatacgacgctgggacgtgcccgccgctagaagcggccctccgtgaagacctcgtcccacgccatgccgaggctgcgcgcgacgtccgcgtcggcggggagccagtcgacgtccaggagctcgtcctgcgaaagccagcgctcggcgtcgtgctcgttggagtgcggctcggaaccctcgagcgggatgcacacgtagacgtccatgtgcaggtggaacgtggggtagtcgcgctcgaccgtgtcgaggtaccacgtcgcggaaagctcgagcccgagctcctcgcgcacctcgcggcgcagcgcctgctccggcgtctcgctcttctcgaccttgccgcccgggaactcccagcccaggagctcgccgtgcgtgcggtgtgccgcgtagatgcggccgtccttccagatgactgccgccaccacgtctaccgtgctcactctgcctgcgcctccgtacgctcctcgatcctcaccgtcgcgtagaactcgccgtcaggcgagtcgggctttgcgaggcgcacggtgcgcgcgtgatcacccacgaagacctggggcaccagaacgtcgcccaggagcgccatggcctcgtactggaccgtgatgcgccaggggagaagcgcgaggccaagctcgtcgagggcgtcgagcgccatctggatgtactgggcgttgttgacgtggcggttggtgtcgagatgctgacgcgtgaccgtgatgggcgcggcctgcgtgaagtcgccgctgacggcgatcttgcggctcgtgggcggcaggtcgacgcgcggcgtgtcctccacgtagaccatctgacgctccggaaccttgacggggcggccgagctcggtgtcgaacacgaaccagagggagtccgccagcacgcagggcggctcgccgcggcgtccgagtgtgaagtcgcggtatgcgagcaggcgctttgtgccgtggctccacgtgctggtggttatctcctcgccaaaggagggcaggtcgtcgatctggatctgccaggcggagaggaaccacgcatagtggttgcggtgcatgtcgtcgaggccgaggcccacgtgctcgcactggaacgtggaacagtcctgcatgaggttcacgaggccgagcaccgagagcctgccgtccgccgcgcactcgctatagcggaccctgctgtcatatgagtacaagctgcaccctccccaggcgcgccacccgaggcgctagtcaaaaacgacgcggttcttctcgtcaaagtaggggcttgcgtggtcgaccacgagcttgttgcagtgcgggatcacgtgcgccttgtagccaagcacggtgccggggatggtgtcgccgtccacctgcatggggatgggcgagtccgtgcggacctcgacctccctgcccgcgaagtgctcgatgaagggtcggccgcccttggcctccttgtcgaacaggcccgtgaagatgggcacgagcagctgcacggcgtccgaggtctcgagcacgataacgtcgatcttgccgtcggacatggagcagtcgggcacgatctggatgtcggcctgcatcttggcggtgttcgcgacgatgcacgcgatgccgtcgcgctcgaacgtctcgccgtcgaccgtgatggtgaagtgctcgaccttggggtgggcgttcgcgagcgccgccgtgaagtacgcggcctcgccgattacctgcttgccggggatggcctcgcgcatgaggatggcgtcgtagccggagcccgccatgaggccgaagccgcgggagtcgctgttgccgtccgtgtcgacccacgagatctcgccgtagtccgcgctcacgtagtagccctcgcggcaggcggccgcgatggacgcgggctcgggcgcgttcgcgaggttctcgaacacgaggttagccgtaccggacgggaagacgcaggtcaggacgttgcgatcgcgaagctcgtacagcaggctcgtcacggtgccgtcgccgccggagagcaccaccaggtcgaaggactccgcgtcgcgcagctcctcgcggccggcggactctgggtcgagcccgcgtatcacgatctcatcgtcctcgcggatgatcgcgtgcatgaagtcgaagatgtcgctcgacccgatgccagactttaggttgtgaacgatgaggatgcgcacggtgccctcccgccttgttatgtatgatgttgtggcgatgccgcgtctgcgggcgccatgaccacaaaggatagcgcatgcgcgaattcggcgtcagtccgacaaattccttaaacgaaagagtcccattgtacatatccgacaagagggagctcgccgccttctgcgagcgggcgtcagggtcaaaggtgctcgccgtcgacacggagttcattcgcgagaagaccttctatccacgactctgcctcatccaggtcgcgaccgaggaagagtccgcggctgtcgaccccatcctcatccagaacctctcgagcctcagggcgcttttggaggaccccaacatcacgaaggtcttccacgcctgcagccaggacctcgaggtgatactccaggcgatgggctgcgtgcccacgcccgtgttcgacacgcaggtggccgcggcgtttttgggctaccgccagcagatcggctacggcgccctcgtggagcagtgctgcggcgtgcgcctgcccaaggcggagtcgctcacggactggtcgcgccgcccgctcgacgccgagcagctcaagtacgccgaggacgacgtgatctacctcccgcgcatctaccaccagatgatggaagagctgagggagaaggacaggctctggtgggtcgagcccgagatggccgaggtgacgagccgcgagcacttctcccgcccgcccgagcaggcctacctgcacctcaagcgctcggggtcgctcacgcgaaagcagctggccgtggcgcgcgaggtgagcgcctggcgcgacgtcacggctgcggagcgcaacatcccgcgcaagtgggtcgtgtccgacgaggtcatcgtcgagtgctgcaagcgcgtgcccaagagcgtggaccggctcaggcgcatccgcggcacggagcagattgccgaccgtgacgcccgcggcatcgtagaggccgtgcgcaagggcgaggcctgcccgccggaggactacccggagtccaagcgcaaggaccgtccctcggcggaggccgagagcgtcgcggacctcatgtacgccatgctcaggatcatctccgagaagagcggcgtcgcaacgaaggtcatagccacgcgcgacgacctcctggacgtcgcggccggccgactgggctccaggctcatgaagtcctggcgctacgagattgccggccggcagctcgaggcgctcctctcgggcaaggtcggcctcaccgtcaaggacggcagggtcgaggtcctgtaggcgaatttatgtccgccgtgttgggtaaaagtgactcaagcgattaacggatcggagaagatcatgtattacggctacggaatggacttcgcctacctggggatcgtcgttctctcgatcgtcctgggtggcatcacgcaggcctacatcaactcccagtacaagaagtggtcgcgcgtcccggcgtccacgggcaggacgggcgcccaggtggcgcgccagatgctcgattcggagggcgcacccaacgtgggcatcggacgcgtcgatggccacctcacggactactacgacccgcgcgacaacaacctgcacctctcgtcggagaacttcgagggtggctccgtcgcgtccgtcgcggtcgcctgccacgaggccggtcacgccgtgcagacggccaagggctacgccatgggcaagttccgcaccgcgctcgtgcccgtcgtcaacttcacgcagcagatctggatcgtcgtgctcgtcatcggcatggcgctcggcctcgtgggcctcacgcagctcgccgtcgcgctgttcgcgttctcggtgctgttccagctggtcaccctccccgtcgagatcgacgcctcaaagcgcgccgtgaagtacctctccaccgagggcggcgcgattgacgagaagggcgcccgccaggtgctgacggccgccgcgctcacgtacgtcgccgccgcgctcatctcggtcctccagctcgtgtacctgatgggccgcacggacagcaggaactagcatggcgggcggcaaggagtcggaggcgctgtccgtccacgaggcggtcatggtggcgagcgcccacgtggacgccatccccatgctcaccgtcttgggcgaggtcagcggcttcaggggacccaacgcaaggtccggccactgctacttccagctgaaggacgacgagtccgcgatggacgccatcgtctggcgcggtacgtaccagaagtgcggcttcaggctcaaggacggcatgaaggtcctcatgaccggccgcttcaacatctacgcggcgtcgggcaggctgtccttcgtggccaagagcgtgagcctcgccggagagggcctgctgaggcaacaggtcgccgctcttgccaggaagctcgaggccgaggggctcatgtccgagtcacgcaagcgtcccatcccgcgcttctgcacgcgcgtgtgcgtggtcacctcgctctcaggcagcgtgatcgacgacgtcaagcgcacgctcgccaggcgcaacccgctcgtcgtgatccaggaggcgggctgcacggtgcaggggcctggcgccccgcagagcataatccgcgcgcttaatgttgcggccgcggcaaagccggacgccatcctgctcgtgaggggtggcggttcgttcgaggacctgatgaccttcaacgacgagtcgctggcgcgcgccgtcgcggcatgccccgtgcccgtggtgacgggcatcggccacgagcccgacacgtccatctgcgacatggtggcggaccggcgttgctccacgcccacagcggcggcggagtcggtcgcacccgcgctcgacgagatcgtgaaccagatcaacgaccgaaaggtcaggctcgagcgcacgatgcagaacctcgtcgcgagcgacgaggccgtcgtggagcagctcgcggagtcctcacggcgtgccatgacgacgtacctgcaggcaaagcgggcgtacgtggagtcgctcgcgtccaggcgctgcctctcggacccgatggcgccgttcgaggttcgcgccggggagctcaacctgacggaggagcggcttaacgccgccatgccgaggctcgtatcccacgcgcgggagtcgctcgagaaggacgcccgcgctctaggcgcggcgggacggcggctgctttcgcccttcgaggcgcagcttcgcgcaagcgcgggttcgttggacgcgctctcgccgcttcgggtcctcgcgaggggctacgcgatcgcaagggacgacaagggccacgtcgtgagcgacgcctcgaggctgagcgtgggggaggacgtcaccgtccttctcggcagtgggtcctttggcgcgaaggtcagctcggtagacgcgggcacaacagacaaggcataggaacctcgtcctaggaggaacgatggcggaagagtacaggaacatagacgagatgtcgttcaaggaggcctcgatcgagctcgagcagatcgtgaggtcgctcgaggccggcgacctcgagctcgaggagtcgctcagcaagtacacgaggggcgtcgagctgctcaagagcctgcgcgaacgcctggcgaacgccgagcagaaggtgcaggtgctgctcgacgcgacggacgcctccgtgggtacggacacgacggccgcgccggcgacggccttcatcaacgagtagcgcccaggacgagaaggacatccataggagggattacgacatggcaatcaaggacgactgcatcttctgcaagatcgcgaaccacgagatcgagtccgactacgtgtacgaggacgacctggtgtgcgcgttcaaggacatgaacccccaggcacccgtgcacgtgctggtggttcccaaggaccactacgacaacctggtcgacgacgtccccggcgaggtcctcgccgcgatggcgcacgccgtcaaggaggtcgcgaagaggaccggcatcgacaagcagggcttccgcgtgattgccaacaccggcgccgacgcgggccagacggtcatgcacctgcacttccacgtgctgggcggcaagaagctgggcgagaagatcctgtagaccctgccccaaggtaaatgtctatgatatgagtgtcattcttggacccgcgttgtggccatggggcgacggcgcgggttacacttgtgcaagtcaagagggcgggaacacgccccatgcgagaggagacacatgaacgttctggtcatcaacgccggaagctcgtcgctcaagtaccaacttctgaacacgaagacgcgcgaggtcttcgcgaagggcaactgcgagcgcatcggcatcgacggctccttcatcggccacgaggagaagggcgccggcaagcagaagctcgaggtcgcgctgcccgaccacaagacggccatcaagcacgtgttcgacatcctgaacgaggccggcttcgaccagagcaagatcgagggcatcggccaccgcgtggttcagggcggctggtacttccccgagtccaaggccgtcacggacgagacgctgggctgggtccgcgaggtcgctcctctcgccccgctgcacaactacgccgaggccgacgtcatcgagatctgccgcgacatgttcccctccatcggcaacgtgatcgtcgcggacacttcgttccactacaacatgcccgagaaggcctggcgctacgccctgccgcgtgacgtcgtggacaagctgcacatccgcaagtacggcgcccacggcacctcgcaccgctacatctggcgcaccacgaacgagttcctcaagggtgacgtgcacaagctcgtgagctgccacctgggctccggtgcctcgctttccgccattcaggacggccacgacatggacaccaccatgggcctcacgccgctcgacggcctgatcatgggcacccgctgcggcaccatcgacccggcgaccgtctgctacctcgtccgcgagggccactacaccatcgacgaggtcgacaccatgatgaacaagcagtccggcctgctcgcgctctccggcgtctcctccgactcccgcgacatcgaggcgggcgcgaacaacggtgacaagaactgccagatggcactcgagatgttctactaccgcacctcgcagctcatcgccgagatggcccagtccatgcacggcttcgacacgatggcgttctccgcgggcatcggcgagaactccgccacgatgcgtctgggcgtcgccaagcagctcgagtggctgggcgtcaagatcgacgagaaggccaacgaggtccgctcggatgacccgcgcgtcatctccacgccggactccaaggtaaaggtgctcgtcgtccccacgaacgaggagctcatgatcgccctcgacgtcgaggagctcctgggcaagtagggttccgcgcaaaggcaagacaaatgaggggcgcgtgccacgtcggttggcacgcgccccttcgcatgggtcgaacgtgttggctcgcggtcccgggcgcactggcctacaggggcatgagcgagaaggacctcacgaacttctcgcccgcgggaagcagcgtcatgccgcgcttgtgctcgaactcgtcgtcctcgtcggtcgccgtggcgcagcccgtccagggctcgagcgccacgaacggcgcgtcgtgcgcggcggaccagacgcccaggtagtcgaagccgtcgaagtcgacctgcatgccgcggccgctcgggccaacgaggcgcacggtgcggtcgggcacgtcctcgaagacgagcgtgtcgacgtcgaaggtgcggtgcgtgagcggaagcgtgcttgcgtcgcgcaggagttcgaagcggtcctggaagtcgagcaggccggtcgaggtgtcgatgcgggggctcgcgtacgtccacgggcacgagaactccaggcggtagtccgagaaggactcgcccccgtccttggtgacgggcacgttgaacgcggggtggccgccgagcacgaaggggagcgtgacgtcgcccgtgttctcgacctcgaacgtttgggttagacgaccgtcggaggcccgataggtcatcgtgagcctgaagtcgtaggggtaggcggcgcgggactcctcgctcgagtcgagccggagggcaagcgcacccttggacgcgtcgagaggcgtgaactcgaggttgcgcgcgagaccgtggcgcttgagggtgacgtcgccctgcgcggagtgcgcgcggtcgttacgaatgttgcccacgatggggaagagcacgggcgccctgcgcggccaccacgtggggtctccctgccagaggtactcggtgccggacttggcgaggctcatcagctgagcccccttggagtcgacggcgaaatcgattccgtcgccgtctgcgcgatagagcgtcacgttcttctcccttcctcgaaacctgccaagagtatcccacgccgcgtttgcgttgaggcaagctttgcggcgaaatgcatgagcagaagcgtctgatatcgttcatgttaactttttcaggcaggttacaagctatgtgcaatatagtgatttgtgaagagtccatgtacgtatagggaggttcggaggttctatggttatcgaagagttggccaagtatggaatcaaccataccgacgacaggaccgtcgtcgatggctcgtgtgccgccctgatcgagaaggcactcgagcgtggcgaggggaccctcaccgagacgggcagcctgcgcgttctcacgggaaagtacacggggaggtcgccgcatgacagattcatcgtggacacgcctgacgtccacgacaagatcgcatggggcaacgtcaacgtcccgttctcggaggaggggtacgagaagatcagggccgaggtaatcggctacctctccgagcgccgcattttcatggtccacgcgctggccggcgccgacaggcgctactcccgcaaggtcctcggcctctgcgagctcgcgagccaggcgctcttcatgaggcagatgctcgtgcgcccgaccgaggaggagatggcgaacttcggcgacgccgacttcgtggtcatggcggcgccgatgctcaagctcgaccccaaggagttcggcaccaactccgaggccgccgtccttctcaactttaagaagcacgagatcctggtcgtgggcacgcagtacagcggcgagatcaagaagtcgatcttctcgatgatgaactacctgcttcccgtggagaacaacgtgctgagcatgcactgctcctgcaacatgaacccgcgctcgcacggcacgaccgtgttctttggcctgtccggcaccggcaagacaacgctctccgcggccgaggaccgtttgctcatcggcgacgacgagcacggctggtcggccgactcggtgttcaacatcgagggcggctgctatgccaagaccatcaacatcacgcctgagaccgagccgcagatctacaacgcgatccgctttggctccctgtgcgagaacgtggtgatcgacccccagacgcgcaagcctgactacttcgacacgtcgctcacgcagaacggccgcgtggcgtaccccgtcgagtacatcgacaacgccgtggtcaagggtgtcgccaagcgcaccccggatgtcgtgatcttcctgacctgcgacgcctttggcgtgctgcccccgatctcgaagctcgaccagaactccgccatgtaccacttcatgacgggcttcacgtccaaggtcgctggcacggagcgcggcatcaaggagcccacgcccacgttctcctcgctcttcggcgagccgttcatgccgcttgaccctatggtgtacgccaagatgctcggcgagcgcatcaaccacagcggcacccgcgtctacctggtcaacaccggctggagcggtggcccctacggcgtcggcagccgcatcaagctcaagtacacgcgcaagatggtcgaggccgcgcagtccggccttatcgacgagtgcgagttcgtgcatgacgaccgcttcaacgtcgacgtacctaccgagtgcccgggcgttccctcggagctgctgaatcccaagtccacgtgggccgatcccgagaagtacgacgagaccgcggagaagctcgcccgcatgttcgaggacaacgccgagaagcgcctcacgtccatgaccgaggaggtccgcgcggccggcccgcatcaccttgggtagggttcgccaggggaatacgcaacgtcgcgaacactttaccgccgattctgacaccttggccgatgacgtggttacggtagggaaggactcgcaaatatgatggcaaggggtgccctttgcggtgccccttgtctttttgtatgcgggtgcgccgatgtgggtggcgtttctcgcacttgccttgattgggggaactatggcaagaatgcacgtgatggagaggagcgaggcccagcagatcatggatgagctccatgacgcggtagggcgccgcttggcggtgagctcgctcgcgccgtgcccggtcgagttcacgatggcctttgttgacatgtgctcgacccagagctgcggaaagtgcacgccgtgccgcgtgggcctcaggatgcttaggcacatgctttcggacgtgctgaccggcagggcgaccatgcagacgctcgacgacatcgagcggcttgcgcggggcatctacctgtcggccgactgcgcgatcggctacgaggcgggcgcgatggcgctcaaggcgatactgggcttccacgacgacttcgtgcaccatgtcgagcaccacgcgtgcggcttctcgcagtccaagctcgtgccgtgcgtgtcgggctgcccggcgggggttgacatcccggggtacatcgcgctcgtgaaggcgggccgcaacacggacgccgtgcgcctcatcaggaaggacaacccgctgccactggtctgcggcctggtgtgcgagcatccctgcgagatgaactgccgccgcggcatggtggacgacccgatgaacatccgcgccatcaagcgctacgcctgcgagcacatggagtccgactaccggccctggatcgcggcggacacgggcaagcgcatcgccgtcgtgggcggcggacctgccggcctcagctgtgcgtactacctcgcgattatggggcaccacgtcacgatcctggagcagcgcaagcacctgggcggcatgctgcgctacggcattccggcgtaccgcctgccgcgcgagcgcctggagagcgagatcaagtggatcctggactgcggcatcgacgtcaggtacgagacccccgtggaggacgtggacgagctgcgcgagaagtacgatgccgtctacctggcaatcggcgctcacgcggacaggaagctcgggttgccgggcgaggatgccgagggcgtcgagtccgccgtggagatgctgcgctccgtgggcgacgacgagcttcccgactaccgcggccagcgcgtgtgcgtgatcggcgggggcaacgtggccatggacgtcgcgcgcacgagcgtgcgctgcggcgcggagaaggtcaccatcgtgtaccgcaggcgcgtggcggacatgaccgcccaggacgaggagatcgcgggtgcccaggcggagggctgcgagctcctggagctcaacgcgccgctccgcatcgcgaccgacgagtcgggtagggtcgcggggctcgtggtgcagccccagatcatcggcgaggtcaagaggggtcgtccttctccccgtgcggcggacaagcccgaggtcaccataccgtgcgagcgcgtgatggtggccatcggccaggctatcgactccaagccgttcgagcgctttggcgttccgaccaagtggggacgcatcgtgacggacgaggccgcggaggtgccaggccttgatggcgtctttgcgggcggcgactgccagacggggccggccacggtcatccgcgcgatcaacgcgggcaaggtggccgcgggcaacatcgacagctaccttggcttcgaccacaggatcgagctggacgtggagatcccgcaggtgcagttccagggcaagatggagtgcggccgctgcgagacgacgttccgcgaggccgaggagcgcaagcgcgactttgacgagatcgagaacggccttacgaccgaggaggtcatgcaggagtgctccaggtgcctgcgctgcgaccactttggctatggcgcgttccgtggcgggaggatccaggaatggtagaggagctcaagacaaaggtgagcgagaaggacgcgtccagggtcgtcaccgtcacggtggacggcaagacggtgcaggttcccgccaacacgaccatactggacgcctgccgcaaggcggggcaggacgttccaaccctgtgctacctgcgcgacattaacgagattggctcctgccgcgtatgcgtggtcgaggtcgaggggatagaccagctcgtggcctcgtgcaacaactacgtgctcgacggcatggtcgtccacaccaacagtcccaaggtgcggcttgcccgacgcgagaacgtgatgctgcttctggcgcagcacgacaccacgtgcaccacgtgtgcgcggggcggcaactgcagcctcgcgcaagtctccaacgacctggggatcatcgactttccgtacaagaccatcctcgcgaacaccaagtggccgcacgacttcccgcttatccgcaacaacgacaagtgcatccgctgcatgcgctgcatccaggtgtgcgacaagatccaggcgtcccacgtgtgggacatcaccaaccgcgcgacgcacacgctcgtggacgtggccggtggcgcggacatccacgacgtggactgcacgctgtgcggccagtgcatcacgcactgtccgacgggcgccctgcgcgagcgcgacgacgtcatgcgcgtgtacgaggcgctcgcggacccggacgtcaccacgatcgtccagatcgcgccctccgtgcgcacgagctggggcgagtactggaacctcccggaggagaaggccaccatcaaccacctggtggcggcgctccgcccgatgggcttcgactacatcgtcaacacggacttctccgcggacctcaccatcatggaggagggcacggagctgctcggccacatggcgagaaacgccaacggcgggtccggctaccccatgttcacgtcgtgctgcccaggctgggtgcgcttcgtgaaggcgcactaccccgagctcgtggacgacgtctccacgagcaagagcccgcagcagatgttcggcgcggtggtcaagagctactacgccgagctgctcggagtcgacccgcacaagatcttctcgctctcaatcatgccctgcgtcgccaagaaggcggagtgtgcctaccccaacatgaacgacgcctgcggcgacccggacgtggactgcgtgctcaccgtccgcgagctgcagcggatgcttcgcgccgaccacatagacgtcgccaacctcgagcccgagccctttgacgagccgctcggctacggttcgggcgccggcatcatcttcggcgcgacgggcggcgtgatggaggccgcgctcaggaccgcctaccacatcgtcacgggacaaaggcccaaggacgacatgttcgagcaggtccgtgggctcaggggctggaaggaggccacgttcgacctggccgggacaaaggtgcgcgtcgccgtcgcctccggcctcgccaacgcgcgcgacctgtgcgacgcgatcctttccggcgaggtcagctacgacttcgtggaggtcatggcctgccccggcggctgcgtgggcggcggtgggcagcccatccacgacggcgaggagctcgccggtgagcgtggcaaggtgctctacggtctggacaaggtgtcccactaccgcaactcgtacgagaaccctgacatcgtacgctgctacaaggagtacttcggaaagcccatgagcgagcttgcggagaggctcctgcacacggaccagcacggctggatgatgcccgcggagtggatccgccaggcggaagaggcgccaacggcgggggagtgacgcttggcgcgcggctccgttggacaggcagcaaaaaggggcgccgccgcaacccatgtggtgcggcggcgcccctcgtgcgctcggtatgtgccaggcgaaggcctactcggccatctgggcctggaccgcggtgatcgcgatgacgcccacgatgtcatcggcggagcagccgcgcgacaggtcgttcacaggcttcgcgatgccctgcaggatggggccgtacgcgtcggcgccggcaaagcgctgcacgagcttgtagccgatgttgcccgcctcgaggtcggggaagaccagcacgttggcgttgccggcgaccttggagccgggggccttgagcgcggcaacgctcgggacgagggccgcgtcaagctgcaggtcgccgtcgacggagagctcgggcgccttctcgtgggcgagctcggtggcctcctggaccttcgtcgggacgtcgcccttggcggagcccatggtggagaaggacagcatggccactcgcggctcggtgcccatgtacttctcccacgacttggcggacgcgatggcgatctcggagagctcgtcggcgttgggggcgatgttcaggccgcagtcggcaaacagcagcgtgccgtcctcgccgtactccttcttgtccgtgcacatgatgaagaacgcggacacgagcttcgtgccgggggcggtcttcaggatctgcagcgcgggtcgcagcgtgttggcggtggagtggcaggcgccggagaccaggccgtcggcatcgcccatcttcaccatcatggtgccaaagtaggtggcgtcgttcatctgctccatggcctcgggcagcgtgacgcccttcttcttgcggagctccgcaaaggcggcggcgtactcgtcgtgcttctcggcggtgcgcggatcgatcaccttgacgccctcaacgtcgattttgctggggtcgccaagaatcacgaggttggccaggccctccgcgacgaccttcttggccgcctcgatggtgcgcgggtcctcgccctcgggcaggacgatggtcttcttctccttcttggcagcggccttcatcctgttcagaaaatcgctcaatttatctcctctccgcgccttctgcggcggattttgccgcagaggcaaacatttttgcgcgtcggctgggtatttctgcctacgaacaagtattatatgccctcgtgctagaatcggattcgtgaacgcttggcgtatggcttggtgccaagggccgtgtggcgaccgtactagacggcgccaatgtcatgaagggatcttttccacatgggtatcaccaatggtctgccggaggacttcaacccccagaactacgatgccatcgtcgtgggcgctggctacgcgggtgccgtctgcgcgcgcaggctcgcggaggcctgcggcgacaaggtcgcaatcgtcgagcgtcgcaaccacatcgccggcaacgcgtacgactgcctggacgatgcgggcgttctgatccacaagtacggtccgcacatctaccacaccgccaacgagcgcgtggacgagtacctctcgcgcttcacggagtggaccgactacagccacaaggtcctcgccaacatccacggcacgctcatgcctgtgccgttcaaccaccagtccctcaagctcgcgtttggtgacgagaagggcgagcacctttaccagaagctcgtcgccaccttcggcgagaacaagaaggtccccatcatggacctcagggagaagaacgatcccgagctctcggaggtcgcggactacgtgtacgagaacgtcttcctgcactacaccatgaagcagtggggcaagacgcccgaccagatcgacccatccgtcatgggccgcgtccccgtcttcgtgggcgacgacgaccgctacttcccgcaggcgccgcaccagggcatgccgaaggtctcctacacggacctcttcgagcacatgctcgaccacgacctcatctccgtcttcctcgaggtcgacgcgcgcgacatcctcaaggtgggcgacggccacgtctacgtgtgcggcaagccctacggcggcgaggtcatctacaccggcgcccttgacgagctcttcgacttcgaccttggcgcgctcccgtaccgcaccgtcgacatggtgttcgagacgctggacgaggaccagttccagcccgtcggcaccgtcaactacaccgtgtccgagaacttcacgcgcatcacggagttcaagaacatgacgggccaggtcgtcccgggcaagaccacgatcctgcgcgagtactccaggacgtacctgccgggcgtgggcgagaccccgtactacgtcatcaacgagcccgagaacatcgagctctacaagcgctaccgtgcccgcgtcgaggacgtgctcaacttccacgtcgtcggccgcctcgcggagtaccgctactacgacatggacggcgtcacggcctccgcgctcgacctgtccgacgagctcatcgcgagccactagacaaaccaagaacgccttggccggtcgtcgctggtgcgtcggccggctttggcatagggaacggaaacatgaataagatcctgagcttcggcatcccctgctataactcctccgagtacatggaccactgcatctcgtccatcctcgagggcagcgactacgcggaggacgtccagatcatcgtggtggacgacggctccaacaaggacgacaccctggccaaggcccaggagtgggagaggcgctaccccacgatcgtgaaggccgtccaccaggagaacggtggtcacggcatcgcggtcatgaagggcctcgagaacgccgagggcacctactacaaggtggtcgactccgacgactgggtcgatggggactcgctcaaggagctgctcgatcttctccgccgcttcgaggagctgggcacgagggtcgacctcgtcatctcgaactacgtgtacgagcacgtggaggacggcaagcagaacgtcgtggactacgagggctcgcttcccaccaacaagatctttacctgggacgacatggggcacttcagcgtcaagaagtacctgctcatgcactcgctctgctatcgcacggacgtcctgcgcgacggcggtctccccatgccgccgcacacgttctacgtggacaacatctatgcgtacgtgccgttcccgcgctgcaagacgctctactacctgcccgtgaacctgtaccgctacttcatcggccgtgcggaccagtccgtcaacgagaaggtcctcacgtccaggatcgaccactactggcgcgtggcgcgcatcatgatgaagtcgtaccacctctacgacgacatccagagccccaagctccgcacctacatgctcaactacttcacgatcatcatggcaatctgctccgtgttctcgcgcctgtccgaccgcccggacgccatggaccagctgcagcagctctgggacgacctcaaggcctacgaccccaggatgtaccgccacgccaagcacggcatggtcggcacgttcagtaaccttcccaccaaggcgggcgagaagaccaccctcggaatctacaagctcgcccagaagatcgtcaaattcaactagtcgtcggcgcgtgggggccgactgccccatgcaagcgaaacgaaagggccgccccggatgaatccggggcggccttgccgttcttctcgcccgtcgtgacgtgacgggaatcgtgcggacgcctgatgccgcgggagcctagcccaggtcgccgcctatggccacgtagctcttgatggcgcgggtgcgacgcttggtgccaggagggaacgtcttgtcgaacagcggcatgatgcccttgaagatcacgctcaccttggcacggtcgagcttgcccgcgacggagttctgcgagtcgtcaagcctctggttgagcacgtccacaaacgcgctccggcgcgcgtactcccagaagtagtcgcccatgtcgcagtcggggtagtcccagggcctgtcgtccgggcccgcgtagtggacgatggccgggttcgcgcgcgcggcctcgtactggtcccgcagctcctgcgggtcctgggcgatgatcttctcgcgcctcaggtgcttccagtccatcagggtgttccagcgcatgtcgatgcggacgtagttgccgtccgcgagcatgttgaggatgtcctggtcgagccagcgccacacgcggacggtggagaggctcagcatgtccctcacggtgaaggcgtagcggaacgcctcgaggttcatcacgagtacgccggcctggaagtactgcatggggtcggacagcttgatgtcgttcttgaggtagggccccacggtgccgtcgtagccgagcatcattcccacggtgtcggcgtcgcgcgtggcgcccagcaggcagccgtccacgtccacgtcatagagcgtggcgatgtcctccagaaccacgaggtcggagtcgaggtagacggccttcctcacgttggggaggagccacggagccagcaggcggaagaacgtctcgggcctgaagtggccgtggtgggggagcttggtcccgtgcagggcgatctcggggttaaggaagccgagccgcatgttgggataggggagatgccccacgagcgtgtcaatcgagtgctgcgacaggtcgcgcgtgagcacgacgatgtcatagtggcggtcgggagacatgtgctccacgatcgactggatggtcaccgcggtgtacggcacgaagtactcgttgcaggcgaggacgatgacgacgtccgagaaggacatccccatctcctcgacggtgcacgagagctgcgtgagcctgccggcctcggtgttcgagctgttaggcataggacctcactggtgccagcgatgctggcgtgatgggaaacaaatccataacatgcagattctaacagagcgggcgagaagtgcgtgcatgcgtagcagaaagccagatgaaacgcgcaacgatgccgctgggtggtctatatgtcccgtgcggcggggaacccgtaggcgccggcggcgtccgtcgcggcgctcacgatggcgcgctcgagcgcctgggtcgagagcatgccgaccacgtcgacgggggcctcgacttcgcccgttgccatgacgaagatggtgtccccgtcgttggtggtgtgcgtggggcagatcgtgtgcgcgtaggcgtcagcggacatctgggcgaccttggtggcctgggccttcgtgagcgcggcgttggtgacgacgcaggatatggtcgtgttggtgcggagccacggctcccgctcggcaagctggcgtatggcctccgtggggtcgagtatggccctgcggtcgccgtcgagcgcgccggcgatggcgcgccccgtggcggggtcgattacgttgccgcaggcgttcacggccgcgatgcccacgcaggcaagagacccggcggaggcgctgccctggccgaggccggacttcatggcgcgctcggggccggcgaacttgcccaccgtgcagccgcagcccgcgcccacgttgcccgtctcgagctggagcgtgcgcttctccaacgcgcgtcgcgtcgcctccgcacccgcctccgccgtggggcgcacggacgcgtcgccgcaggcgaggtcgaacaggcatgccgaggatactatgggcacgatgccgacgcccacgtcgagccccacgccctggcgctcgagctcctgcgcgactccgcaggacgccgcgagaccgtatgcgcttccgcccgacagcacgacggcgtggagcacgtccaccgtctcttccggacgcagcaggtcggtctcgcgcgttgccggcgcacccccgcgcacgtccacggcgccccgagcgcccttggggcacacgatcacggtgcagcccgtaccagactccgcgtacgtgtagcttgaggcgtatacgcccgtcacgagctcctgggccgcattgttgatgctaggcatgtcttccctccagaatcttgcagagcagcggctcctccgcggtggcacccatgtcctcgagctccctcacgagccgcgccacgggcagtcccacgatgttgaagtagtcgccgcggatctccctcacgagcagcctgcccagcccctggatcccgtaggcgccggccttgtccataggctccccgctgctgacgtaggagtcgatctgggcgtccgtgagctcgtagaacgtcacgtcgctcgtctccacaaaggagcgctcctcgcccgcgcgggcaatggccacgcccgtggagacgtggtgggtgtggccggagagcgccctcagcatgcggcgcgcgtcgtctgtgtccgcaggcttccccagctcgacgtcccggaaccacaccgtcgtgtccgccgcgaccacggtctgcccgcgcagctcagggggcaggtccttctcgcacgcgtgagccttgcccctggcgaggcggagcacgagctccgtgggcgactcgccggggaggggagtctcgtcgatgttcgagggcttcacgacgagcgtaaagcccaactgggagagaagctcgcgccttcgcggcgagcccgatgccaagatcatgcgtctgcctttcgcgtccgtgcggccggacgcctcgccctacagaaaaggggccgcccaagggcgacccctccatactagcctttgaccagcgacgtgctactcgatggtaatggcgccgacggggcagccctcctcggcctccttggcagcgtcctcgttctcctcggggatgtcctcctcgatggcaacagcggtgccctcgtcgccgatgctgaagacctcggggcaggtgccctcgcagagaccgcagccgatgcactcttcgctaacagtagccttcatggtgaaatcctctcgttgtgccttgggccccttacccaagtcggtacatgaccctttttactctaaagtgcgccagagttctagtgagaatgggactttttccccaagcgtcgggcgcgctgttggctacgtctaactcgcttacgcgttttgcctggtcaggattgtgacggtctcgacatgaaacgtttccgggaacaggtcgaccggcgtcacgctcgttgcggaaaacgttcccagcgcctcgaagcgcccgatgtcgcgtgcgagcgtcgccgggtcgcacgagacgtaggcgatggcgcgtgccggctggcgtgagagcttctccaccacgtccttggcgagtcccgcgcgcggcgggtccaccacgatgacgtccgcgtcggagtccgggaactctcgtccggcgtcgccacccacggcgtccgcgttggagaggcccgcgcgctcgaggttgcggcgcaggtcgcgcaccgccggaccgtaggactccacggcgtcgacccatgccgtgcgccgcgcgagcggcagcgtgaacgtgcctgcgccggagtacaggtccatcgcgacgtcgtcctcggttggcttgaggccgtcgagcacaagggacacgagcttctccgcgcccctggtgttgacctggaagaacgacggtgcggacaccgtcatgcgctcgtccagcacctgctcgctccagctgccggcgcccgagagcctctcgacgccggtcacgcgccgcgccttggtcgggcccttggtgagtacgcgcacgatcgagcttgcgcccgtggcgtcgcccaggatcttggcggcctgcgcccgcgggaaggggcccggcgccgtccagagcgcgacctcgacgttgcccgtgcgctttgaggcgcggatgcccacacggtcgatctgcagcgcgtgcgagttggagaggtacgagagcgcgccgctcgtggccttgacgagcttctggaagcgcgtctgcagcaggaggcagcgatcgaccttgacgacgccggtgccgctggcatcgtgcatgcccacgacggcacggccgcgcacgcgctggaacgcgagctcgaccttgttgcggtagccccagggctccccgggcgccacgcactccgccacgagcgactccgcgcggtcgcggtccaggtgcccgatcctcgcgagcgagtcgaccacgttgccccgcttggcgcggagctgcgcctcgtacgacacgtgcgcccacggacagccgccgcacacgtccgcaaaggggcagggcgagtccacccggtccggcgacggctccaggacccgcgtcacctttgcgcgcgagaaggacgggccgtcctggtagacgctcgcctccaccgtgtcgccgggaaccgccccctgcacaaacacggtcttcccgtcctgcgcgtgggcgatggagtcggggccatacgtcgcccgctccaccttgagcacaaggggcgtgcccgcctggagcacgccctcgtttgatacatcttcagtttgccgaccgatgcgctgagcctctgtcaactactttctccttttggtgagattgcccgtgaagagctccgcaaagccgagccctatgagcttaaatgctacggcaaatcggttcggcctgcgaatctcgatcgacgtggtctgcgtgttgggctcgctttcggcggcggacggcttctcgtcgatcacgtgcgcgtccaccgggctcgcctcgcggggtgcctccggctctgccggctccgccgccgtgggctcgggcttaacggtctccgcggcagccttcgtgtcaaagtgctttggagctgcgctcgcgggctgctcgggctcctcggcttcaggctccggctcagtctctgcaacctccggttccggctcgggctcggtagaaggcgcctcggccgcaggggcctcctcggccaccggctttgcctcgggctcggtggccatgttcttctccaccggcgatgcctcgctcacgggggcgggagtgggaacctgcgtggccttggccttcgcctcctccttgtgctccaccgcgagcagtgcgcgctcctggtccaggaactcagccggggtcacgatgcgcgtgtgcacctgctcctggccgtcgcggtcctcctcgaagctgccgatgtaggggagcgcgaccagcgtgcgcgtctcctcgggagtgagcatggggttggccttcgcgacgagctttgcgtccatcgcggcgtcggccacctcctgcgtgttgagatacgcctgcgccagcagcagctcctgcgcgtcgatcttggggtcgtctggttcggtctcgaggcgctcccacgtgccgtcctccgtgagcctgcgagccttcacgttgtccgcgagctgcaggttcgcaaactcgaccacgcgcttcttgcacgtggggtcgagcacggggtaggcgatctcgacgcggcgctcggtgttcctggtcatcatgtcggcggacgagaggtacaggatgtccgtgtcggcaccaaaggcgtagatgcgcgcgtgctccaggaagcggccaacgatctggtgcgcgatgaggccctcggtcttgccgggcacgttcgccttgatgcagcagatgccgcggatcatgagcatgacgcggacgccggcctggcaggcttcggcgatcttgtcgatgacgtcgcggtccgtgagggagttcatcttcatgaagacctgagcgggctcgcccatgcgggcacggccgatctcgcggttgagtccgcgcatgacgagcggcttgaggccaacaggtgccacgcccaggaagttgtagcttcccttgaggttgccgagagagaggttgcggaagaacgtgttgccgtcgtccgcgatgcccttgtgggccgtcatcagcatgaagtcggagtacagctttgccgtcttctcgttgaagttgccggtgccgaggcaggtgatcctgttgatgcccgagccgtcgtggtaggtgatctggcagatcttggagtggaccttgaagccctcctggccatagatgacggtgcagccggcctgctcgagcctgtccgcccactcgatgttgttcgcctcgtcaaagcgggcgcgcagctccatgaggacggtgacctccttgccgttctcggatgcggcgatgaggctctcgcagagcttggagcgcttggcgacgcggtacagcgtgatcttgatggagatgcacgcctcgtccgtggaggcctcgcgcaggagcttcagcagcggggacatgctctcgtacgggtaggtgagaaggacgtcgtggtcatcgacctgcgggcgcatcggcttcgagaggtcgaccatggagctgggctgcggctcgaacgggtcgaacacgagctcgtgcctttcggactcgggaatcttggactcgaggccgtagacgtagtcgtcgaggtcgagcggcatgtcgcacctgaagacgcgctcgtccgtgaggcccaggcgctcctggacctcgtggagttgctcctctgggaggtagccctcaacctcgaggcgcacgggctggaggcgctgcctgcgcttcagcaccttcttcatgtgctggcggtagtcttcctcctcctcgacgccctcgccgtcggggtcgatgtccgcgttcctcgtcaccctgatgaccgcgctcgccgtggggacgtagtcgccaaagcagccctcgagcagctcctgcatcacgtcctccatgaggatatagcgatactggccctcgcgggaggggagcgggatgaccctgccctgcgtggtggggacctcgacgatgccgagcaggcccttctcgtccgtgccgtcaagcgtgcaggtcacgtagaggttgccgttgcgcaggttggggaaggggtgcctggggtcgatgatcatcggcgagatgatcggtgcgatctgccgctcgtaggtgcggaccatcgccgtgcggtcggcgtccgtgaggtcctcgcgcgcgacgcgcgtcaggccgtgctcggagagcgcctgctcgatctgggcgcacgccttgccctggcgctcgatgagcgcgggcagcatgccgaggaccgtgtcgatctgctcggagggcgtctggttagacttgttgtcgcgcggctggtgcttgagcagcgtgaggtcgctcaggccgccgatgcggatcatgaaccactcgtcgaggttgctgccaaagatcgatacgaacttcagcctctcgaatagtgggacgctctcgtcgtacgcctcgtccagcacgcggtcgtcgaacctgagccagctcacctcgcggttctgcgtgtaggagaagtccctggtctcgcttgccttgttcttctcgtccttcgcgtttgcgaactttgcggcgcgcttctcgagcccctcctcggagtgctcgaactcctcggtctcggcgtcaatcgacttgcccttgttcttcttgcccttacccatatatctacatccgttctgaagaatggtattgacccttagattttaagtctgcgagaagtgcgtgtgatgctcggtcgcgcaaccttacgtagacgtaactacccggctgatgtcgagagtgccaatacgaccctgtccgactctcgaaaggcttacgagaacggcttgctctcgtgttgcgaaaccatattgcgtattggcaaaaatagtataaagacgaaattccatagtatgtttttgttggcaaataatcgtttcacgcatagggttgagtaaggtttgtctggttttgaagattggttgagtctggtttaggcgtaagaaaacaagcaggtaaaacatggtgtaaatcattacattccgacagaatcgaccgttcgggaacagaaagctaccgttcccccagagggaacgaatttcggatttgcgaaaaaagttattggatatagttggggttggcgttattgttagtgctgcaagttcgaagcagggcggcgatccggtccgccggtttcgcatcctgtcagaacgcagcgtagtatccattgcgttggtcgggatttccccgacgcgaaaggagtgggaggacatggctaacggactctacgtccacagcgagattggccccctgaagaaggtctgccttcaccgtcctggcgaggagcttctgaacctcaccccggatgacctcgagcgccttctgttcgacgacatccccttcctggaggttgctcaggccgagcacgacaagttcgccgagctgctccgcgagcagggcgttgaggtcctctacatcgagaacctcgttgccgaggccctcgacgctgcaggttcccgcgaggagttcacgcagcagtggctggacgagtccggcctgaagggcaaggaggcccgcgcggctgtcaaggagtacatggactccatcaaggacaccaaggccttcgtcgacaagtgcatcgccggtctccgcaagaacgagatcgacctgcccgttcactccagcagcaccctgtccgagctcgtcggtgccgatcaggatggcgagaccgacctcctcgtcgacccgatgcccaacacgtacttcacgcgcgacccgttcgccgtcgtcggccgtggcgtcaacctgaaccacatgttctccgtgacgcgcaaccgcgagacgctgcttggcaagtacgtcttccgcgatcaccccgactacaaggacgctccgctttggtaccgtcgcgacagcgccttccacaccgagggtggcgacgtcctcaacatcaacgcgcacacgctggccatcggcatctcgcagcgcacccaggctgccgccatcgacaagctcgctcagaacatgttctggggcgccaacgccgagaagtgcgagattacggacatctacgcgttcaacatccccgtgtcccgtgccttcatgcacctcgacaccgtcttcacccagattgatgttgacaagttcaccatccacccgggcatcatgggcaccctgcaggtcttcaggctcaccaagggcgctaccgagggtgaggtcaagatcgaggagctcaacgacacgctcgagcacatccttgagaaggccaccggcgtcgacgcgatcaagctcatcaagtgcggtggcggcgaccccgtcgcggctgctcgcgagcagtggaacgacggctccaacacgctggccgttgcccctggcaagatctgcgtctaccagcgcaactccgtcaccaacgacgtgctctacaaggagggcctcgacctcatcgtcgtgccgtccgcagagctctcccgcggccgtggcggcccccgctgcatgagcatgcccttcgagcgcgaggacatctaatcggtgtagctgcttaaggcgataccggggacgcatgttgcgtccccggtatcgatgcgttgtcaattgcatacctgccgacaaggacggcggggtgtaaatattcgaaaggatcaaaatgggcgttaatcttcgtggtcgtcacttcctgaagcttctggacttcacccccgaggagatcaactatctgctcgacctgtccgtcgacttcaagaacatgaagcgcgctggcgttcctcaccgctacctcgagggcaagaacgtcgcccttctcttcgagaagacctcgacccgtacccgttgctccttcgaggttggcgcctatgacctcggcatgggctgcacctaccttgatcccagcggttctcagatgggccacaaggagtccatcgccgacaccgctcgcgtcctcggccgcatgttcgacggcatcgagtaccgtggcttcgagcagaccaaggttgaggagctcgccaagtacgctggcgtccccgtctggaacggcctcaccaacgagttccaccccacccagatgctcgctgacatccttacgatgaaggagaacttcaacaacgacatcaagggtcgtcagctcacgttcatgggcgacgctggcaacaacgtcggcaactccctcatggtcgtctgcgccaagctcggcgtcaacttcgtcgcctgtggccccaaggagaacatgcctgaggctgacctcgtcaagcagtgcgaggccatcgccgccgagaacggctccacggtcaagctgaccgaggacgtccacgagggcgtcaaggatgccgacgcgatctacaccgacatctgggtttccatgggccagccggacgagctctacaaggagcgcatccctctgatggagccctaccgcgtcacctccgacgtcatggctcaggctcacgacgactgcatcttcctgcactgcctgccctccttccacgacaccaacaccaccaagggtgctgaggtcgcgaagaagttcggcatcaccgagatggaggtcacgaacgaggtcttcgagtcccgtgcgtccaaggtcttcgacgaggccgagaaccgtatgcacaccatcaaggccgtcatgtacgcgaccctgaagtaaccaatacataggtcttggttaacgaggcctccccacgtatatggggaggcctttttcgtgcaattgtttcataaaatatattggaaatgcatgagatttgtcgctgcattgtgaagcattcgtatacaatatgtgtgtaaggtccatcacaaattcttaggaggaattcgatggcaaacgaagaaaaggtggacaaccctaatggcgttggcttcttcggcctcgtcggtctggttgtctcatcctgcatcggctccggcgtcttcgcccttactgggcagctcgccaacgtggcatcccctggtgccgcgcttgtcgcatgggtgatctgcggcctgggcttcctgttcctggccctgtcccttgcgaacctcggtgcgaagcgtcctgacgccgacggcgtcgtcgcctacgcagaggagggcttcggcaagttcgccggcttcatctccggttggggatactggctgtccgcatggctgggcaacgtcggcttcgcgaccatggtcgcccaggtcctcggttcccagtactgcctcggcaaggtgttccctggcttcttctccgttcccagcaccggcaaccccgccgtcggcggcgtcatcgtcatctccctcgtcctgtgggcactcacgtacctcgtcatccgtggcgtcgagagcgccgcgttcttcaacgcggtcgtgatggtcgtcaaggtcgccaccatcctcatcttcatcgtcttcaccatcttctccttcaacgccggcgtcttctccgctgacttctggggaaccgctgcccgtaacgccaccatcatcgccgccggcaccaagggcggtctcggcagcgtcgcgaatcaggtcacgcagtgcatcctcgtcatgatgtgggtcttcatcggcatcgagggcgcttccgtcatgtccaagcgtgcccagaagaagtccgagatcggctccgccaccatccttggccttgtcgtccttctcgtcctctacatcggcgcttccgtgcttccctacggcgtccttccctacaaggagctcgtcgctgccccgaagccggccaccatcaccgtcttcgagcacatggctcccggttggggcggtgccttcatctcctgggcaatcatcatctccgtctgcggctcctggctgtccttcaccatgctgcctgcagagtgcgcctcgatgatggccgaccacggcctgctccccaagtcctgggacgagcgtaacgccgccaacgcgcctcagatgtcgctgctgatcgtcggcgtcctcaccgagatcttcatcatcatcgcgagcttcgctgccgacgcctacaccttcgcgatctcgatgtgcaccgtcaccatcgtcatcacctgggccttcgccgctgcctaccaggtcaagtacagcgcacagaaccacgagggcggccagctcgtctgcggccttctcgcgctcatcttccaggtcgtcggcgtcctgttcacgggctggggcttcctgctgcttgcctgcctgggctacatccccggcatgtacttctacgtcaaggctcgtaaggagaacggcgcctccgtcaccaaggccgagtgggctgtctacgctgtcctgaccatcctgggcatcatctccatccctctgacggccgtcggcatcatcccggtcttctaaatcggggaatatgggttaacttggggcagggtccgtggtggtccctgccccttttttatctaaggagtcgaaatgaacaaccccatcaagctcatcggctgcgaggactggctcaacgtctacgagaagagcgcaaagtgggacatcgcgcagtccacctttgcctcgttcacgatggacgagctcatgaacctggatgacgagggcggtgcgacgttctacgagagtctcaaccgcgaggtcatgaactacggctggatcgagggctctcccgagttcaaggacgaggtcgcgaagctgtaccgcaagcccgtgagccccacgaggatcctgcagaccaacggatgcactggcgcgaacctcaacgcgatgcacgtcctaatcgagccgggagaccacgtcgttgccgagtggccgacctacacgccgctctacgaggtgccgaggcagctcggtgccaaggtcgactactgggagctcgaggagggacttggctggaggcccgacatcgagaagctcaagaagctcgcgaagccctcgaccaagctgatttgcatcaacaacgcatcgaaccccgtcggctgcgtactcgacaaggagacgctcgagcagatcgcggagattgcccgctcggtcgacgcatacgtgctctccgacgaggtctacatgccgatggacaacaccgaccagtactggtccatggcggacgtgtacgagaaggccatcgtcacgaactccatcagcaagacctactccacccccggcgcacgcatcggctgggtgctcgccgatgaggaggtcgctcagcgcatccgcgtgtacagggactactcgatgatctgcgctggtgtcttcaacgacatcctcgcgacgtacgttctgaggaaccgcgagacgattctcaagcgcaaccgcgacatctgccataccaaccatgacatcgtggccgagtgggtcaagggccagccgcgtgccaagtggaacgaccccaagggcgtctccgtctcgtacctccagctcgacatccccgagtccgacgaggagttctgcaagaggatcctgagcgagaggggagtgctgctcgtgcccggcacccgcttcgagctgcccaacggcgcgaggcttggctactgctgccacgaggacgtgctgaggaagggcctgtccctcctgggtgacgcgcttgcggagtacgacgcgtaaggtgcgcgtgcggtcagataaatagatattgatgaagcggatatgcagaaaacatatccgcttttcatttctcaactatctatttgagaagattattggaatacttccaaaaggttggcgtggctctgagcttgccttttgttattgagaagaacaatgagccggatgagcgctcgatattttcccgcaaacggtaattgtcaaattcatgaccgctcgtgtaacaattcaccgactattgcataacgctggcgaatgtcactcgtccactttgacgaagtcatgtaggatatgtagcggaattaagcggattgtgtagccaaactgttacgcagccgctggcactaggtcgagtgacgcattgcgtcgaaaggagttgcggtcatgtcagacacgacagcgcagccgaagaagaagaggaagatgctcacgtccttctctatcatcttcatcttgctggccattgtggccatcgtctcgatcctcatgaacggtacgccgtaccactatgaggacatccaggggacggtaacgggcgccacgcttggcagcttcatgatggcctccgtcaacggcttcaaggacgccgtcgacgtctgcctcttcgtgatggtcctcggtggcttcctcgggatcgtcaacaagaccgacgcgcttgcgacgggcatcgacgtcctggtcgagaagatgaacggcaacgagctcaagctcatcccgatcctcatggccatcttcgccttcggcggcaccacctacggcatgtgcgaggagaccgtcggcttctacgctctgctctccgccacgatgatcgcggccggctatgactccctcagcggcgcgatgatcgtccttctcggcgctggcgtcggctgcctcggttccacggtcaacccgttcgccaccggcatcgcgagctccgcgctcacggacatgggcatcaaggtcaaccaggccgtcgtcatcggccttggcctcgtccttcttgtcgtctcctatggcatctccgtcttcttcgtgctgcagtacgcgaagcgcgtcaaggccgacccctccaagtccctcatgagccaggacgagatcgatgcgtccgtcgcggcgtatgccaacgaggacgcgaccgacgagaagaagagcctctctggcaagcagaaggccgtcctctgggtgttcgcggcagcgttcatcatcatggtcatctccttcgtgccttgggaggacctcggcaacaacttcttcgtcgcgggcgcatcttcccacgaggagaccaccaaggtcaccgcttccgacatcatccagcagtacagcgatgacagccttggcgacctcaagctgaccccgaagaacaccaagggcaccctcaccaccaccgtcaccgacaacgctggctggtccgcgttcctgacgggcaccccgctcggccagtggtacttcgcagagtccaccacctggttcctgctcctcgcaatcatcatcggcatcatcggagggctttccgagcatgagatcgtcgacacgttcatggcgggcgcaggcgacatgatgtcggtcgtcatgatcatcgcggtctcccgtggcgtctccgtcctgatgaagagcacgggcatcgcgaacctggtcctggccgactccgccaacgcgctgaagggcaccccggcagtcgtgttcaccatcggctcgttcctgctgctgttcctgctctccttcctcatcccgtcgacgtccggcctggcaacgctgtccatgcccatcctcgggcccctggccgcaaagctcggcttcaaccccgcgatcatgatcatgatcttctccgccgcatgcggcgtcgtgaacctgatcacccctacgtccggtgcaatcatgggcggccttgccctgtcccgcatcgagtacggcacgtgggtcaagttctgcctcaagatcgtcatcgcgatctctgtggcctgcatggtcatcctctccatcgccatggttgccatcccggcatagcctgcacggcacaggtagagaagggcgcctcccaagggggcgccctttttgcgtatggagaagttggggcaaattgcatcaagttgtgagaataacgtttaccgagcagcttgacgctgcgacagataagacaaactcacatgttacagaacgattacgatacataaatgtattctataagttggccgcgtgagcggccattgctttgaagggatgtgtagcggtgtcggagggaaagggaaagaagagaagggtactcacgtccttctcgatcatgttcatattgctggcggctatcgcgctcataagcgtcgtgctgtcggcgttcacgagtgaggtcaaggccgtgtcgtttggcacactcatgatgtcgcccgtcaacggtttcaaggacggccttggggtcgccctcttcgtgatggtgctgggaggtttcctcgccatcgtgaacgcgaccgacgcgctctccgcgggcatcggtgcgctggtcaagcgcatgggcggcaatgagctcaagctcatccccgtgctcatgttcatctttgcggtgctgggcagcacctatggcttctgcgaggagaccgtcgggttctacgcgctgctttcggccacgatgatggccgccggcttcgactcgctgaccggtgccatgatggtgctcctgggcgccggagtcggctgcctgggctccacggtgaacccgttcgcgacgggcatcgcgtctgacgtcctgagctcgtgcggcatcgtggcgaaccagggaatcgtcatcggccttggcctcgtccttctcgtcacctcgtacgttgt

SEQ ID NO: 146 - DNA, 15306 bp, Unknown
  Metagenome-assembled genome
gcttcgtgaggatcgacgagatgcggttccgcacggtaccagcgctcatgcacagctcgtcggcaacttccgcgtttgtcagcccgtcggcaatcgcgcgcacgacctcacgctctcgctccgagagacaggccagggcgctctcgtctggcggcttcatccccgcgctggtatccgcatcgacggagagccgagcagcccttgccaacacctcgccctcgagcacgcactggccacgcatgaccgacctgagcgcaggtgcgacggtcgccacgtcctgctttataaggtagcctcgtgcaccaagcctcagcgcacggacgatgtactcgtcgtctgagaacgtggtgaggaagacgatgcgggcgtccggccgaaggtacagcatctcctccgcagcagtgagcccatccccaccgggcatctggatatccatgaggaccacgtccggattcagtcgagagaacagctcgaccgcctcgtgcccgtcgaggccctgtccaacgacctcgatgtcgggctctacgcccaggatggtcgccagtgagcggaccacgatgcgatcgtcatccacaactacgaccctcatcaggccacctcctccatcgcgacgtggcggggcatcgtcgcgaagaccacgaaccagcgctctccgccatgcccctcgattttcacgttgagcgtgccgccaagcgtggcgaccctctcgcgcatggacctcaggcccatgcctcgctcctcaagcccctcggcttcctctgggaccgcaccgtcactcgcgacccttacctgccacagccccggcagcgatcgcacgtggacccgaaccgtgtcggcatggccgtgtcgagcggcgttcgtgagcgcctcgcgaactatcgccaggatgcagcgaccgacctccgcaggaggctcgacatcaagaccgcaatcgaccgatgcgcgagcaatgccactcgaggccacaaggccgtgcagcccgacggacacgttgacgccagagtcttccagcgcgtggacgctcctccgcatggacgaggttgcctcgttcaagccatcgagaatcgcgcccaggtcctccagcacctcaggttccccgcgatgcacgaccttgagagcctccacctggaggacgaggcgcgtgagggtatggcccaccgagtcatgaatctccctcgcgatcctcgtccgctccgcgagtgcggccgctcgcgactcaaactcacgcgcatcctcaagctctacgttcttctccctcagcgatgcaatcctgtcctcaaggtcatcctgcaggccatgaagctcccttgtgcccgcgagctgagccgtgcacctgagcgagagcatggacgcaagcgccgaggttgcgacgagtcccaccccagacgcaagcgagagccccgaggacagcgcagcacagagcgccgcgacgggcgctaacccacgcgcctggcgccatggcaggcgcgggatgtcgtagcagaggagcggtagcgtaacgtacgcacccggaacaagcgacgccaggacgacggccgaagcctcgacagcagaggccgcaacgggcactctgccgactaacagctcgaacaccgcgctcacgcacacggagaggagcagcgcaaccaccacgacggtcgacgcgccccttgagccggcaacgaacgcgagcgaagccagcagcagcaagcctttgtcccctagtctctccatgcggacagtataagggtgagcacgttcgaccgcaccactcgcgagctggcctttcccaagtgatgacaaatgtcataccccttggcgcaagacgcgcgaaagtcgtgacaaacgtcactcccacccgtccgaacaagatgaaagaatggggccaacaggaaaggcaacctccagattgcgaggcaaccatgaacgaggcaacgggcgagaaggacaagactcggatgcgcgaccacgcccccgtggttcacgtcgagaacctcgtgaagcgctatggcgaactcgtcgcggtcgaccatctgtcgttcgacattgcgtccggggaggcgtttggcctgctcggccctaacgggtccggaaagacgaccaccatcaactgcatcctgcagctgctcagctacgaacacggcgacatcagcctcttcggcaggcccatgcgcccgacgagctatgacctcaagcggcagatcggcatcgtcccgcaggaagtggcggtgtttgacgagctcaccgttcgcgagaacatcgacagcttctgcgccctctacgtgagcgaccgcgcaaagcggagggagctggtcgacagggccatcgagttcgttggactccagaagttcgagaagttcaggccaaagaagctgtccggaggcctgatgcgccggctcaacatcgcctgcggcatcgcacacgagccctcgctcatcatcctggacgagcccacggtcgccgtcgacccacagagccgcgaggccatcctcggcggcatcgagcgcctgaacggggagggggcaaccatcatctacacctcccactacatggaggaggtcgagcggctctgcaagaggatcctcatcatggaccatggccgcgcggtcgctagtggaacgcccgacgagctcaaggcgatggtcggcacgggcgagaaggtctccgtagagacggccgagccgtccgagcaggttctcgaggacctcaggaggctttcctgcgtgaggcaggccacgtatgagggcggaaggatacgcgtccagtgcctgaacggcgagcacaaccttgccgacatccttggcgtcctggccaaggacaacgttccctacgggcgcgtgctttcggagccgcccaccctgaacgacgtcttcctggagatcaccggccgcgcgctgcgtgacgaggcataggagaaaagatgctcgcaagcttcaagacgacggttctctcgctcctgaggaacaagtccatgctgctctgggccctgctcttccccatcgtcctcacgtgcatcttcatgggaatgttctccggaatcgaaagcgcctactcagccgtcggatccgacctcggcatagtgcgaagcgccagctacggctccaacgaaggcctgcagcagacgctacgctcgatttccctctccaccggcaagaacggcatcgtcaagctgagctacttcgacagcgaggcggccgcgcgcaaggcaatcgcggacgagaaaatcgactcttatctcacggtaagcaatgcgggaagcatctccctccatgtcggccagaggagcctgggggcgaacggctcgcttcccaccacgattctcgcctccgcgctcaactcccacctgcacgcgacgaacgccgttgccgtcatcatggcgcgagtgactccaggaggcagcgtgccggccagcttggcctcgggcgacggcgtatcgatcaagaggctcgtcctcaccaagaacgcccccgacccggacgtgcggtactatttctcgctcctcgccatgaccgccggcatcgggtctgcggccgccatgctgagcatccaaaggctgcagccaaccgagggcgccgtcggcgcccggcagtcggtctcttccaccccgcgctggctcatgctcgtgggcgcgcttctcggctcatggctctgtcagttcgcctgcatgcttgccgcacttctcttcatggcgctcgtggcccgcgtcaactttggcactggcgccgccccgctccttctcgccattgcggcatcgtcgctcacgggttgcgccgcgggcgccttgctcggcaccatcccccacatggaggacggcatggtgtcgggaatcacctgcctcctctcgctctttaccggcctgtacgggcccgcctcgcagctgatcaccgattccctcgaggctacggcgcccaccctcatacacgcgaaccccctctggcagatgaccaactgcttctactccctcctgtactacgacttgtacggacccttcctgagcagcatcgcggcgctgctcgccatgaccggcatctttctggccatagcggccttccgcatgaggaggatctcccatgggcagctataagacatctatgagaatcgtcctctcgcatcgcgtctacatcgtcatctaccttgtgctcatgacggccgttggactcacgataggcatgctgacccaaccagggtcgaccgcaaccttcaagccgaccgtgacgcgcgtcgccgtggtggaccacgatggctcgacgctctcgagggccctggcctcccgtatctacaagggaaacgagaaggtcacgctagatggcagcaagcgtgcgacacaggacgccatagccaaggactccgtctcgtatctcctggtcatccctgagggctggggagatgggttcatggcggccgcaaggtctggcaagaaggcccctactctgaactcgtccgtctcgtacagctcgggcgagggacgactcgtcgagctcacggcgtcaagctactcgaacatgctctatcagatggccgcgaccctcggcgggagccaagaggacgtcgtcagcgcctccgactccgcttggaagggagacgtcagcgtagacgtggtcaagagcaaggccaccccccttccagcctcgcttcgcgttgccgccgagttctcctcgtactcgatattcgcaagcgtcaccgtcgtgatcgccgtgctcatgcaagcgctcaacaggcccgaggtggcccgtcggaggatggcctcctcccaacccgcgcacgtccgaagcgcctctttgctcgccgcatgcctgaccatcgcccttgtggcatggatcttcaacttcggcctgcaggtccttctcctcggacgcgacgccacgactaccgcacccctccagctcgccatggtcggagcggcggagctctcgtacagcctgttctcggcggcagttggcttcctcatcggtcagatcggcctttcggaaaatgcctctaacgccgtggcgaacatattcggaatggtcttctccttcatgggtggggcttggacgggcctgtcgctgttgcccgacagcctgcttgccgtagcgcacttcatgccgtcctactggacgacgcttgcaatcgagggcgcatccaacatggagacggtgacgtctgcggctatgggttccctcctgggcgacgtgggaatatgcgcgctcttcagcgtcgccatcctgctcgtgggtttggtggtcggaagggaccgctcggcgggaaggtcttcctaagagtcccgcgtcatgacgcaattgcggaattccctaccatcagcgcaggtaaaggacccaatgcggtattgttctctggttatgagaacacccctggcgccatgcgccagaaaaccacgcgaaagagagacccgcatgaagctcaccggaagccagatccgtcagctgcgaagcatgtgcaaccagctcaagcccaccatctccatcggcaaggccggcgtcgaggccgtcatcggaaccgccgagcaggagctcgaggcgcacgagctcgtcaagtgcactgtgcagggaactgccggcctcgacacccgtgaggccgctgacgagctcgcccgcctgaccaacgcgaccgtcgtccaggtcattggccacaagttctcgatctatcgcgagaccagccgcaaggacgtcgagaagatcaagctgtcgtagcccgggcatttctctagactgtcagcaggacacagacagcaccacgtgggcccgcactcaatccacgcgcatcggaggcgaaagacatgaggaagattctcgtcgtagtcgacatgcagaacgacttcatcgacggagccctcggcacggccgaggcacaggcaatcgtcccgaacgtcgtcgcgaagatggagggctatcccaaggctgacatcttcgcgacccgcgacacgcacccccagaactacctcgacacgcaggagggcaagtacctgcccgttccccactgcatcaagggtaccgagggttggcagctccgcgacaaggtcgcggagctcgtcgcgccggagaacgtgattgacaagccgacgttcggctccgtaaagctcgcccacatgatgagcgagctcgcgcagaaggatgagctcgagatcgagctcgtcgggctctgcacggacatctgcgtggtatcgaacgcgcttctcctcaaggcagcgcttcccgaggtaaagataagcgtcgaccccgcgtgctgcgctggcgtgacgccacagaagcacgaggcggcgctcgagaccatgcgctcctgccagattcaggggctctagctcgcaagctggacactgcgcccgtaacataacgcgagcacgcaaagcggcggtcgcctttggcggccgccgctttcggttgtgcatgcggaaaggttagatgaactgcgcctcaagcagcttgattcccgtcttggtgcggaacacccgctcgcgcagcgactccgctatgcgacggcgcgcatcgacgtcgccctcggagtcctcgtacacgttgaccagcatgtccgcctcgatgagcacctgcaggtcgtcgtcatggatgtcgttgtaatggtgatggtgcgccacaagccagcacacgcggtcgatcacctccggagcatagcccaggcgctccatcatgggacgggcctcctttggcccgagctcctcctgatgggtgccaacggagtcaccgtagatgcgctcgctctcgtggatgccgatgtcgtgcacgagggctgccgcctccaccacgtagcgctggtcagggtccatgccctctgccagggcaatcgtgcgcgcgagcgcgtgcaccttcacaaagtgctgaatccgcttggggtccaggcggtcatactcgaacatcgcgagctccagcgcaacgtgatcctttggcgcatctgccatgtggcgtcctccctcgagtggttttggccattgtacatacggcgctcggcaggacgaccaaacgacatggcctcgcaacgattagaatctggcccaagcagctcgctgtgattggaggacgcgatgacaccacaggagtttgacgaggcggagtcgtactggacgagtcgcgaggcggagtccaagcggatgccagagggcgagctgcgcgcggcaatcgaagcgtttctcgcctcgcacaacacctgcgcgctcgcctgcggagctggcgacttcgtgcgctgcacgccgctcgagtacgcctatcgcgacggggcattctggatcttctcggagggcggcctcaagttccgcgcgctcaggcgcaacgcgaacgtgagccttgccgtgttcgagccctactctggctttggcaagctcgagagcgcgcaggtaactggcactgcggcgatcgtcgacccggacgatcccgcgtttgcgcgggcggcggccgagaagggcatccccgtcgacatgctcgcccgcatgcgctcgcgactccacctcatcaaggtcgcgccgtcgcgcatcgactacctgtgcagcgcgctcaaggcgcagggctacgacccgaggcagtggctcgagccgtagcgaggcgaccaggtgcggctcggcagacgccgccgcccacctggtcacaccgttctgttatgcaaggtacttggagaacgcccccaccattccctcgggcgtgtcctgcgagaagacgtcggccgccttggcctcgtccatgaagatgcccatgagcttctggagcatctcgacctggccgccgtcgcgcacgatgccgaggttgatgaccaggctcgcctggacgtcctcgccggtgccgcccatcgccttgaacgggatggggcgcttgggcttgacgatgcagatgtagggcctctgcaggttgacggggtcggtatgcgggatggcaatctggcccgtggggcaggccaggcccgtgggataggacttctcgcgagtcgatatcgcgtccctccaggtgtcgcgcacgtagcccgccggcttcaggcgcttctccaggctcgcgaagagctcgaacgcgtctgcggcctccacgtcgaagaagacgaggtccgagctcaagagcttgatgtcatctgcggacatttgcatttctccttatcaaatcaccagtgtcgtgccgtggggcagtcgtgccagggatggccgcgccaggggcggtcgtgccagactccctacctcccgcgggatgccttgccctgtgcggggctcgcctcaccggccagcttcagaaggaagtcgtatacggggccggcgttgtttccctccgggtcgtacaggtcctcgcagtgcaggaagtagcgcccacgcagcggcgacgcgttgttgacgcgcaggtagagcctcatgcagtccgggtagcgctgcacgcgcaggcgctcgatcgagccggccggatacgagtccacgtggccaaacgactcgaacgccaccgaggacccgtcaaaggtcaccttgcgcggatacgcatgcgccacgaaggcgttgagcagggagtacccgcacaccacggccagcagcagcatgaggggcgcaaggaccccaagggagagaagaacgaccgccaagggcagccccaccaccgatacgtacgtggccagcagcacgtcgatggtgtagcgcctgcggtcgtaggtatacgtgacgcccttctccatatgcacggcacctccagaaaaatggtgccgccagcaagcggtgctgacggcacccgaaacggaacacttaaggaaagaccagctaggcttggtcgccgttcttctccgcggcaacctctgcgtgaagctccttggcctccttgacgatgcgcttgtggttccagagggccatggccaccgccacgacgcccgtcgcgacaaggccgacgaacgcgttgatgctagagagaaggacgaagatgccggagagcggcgagccgccatcggagagcaccgtgatcagcgaggtgccggcaacgcccgtggcgccgactgccttggtgatgttgaagcctgcctgcgcggcggactgggtgatgagcggggcgagtgcggtggagatcagaaggcccatgatgaccgagatgatgccgatgatgaagccgcggaagccgttgcccttggagacgggcaccgccacggccagcatgtaggtgccggcggaaaggtcgacgaacgggagcgtctggttgcccaggggctgcaggatgacggcgaagaggaccatcagcgggatgcagatgagcgcgagggagagcgtgacggggtgaccgacggccactgcggagtcgaggccgatgtacatcttgccgcggttcttaaccttgttctggatgaagttggaggcggcgtcggagatcgggagcaggccctccatcaggagcgaggccatgcgcggaatgagcacgaggacggagccgagcgtgatggcgaccgtcaggaccttgccgatggagccggcaacgtcgccgggcttgaagtacgcgatgatgccgatgatcaggccgatgattgtgccgacgaagagcggctcgccaaagacgccgaacttcttctgcatggactcgacgtcgatgtcgatgtcacgcacgccggggatgcggtcgatgacccagttgatggcccaggcgacgggtgcatacgcgagcgagaagccctgggagatggagacgccgggcatgccgagtgcctcctggcagtcctcggcggtggcgtctgccagcacgagcagcacgacctcgtcgatcacggcagcgcagaagccaaaggtgatgttgccggtgacgttggccacgagcgagcccacgaacgcgtagtgccagtagttccagatgtcgacgttcacggtctgggtgaagttgacgagcacgagcaggaggttcaccaccagagcgagcgggatgatgaccaggccgacggtcgtgcccagggcgattgcggcgccggcgggccagcccacgtcgatgacggagagggcgaggccgaagcggtggatcatctcctgcacggccggcccgatggtggtgccaaagagcgagttaatgacgaggttcaggccgatgaagccgacgccgaccgtgaggccggccttgaggctcttcccgaagccggcgcccaggcacgctccgatgatcgtgatgatgattggcatcatgacggagacgcccagtccctgcaggaacgagaagaacgagattaccgcgtccatgtgactgccttacctacctttccttacttgctgccttaccagctgctacttcttgagcacgtccagaatctgctgctcggcagctgccttgccgatggtcgtgaggaacggcacaccgttcacgtaggggcacttgatgcccgcgggagccgcggtggtcgcaatcaggatgtccgcgtccgcacactgcgtcggcgcctcgccgatggcgcacttcacgatggagtactcgcccttgagaccattggaatcgagcaggtccttgaccttcgcctcgactgcggttgacgttgcgatgccggatccacaagctacgacgaccttcttcatggggattcccttctcttgtcgcctacgatgacttgatagtaaacaaattaaacgcacttgtacagtttgttttctgagaaatttccaagttgaaagacaatttccctagtacttctcttccaacagcgatttttgacgctcaaatcggttagacattgacctatattgtttactgtcagagctcaaaaccatcggagcgagactttttcaggttctgtgtttactgctgttcaacaaaaacttggagtgtgcgcaggacggttttagtaaacaaagatggtgtattgttaaacgctagccataggtcatgccgtcggaggtgccatgggtcgagtcagcatacgtgacgtcgccgccgagacgggctactcccccgccacggtctccaacgtcctcaacaagaagggcaacgtaggtgccaaggccacggggatcatcctcgaggcccttaagaccatgggctaccgtcgcgcaagccagatcgaccgcgtgatcttcgcggtcgtacgcatgacgggccgcatcgtggacgacagccccttccacgccgtggtgtacgccggcgtggagcgcgccgcgcgcgagctctcgctcaaggcatccatggtgacgctcgacctcacagaccccgcgacccgcaaggccgccatcgcggagctggccgacaatcccaacgcaggggtcgcccttctcgccactgagatcgtggacgacgatgactacgccctcttcgaggacttcccgctgccgctcgtgatggtcgacggctggagcgaccggctgcccttcgactgcgtgggaaccgcaaacgagtccgccgcctaccgcgcgacggcctacctcgcgttaatgggccacgagcgaatgggctacgtgggctccagcgtgcgcatcaagaacttccccctgcgcgagaggggattccgccgtgtactggatgacatgcgcatcccctttgacgagcacaaccgcctgctggtggacccctcgccggagcctgcctttgcccagatctcgacctggctcgacggcgaccccgagcttcccacagcattcttctgcgacaacgacatcatcgccgcgagtctcgtgcgcgccctgcagctgcacgggtacgccgtgccggagggcgtctccgtcatgggcttcgacgacgagcagctctgccagctggtgcagccgccgctcagcacggtccacgtgccgcgccacaagatgggtgccatggccgtgcaccggctcatggagcagacaaccgctgcggacgccgccccctgcatcgccctcctgcacacgagcctggtccaccgccagagcgtgcagcgcatctaggcgcacggcaaggacggatcggccggcctcgccacatgaacgcataggggtgcctcccacgcgctgcgcgggaggcacccctcgttggcaaacttcgatttttgattttatgaccactgtgcgccggggcgcccacggcgcgcctggggcacggcggtggtccttctcgcctacgcgacctcctcgaactgcgactggtacagctgcgcgtagaacccgccgctggccagcaggtcctcgtgcgtgccgcgctccacgatgtcgccgtcgcgcaggaccaggatcgtgtccgcgttcttgatggtagagagccggtgcgcgatcacgaagctcgtgcggccgaccatcagcttgtccatggcgcgctggatgcgccactccgtgcgcgtgtcgacgttggaggtcgcctcgtccaggatgaggatcgggcggtccgccagcacggcgcgcgcgatggtgagcagctgccgctggccctggctgacgttcgtggcgccctcgtccagctcgaagtcgtagccgccgggcagcgccttgatgaagtgctcgcagtgggcgtagcgcgccgcggcctccacctcctcgtccgtcgcgtcgagccggccgaagcggatgttctcgcggatggtccccttgaagagccaggcgtcctgaaggaccatggagaagttctgcctcaggtcctcgcgggcaacgtcgcgcacgtcatgcccgtcgacccggagcgcgccgccgtccacgtcgtagaagcggagcagcagcttcatgagcgtcgtcttgccggcgcccgtgggaccgacgatggccacggtgcggccgggcgtcacgtccgcgctgaagccgtggatgatcgtctggttgggcaggtagccaaaggacacgtcgtcaaactggaccgcgcccttggagccgccgatcttctccaccggctcgcccgtggcggggtcgagcgcggcggtctccggctcctcgggggcctccaggaactcgaacacgcgctccgcgcaggcagccatctgctgaagaacgttggaaacggtcgcaagctgcgtgatgggctgcgtgaagttcttgacgtactggatgaacgactggatgtctcccggctggatggagcccgagacggccagccccgcgcccacgaccacgacgcccacgtagcccatgttgcccacgaggttcatgagcggctgcatgaggccggacaggaactggctcttccacgcggactcgtacaggcggtcgttctcttggtcgaagctcgcgaccgcacgatcgccctggttgaaggcctggatcaccacctggccggagaagtcctcctccacgcggccgttgacggcgccgagctgctcctgctgcaggcggaagtagcgctgcgaccgcttgatgagcacgcccaggatcgcggcggacacgggcagcgtcacgaaggtgacgcccgcgagcggaacggagatggaaatcatcatcaccgcgacgcccacgacctgcgtgatggaggtgaccagctggatgaggccctggttgagcgactggctgagcgtgtcgacgtcgttggtcatgcgcgagagcacgtcgcccttggatatggtgccgccgtcaaagtacgacaggttgaccttggagatcttctccgcgatctggccgcgcatgcggtacacgaccttctgcgtgacgccggtcatgatccagctttgcatacccgacgcggcggcgctcgcaaggtagatgcaaaggagccccagcagcgtgcgcccgatgagcgcaaagtcgatcccgcctttgccggccgcggccgtctgcgcgccgcggatgacctccgtggtggcgctgcccagaaccttaggtcccacgaccgagaagagcacggacgcgatcgcgagcacgaccgcggctatgagtcccacgcggtagacgcccatgtagtgcaggagcttgcgcatggtgccgccaaagtccttggccttctcgcccggcgccatgcggctgcccgggccgtgaggccgcatcggcttcctgggctgttgcgttctttccgccacgctactcatccccctccaggccgagctccttggcgctcagctggctcttcgcgatctccaggtactcggggcagtcgcgcaggagctgctcgtgcgttccctgccccaccacgcggccctcgtccagcacgacgatctggtccgcgcccatgacggtggcgatgcgctgcgccaccaccacgacggccgtgtccgcgcagtcgcgcgcgagcgcctggcgcagccgcgcgtccgtggcgtagtccagcgcgctgaacgagtcgtccagcaccagcacctccgggtgcgtcgcgagcgcgcgggcgattgccaggcgctggcgctggccgccggacacgttcgtgccgccctgggagatgggcgcgtccaggccgccctccttctggctcacgagctcggaggcctgcgccacgtccaccgcgcggaggagttcctgccggcgggcggggtcctgccgggacatcgcgtccttctcgcccgcgtcaggcaggccaaaggcgacgttggagccgatggtgcccgagaacaggaagccctgctgcggcacgtagcccacgcgggagcggacatcagccagagacatgtggcgcaggtcgacgccgtcgagcgtgatggagccggacgttgggtcgtacaggcgcgggatcagctgcacgagcgtggactttccggagcccgtggagcccacgatcgcggtcaccttgcccggcgcagtggtgaagctcacgtcgctcacgacgtcgccctccgcgtcagggtagtgaaagctcacgtggtccaggcgcagctcgccgcgcggcgcgtctgccgccggcgcgacggggcgctccggctcgcgcacggcgggctcgacggagaggacctcctgcacgcggccgacggagacctccgcgcgcggcaggatgacggcgaccatggacacgatgaggaagctcatcacgatcatcatggcgtagctgatgaaggccatcatgtcgcccgcgcgcagggcgcccgccgccacgccatgcgagccaaaccacacgatggcgacggtcgagatgttcatcacgagcatcatgagcggcatcatgagcgtcatggcgcggttgacgaagagctgcgcgtcgcgcaggtcgcccgaggccgcgtcaaagcgctcgagctcgtggccctggcgaccgaacgcgcggatggtcatgatgccgtcgagcatctcgcgcgcaaggaggttcacgcggtcgaccagcgactgcatgaccttgaagcgcggcatcgtgagcgagaagagcaccgccacgacccccagcacggccaggagcgcggcgcccgcgatccagaccaggccgccgcccatggtgagcacctgcaccacggcgacgacgcccatgatcggcgcgaacacgaccatgcgcagcatgatgacgatcatgttctggatctgctgcacgtcgttggtgcagcgcgtga

SEQ ID NO: 147 - DNA, 4121 bp, Unknown
  Metagenome-assembled genome
gcacggcagccatcgttgtattggtgatagcactcatcgccgtagccacactattggttgcgctgcgtctggaagacacccacgtgaaggtcctcgcacaaagtggctattctgctggctccgccgcaagcgcgaggtaccagctcgaggagcgtaacgcgcgaccagattgatcaacggaagtcaagggctggttcgtgctgccaggtgtaacctacccctactacaactacggcaatgatgaacacaagactggcgtatacgactatatgcggcttgccgtgaagaacgacgacggcagcctaactgtatttcccaccaagctggagctacgccccgacgtcaccgcagcacttgccgatggaaccgattaccgttactgcggcttccatgcactggtgccagcaaagtggtcaagctccctcgactctaaccagctggtcatggcaatcactaatccggacggagacgttaccttctaccctctcagctggaagggagatacaaaatgacttccaggaagaaagacgccctgattatgggcgtcacattcgtcgcgttcctgctgctcgacctcttcatcgccagccgtctagacgacttggtgtttcaggacgccctcaatcgctatggcagcctgtggggatgggccacgtggttctccgcaaactggggcggccgtacgctgccgcaaggcgtgctggtggtggtgctacagatgcccaacatcgtgttccatatactggatgcactcgcatgggtggtgctgctgcggtatgcgcagctagacctggaccccgagcgccgtctggggaacgctgccgtgttcctgggcctccccgtggcgctcttcacactggtccccgtgactgtgctctcaggcaccgtcttctggaagtgcgcaaacgttttgtacctttggggcaccgcatctgctctcgttgcactcagaccggttctggacgtctggcgctgcgcggcaccctcgcttgccgagatcgccgtcgcctttccatgtacgctctacgccgctggcttcgaacagtcgggagcactcatggcaggaatcatggtcgcgctcgttgcctacgaactcttgtcacagcaccgcttgcgggcttcagtaattgtactcgccgcgtttgccgtggccgcgacggcgtttttcgtcagcctaccgggcaacgccacccgctcctacgttgaaaccctggggcggatgcaaaatttcggcatgtactcgctggtagacaaggcggtacttggtctgtggtacgtgattgagggcatagagacggacgtccctgcgctgccgttgctgctctcgctgctggtattggttgtggaaatgcgacaccaccctcatcgcacttggacggtagtactgacggctttcacctgcgcatacttcgtactggtactgattgcccgcgagggtcaagccgcaacgggcaaccaaacgctactgaccaaggcactcacattcataagccctgataccacgaccttcctacccagttggcctcgcttggcagcaagcgcgctacacttcatggcttacgtagcattgggtacgagtatactagtcgcgtttcccgaacacctggaggtacctggcttcttgctgtactttggcggccttgcaaccatgtggatgatgggcttctcccccaccgtatacgccagtggagcacgaccgcgaatgattggctacctcacgctgctacttgtagcactgcgcctcgtgaccatagcgctcgagagagacgaaacgagcctgcctcagctgctagacggcagacgtgatagtaagcagtaactcaccactcgaagaagtgccgcgaatgagagggggctctcccaacctttactccctctctctagcaccacatgagactacctgtaacccgcttgaagggtcccgagtgtccatgcaacgcggcatggctagtgagttccacactcgatgccggcgaaggcatcgtaatacgctagcaaatgtacggacatcaatcaggttttcagtcgcacgtcgagtcagacgtgccagagcgagcagcgagacaccagaggacatggcaattcgccccgaccccgagagaaccgggaccggggcaacttaacttttgcctgaggtgtcacatataagtcgagcaacacaatagagaatgttgttgcaaattgcagacaagctagtttagatcgaggtagtccttccagtagtcgaccgaggtgaccttgctacggcacgcctcgaagtcgctctcgagctgtatcttgttcttcttgtaggcctcaacatcattcttgaaacgctgccagatctccttgcagcgttcgttgtcacgatgacgaatgatgccagtcttcgactggacgttgatgaccaggagcgtgttggcaccgtagagcttgccgggctggtaggaccagccgacaccctcgataatctgcacctgtcccatggtcggcgtcaggtcgccgtagagctggccgttgagcgtgcgctcgaagagctgcgtgtggtacacgttgtacaccttgccgtgctcgtacccgccaagtgggatgtcacgctggacatcgtcgtcgcagagtctgttgacgtcgatacccagctcgtcgagtgcctgctgcctgagctttgccagaggaacctggcgctccttgttcttgttggccgccatgaacgccatctcggagaagtccttctgcaggaagagctccggtcccctgaggaagtcctcgaagccctgacagacgagctctgcgtccttgtagttgaacttcacgagctcgagcttgatgttcttggtaatttcgttaaggaagtccgtgctgggcgcaaccttggtgatcgcctggccgaggatgccgttcctgaccgtctggtagcgctcgacgccggcgttgtacctcatgttgaaggcgtcgtgccagatgcagatgccgttgagcgtcacgaacctgggcttgcagcgcagtccgtactcggcatcgtcaaatcgcacgaagaagggcaaaggcatgccgttcttcttgatcatggagacagggatgcagcagtaccaccatgccgcgtacttctgcttgaggtcctggtacacgtctgtcgcaggatggaagctctcgctcacgacacagtcgtgcagcacgctcatgtggagcatcggcttgtaggggcggtagatgccctcttcggtcatgtaaccgacgtcctcccagtggacatccgggtcatcgtggttcatcatggcgccactgatgaaagcttccccgtactcattgttgagaatcctcagcagctggtaggtgcgcttgatgctctcgggtgatacctcgacgtcgtcgtccatgaggagaatgttggtaacatcacctgcatcgagcgccttgatcatgccatatgcgaagccgcccgatccaccaacgttgcggtttgggaacaccgtgacaccgttgccggaaagcgcctcggcatcgagcgtgctgccgttgtcaattacgaacatacggaagtggccagcaatatcatcgttggaaccgaggaccttctcgcgcacgagctcgatattgtgggtgatgtacgactccttcttgaaggtcgtcgtggagagcgcgagctcaacgtcgcggatgctgtcatcaggcacggacgccgcgtagtaggagttcctgatcctcacgggacccgcggcctcgatcaggaagccgcagatcacgtcggactcgctgtactggatgggaaggtcgatggcgtgccagccctcgccctcgggcgcgaagttctgctcgagcgtgcgggatgagtagtcgaacgcctccgcgtgcgtctggtagagggccttcacgtcgccgttgagctcgaggtgcaaggtgtaggacgccgccgtggtgtagcggtcgtacttctggaccgacagcgcgttgaagaatgtggtgaagtcgaacgtacccgggccatccagcagccaggagtcgcccttctccctcacgggcgcatcggcgcgaacgtagagctggggcaccataaagaactgcctcgtgccctccaggaggacgttggcgatcttgacctgcttcatctatacctcgacttcccgcgaccttggccgcgctgg

SEQ ID NO: 148 - DNA, 3829 bp, Unknown
  Metagenome-assembled genome
tcgacgtgtcgtcaccccaggcgctcgaggacaccatggagcgcttcgtccgccacggctccggcacctgccgcgccaccatcatcgagggaagggtcgcctatgaccgcatctggaactgaccgcacgtctgcccagctcagcccctacgcgcagggcctggtggccgcgctcgaccttgcgccgcaccccgagggcggctggtaccgccgcacgtggcagtcggccaccgtggccacaggcgacgcctccgccgccgacctcggcgaggacagcacctccgcgcgcccgctggcctcgctcatctacttcctgctgcctgccggcgacgcgagcgcctggcacgtggtggacgccgacgagctctggctctggcacggccccggcgccatcacgctcgagctggcgggcacgggcgacgccccggacctggagcacgccacgcgccgcacgctctacctgccgggtcccacgggcgagaagaacgcgccctcccggcaggacacccctcgggacgcatgcacccagctcgtggtgcccgccggcgtgtggcagtgcaccgtgcccacgaccgaggacgcactcgcatcctgcgtggtgagccccggctttgtgtactcgggattctcgctcgcgaagtagggtcggctaacggctcgagaacctgattcgaaagttgatatctgttacggaggacgtatctgggaattcgatgcggcagtggtcgaacaggtatgacctgaacgcctcgctgtccaacgcgtcgaatgcgaccagcttgtcgtccgcgtcaatcgtaagcaaaccgccgctgactgtgctcctcccgtcccacaacgtacttgccgtgagtccgcagtacgacgcacgcaggaactccttcagcatgtatgggtacttggcctcgggacgcgtgaggccgcacgggttgcgctcgatcagccagtcgcgaacctcccgcatggaggtggtggccccgtcgaactgcccatgggagaagtgtgcgcatacgacctcccgccacaccctgggcaggcgtgggttaatgagctcgcagttctctgcaagagcctgtgagcccgcagtggtgtcgagcagcgtagactccatgcaccaccggaatgcgcccgtatgcgggtcggaaacatcaagaaatgcatcgtttttctcgcccgcgggacatgacggaagggcctggcgcacgagttcaagaatccagcacgcgttgttagcctcgtccgagcgtgcgccacgaacccgcacggctaggcgcctcttgctcgtgggactcacccccatgaagtaagcaacggtttagttattgatactgtaccggacttgctctacgctgtgagcgcgcgaatgggaatcgcatagattccgtcctcgacgcggtgcgcgtactcggatacgccggtgatgaccgccatgaactcgggcggccgcacacgagcacgcgggttctgtgtcagcttgttcctcaagcgcttgaggctcgccacgccatcggggacctttacctcgctcgtcttgatctcgaacgccgcccacctgccgtccgcaagctcgatgatcgcatcgatctccaggcccgcggagtcgcggtagtagcgcacgggaacgtccccgcacagcccctgcgcctcggcatagacctgcaggtcgcgaatgcagaggttctcgaacacgaggccaaacgtctgccagtcctcgaggagcgcctcgggcagcagcgcgagctgcgccacggcaagggacggatccgcaaggtagcgctttggcttggtgtggatacgctttgcggaacgcgctgggggcagccatccgggaacctcgtcgactacgtaagaagcccttaggagttcgagataagaggagaccgcactttcgcttggcaccgcttccgcagaggcgtcactggcatctgccgccagcgtcttgtacgttgccgactgtcccaggtttcttgcgagcgagaagagcatcctccccatcgtctctgggtccttgccctgggagggcgccgtgatagtacggaagcgacgcaggtactcgcgcgcaatctcctgcgcgtcctcagccgaaaggtcgatggcctccggccagccgcccctgcacgcaaggttcaccaggtcgtaggcggttgtctttacctggactggctcaaacttgccatcaaacagctcggccagggaaaccgccccaacggaatcgccgctttcgaaaagcgacatcgggcgcatgcgtacgcgcccgacgcgtcccgctccgctgtgttgcggaagctcatctttcttccttaccaggggcgaggaggaccccgtcagtatgaatgaccccctctggccgcgcttcctgtcgacctcgtggcgcaccacgtcccatatggctggaacgcgctgccactcgtcaatcacgtgtgggcgctcccccgtcagcattgccgaagggtcgtcctgcgcgagcgccaagttctcgtccacgtagctcacactctgcgcatgccgaagcgcggtccatgtcttgccgcaccattttgtaccggctatctccacagctccgaagatacgtaagtacctgtcgacgcgcttgtcgaccagtctcggtaggtaaccctcaggctcaagggacattactttgcctccacaacaagcagaaacatgacagctcacaaacacatatggttacgtgcttgaacgcaagtatatgagattttccacccaacttgaagttgattttccaccctatttgaaatggattttccaccctattcagcgtggattttccaccctgatccggacacaaaatacttggtcgctacgcctgcgcgagccgcctgatcacgcccatcgtgacgtccgcggtcaggcgggccgtcgcaaacaggtcctgctcgcggccgtcgagcgcctcgtaggtctcgccgcagacgttgctgatggaccggatggccagaaacggcacgcccgcgcgcgccgccacctgcgccgccgcgacgccctccatctcctcgcagtccgcctggtagcggcggcggatgtcgcgcaggacgttgggctccgtgctgaagatgtcgctcgtagcgatggccccggtcacgtagcgcggatcgtgcggcgccagcgtgccgtacgccgcggcggaggcgttggcgtcctccaggctcgcgacgggcttaacgcgcgcgaagccgcgggcctccagctcctgctccgccaggcgcacgagccccgcgcttgaggggaagctcgtgaggtgcggctcggactccgcgatgatctgcatgtccgcgtccaggcactccagacgcgcgcccaccaccacgtcgccctcgcctatctgcgggttgaggcttccggcgatgccgctgaagatgagcgcgtcgggctcgtatgcgtcgatcagcagctgcgcggaggccgcggaattgaccttgcccatgccgccgttggcggccaccacgcgcacgcccgagacctcgcgcaccgcaagctccacgccccggcgacggaacggttcttctcccccaagctcaaagaacgcgagggactccttctgcagcgcgctcagcacggcaacggtcctgaccatacggctccaatccacccaggcgacgtgactttgcaacgtgacgttcgcaagtatagccaacgggcgcaccccaccgccacgtgcgccggccgcacgtgccgccgctagtgccgccgctcaagcgtccttaacattgcgtaacgaaacatagacttttatatgttacgtacagacccacaaacttggctttgctaagcttgtgcttgtctgagaagaacacccccacgggttgtggggg

SEQ ID NO: 149 - DNA, 8626 bp, Unknown
  Metagenome-assembled genome
ctacatggacaagatcaacgccaagctcggcaccagctatcacctgttcgactactacggtgccgatgacgccgaccgcgtcgtcgtctgcatgggctccttctgcgacactctcgaggaggtcatcgactacctcaacgcccacggcgagaaggtcggcctcgtcaaggtgcgcctctatcgcccctggtccgtcaaggacttcgtcgcggcgctgcccaagaccgtcaagaagatcgccgtcctcgaccgcaccaaggagcccggctccatcggcgagcccctgtaccaggacgtcgtcacggccctctatgagtccggcatgtccgacctcgtggtgaccggcggccgttacggcctcggctccaaggacgagccgcccgcggctgcgttctccgtgttcgaggagctcaagaaggacgagcccaagcgcgagttcaccattggcatcgtggacgacctcaccaacctgtcgctgcccatggacccggacgcccccaacaccgctgcccctggcaccatcgagtgcaagttctggggtcttggtggcgatggcaccgtcggcgcgaacaagaactcgatcaagatcatcggcgaccacaccgacaagtacgtccaggcctacttccagtacgactccaagaagaccggcggcgtcaccatctcgcacctgcgctttggcgacaagccgattcgctcgccgtactacgtcacgaaggccgacttcgtcgcgtgccacaacccgagctacatcgtcaagggcttcaagatggtccgcgacgtcaagcctggcggaaccttcctggtcaactgccagtgggatgacgccgagttcgcggagaagatgcctgccgaggcgaagcgctacatcgccaagaacaacatctccgtctacctgatcgacgccatcgaccttgccgccaaggtcggcatgggcaagcgcaccaacacggtccttcagtccgcgttcttcgcgctggccaaggtcctgcccgccgaggacgccctcaagtatatgaaggacgccgcggagaagtcctactccaagaagggccaggcaatcgtcgaggccaactggaaggcaatcgacgccggcgccaccgcgttccgcaagttcgaggtgcctgccgactgggcgaccgcagaggacgtcaagcacgaggtcaagctcgagggccgcgacgccatcgtcaagcaggtccgcgaccttctcttcccgatcgacaagatggacggcgactcgctgcccgtctccgccttcaaggacaatccggacggccagtgggagctcggcgcttccgcgtacgagaagcgtggcaccgctgtcatggtcccgcgttgggatcccgagaagtgcatccagtgcggcagctgcgcgttcgtgtgcccgcacgccacgatccgaaccgttgccatgaaccccgaggaggccgctgccgcccccgaggccatgaagaccaccgacctcaagatgccgaagaacaccggctacacgttctccgtcgtcgtctcgccgcttgactgcatgggctgctacaactgcctgtacgcctgccccaagagcgactacaagaacggtggcgccctcaccatggtgccgcaggaggaagaggccgctcaggccgaggtctgggactacgccgtcaacaaggtgagcgagaagaccgagctcatcaacgacaagacccccaagggctcgcagttccacaagccgctgctcgagttctccggctcctgcgccggctgcgccgagacctcctatgcgcgcatcgtcacgcagctcttcggcgaccgcatgttcatctccaacgccaccggctgctcctcgatctggggcaaccccgccgcgacctcgccgttcacggtcaacgctgacggccatggccccgcgtggaacaactcgctgttcgaggacaacgccgagcacggccttggcctgaagcttggctacgacgccgagcaggcgcgcctcgcgacgatgaccgagaagctcatcgagaccgagggcatccccgagagcctgaaggagtccgcaaccgcatggctcgaggccaaggacaagactgccgaatccaaggctgctgccgccgagtacgtggcacagctcgaggctgacggctccgacgcctccaaggcgatcctggccgacaagtcctacctcagcaagaagtccttctggatcttcggcggcgacggttgggcctacgacatcggcttcggcggcctggaccacgtccttgcctctggcaacaacgtgaacgtcttcgtcttcgataccgaggtctactccaacacgggcggccaggcctccaaggcttccaaccttggccaggttgcgcagttcgcagctgccggcaagaccaccaagaagaagtccctcgccgagattgagatgtcctatggctacgtctacgtcgcgcaggtcgccatgggcgccaacccgatgcagaccctcaaggcaatctccgaggccgaggcctacgacggcccgtcgctgatcatcggctacagcccgtgcgagatgcactccatcgcccacggcggaatgatgcacgcccaggaagagatgaagaaggcagtcgagtgcggctactggaacctcttccgcttcgacccctccgcacccgagggcaagaagttcacgctcgactccaaggagccgaagggcggctaccaggagttcctgatgaacgaggctcgctacagccgtctgacccgcgagttccccgatcgcgcgaaggagctcttcgccgagaacgaggaggccgcaatggcacgctacgagcacctgctcaagctcaaggcgatgtacgcggacgcctaggggagaagaacgcatcccctctagcagctagctaggacaagccggtcgtggagagatccacggccggctttcttgtgccctgggggcatggctgcggctgcgaggggcgtccttctcgcccggcagcaagaccctgccaaacggggtgtggctgcgctacccttgataaggaatgctacggccgtgacgccctatatgattgccagggcgtacggcgtgactcttcgtttggaggaatggaaatggcagagaagagcttctgcatcaaggcgaggggattcttccttccgtcgggttaccgcgacggtgggtacctgaacgtccgtgacggcgtgatcgagggcgtttccgacgagcctggcgagggcctgcgggtcgttgactatggtgacgcgaccgtgacgcccggctttgtggacacgcacatccacgggtacgcggaccacgactttatggattgtgaccccgcgggcaaccacgagatcctgagggcgctggcccagaagggcacgacgtccatcctcgcgaccacgctgacggcctcgaccgaggcgatcgacaaggcgtgcgcggcaatcgccaagacggtcgacgagcgcgaggggggctccgcggaggcgcgcgtccagggcatcttcctggaggggccgttctttacggagaagcacaagggtgcgcagaacgcggcgtacctgtgcccgccgagcctcgacaagctggcagcctggcaaaagtctgcgcgcgggctcatccggaagagtgccatcgcgcccgagtacgaggagtcgctcgcgtacgtgcgcggcgccgtcaagatgggcgtgaaggtggcgctgggccactcggacgcgacgtgcgagcagggacgccgtgccgtggacgcgggcgcgaacacctttgtgcacacgtataacggcatgagcggcctgcaccaccgcaagccgggcctggtgggctgcgcgatgacgacggacaacacctacgccgaggtcatcagcgacggcctgcacgtacgacctgaggccattgacgtgctggtgcgtgccaagggctggaatgaggtcgccctggtgagcgactgcctgcgctgcggcggcatgcctgacggtgactacatgctgggcgagcttcccatcgtgctcaagggcggcgtggcgcgcctgcgcgacgagggcaacattgccggatccgtgctgacgctgggcaaggccgtccgcaacatcgtggattggaacatcgagtcgctcgagcacgccgtggcgatggcgaccatcatcccggcaaagtctgcgggcattaacgaccgctgcgggcagattctgcccggtcgcgccgcggatctggtggtgcttggcgctgatttgagcgtacgggcgacctacgtcggcggcgtgaaggtggcgtagcggatcgagcctcaacgcgccaacgcattggcgcagtgcgatacaacctagcgtgtcccctggcccctggcgtatgctgggggccaaactcgtgcgcaagggtcggtttgagggttgtgcgtgggccgggataatcccgcatcaacccctccgtcgaggctccgcgggcggttggcaaggtggcgcgagtggttgagcacgttcttctcgccttacttcgaaacataaagactgttaataaaatatttgtaaaaatcggaacgcaactgcaaggattacgtcatataggtttcggtttagtgtcgattagggcagttggaacccggataaactggaacttgggaactctgcttgccaacatggttggtgagcaaggccgggcgcgacccggtgcgaacggaaggcggccaggtgggccgctgggacacaaggagaaggagttccgacatggcaatgcccaaggatttcatcgacaccaacgacttcactaaggagcagctgctcgcgattgaggaccttggcctcgctatgaagaaggccatcaaggttgacggctactatccccacctgctccgcaacaagtccctcggcatgatcttccagcaggtctccacccgcacccgcgtctcgttcgagacggccatgaccgacctcggcggtcacggtgagttctttggccctggcaccatccagctgggcggccacgagtccctgggcgacaccgcccgcgtcatgggctccctgctcgacatcatgatggcccgtgtgaaccgtcacgccgacgtcgagggcctggccaagggctccgcggctcccgtcatcaacggcatgagcgagtacaaccaccccacccaggagatgggcgacctcatgacgatgctcgagaacctgcccgagggcaagaagatcgaggactgcaagctcgccttcattggtgacgcaacgcaggtctgcgtttcgctcatgttcatctgctccatcatgggcatggactttgtgcagtttggccccaagggccacaccatccccgacggcgccctgcacgttggcacccccgaggagcgcaaggcctttggtgaccacctgatggccgttggcaaggccaactgcgagaagtctggcggcaccatcacgatttccgatgacatcgagtccatcaagggcgctgactttgtctacaccgacgtgtggtacggcctgtacgaccaggaggagtccggcgcctcctacatggacgtcttctatcccaagtaccaggtgaccatggacctcatgaacgtcgccggccccaactccaagttcatgcactgcctgcccgccacccgcggcgaggaggtcgtggacgaggtcatggacgaccccgagcgctccctctgctgggttgaggcagagaaccgcaagcactccatccgcgccctgctcgcggccctcggcccccgcaccccgctgaacgacgagggcgtcgagtactccgccaaggacgagctgcacgccaccctcaagaagattgaggagctccaggcctagtcaaggcatttgcgagaaggacgtgcccccgcggcgtcgagcgccaacgggaccggcgtggccacgtggctgcggccgagggggcgcgttcttctcgacgtatagacgcgaaacgagagaggagttggcatggcagaaaagaagggcatctcgtttctgaccatcatctcgaccgtcatctgcgtcgtcttcgtgtgcgaggcggcggcgccggcggcggccatcgggaaccagcagttcttctggtggatcttcctgatcatcaccttcctgattccgtacggcctggccgttgcggagctgggaaccacctatgacagcgagggcggcatcatcgactggatccgcgacggcctgggtgacaagtgggcggcgcgcgcgtcgtactactattgggtcaactacccgttctggatcgcctcgctcgcgaccatgttcccggacatcctcaacatggcctttggcatcaagttcaacctcgcgggcagcctgatcatcgagcttgcgtttacctggatcgtcacgatcatggcattctccaaggtgtccgactccgagtgggtgctcaacggcggcgccatcatcaaggttgcaatcgccgtcaccgtcggctgcctgggcatctggtatgcgtcccagcacggattcgccaacgacatgagcccgcagaccttcctgccctccggcaacctcaacgcgctgagctacatctccatcatcatcttcaacttcatgggcttcgaggtcatctgcaccatgaccgacgacatgagggaccccaaggtcgagatcccgcgcgctatcatcatgggcggtgccgccatcgcgatcatctatctgttctgcggctttggcattggtgcggcaatcccggccgacaagatcgatcccgactacggcatgctctacgccgtgctcaccatggtcggcgactccgtgctcttcaaggtcatctgcgtcgcgttcctcatcacgctcttcgcgaacatggcgtcctggtcctttggcgtcaactccgttgcggcctacgccgcgcagacgggcaacatgcccaaggccttcggcaagatgaaccccaagaccggcatgcctgacaccgccgccatcatcaacggcgtcgttgcatccctcatcctctgcatccagcttgtcccgatcaaggcaatctccaacggaatcttctggatgctcttctccctttccgtcgtcttcctgctcctgacctacgtgcccatgttcccggcgttcatgaaccttcgcaagaacgatcccaaccgcaagcgcgtgtacgagttcccgttcaagggcggcatgctcaaggctgccatgatcgtcccgatggtcgagctcatcgccgtcgtcatcaccaccgtggtgccgctgtccgccgacgaggtctccaccaagatgccgatgctcatcggactcatcgttcttctcgtcattggcgagatcgtccgcgtggtctccgcacgtggccgcaaggaggagtacaagggcctcacgcccgagctcgccgagcagcgcctggccgaggaggccgcggcagagaagagcgaggcatagtcgcctaggcatcaccgtgagctcctaggagccacctgttcttgttccataaggtaaaggcagccgaaagctgccgtcacaagaggaggttttgcaatgcgtaccatcaccgagtccgagtccaccccgagggctgacggcttccacatgcctgccgagttcgagccgcaggaccgcgtctggatgggctggccgcaccgcaccgacacctgggcctttggcgccaagcccgcccagaggcagtacgccgccatcgcccgcgcgatctctgagttcacgcccgtcgtcatgtgcgtgaacgaggccgactacgccaacgccaagaaggtcttcgagaacgacgagaacgtcctcgtgctcgagatgaccaccgacgacgcgtggttccgcgacaccggcgccaccttcgtcgtgaacggcaagggcgagaagcgcgcaaacaactggcacttcaacgcgtacggcggccttgttgacggcctgtacttcccctggcgctccgatgacgagatcgccctcaagatggccgagttcgccggctgccgcacctatcgtcccgacgacatgatcctcgagggcggctccatcaccgtcgacggcgagggcacgctcgtcgtgaccgaccagtgcctgctctccccgggccgcacctgctccgccgtcatggccgaggaggaggacgaggacaccatctggccgaagtacgcccgcaagttcgagccctggagcgaggagcttcgcgagtacatgaccgagcacctcaaggactacctgggcgtcgagaaggtcatctgggtcaaggagggcatcgaccccgaggagaccaacggccacatcgacgacgtcgcgaccttcatcgcacctggcgtcatggcctgcatctggtccgacgaccccgactacccgttctatcgccagtgccacgccgcgtacgagacgctctccaacgcgactgacgccaagggccgcaagctcaaggtctacaagctcccgatgccggtgaagccgctttacatgacgcaggaggcctgcgactccatcgacgtggacgaggctgccgagccgcgcgtcccggacgagccgctgatcgcttcctacatgaactacctggtcaccaaccacggcgtcatcaccccgcagtacggtgacgagaacgaccagctcgccgtcgacaccctgcagaagatctacgacgagacctggggcaaggacgtctacaaggtcgtgggcgtcaagtccgaccaggtcgtctatggcggcggcaacatccactgcatcacgcagcaggagccctctgcctagg

SEQ ID NO: 150 - DNA, 7062 bp, Unknown
  Metagenome-assembled genome
cggaccgacaggggcccgactcacaaagcgtgctttgtgagtcgggccctttttgcgtttgggctggtaaataggttaaggcgggcttgcgcccacactcgcaaagcatgctttgcgagtgtgggcgatgtgcgtggttcgaccttggtgggaccgcattccagaaacgattttggaatgcggcctaaattgcgtttgcgcaggtaagcgacttggtttcggcataccagaaaagtttctggaatgcggggtgcggcgggcgccgtgtgcggacgcctcgggcgccgcgcgggcgggcccggcgcgtcttggcagaatgcgtggcggtggcaagcttgggtcgcggttcttctcgcccggcgctaaggtagctaagggcggcggcaagcctgacgatggcgagcattgcgttggcatgccagacgaaggtaagcctgccgccggaccgtacgcaggggacgctcgctcggaggcaacgtgatcaagctcattctttccgacatggacaacacgctcgttccgtttggcgccgagatggcgtcgcagaggacggtggacgccatccacgcctgccaggagcaggggatcgactttggccccgcgagcgggcgcgaccgcggcgagctgtcgggcttctttggggacgacgcgagctgcttcaacacgggcgtcctggtgaacgggcagaaggtgtactacctgggcgaggtcgtgtacgagaagaccctgcccacggacgagctgcgccgtgcggagtccatcgccgccggggtcgagggcgtggcgttcatcacgtaccgcgacgacaactcgggcgactgggtgggcgcgaccgccgaggagcttggcgacatgtacgaccgcgtcttcatgtgcggcggaaggcatcacgccctggaccgtatgccggactatcccgtggttaaggcggggctcgtggtgctgggcgacaactcgcgcgccgtggagctctcgaagcggctggccgaggcgtgcccgagcctgatcttccccaacacggtgcacaactggctcgacgcgtcgcccaagggctggggcaaggccgacggcatcgccatcctccaacgcatcctgggcctttccgacgaggaggtctgcgtgtttggcgacgcggacaacgacctggacatgctggggcgctaccccaactcgtgcgccgtggccaacgcgaacgaggccgctaccaaggcggcgcactggcacgtgggcgcgagtgcggacgacggcgtcgcgcgtgcgatggagcagatcgcggcggccgcggcacaggcgcgcgtgacgggtcgcgaggtcgtgccggagttcatgcgcgggtagcgcgcggtgcgggcgtacgccccgcgacaacgcgtgcgggcatggcatagttccagctcgccgcattgctatcggtaaatgcgataacaaactacgcacatcaactatattttccgcttgttaacacgccttacctcaacgttcgcctatcacgtcagacgctatcattctctccgtcaacaacgcgatgcgcgaacggagggtgatgcggcatgcagaacgtactcgcgtacttctctcaaaacgggacggagttcgtccagatggtggcgacccacctgtggctgagcgcggtcgcgctcgccctcgcgacggtcatcgccgtgccgctcggcatcctgggcgcgcgcttccgcaggctcgacagcgtgtcggagggcgtgtggggcacgctgcgcatcatcccgagcctcgcgctgctgctggtgctcatccccgtcctaggcacgggcacgctgcccgctgtggtctcgctcaccgtgctcgccatcccacccatcctcatcaacacgacgaccgcgttcaagacgcttcccgcggacgtgctcgaggccgcggagggcatgggcatgccgccggcgcgtgagctcctcaccgtcaagctgccgcttgcgctgccggtcgcgtttgcgggcttccgcaccgcaacgtccgaggtcatcgccagcgcgatgctcgcggcctacatcggtgcgggcggcctgggcgacctcatcttcacgggcctcggcctcatgaggacggacctcctgtggatcggcggcctttccgtggcggcactctcgctcgccgtgggcgcgctcctctcccttgccgaggcgcgaatgcgcaggcgcgcgggcatggtggccgcataggccgcgccgcgcactggcaccaatcgcaaggcaaatctgcatcgcgcgccgcccgtatcgggctggtcaatcaacagtgcaactaatcaggggagaagaaccatgacctttatcgacaactccaacgcaagcggcatcatcgtcccggctgcggcccccgcgctctcgcgccgcgcgttcctggccggcgccctcggcctgggcgcgaccgcccttctcgccggctgtggcaccggctcctcgtcgggcggcggctcgggcaagaccatcgtcgtcggctccaaggactttacggaaaacctgatcctggccgagctctatgcgctcgcgctcgaggacaagggcttcaaggtaaagcgcaagttcaacatctcgagctccgtcacgcacacatcgctcgtgaacggcgacatcgacctctacccggagtacacgggcaccgcgctgatatccatcctcaagaaggacgtcgagaccgatcccaagaaggtctaccagacggtcaaggcggcatacaagaagaagtggaacatcgactggctcgagtacgcaaaggcgaccgactcccagggcctcgtgatcacgaccgcggcctccaagaagtacggcatcacgaccatcacggacctgcagaagaacgcaagcaagctgcgctttgcgtcgcagggcgagttcgacaagcgcgaggacggcattcccgcgctcgagaaggcctacggaaagttcgactggaagtcctcaaaggtgtacgacaactcgctcaagtacgaaatcctgcgcaagggccaggccgacgtgacgcccgcgtacaccacggagggccagatcgccagcaagacgttcacgctgctcgaggacgacaagcacgtctggccgccgtacaacgtggcgcccgtcgtgcgcggcaaggtgctcaaggccaaccccaagatcgaggacgcgctcaacgccgtcagcaagacgctcaccaccgcgggcctcaccaagctcaacgcccaggtggacgtgaagaagaaggagtacgaggacgtcgcggccgcgtacttcaagaagatcaagtaggggcagccatgggggagaagttcatcaatcgctttggcatccctgagccggccgcaccctacgtggacctgctcttctcgcccgcggaggtcgcctttgtcgaggcggcgcctgagggccccttcacggcggcggacgtggcggacctcgtggagggtgacgccgccgcgttcctggacgcgtgctaccggcgcggcgtcgtgtcgctggcgcccgcgtccgatgcgccggccgcgcccgacgcccccgcctacgtcgtggccaatttctacgcgcgcctcgacgtggcgtgcgtgagcgagcagggggcgtacggccgcattcccgcggaggcgcgccgcgcgattaacgcgtggtacttcgacgcgtactaccagagcctcgacccggatcccgccgtgcggcccacgcaggaccgcgtgctgaccctgcaggaaacgctcgacctgatcgacgcggacgaccgtcccgtctacctgggcaactgcgactgcaggagcctcggcggagactgtggcctgcccacgcgcacctgcctgagctaccgcgtggggcccaacacctttgcggaccgcggcgtcacggagcgtgtcagcaaggagcgcgccaagcaggtcgtgcgcgacgcggaccgcgcgggcctcatgcacacggccaatcccaacggcatctgcaactgctgcggggattgctgctacctgttccgcagccagcgccgccgtggcagccagggcttctggcccgagtcgccgtacgtcatcagcttcgacgccggccgctgcgtgggctgcggacgctgcgtgcagcgctgccactttggtgtcttcagcagagaaggacgcacggtcacggccgacacgtcgacgtgcgtgggatgcggaatctgcgcgaacacctgcccggcgcacgcgctcgagctggtgggaaggagcgagccatgccctgcgaggtagagttcgaggacgtaaccaagcgcttccccggggcggcgcggccggcgcttgaccacgtgagcctcaaggtcgaggccggggagttcgtcacggtgctcggcacgtccggctgcggcaagacgaccatgatcaagtgcgtcaaccgcctggtggagcccgactccggcaccatccgggtcgagggcgaggacgtgtccgccgcggatcccgccaggctgcgccagcacatcggctacgtgatccagaaggtgggactcttcccgcacatgaccgtgggcgagaacgtggccaccgtcccccgggtcctcaaatgggacaaggagcgcatccaggcccgcgtggacgaacttctcgccctcgtgaacctcgaccccaaggagtttgccggccgctatccctcgcagctctccggcgggcagcagcagcgcgtggggctcgcccgcgcgctcgcggcggacccgtcgctcctgctgatggacgagccctttggcgcgatcgacgccatcaaccgcgaggccctgcaggacgagctgctgcgcatccaccagggctcgcgcaagacgatcctcttcgtcacgcacgacataaacgaggccctcaagctgggcacgcgcgtgctcgtgatggacgcgggccgcgtgcagcagttcgacacgcccaaagagatctgcgagcacccggccacggacttcgtgcgctcgctcctgcgctccggcgagttccgcctcaggtccgcgtacgtggagccgggggagggcatctgatgggcgcctacctcgagttctggtcagagcatgccgagaagttcctcgacccgctcgcggagcacctccagatcgtgggcgtcacgctgctgatatccgtggcgctggcggccgtcgtctccgtggcgctcctccgtcacccacgggccaagggcgtggtgctgcagctcctctcggccgtgtacgccatcccgagcctggcgctgtttgccgtgctcatccccgtcacggggctgggagagagcacggccgtgctcgtgctcgtggcgtacaaccagtacctgctggtccgcaacatcgtcacgggaatcgacggcgtggatcccagcgtcgtggaggcggcgcgcggcatgggcatgagcgacgcgcgcatcctgcgcgaggtgcaggtgccgctggcgctgccgctcatcatggcgggcctcaggctggcggtcatatcgaccataggaattgcaaccatcgcggccaccatcaacgcgggcggcctgggcaccgtgctcttcgacgggctgcggacgctcaactcgtacaagatcgtcggtggcacgctggagtgcgcgctcctggccatcgtggccaacgcggcactgcggctgctcgagtccgccgtcaccagaagggtggtcaggtaacgtgagggacgtgacgttggcatgacgtacgacgcatttagcaaccaggcgctcggcttcaccacgcgccagctgcacgcgggctacgacccggggcagcacctgcgctccaaggccgtgcccatctaccagacggccgccttcgagctggggagctacgagcgctgcgagcggctcttcgactactcggaggagggctactcctacgtgcgctactccaaccccaccaacgacgtgttggagaagcgcatcgcctcgctcgagggcggcacggcggccgtgggcctcgcgagcggcatggcggccatctcggacacgttcctcacgctctgcggcgagggggacgaggtcgtcgcgacccgcacgctgtacgggggaagcacggcgctcctctcgtccgtgttgcccacctacggcatcacctgcaacttcgtggacgacccggacgaccccgcctccttcgagcgtgccatcacgccgcgcaccaaggcggtctacgtggagtgcctgggcaaccccgtcatcaacatcgtcgacttcgaggctgtggccgccatcgcgcacgcgcacggcgtgccgttcgtggtggacaacaccttcgcgacgccctacctcttcaggccgctcgagcacggcgccgacctcgtggtctactccgccaccaagtacctgggcgggcacggcacggtcatcggcgggctcgtggtcgagggcggcacgttcgactggctgggcggccgcttcccgcggctcgaggcctactaccagcagtacgccgcgcggatgggggaggagcggctgcggcgggagctcttctcgcatgccctgcgcgagcgcggcctcatcgacctgggcgcccacatgagtcccaacaccgcgttctccatcctgcagggcgtcgagacgctgtcgctgcgcatggagcgccacgtggcaaacgcgcaggccgtagccgagtttttggacgcgcatcccctggtggagaaggtcaactaccccgggctggcgtcgagtccctaccacgggctctcccggcgctacttccccaaggggccgggcgcgatgatgtcgttcgacgtcgcgggcgggcttgcgggcgcgcgccgcgtgatcgagcggctgcgcgtgttcgacttcatggtcaacgtgggcgacgccaagtcgctggtggtgcaccccgcgtcgtccacgcactacgggctcgacccggaggagtgcgcccgtgccggcgtctttccggggacgctgcgcctgtccgtggggatcgaggacgttgaggacctgctggcggacctggaccaggcgctgggcgcgtagcgggtgcggccagcgcccgcgtccgctacgaaagcagcatgcggtcgttgtcgagctcgccgcccgagacctcctcgaacttgcggagcaggtccggcacggtgagcttgctcttctcgtccccgcgcacgtcgaa

SEQ ID NO: 151 - DNA, 13544 bp, Unknown
  Metagenome-assembled genome
tcgtgctctgcaccctgtgcgagtggctggcgctctacgtgttccacacggcccaggcaccagccggccagggctggatctggcccatgttcttcatcaacttcgcgttcgcctggtgcgtcgcgaccgtcatcggcatggtgccggcgctgccggagaagggcgtgcgctgggccctgaagcgcgcgaggcccgaggacggcctcaggttcggcgcgctcgtgaacgtgccgatcaacacggtctacgccgtcgtcctgtgctacctggtgggcgcgctcgacgcgtgcgtcctgggcggggcgccgctcgtcgcgtccgtcttcggcttcctgcagaacatcgtccccgtgtgggtggcctgctacgtggtgacgctcttcctgcagggcccggtcgagggcgtggcgcgcggcatcacgaacgatcccgcgcccaggatggcgtaggggcgtcggagcggcgcgacttccgcccggatgcgaggaaaccgtcgtttgggcaagcgaggaaaccgttatcctcgcttagcggttcgagttttgttgacgccactggcggtttcctcgcgcggcgcgaggaaaccgcgggacatttggggccgaaacgtgctgccgcgcggtcccggccggtggccgacgcgaggataacggaatcctcgcttgtgcgttcttcggtttcctcgcaaggcatggcctgacaggtggcaagcgcagaaaccgtcaatcacataagcgcagaaatcggttcctgcgcttggccgtctgacggaatctgcgcttgtgaccgcggcggcgcgggaggaccttccccctcgcgtcggcccactcggttcccatgcgtgacgcataggaaccgcgatttcggcacgcaaggattccgtttgccatgtgttggcaagggcggaatccttgcgttcgggccgaaagcggccgtctttcgaccgcttcccatgcgccacgcaagggaaccgtcagtccaaacgcatgggaaacggaatccatgcatcgctttttcacggtatccatgcgtggcgcatgggaaccgtcacccaccgcgccaccgtaccccgtcgcgcccggcagcgctcaagtggttcgccctcgctcgtcccgtgccgtccgccgtgcgccaatgtccgttgcactggtgcacaaaagccccgtggcggcctggtaagtatttgaacttggtgccatgtcgcgcgccgcgacctttggcgagactctttcatgacagataggacgtctgaaaggggtttgccatggacgaggatcgtcaggaagtgtgggacgcgctcaccaagcgcgcaagccagctgttcgggaaggacccgtcggagttcaccgaggacaccaagttcgcggacctcggcatcaagagcgtccaggtgtcccagctcaccacctacctcgaggacgagctcgacatcgaggtgccgttcatgaagttccgccgctgcgagacctttggccaggccacggacttcgtctgcgacctcctggacgagtagggggcgcgcatgttcgtagagcccaggatcccggccgagtgggtgccggtaaaggacaagaagctgcacgacctcatccagatgacgggcgagtgcgcaaagtttgacgaggacgagtgccccatctactgggaccctgacaccgagggctacatcttcctgcaccgcgagcagtttggtgaggacgagttcatggcggcgtaccgcgtggcccgccagcccaacgacaaccaggccgaggtcgacctctccgcgtccgacgacccgatggcgcgcatgggccagggcttctgcccgccgttcaacccgcacacctacgaggccgcggacggcgtcatctgcatgcaggaccaggaggtcgtgctgcgcgacggcaccaagatctactgcgacatctatcgtcccgaggacgtggagaaggtcccgaccatcgtgtcgtggtcttggtttggcaagcgcccgggcgacggcatgagcgagtggcagatcatgggcgtgcctcccatgaccgtgtccaagtgcgcgaagttcgagagcccggacccgctgtactggtgctaccagggctacgccgtcgccaacgtggacgtgcgcggcgccggccactccgagggctccgtccacatgttcacgcaccaggaccgcgaggacggctacgactttgtggagtgggtcgcggctcagccgtggtccaacggcaaggtcggcatgagcggcaactctggcgtcgccatgcaccagtggggcatcgccgcggagcagccgccccacctcgcgtgcatcgcgccgtgggagtgcacaaccgacctgtaccgcgagagcttcttcgagggcggcgtccccgcgctgagcttcaacaagttcatcgcggcacaggtgacgggtcccaacggcgtggacgaccaggtctccatggccaagatgtacccggacatgaacgcgtactggaacgacaagcgcgcggacttcaagaaggtcaaggtccccgtgtaccagacggccggctggtcgcacttccacctgccgggctcgttcaacgcgtggcgccgctgccgcagccacctcaagtggctccgcgtgcaccgcgacttcgagtggccggacacctacaacccccagaacctggaggagctgcgccactactacgatcgctacctcaagggcatccacaacggctgggagatgatgccgcgcgtccgtctggacgtgatggacggctacgacgtggactaccaggagaagcgccccgagaaggcctggcccatcaagcgcaccgtgtacaagaagctctacctggacgcggccacgcccaaggactgcgttgagctcgatcaccccgcaaagtgcttcgagctcgcgacggaggcgcccgcggccgagggcaaggcgtcctacgacccggcgaccgaggagctggactttgacctcacgctccccgaggacgtggaggtcacgggctacatgagcctgcacctgtttgtgagctgcgacggctacgacgacatggacctcttcgtcaacgtccagaaggccgcggccgacggcacatgggtgccctggctcacgctcgacgagccgcaccccggcgcgtggggcaagtgccgcgtcagccgcgcgaccgtggacgccaagctcaccaagaagcacacgcccgtctacaccatgacggacacgcacaagctcgaggacggagaggtccgcgcggtcgacatcgcgatcgtccccacctcccgcgtgtaccacaagggcgagcgcttccgcgtgcagatatccggaaggtacatccgtgacggctggttcgagccgctgtcctgggacacggacaaccacggcacgcacaacgtgcacacgggcggggagcacgcctcctggatcgaggtgcccgtcgtcccgccgcgctaccaggcgggggagtacatccacaggtaggaaggtgcgggcgcgttggcccgtcacctggctaacgcgggcgagaaggacggtgcgtccttctcgccccgtgagcattggtcccatcggcatgccgcgtgcgctcatggctcgctcgcgcgcgtggcatgtgccgaggttgggacgtcatgtacccaaacacgcaatctagctgcggtaatgcgcgggtgttgcacccgcgccggtaagcgggaagcaaagctatcaggaaggaaaccatcatgcccatgaagacgtcgacgcggttcgtgaaggccgcgctcctgaacctctgcaccgcgctcgtactgtgtaccctgtgcgagtggcttgcgctctacgtgttccacaccgcccaggccccggccggccagggttggatctggcccatgttctggatcaacttcgtctttgcctggtgcgtcgcgaccatcatcggcatggtgccgtcgctgccggagaagggcgtgcgctgggcgatgaagcacgccaagcccgaggacggggccaagttcggcgcgctcgtgaacgtgcccatcaacacggtctacgccgtcgtgctctgctacctggtgggcgcactcgacgcgtgcgtcctgggcggggcgccgctcgtcgcgtcgctcttcgggttcctgcagaacatcgtccccgtgtgggtggcctgctacgtggtgacgttcctgctgcagggcaggatcgagggccttgcccgcaaggtcatgaacgaccccgcgccgagggcggcgtaggggcaagcgcaccgcgccggaagggaagtgcgatggaggcagccattcgatcgaggcaggttcgcgagcatgtgtggcggctcgcggacatcgcgggaaaccgctgctacctcgtggtgggaagcgagcgcgccgcgctggtcgacaccatggagggcgtgggcgacctgcgctcggccgtggagcgcatcacggacctgcccgtgaccgtgctcctgacgcaccaccaccacgaccacgtggctggcgcgtacctgttcgagtccgccggcataagcgcgaccgacgacggattctgggagcaggaggagtcattcaacaagcgcatccaggtgcagctaagtgagaagtacgaccttcccgagggcacgttcttctcaaccgagcgcggtgcgcgaccgcagacctggcacgtgagtgagggcatggagctcgacctgggcggcgagcgcttgcgggccgtgtcgctgccgggacacacgctggggtcgatgggttacgtggtcgtgggggagcgcgtgctgctcagtggcgacgcggtgaccccgtgcatgacgctgttctacgacgactcgacctcgatcgctgagtgggaaagaacgctcgagcgcatggcggggctgcccgtggacgcaatcctgaccggccactacgaccacgagttcagtcgcgcggacctggcctcgtggcggaggctggcgcaatgggcgcccacggacccgggcatgcgctggcagaacttcagcctgcccgagctgcgcggctgcctccacgtgatgagccccgacggcacggacccggactcgcccgagttccgggccctgatagagaagtcaaagcctcgcgtccacagggcgagaagggcgcgccgccatcgcccggacggcgatgcgtccagcgcggacggcgatgcggacgccggcggtgccagcgtctagctcacacccaggaacgcgaccagccttggccagacattcgacgcggcccggagcccctgctcgtaggcagccaggaggcgctctgggtcgcgctcggacatacgcgcggcgatgggctcctcgggccagatacagaggagctcgcccgcgtcgtgcaggcgctccagctggtcaagctcgtccgcgtactccgcggagcgggcggccatggcgcgccccagcgcggggtgcgcggggtagcgcatgcgcacgatgggcacggccgggtcgtccgggtcggggcggtagccgcggggacgcgtgagcaccacgacctggcggccgcggtagcgctcgcgcccgtaggcaaaggggacggggcgcgcgatgccgccgtcaagcaggagctttccgtccacgtccacgggacggttggcgcagggcagcgccgcactcgccatgaggtagcgggcctcggtcgcgtggcccctgcccttggcgagctcgtggtagtcgggcttgccggtctcgatgtcggtcgcgacgctgacgagccgcatgggcgactgcgagtacagccaggtggggattcgctcgagccggtagggaatcgtgtcgaagatgaactcgccgcccacgtagtcgccgcagcgcagcttggagcgcacggacatgaagcgccagtcgtcccggtacgaaacgatcatgcgggccgtctggccggccacgcccgacgcgtagctgaagccgcacgaagccccaatcgacacgcccaccacggactcggccagcaggccgtggtcaagcaggaaatcgaccacgccgcaggtgaacatgccccgcatggcgccgccctccagcaccagctgaaacggcgtcgtgcgccagtggcgccaggcggggtcgggctccggaccggctgcctgccggccggcgggtgtggttggttggacgtgcatgtcgaggctcatcgttcttctccccaggggacgtgccagcgcacgtgccggtgcgccgatgtcccgattgtagccttgggcgagccaccgcggcgggcgagaagaacgtgcccccatggccgccgcccctgcggtaggctagggtcgttcggacggttcgcgcgtggctgggggtcgcatggcagctgcagacaaacgctatgagtacgtcgtgttcgacgtggacggtacgctggtcgattccgagcgggccaacctcgtgtcgctgcagcagacgctgctcgagcttacgggcaggcgctacgagctcgaggacctgcgcttcacgctgggcctgccggatggccccgcgctcaggcagctggggttcgagcagccggaggaggccgagcgggctggcaggcgctgggagcagctcgcggagcgggaggccgcgtctaacacggtgtacccgggcatccgctccaccattgaggagctgcaccgtcgcggcatcggcaccggcgtcgcaagctcgcgcgcccgacacgagtacgcggagcagatctcgccactggggatcgacgacctctttgatcacatcgtcctggtggaggacacggagcgccacaagccggagcccgacccgctgcttgagtgcctgcgccgtgctggcgtcgcggcggagcgggcgctctacgtgggcgacgccgagtacgatgtgcgctgcgcgacctccgcgggggtcgacttcgccctggcgggctggggcgcccagcgcacctacgggggcgagaggtatgtgctgcaaaggccggaggaccttctcgccctcgtgtaggcgcgttaagcttgggtagaccttggacagtttacggtggcgccccctggggtgggcgccggctggcttacttgcggaagtctgccgcaagcgtggtggctaggccttctgtcccacaaccatgcggtggaagcgcctgaagccgaggccgcccatgatcacgatggccgccaccaggccgaggacgctccagaccagcggcatgtgcgcgatctgcggcgtgaggatggcgcgcagcgcctcgtttgcgtagacgagcgggttgaccagcacgattgtctgcagcacggggatggcggagaggctctgccacgagaagaagatggctcccaggaagacgaccggcatcaggaagccggggaacattgcggctatctggttgggcttgacgatggtgccgaccaagaggccgagtgccgcggacgcgagggagataagcaccagcaccaggacgagcggaaggatgccgcccgcgcccatggtcacgtcgatgcggctgcccatgaagatgagcgagatgggcagcacgatgagcccgcccacgaacgactcgatgatgcccacgagcatcttggagaggccgaccacggtggacgagacgggcgcctgcagacgatcctctatctcgtgcatgttgttgaaatccatggtgaaggggacggccgtgccgtgtatgcccgtgatgagcatgctcatgcccaccatgcctgcaaacatctgcgagggaaagctcttgggcagcacgccgagcgtgggcagcatgaagccgtacgtgaggatcaggatgaagggcagcatcgccacgcggaacacgaactcccatgcgtcgcgagcctggatcaggaggtcgcgctgtaccatggcccaaaacgcctgcctcgcaaggcggccgctgcgagccgtggcgttgttcttctcgccagcgttagtcattctggctcatcccctttccggtgaggtagacaaatacgtcatccagcgtggtctgcttgaggctcatgtctgaaacggcgaggccctgctcctccgtccagcggaagagccggtcaaagtccggcttgggcgcgtcgatgtagagcgcgagcgtgccgtcctgcagctttgcgtgcgtgacgcgaggcaggcgctccgcggcgcggcggacgtcctcgtccatgcgtgagaggcgcatcgtgacgatggtggaggtgggcacgagcgccttgagctccgcggacgtgccacttgcgactatctgcccgtggttgacgatggccatgtgctgcgccaggcgctctggctcctccatgtagtgcgtggtgaggaagatcgtggtgccggcctcgcggttgagggcaagcatctcgcgccacaggatctcgcggtagttggggtcgaggccggtcgtgggctcgtccagaaagaggatcttgggcgtgtgcatcatggcgcgtgcgatcttgaggcgctgcgccatgccgccggagtaggtgcgcacgtagtcgttctggcggtctgccaggccaaacttctccaggtactcgtctgccttgcggttggcttcgcggcggcccatgccaaagtagcgggcgtggtagatgaggttctcgcgcgccgtgagcccgcggtccaggttgttgtgctgcgccacgacgccgatctccgcgcgggcgccaacggggtcgtccgtcacggagcgcccgtccagcaggatctgcccgcccgacgactcgagctgcgtggtcagcatcttgatggtggtggacttgccggcgccgttgggccccaggaagccaaacacctccccgcgtgggacgtcaaagctgatgccgcgcacggcctcgaacccgccgccgcccttgcgcgggtacgtcttgcggaggtcgcgcacctccagaatgttgtctgccatgtcccctcccgtatgtcatacccctatggggtatatattggtcggttgtgactatacccctaaggggtattaagtcacgcaggcgagaagagcacggtgccttcttcacgtccgctccatacggacgcgcaggccgccgttggtgtagcatggggggacatggatggcgtaacgtcgtcgtaaggggactgcccatgcgcgcgtggaaacctggaaccagggtgcttctttttgtgttgttggcgtttgtctttacgtgggttccccagttggtgctgggttcaaccacgggctggcgtgttgatcagtcgcttctggcatggtcgatcacgctttcgctctgcatgtttgcgccgcttgcgtcggcgctcatcacgcgggcggttacgggtggcggcgcctcgattggctggcggccacgcgtccgaggcaacgtgcgctggtacgtggtggctcttctcgccccgagcgtgctcacggctctgggcgccgtcgtgtacttcctgcttgtgccgggggacttcgacccctctgccagcaggtacatggccgccgtccaagcgcagctgggcgtcactgcctcgcaggcgccgctcgtcctggttgcgcagctggcgtttgccgcgctcgtggcgccgttcctcaacatgctccttgccgtgggggaggaggctggctggcgcggcttcctataccctgagctgcgcgagcgcttgagccgtcccgccgccgtgatcgcgacgggcgccatctggggtgcgtggcacgcgcccgtcatcgccatgggttacaactatggcaccagctacctgggctttcctgcgctcggcatcctgtgcatggtcgcgttctgcgtcgcgttcggcacgctgctctgcgtgttgagggatgcgacggacagcgtgtgggcaagcgcactcgcgcacggtgcgatcaacgcggtcgcgggcacggggctgtacttctcgcaaagcgggcggctgggcctgctgggacccgcgacgcttggcattctggcctgcattcccaccatcgtgctgtgcgtcgtgctcctggtcatggcttcccgcggtgtgcttccccaggagaaggaggaccagtagtggacttgggtgtagcaggtacgccgtccctacagtgcccagtcgctctgtagccttgcctctagctgctggaacagtggaatgaacctcgtccgcgtgagccctatgagcttcaatgcaacgctttcgtcatagctatgtgtgacgaggtttcttgcctcaagtgcgtcgagccaacccttctcgtcgtcaatcatgcctgcgctgtaagcgcacttgataacctttctgggcgaaccggtctgggcttcgctgaacccctgctcctcaagagtggccttcatagctttccaggactgctccatgcagacttggaaaagcgccactaagcctgcttctgtcacagcatcatagggaggctggtagtgctgtgactgctcgaggtttcttaacgccttcgagaagttctcacgcttcttttcgctcatacagcactacgccatcctttcgaatctctgctaggagctcaggctgcactatcccatcgagatcgacaacgtcaaactgcaaaagtgttggggtctcctcgtctatatctagggcgaatgcggcgatatcgccaccacttgcagctagatcgatgtcgctgcgctctcggttatcgccgcgtgcacgagatccgaagaggagaacgcgcgctactccgtcttgccgtgcaagagcttgaatactctcgacgatgtccgctcgtagattcattgtcctccctctcgttgggcagtacgtttgattttatctgatgtcttccggctgtcttctattctggtcgcttcatcacgatagaggatgaatttgggataccgtgcaagcgagtctattcgagaactgacgagctacgtagccgagcgggtaaattctatgtcgcgtgcaattgacatggggttatgtgtgttttgacttacccccaaggggtatctgctcgacttgtcacgtcgattgagcttggaggaatgcccgcaaaccccatcaacggctatcagggggaggcctctgagcgtcttgggagggatgccagcttgctctggcgcctcggaaacacacacaagcccctccaaattgcacgagtggcaaggaaagtccgacccgattctcgcataccccccttcacctcattccagattgagcgagcgagccaacgcgagtcttatctggcgtattttcactaatggaattggcgtaaaacgttaaatgagaatggcgtaaaatagtgaatgagaaaggcgtattttaatgaatgacaagcaatttgccagttgaaatggggtgtcgaaagtggcgtcatcggattcttccaacaagactgtacttaccccaaagggctatcaacctcgtcttgtcgagggccggctggatgcccttatgagggcgttcggctgcgttgagatcaatgggcccaagtggtgcggaaagacttggactgccatgtcgcgcagcgccagcatctcgcgcctggacgatccgtcccagcgtgaggcagctcagatggatcccatgctcgcattggttggggatacaccacacctggtggacgagtggcaggaggttcccgaggtttgggatgccgttagacgtcgcgtggaccagtctggtaaccagcgtggcttgttgctgctgacaggctcgacgaccttgggcgagtccaatcgccagaaggtgacccactctggtacgggcaggattgcccggcttaagatgcgacccatggcgctgtgcgaatccggcgacgccgagcccaaggtctcgctgggcaagctgtttgacggcgacgacctcgttcccgcccgcagggactctggtctggaagacgtcgctcgctggtgctgtcgtggtggctggcctgccaaccttgggatgcctgacgaagtcgcgtttgagactgcgtcgcagtacgtgagctcggtcctggacgtgaacgttatcgaggagcaccgctcgcccgacgtcgcattttccctcatgcgcgcgctcgccatgaacgagagccagtccgcaacctacaagacgctcggacgtgacatgggattgggggaggagtctccaaccactcagaccatagcctcctacctcgagctgttcgaccgcctgcacctaacggaggagctgcgcgggtgggagccgcccgtgcgcgggaaagcgcgcgtccgcatcaagccaaagcgctatttctgcgacccgtcacttgccgctgcacttctgggcgcaacgccgcagcgcctgctcggcgacatgcagacgcttgggctgctcttcgagaacctcgtcgtgcgtgacctgcgcgttttcctttcgacgtatcccgggcttggcaacggcctctactactacagggatgagaagggtcttgaggtcgacgcaataatggagcgcaatggtcgctgggctggcattgaggtaaagctaagcgacgtcaaggcggacgaggctgcccacaacctcctgtctctccgcaaaaagatgctcgccaacggagccacgcacaatgccgagcccgcattcctggctgttatcgtgggccgtggctctctggcgtaccggcgcgacgacggcgtgtacgtcctgcccgcggcgctgcttggtgcctagcacatcggtcatcactccgcagcgcctgaaagggatccgcacgcgggcgagaaggacggcctactccagcccgttctcttccacaagctcgcgagcctgccgttgcccgtcgatcgcctgctgcaggcgcctgcggtagtacgtctggccgtccgcgatgtccaggcgcaggcccacctccgcctgctgaaagagcatgagcgcccgcagcggatcgggctcgatgccccacttggcgcagtccgggctcaccaggagctgcgcgatgcggatggccggctgagcaatctgcacgatgcccttcgccaggtcaaggctccgctcccacagcaggcaggcacgcgcaaggttgcgctccacgctgcgcccgcgcgagtacatgtcgcccagcttgtagcttgcctcccacgagggctccagcgccgcggccagcgcgtagcactggtaggcgcgcccatagtcgggctcgcccgtgcgaccgtactcaaagatatagcccaggttgatgatggactgctggcagccgcgatcggcagccatctggtacagatctcgcgccttctggtaatcctgctccaggacgccgcccatgtagtggtacgcacccaggtcgttcatgcacgcagcgctcccgcgcgagatgccaaagcgataccccaactccaccatctccggcacgcgcgggtcgtccgcggccctcgccacggtgcccttgttctcgctcatgaacctggcaaactcgtcctcatcggaatcgagcgctgcgtccgccatctgcctcaggagcgtgtccacgtccaccacatcggaatcaaatgcggcctccgcttcgtcgctcgcgtcctcgggggagaaggacgagtcctcgtccccgatgggcatgccgcccagctccgcaatgcgcaaaacgtccttgccggtcagctcaaagtcctcggcagccatggcgtcctcttatcctcttaatcgtcgcctcccggcgactttagtcctgtattacgggcaaccggatatgggacattgttcctgacggcgggggatcgcgtgatgcttgcgccttgggacctcgatctcttc

SEQ ID NO: 152 - DNA, 4012 bp, Unknown
  Metagenome-assembled genome
atgccgcgctgcgactgcctcgtgggtgtcagggtgccgcaatttcctatctgcgcggctgtgcctgcaaggtcaatctgcaggacgagcgaacttcgggatgcgtcatacatgccagctttgtcggaagcttgcgcgagggacaaggcgatgccgtggagacactcctccagcacgatgacgggatgctggtggcgcctaccggcttcgggaagaccgtcgttgcggcagaccttatagccaacaggagcgtcaacacgctggtgctagtgcctaggagctcgctactgaatcaatggcgcgagtccctggagcgcttcttgcggatagcggacgaaccgcccgtgttgctgacgccgactggacgaaagaagaaaagccagcctgggcagattggcgtgatgggcggagggaagaagctccccagcgggatcgtggacatcgcgctggtgtcgtcgctcatggaaaatggcgaggtagcaggagagcgccaagtgagcgatctggtaagtcgctatggcatggtgctggtggacgaggcccagcacgttcctgcatcgggcctggtaaaggtcctgaagcacagcagagcgaagtacgtctacgggcttactgccacgcctcgcagaaaggaccgcctggaccgggcaatccagatgttcctgggtcccgtgcgcctaacggtgaagccggacgcaaagggtcgagcgcggcgtgccaccagagtactggtaccgcgatttacgggaatccggcctccggcgggtgtcgacccagcagattggaatgcgcttttggacgtcatctgcaacagcgagcagaggaacgtcagcatagctgatgacgcatgtgaagccgtgcaacagaacaggtgcccactggtgctgaccaggcgcgtcgagcatgctcgtacgctggcgaagctcatccagaagcgactggacgagtgctctcgctcgggaaaaggtatttccacaaaggagactcccgcgaaagagactcccacggtggtcactctggtgggaagcgacgacgagaagacccgtcgcgaacgccttgaccaaatacgcaaactcccgtcaacccagcccgcatgtatcgtggctacagactcatatgttggtgaaggctttgacgagccccgcctagatatgctgctgctggcggcaccggtggcctgggagggacttctcacccagctggtcggcagaatccagcgcgagctaccaggcaaaactgacgtctacgtgtacgactacatcgacgagctggtgccgctctttgctcggcagtggcatggtcggctgaaggcatatgccaagttgggatacgtggttcggaatgcgggctccgacgcagagtccagccacatcgtaactgccggtcatgctgcgacgacgcttttgcaaggcgatatccaaaaggcccgggcgaaggtcgtgctcttctcggcatgggtggcatcgaaggcggtggatgtcatggagcctgtgctccgagacgccttggctcgcggcgtagaggtgttggtcatggctcccgcgaaggaggagtcggacggcgtgcaagcttgcctgagtcggttgcagctgatggggtgcagggtcactcggactgcgggaaagctcgtgaacgccgcggtcttcgacggcgaacttgtttggttcggcggcattccgcccctggcctttggccactcggacgactgcagcgttcgcatcgtgaatcgcgaactcgctggggagctcatagggtcataggtcggtacttttcactcgtcaacaaaattaagggtgattatcgaggaatatacgcgataattcccctagtattgttgatatggtagattgccatcgattagttctacttttggagggactttatgctcatcctattttccgtaaagaactatcgatcgattcgtgacgagcaggtgcttaacctggttgcgtctccgtattactcggggaagaagtcggatgatagcgcgcgggcaaatcgtcagctgcaactgatacagaagcggctgccaggactatccggaaaggatttcctgcgatctgtggcgatctatggtgccaatggctcgggaaagtcaaatgttatccatgcaatgaaggccatgcagcgaatcgtccgggattcctcgtcctatgcgccaacagatgagctgccatacgatccgttcgttttggatcagagctctagtaagaatccaacggagtatttcatcgccttctattggggaggcgttcgctacgaatatgaattctcgcatgacgaccagaggatagttgaagagcggctgtgctcttttccgaaaggtctcaggcggaccttgtacgaacgctcggccagcccatccggtagtcccaaagttcaggactcgtcgtacttgcccatcaacgatgtcgttgcgagcatgctcaatcccaatacgctgctcttgtcattcctgtatggacatccagggctgcagggctttgacgtgatcaagggggccggcgacttcttccgcgatgggctgatcgttctcgatcgggtgagggaccgctggctggacttcccggtatcgggtgaagtattggacggacagacaggcagcgactttcagcgcgacctcgtgcagaagatgatgcgcgattccgatgtcggcatttcgtccgccaaggtggttcgtcgaaaggttccgaagaggccggctgcggcaagcgaggacgcagaggaaaatggggagccaatcattcaaaaatccgtagtgctggagcacaagggcaatatgggcgagggcaacatcaacctgatgaacgagtcgctgggcaccatgcaggtgttctcgctgagctccttcataggggaggcgctggagaatgatgcaacactcgtagttgatgagctcgatgcatccatgcaccctatcttggcaaaacgggttgtacagatgtttgagcgtccggagttgaagggggatgaaaaagagaaggagaatgagaggtccgctcagctgatttttaccgcgcatcaaacgtatttgatgtcagggaacaccttggagcgggatcaaatctggctaacagataaaggacctgatgggggcacggtactctatccgctttctgactattctccccgcaagggcgagccgattgcccaggggtacttgttgggaaggtatgccggtgtccctgtgcttcccgaagacttcggggtgctgctttccaagggtgaccatcatgagtgaaaagcgcagctatagtcgtaatgcccccaagagatcccccagaccttcgattgtcatattggtagaaggggaggtaactgaaccagagtatctcaaggctcttatgggggctcttcgtgttcccggcgacctggttgacatccgcaaggctgagcatagcgacgctgaaggaatagttgtggaagcgaaagagcttctacggaagtctaagagaaagagatcagcatcggacgtcgacgaagtctgggttgttgcggatacggagtcggagcatggcaatgggtctccggaaaacgttttgcgtgcaatcaatcggtcgggcgatgatgttagcctcgtgctggactctcctggcatcgagtactggttcttgctccacttcgtaagtacgacacgcagctttcctagcgttgcggatgtcatagcacagctgcaaactcattggcctgagtactccaagagaaagggcactttggactgggaatttcttgtaaagaaaacaccagatgcaatgaagagcgctgagcaagtgaggaagtatcgcgaggattctcagtcggagagacccatagctgacttggacgtgttggtggcaaagctaaatggtatgggcaggtttgacgtctttggtctgtctgctacagaaaagaagccagtaaatttgcctacccgagaagatctcttctcgtggaaatggacgcataagtcctgttagataagcattgattgtggggcgaggagccacgttcttctcgccctttatgcttgctg

SEQ ID NO: 153 - DNA, 20577 bp, Unknown
  Metagenome-assembled genome
cgccgctcaagcgtccttaacattgcgtaacgaaacatagacttttatatgttacgtacagacccacaaacttggctttgctaagcttgtgcttgtctgagaagaacacccccacgggttgtgggggcatcgggaagggaatccccatggcatccatcatgagctcctcgttcagcaggcgccaggccatcgcgctgggcgcgggcgcactgtccaccctaggcctcgccgcgtgcggcggctccaacggctccgacagctccagcagcagctcctccaccaaggcgacgggcgtcaaggccctcacgcacaccaagggcaagctgaccgtcgccacgggcaaccccgcctacacccccctgggttattgacgacaagccgcagtccggcaagggcttcgaggccgcactgatctacgcgctggccaaggagatgggcttctccaagagcgaggtcaagtgggtccgcaccacgtttgacgaggcctacgcccccggcgagcacaagtgggacctcaacatccagcaggtctccatcaactccgaccgcaagaaggctgtggacttctcgcccgcgtacttccgtcccacgcaggccgtcgtgctccagaagtccagcaagtacgccagcgccaccaagtgctccgaccttgccgacgccaacatcggcgtcatggtgggcaccaccgcgtacgactacgtgaagaagatcatcaagggcggcaaggacgagggcatcagcatctttgacgacaactccgccgccgcgcaggccgtgaccgccggccaggccgacgccctggtgaccgacacgccgcaggccgtgtacatggtccagtccaagcagatcaagaagggcctcgttgttggccagatccccggcaccgaggatcccgagggcctgggcatcacccttgccaagaactcccagctcaccaagtacgtcaccaaggccatgaacgccctcatcaaggacggcaccgtcaagaagctgcaggacaagtggcttgccgagtacaccacggacatccccacgctcaagaagtagcggcgcctttgtgcacgccgacggccggggcgcctgcctcggccgtcttgctttttgccccaaaccttgaaaccccatgaaagggggccgtccctcatgtcaggcaacacacatgacgccgtgagcgacgtcgagctggagcgagaggagtaccgccgcaagcagagcatgcgctccgtgctcacgagcatcgtgtcgacgctcgtgttcgtggccgtggtggccgtgggactccacaactccccgggctggccgcgagtgaaggagtcgttcttctcgcccgagtactttgcgcaggcgtggccccaggtggtcgacggactcatgctgaacctgcgcgtgctggtgatcgccgtgatcggagtggccatcctgggcacgctgctcgcgctcacgcgcatcaccacctcggccgtgatgttcccgctgcgcgtggtggccaggctctacaccacgatcatgcgcggcatccccatgatcgtggtgctgtacctgattggctttggcatccccggcctgggcatctttgggcgcatggaccccgccgtgctgggcaccgtcgccatcatcatgtcgtactccgcctacatcgcggaggtgctgcgcgccggcttccaggacgtgcacccctcgcagcgcgcgtccgcacgctcgctgggcctgacgtccggccagaccatgcgcctggtgatcatcccgcaggcgctgcgcaagatggcgcccgccctcatgaacgacttcatctcgatgcagaaggacgtgggcctgatatcgaccctgggcgccgtggacgccgtgcgcgccgcccagatcgtggtcgccaagacgtacaacttcacgccgtacgtggtggcaagcgtgctcttcatcctgctgagcgtgccgttcatcctcctgaacgactggtactccgctaagctccgccgccgcgagcagacgggaggcatggtctaatggcagacaacgcaaccgcaacggctgccgcgcaggcagccgcgacgcccgacgcgacccagaaggtcctgcgcctggacagcgtggtcaagcgctttggcgacaacgtggtgctggaccacgtgtcctttgacatcagcaagcacgaggtcgtggcgctgctgggaccatccggctccggcaagtccacgctcatgaagtgcgtcaacatgctcgagcgcgtgaacgacggccagatctggctgggcgacacggacattaccgacccccgcgtgaaccaggaccaggtgcgtcgccgcattggcgtggtgtttcagcagttcaacctcttcccccacatgacggtgctcaacaacgtcacgctcgccgcgcgcaaggtcttcaagtgggaccgcgacaaggcggaggagaaggccatgggcctgctcaagcgcatcggcatggaccagaaggcccgcgagtacccggaccgcctctctggcggccagcagcagcgcgtcgccatctgccgcgcgctcatgggcgacccggagctgctccttctggacgaggtcacgtccgcgctcgaccccatgctggttggcgaggtgctcgagatggtgtccgagctgaaggagcagggcgccacgatcctgatggccacgcacgagatgagcttcgcccaccgtgcggccgaccggatcgtgctcctgcgccgcggcaagatcgccgagaacggcacccccgccgacgtgatggacaacgccaccgaccccgagacgcgcgcgttcttccacagctacgactcgtagcggggcgcggcacgcggcgcgagccgacgcgcggacgcacctggctgcgacctgtgcccgccacctgctcccctgccggagcgggtggcgggctttttgttgctgcggtcttggagcggggtcgcctactgccgcaatgcctcgagcatggccttgcatccaagcaggacgtcgtcgtacgtcgcgtcaaagttgccggtgtaccacgggtcggccacgtcgcgatggacgcccgcccagtccaggaggcgcgacaccttgccctcggggtcggccgcggcgcgctccgctgccgaggtggggcgccagctgaagccgtagcccttctcgcccagaagcagacggtagatgccgtccatgttgtcctggtccatgcccacaatgtagtcgaacgcctggtagtcggcgggtcccatctggcgcgacgcgtggtggccgcacgggatgcccacctccgcgagcttggcgcgtgtgccgggatgcacgtcgtttcccagctcctcgcggctggtcgcggcggagtcgatcgcaaagtcatccgcaaggccggcgcgccgcacgagctcgcgcatcacgaactcggccatggtcgagcggcagatgttgccgtggcagacgtacaggatgttgggcatgcttgaaacctctcgtgagcgaactagattgaccgccatccgctggctgcggacggccaatcccaccagcccttgcatcatctcatttctggggcaagcattgcccagcaacccaaggggcgcccggaaaccccttggctccggacgccccaacgttgcgctggctatgccccagctggcataagtgcctggtgagaagagctactcgtccttgcgcatgcggcgcgcggtcgcgacggacccgatgccaagggccgcgagcaggctggcgaggatgccggtctggcccgttgtgtcaccggtcttggggatcgctgcagcggtggtcttggcagccgccttcttgggagtgacggtggcctgcttggcaggggtctgcttggcaggagtcgtctgctcggccggcgtggtagcgtagacgttctggaagacgattcccttgtcgtcactgtcgtcggttacgagggtcgcgacgagcttgttcttatcggaaagggcagactcgtagtgggccccaatctttacggtcacggcctcgggatagtcgtcgtaggtaatgccagccgcgttgcccttgacctcgcgcaccgtcaggcgataggtgccgatcttctggaagctgaggaccttgaaggtgatgctgccgtccgcggcgttggtggccgtggacagtaccttgccattctcgtccagaagctggaaggtgaactcgccgcccttgagggtcgcgcccttgaggaccttggtgcccttgatcttgacctcgacggggtcgtagctcttgaagatgattgcgttcttgttgagcgtgaagacctcggcggtgtcctcgttctggccaaagaccagctcgcccgacccaccagctgcaatcctcttgttggctgcctcaatggcgtccttcatgtgctggatggtggtcgcgctcacgccgttggccttagcataggcgtccagctgggcctcgtcgtaggtccagtaaccggacgtcgtcccctggttttccgcaaacacgtcgtaggtgatcactttaccctgcgtgtcgtgataccagcaggactcagtgtagtagctgtcctcgttataggtgttgtcggtcttgacgttgttgaccttggtgttgctgttgttggtgagggtcaggttgacggtgccgatcatcgcgtgcgtgagcgtgttgttgctgatagtcacgtcggtcggggcgttgctgagggtgtcctgcacgaccaccttgttgcgcaggctcttcgtgccggtgacctcgttgttcgtgaactcgaaggtgccgctgttgggagtcaccttgtcgccgttgtcccaggacccatgccatgcaaaggagcagttctcgaacttgttgccggtgatgacgaccttcttgaggccgccctcgacctcggtgtagatgccgcagccagccttgtcgtcactcttctggttgatgaggttcttgaaggtgcagtccttcacggtgtaggtgtcgagcttgttgtcagtcatgatgccgttgcccacacccgacccgttgaaggtgcagttctccaccgtgaggttgttcgcgatgtccatggtggtcttgccgttggacgcgcagatcgcggacgccttccagaggccgtcggtatgcgtgcccatgtcgaacacgatgttgcgcagggtcacgttgggagactgcacgaccacgccgtagtaggcctgcgtggtgtcgtcggcggtggtgttgcctgtgtagggcgtcaccttgtcggtaaacaccttgacggtggcgccgtggccgtcgacggtcaggccgtcgtagatgctgcgacggatgttgaacgcggagtagctggaaccgttctggaggttgatggtccagccggtcttgtcctgctgggtgccgatgtagtcgatagccttctggatgccatcggcatcggtgacggtaatggtcttggcgctggcatccgtgaccgtgaagcctgtggttgccgcagttggggtgctgttggtggcagcctgtgccggcgcattgcgggcagccgtcttggcagcgctggcctgcgtcgcggcagcgtcagtcgtggctgcggtgggcgtggcgtcctccgacgctgacgcctcggacttggcggcctgtgacgtggaatcggccgagtcagttgccgtggtcttctcctcggacgccgtcgtagtcgtcgcggcgggctggccagaggcctccgtctgcgtggtcgtcgctgcgggagcggaggtggcaacagcggccgtggcctccgtctgctttgctgcagtctgctgcgtggcggcgctcacctgcgtggtcgtggagctctccgtagctgcggcggactgagtgctggactcggtctccgccgcagccagctccgcggccggcgttgcggtctgcgtcgcggtcgcggccacggccacggtcgcgctatccgtgctgaccgcgggactggaggtctcggcctgggcaatcgtcggagcaatggagatggccagcatggttgccgccgccgctcccaaggccttggtctgcaggttatcgtgcttgcccgaagcgaggcggttggccttctccttgcgcaaacgtcgtgcagtcttaccagacataagaaacctccaatttgctcgatgatttgtccgtctttttgcatatatagcacgaaccttaaatcaggttgcttaaaattgccgtcatgatacggtaatcgcggcagaaggttaaagaagacttgcgaacggacatgcccggctcatcacgcacgcatcccacccgagccgacgggcaaaggcaaactatactgaacgggagaaatgcaatcgggacgtcccgcgggcgtccccgcacgaggaggctccatggcagacagccaaaccaaagacacgtccacgccgggcgagaaggacgtcacgcccgagcagcaggcgcttcgggacgaggcgcaggacacgttcaagcgcgtgcagttcgcgctgcagatgcgccaccccgaccaggggctccgcatgctgcagccgctgctcaagaagctggacgcgcagtcgcagtccgcgccggacaacgacccgatggcgttcgacttctccaaccccgagcaggcgtacctctacttcaacctcaatcccaagacggatccggacgccctgcatcccaccgtcgccccgtacacggacgcgtatggcatacactcggcgctcctatacacgctgggcgactacgagggcgccgtcgcggccatcaacaaggccctgcagttcaaccccacggacgcgggactctacctcgagcgcgcgatgtcccacgaggcgatgttcgacttcgacaccgtccagcaggacatagaggacgcctatcccatgatcacgcgcgcgatcgacctggcccgctaccacgcgttccgcgcgaacgtcctcatcgcccagggcaagtacgacctcgcggccgcccactacgccgtgtacgaggacttcgacccggacgacgtttatgcaaacccgcacgaggagctccacgagctcggccaccgcacgggtcacggccacgcgtatgcccacctcacgagcgcggacgcggccaagcgcctccagcgcgcaagggagaactacggcccgtccgacctcgcggtctccacgctccagcagatcctgaacgacagcatcaacctcaggcacccggaagacgcccgcgccgccgcgcagtcgctgtgggacatcacgcacttcgacggctggaagaccctgatcgaaaagttcgacgagctcgcgcgcatgacgccggacgagcggaaggcagccgcaagcaaggccgccgccgacgaggccgacaccgcaccggcgcccgactctccggcagatacgtcagacaacaagaaggaaagtgacagcgatgactaatcccgagccatgggacaagaacggactcacggaggccgagtttctcgcccagtacacgcccaagaagtacccgcagccgtccctcacggcagacatctgcgtgttcacgcgccaggccggcgcacgcggcggcctcaagctgctgctcgtgaggcgcggcggccacccgttcctgggctgctgggccacgcccggcggcttctgcaaccccaacgagaccgctgaccagtgcgccgagcgcgagcttgccgaggagaccggcgtgaccggcctcgccctcgagccgatgtacctctacagcacgcccggccgcgatccccgcggctggaccgcctcctacgcgttcgtcgctctggacgagaagggctccatccccgtggccgcggacgacgccgcggacgcggcctggttcgacgtcgcggccgaggactcccctgccgccgcggacgcacccgcagacaccacgctggtcctcacccacggcgacacgcgtctaaccagcacgtttaccattgttgagcagcccatcacgcacaggcgccgcgcgcacgtcaccggcgcccacggcctcgccttcgaccacgcgcagatcgtggccgacgcgtggctcacgctcaaccgcgcgtagcacggcacgacgcggcaagacgcagcaaaacagctcgcgtcaccagcgcgccggcgggtcggctctggtcggctcgccggcgcgccttgctaccgctctgcccacgcggcccgcgcccagcctaacctgccagcccctcgtcgccgacgggcttctccaccaggcgctttatctcgccctcaagctcgggatgctcgcgaacctcctcctcggtctcggccctcacgggatcgtccgaggtgtacgggtccgcgtcctcggtgtggatggcgttcacccagtcgtgctccagcacgctcgccgccgcgtcacaaaggtagacggaaagccggcccccgccgcagtcgaactctgcccagccgtccggcccgatgcgcacgtccttctcctcgccaatcacgcagtgccacagctcgcccgcgtggccctcgcccacgagcatgcgcttggccccgccggagcggtccgtcagcaccacggccacgcccgagccctcgtgctcgcggtcgccctcgcgcgtccagccgatcacgtccgcgtcatccagccagtcgcgctgccggccgtacgcaaagcgcctcctgatctccatcaaaagtggaagctcaaccaccgcggggatgttcccgtcgttcggcatgccgtaaaggtccccgtaaaacacgcaggggtagcccgcctcgcgcagcaggatgcatgcgtacgcgctcggcttgaaccacggcagaacaaacgactgcagcgcctgccccggctgcgtgtcgtggttctccacaaaggtaaccgcacgaacggggttccacgtgctcagcgtgtcatcaaacagcttcgacaggtcaaagttcccgttcgaggtcgacgcactaaagaagtgatagtgaagcggaacgtcaaacaggctcatcgtgggcatgtcgttgatgtagtccaccagctcccccacgttgggcgtccagtactcccccaccgagaagagctcgcgccccgcgtagtcgcgcatctcgggaagccagtgcctgtagaagtcgcggctcatgtgcttgagcgcatcaaacctaaaaccatcgagccccgtcgtatccagataccaacggccccagttcgcgagctcctcgtagacgggtccgtacatgaggtccacgtcgcagcccatcaggtagtcgtagttaccgttttcgccgtggtccacgtcggcgtcccaatgcttgccgtcaaacaggtagatgccacccctgcgcgtggagtcatcccagtccacgccgtggaagcacctccagtcccacgtgaacctcgagtacttgccgcgcctccccggaaagcggaaccgcgtccacgcgcgaatcttcctggcatccgcaaccacgcggttgcggtcgtcctgtgccacctcgcgcgcgaccacgtcctcggcctcgtcggcacccatgcgctggttcagcaccacgtcgcccagcgcctgcacgcccgccgactgcaacgccttgatgcaagccaggtactcgtccttcgtgccgtacttggtcgcgacggtgcccttttggtcaaattcccccaggtcatacgtgtcgtacacgccgtagcccacgtcaaagccgccagcctgccccttgtacgcgggcgggagccacacggccgtgatcccctcgtccgcgagcctctgggcgctctgcgccaggcgtcgccaatgcttgccgtcagccggaaggtaccagctgaatccctgtagcatggtcccgttatccatttcgcgcctccgtaggccctcatacccaaaagccggcgcctacgtacccgcgacagcccgttataaacggcactccaccatccctgttttccaaatccgtttttggaagaatggcgcttgaagcaaagcaggaggtagatgccttttccgacaatttccaaatccgattctggaagattgacctacaacttgcccgcaaatcgtcacgtttacagcaggcggcatgcccctgacgtctaatccagatcaaccgcgaagatcatcgcgcaggttttgtacccctcgtacaaaccgagagtccattggtggcacgtcaatgcccaaccgcttcccgatcgtgaagcgtacaaggtcatcaaaccatctgtagtttgacaaacgctccgccctcaccacaacgacctcgtatcccatgtcttgaagaacctctcgacggtcatcatcgtggtccaacttgacaggggagttatgaaaagacctgctgtcatattcgacaaccagccgctcatcttcaaacaataaatcaactacaacgtattccgtacgcagtcgcatctgcgcgtcacgagaaatgtcaattcgcctgtttaacaggggcttgggcagtccatatccaaacatgctccgcggtatacacagaagcagataaagcaacgtttcggcaggagacctcgaaccttcccccgcgattcgcaaagcctcgagagcacgtttgcaaccatgcattcccccacaaccgcgagtaaaacatccgagctcttctgaggtactcagaggtgccctcagctcgaatcccctctgcgtccaaggcgtcatcgcgtagcccccacagagttccatggcataagccgaaagcgttgacgtcttcatcgaccttccaagattcacgaacgttagctcagggctcgtcacatacagatcgcttcctatgcggcacacgctcgaatgcggaagcctagatgagcacacgtgttcattcacgcttcgcaatctgcctctgacatctcccgagggcaccatcaagtcaaccggttgctccaaccaaatgggtcgctcgtcacaatcgccaagcaaattagctccgcaccgttcaatggcagtccttcgcgacgacgccgccctcagaaccgggtcgccgtcgaccaacccccgcttgccggcagctcccacgaactcccagtagcgacgcgctgtgttatgtgaaagtagaatcgtcatgccaatagcctaagccagcaacggcactcgcgccacaagtaaatttaacccaaagcaactggccttttgcgacagcctaagacaggctttgcccgctactcgcagctgcaacacattcattgatttatctttcaacccatgcctcgcccactcccccgcccaccgcacgccgccgcaattcgaccgtctccccaggcgagaagaacgccatccccacccctcctacaatcaaacttgcaacggcgacgtgtcgtgggagccgcggcgccacaacgcccggcgcccggccccacgcgcccgccaacaaccagacgcgggaggaaaccatggcaggggaccagttcattgcctcgtttgacgggaccaagctcttctacaacccggaggtgacgccagacgacaaggccgtctgcgtcattgtccacggactgtgcgagcaccaggggcgctacgactacctggcaaagtgcctgcacgaggcgggcatcggcacctaccgcttcgaccaccgcggccacggcaagagcgagggcgagtgcgcctactactcccgctgggacgagatcctggatgacaccaacgtcatcgtcgatcgcgcaatctcggagaaccccgaccgtcccgtcttcatgttcggccacagcatgggtggctactgcgtcgctctctacggcgcaaagtttcctgacaagaagctacgcggcatcatctgcaacggtggcctcacggaggacaaggcgggcatgttcgcgagcatgcccgagggcgtggacccacacacgcagctccccaacgagctgggcgacggcgtctgcagcgtcaaggaagtccgcgactggtacgcaaaggacccgctcaaccgcaagacattcgcaatcggcctggtatacgcgctcaaggacggcatcgcatggttctcgcacaacaagggaaagttcgcctaccccacgctgctcacgcacggtgagaaggatgggctcatctcgtacgaggacacgctcgacatgttcgcggccatctcgagcacggacaaacagatgaagatatatggcaactgcttccacgaggtcgtgaacgagtggtgccgcgacgaggtgatagacgactacatcgcctggatgaaacaccgcatctaacccagctcaacgcgtcgccagcgcggcgcacggccagccccctcgatgtcacggcgtgcccccgcgcgccgtgacatttgtcatcacctgggcacctgaacgttcgctcaacctttaaatgggtagaatgggaacattccaaaaaatgcgactagcggggaggacgtcatgctcaagcagaagcacagtatcgtgcgcgggacccttgcggtcacgtgcgcccttgcgatggggctcggcctcgtcgcatgcggcacggtcgacggcaaggccgcggacgcgacggaggtaagctcctcgtcgcagaagaaggagtcaaaggacaccagctcggacaccatgaaggtgaccatccccaagtacttcttcaacgggagcgcctactccaacaagaccaccaagcagatcaagaagcagctcgagtccaccatcggctccaaggccaccaagaacaaggacggcagctggacggtcaccatgaccaagaagcagtacaagtccttcacgtccaagctgcgcaagagcgtcaaggccacgatggacgccatggcaagctccaagagcttccccaacatccagaaggtcgagtacaccaagaacttctccaaggccacgatcaccctcaagaccgagaagctcgagatgtctgacatgtacgacgccatcgccgtgggcctgcccgcatgcgcctaccagcaggcggcgggcaagaccgtcaagtgcacggtcaccgtcgtcaacaaggacggcaagaagctcgacaccaccgtcgtgccggacgacgtcagcaagtccaagaccaagtccaagtcggacacggtcacggacctgctcaacagcctctccgcagacggcatcacgatcgacagccagaacctgcccaacatagacttcagcgacgtctcctcgtctgacatcgagaacgcacgccagaccgcaagcgacgccctctcgcaggtcgtgtcggcactcaaccagtaaggctccgccatcgcatcccaaatgcggaagagaaggacgcgcgacctcggtcgcacgtccttctcgccttcttggcttactctgtcgtaaccgcgtttcacgcggcgtgcgaggcagacgttttcagccaaatttcgcagccgtaaagagctttggaagcgtacctacctactcacgattctgcataccttgcgtcataccatagctgcagtcgatgggcaccccaagcggtagttccgcagaggatggccttcgaccttttgtaacgcgagacatggggaggtatgccatgggcagtattggcagcatgtcaaagccaaaaatgggtttccttgtggcggctatacagtttcctgcgccagtggtcaacagtcgcgaggacatcggccgccaagtgaagagcatcgtgcgcaccgtacacgccacaaaggcgggctatcccggtgtcgagctcatagtgttccccgagtacagcactcagggcctcaacacctccaagtggctgaccgacgagttcctgtgcgacatccccgggccggaaaccgaggcgttttcgaaggcgtgccaggagtgcggcgtatacggcgtgttctccatcatggagcgcaatcccgaccccaacaagaacccctacaacaccgccatcatcatcgaccccaacggcgacatcgtcctcaagtaccgcaagctcttcccctggaaccccatcgagccgtggtatcccggcgacctcggcatgccggtctgcgagggccccggcgggtccaagctctccgtctgcatctgccacgacggcatgattccggagctcgcacgcgaggccgcatacaagggctgcaacgtgtacatcagaatttccggctacagcacacaggtaaatgaccagtggatcctgacaaaccgctcaaacgcctggcagaacctcatgtacacggtatccgtcaacctggccgggtacgacaacaccttctattacttcggcgagggccagatctgcaacttcgatggcaccacgctggtgcagggccagcgcaatccgtgggagatcgtaactggcgagatttaccccgagctcgctgataatgcgcgccgcacgtggggactggaaaacaacatctacaacctggggcaccgcggatacgttgccaagccgggcggagagagcgacgccgggctcacctacataaaggacctcgcggccggtcgctaccatctgccatgggaggatgacatccagatcaaggatggctcgatctacggctaccccaccacgggtggcaggttcggcaactgacgagcggcacgtacgcagccatcaggtaaacgcgggtacattttacccaaagagaaggacgtgcggcctcggccgcacgtccttctcgccttctttggcccactcggccgcaactgcgttgccgctgcctactgcaggccggggatgtgcgggatggtgtcgaagcccgcctggagctcctcgtccgtggggatgtggtcctcgagctcgcccttgttgtacttgtcgtaggcgaccatgtcgaagtagcccgtgcccgtcaggccaaacaggatcgtcttggcctcgccggtctcgcggcacttctccgcctcgcgaatcgcctgaaggatggcgtgggagctctcgggcgccggcaggatggtctcgagcttggcaaactgctcggccgcgccaaacacgtcggtctgcttgacggcaacggcctccatgtagccgtcgtgcttgagcttggacacgatggggctcatgccgtggtagcgcaggccgccggcgtggtccgggctcgggatgaagccgttgcccagcgtgtacatcttgcagagcgggcaggtctggccggtgtcggcgtagtcgtacgcgtacacgccgcgcgtgagcgaggggcagctcgcgggctccacgccgatgaagcgcgtgtcggggtgcgtgccgttgagcttgtcgcgcatgaacggcgcgatgagcccgccaaagttggagccgccgccgcagcagccgatcacgatgtccgggtactcgcccagctccttgagcgcctcgtaggactcgagcccgatgatcgactggtgcaggacaacctggttgaggacgctgcccagctggtagcgacccttgttctgcggcacgttgagcgcgcgctccacggcctcgctgatggcggtgccaagcgagccggtgcactcggggtcggctgccaggatcttgcggcccgcagcggtggtgtcggagggagacggcgtgatggtcgcgccaaacgtctgcatcacgctgcgacggaacggcttctgctcgtacgagcacttcaccatgaagacgtccaggtcaaggccaaagtgcgcggccgcctcggaaagcgcggtgccccactggccggcgcccgtctcggtcgtgatgttggtgatgccctcggcgtaggcgtagtaggcctgcgccagcgcggagttcagcttgtgcgagcccgaggtgttgttgccctcgaacttgtagtagatcttggcgggcgtgtcgagcgcgcgctccaggttgtacgcgcggcacagcgggctggggcggtagaccttgtacatctccatgacgggctcgggaatctggaagtacggcgtgtcgtcgtccagctcctgctcgcaaagggcgcgagcgaacacgggcgcgatgtcgtccaccgtggcgaccttgccgttgggaaggcgcatgggctctggcttttccggcatgtccgcgcgcaggttgtaccaagccgtgggaatctggtcctcacgcaggtagacgcgatagggatcggtggtcgttgcttccgccatgatcgtcttcctttccactgggcgcggcgcgcccgcttacataaccaagcttgcagaaccctgccatgccgcctcggcatacaaaaaggcccccggaactagtccgagggcctttgcgtgtgtatggttaagcggccgtcgctagtccggaagtcgagtcacccttgtccaccaccatgcgccagcaaacgccggggcgtttgcgaacacgctgttgttggctgcaagggacatccgtcttcctttccgtgacgttgccagctacgatatgccgcctctgttgcaaatacatttcgggcgagaaacgcgtgcgtttctcgcccgaacctgaagccaggcgaaaggctacttctcgcgccagcccttgcacacgtccacccagccgagcgagtggctcgcgcgctccagctcctccatcgtggtgtcgacgccggtgcgctcgcttcccgccgcggggcgcacgaagtcgtagcgcctgagcgagacgtccaggtagcacgtgacgccaggcttcacgtcaaaggggcagacgccgcccatgggatggccgaccttctcctccagctcgtccggcttgatgaacaccggcttggtgtggaactgcttcttgaaggcggagttccagaccttcgcgtcgccggagcacaccacgagcaccggcttgccgtcgacgtcgaacgccatcgtcttgccaatctgcccgggctcgaggccggacgcgtccgcggcctgctggaccgtcgccgtgagcacgtcgtacacgatgatcttcttgtccagcccaaactgtgccagatacctgcgcgtagactcctcggacatgctacttcgcatccatgcagaacagcagcgtgtcgaacatctcctggctcgtgggccacatctcgcggtccacgccgtcgagcatctgccccagcgtcatcgtgcggtcggggttggtgcagtggtacacggtatcgagcggcggaagcacgaacttctcgtcagacatgaaaggtctccgttctctttggactcgctgttgcagaggcgcggcaggtttgcgaaaggttggcccccgcgctgcgtcttgcctaactatatacgcaaactgcgtactggaaaccgcgattggcagttcattttttatgggactcagcctatctttccgcagtccgtgcctcgcctacatctgcatatcaaaaatcatcttttgcgtttatctttaccctatctgcaccaatatgcaaatctgtctaactggcacgtatcttgcggctatcttgcacttatctttaccccgcgccaacccgcaagatttcgcgttcatcaagatgaatgctggttggccaatatttaaactttttgcatcaacaatttgtgctggccgctccctggggtaaagataactgcaagcaaggtgcgccacccgaaacggccggcgatccgccatccaccagcgtgccctaacgtgcaagggaccgcccgcacaagcgagggccgccgcccgccaaagcggaacggcgaccctcgcgtcgcttcacacttcctacacgtttgcggccgcacgtagacgcacgccagcacacccaacaccacgcctgggcttcgcgccgggccctaccccagcttcacgctcttgggcaccgtgcggaccatgccgtagaacgcgtccacggcgcgcttcctgatggattccagcatgctcgggcgcacggcgtcccagtcgggcgggtcgtcgcgcagcatctgtcgtgcctccgcgatgacctgctcgcccgtgccggcctggaacgcgtcgtccccactcacgggaaggttgatgtacaggtcggcggcgttggcgtggatcttgtccaactggttggcgccgcagctcatggtgcgcatcgcgatgttgagcggcgtgatgtcctccatcagcttttgcttgcggatcattcccacgcccaccacggcgtccaccatgctgcggtcaaacagcggcgtgggcaggttcatgcggcagccgccgtccataaaggcatgtccaaggtacttggtgggcgagatcacgagcgggtacgacgcggagcacgagcagcacttggccgcgtccagcgccgggtcgcagatcacgttccaactgccgtccgttgcggcaaacaggtccgcgtcgttcgtgaagacgcagaggtcgccggtcatgatgtccacggccgtcacggcaacgggcatgttgaagtccgcaaacgtgcggatgcccgcctcccccaggatgtcgcgtgcgatgccctccatcacctggctgtccacgatgccgtggttggagaacacgttcagcaccctgagcggcatgttcttgaggatgccttcctgcacggtgcgattgtccagttcgacgagaagttccgccatccgggtcgagccaatgccggaggccgtgagcgccgccatgagcgagcccatggacgtgccagccacggtggcgcagtgcacgtcgttcttctccatgtcctcaactaccgctacctccgcaaaggacctgaagcctcccccgcagaaggcaacgccaacgccgtcgagctttgccatgcttcccccttgaacagatgtcggggcgcacgtccaaccaggtgtcggcggcgccacatatctttttggtacccaatcgaacatgaaaaagaacagccgcccgcaaaggcgactgcccattttcgcaatcgatttcacttcagaatgtgatgaggccggcgcgggcgttcttctcgcccaccatggccccaggcggcagagccgccgcccgtgccccgcggggcaacaggcgtcctacgctgccttgacgcacttgaccagcaggtgcgagtcaccgtggttctggctgtgcgagccataccagcggtcaacatcaccaaacagcgtcctgaggctgtccgcctcgaagtcgcgcctgtggtcatcgaacatggcggtgtacacaccactgatgaaccaaccgttcgagcaggcatcaaacacgcgcctctgctgcttgtccatgtccttgatcctcaacatgcttacaccttcccttcgacctagacgtttacggacacttagaccttacccgcaaaacgaggccaaaagtcggcagcatgggggactttacatatctgttcctaacttagaatggactccttaccatatgttttgcaaattaatgtgacgattctgaggattgcccagctcaggggcgaggttctggaaacgtttccaggcaagaaggcgttcccggcaaaagcgtcgcctccgggagccacgggcgagaagttcacatctctgacaccccagctccacagctgtgtgcaccgcatgccagctttgtgcaggtggcgacacatatctgcgtgccactgcgaccgccgaggtcggccgtggagcccggcgcctcccctactcgcgggcgtccgtcacgttgacgcgcatggtcacacggtgctcgaggtccgccgtcgggtcgatggccagcacgtacgccttgaagacgtcgctgtggccaaacgcgagcagctggctgatcgtgccgttgcacgctcgcggcacaaagccgatcttggtcttgtggaagtacaccgcgaccgcgcgcgagtcgtacgggttgtccggctccgccttgagcttgagcttgctccccaccttgagctcgtcaaacacctccgcgatgtcccagtgcgactgcccagcgacgttgcaggtcagaaactccttgctcatctggtacatggcgtcctcctccgttccgcggctttgcggccttgcgcctttgctgccacgtacgttacggcccgcaccggacattaattcgcgcacgcgcgccgcgcgcatgccgctcgcgggaggcacatgcccacgccggatgctgccgtgagccaagccagacccctgactcacaaagtacgctttgtgagtctaattcaaactcaatctacctgcggaaacgtgaatttttggccactcacaaagtatgctttgcgagtccgtgcgccgcaagtcgggcctgcgcccagacgctgtggtgtcactcgagccggcccagtgtaccccgcccctacagctccgtgtacttgcgcgagctgccgcgagacttctgcaccggatacttggcctcgtcctggcgcagcttgcgctccatcagctcgacggggtcctcgcccaggtggctcgcgagcatcacgcagtagatcatcacgtccgccagctcctcgcgaatgtggtcgcccttctgcccgcactccaggtccgcgccggaccactggaagttttccagcagctcggccgactcgaggctgatggagattgccaggtccttggcgttgtggaactgcgcccagtcgcgctcgtccctaaacgcctcgatccgcgcgacctcctcgtcaaacgtcatgcccgctcccctctcgcgcagccggacgcgcgcccgcacgccgcgcacttctcgcccgcgcacagtatcaccacggcaagaccaccgcttgcccacagcagacaattgtaaggaagccgcgtcgtgggtagataccaaacgacaaccgcgtcgtcacgaggaggagaaggacatggcatttgtagaggtggacccccatgagatcgagctcaggccatttgacgcgtttgaccgcgggtgggcgctgctcgcggcgggcgacgccgaggcagccaactgcatgacggtgagctggggcggcgtcgggacgctgtggggcaagccagtcgccacggtctacgtgcgcaagagccgctacac

SEQ ID NO: 154 - DNA, 2212 bp, Unknown
  Metagenome-assembled genome
aggccccggcgacatacccccgtcacgggcggccgccggccgcctggcccctcgtgccggaaaacaacgttccatatccggttgtcaaggtgctggaaaggccgaagttggcctggctaacctgttgacaaatccatagctggctccctccgcgcggccgctcccgtgtgtggcctgcgccccggaccgggctgcgatccggggcgcaggcgccgttgcactagattgtatccgcttgggaggcgcgagccgtcggaggcttagtcctcgtcaccccagaccttgcgcgccacgcgcttgaccagcgcgaccttgccccactgctcctcctccgtcagcttgttgccgatttcgcagctcgcgaagccgcactgcggggacagatagaggtcctccagcggcacgtactgcgcggcctcgcggatgcggcgctcgagcaggtcctcgtcctccaggccgggctgcttggacgtcacgaggccgagcacgaccttcttgccgggcgccacgtgggcaagaggctcgaagcctccggcgcgaggcgtgtcgaactccaggtagaacgcgtccacgtcctccttggcaaacaggtacggcgccaccgggtcgtagccgccctcgaaggcgtacgtggagtggtagttgccgcggcacacgtgcgtggtgaccgtgaggtcgtccggcctgccctcgagcgccgcgttgttgaggctcacgcccagctcgcacaccttcttgatgtccacgggggcgaggccggtcttcgccacgaagtcgcggtcgcagtagatgccccaggtgcagtcgtcaaactggatgttgcggcagcctgccgcatagaggtcggcaatcacggtgcggtaggcggccgcgatgtcggccgcgagctcctcgttggtgggatagacgctccgcaggctctccacctgtccgtccgtgcggtccaggatgacctcgctgtaggtctggatgggcgcggggatggtctgcttggccacgttgccctcgctctcgagcgccttcacgaacttgtagtgccgcacgaaggggtggttcctaccgtcaatctttcccaccacgacggcggtgtcggccgtggtctcctcgtcgtggaacctgtagccctcgcggctggcgcggcgctcgatcccgccgagcccccacatgaagtcgaggtgccaatagctgcggcggaactcgccgtccgtgatgacgtgcaggccggcctccttctgcttctgcacaaggtcgcggatggcctcgttctccacggtggtgagctgctcgtcagaaatgagcccggcggcgtggtccgcgcgggcctgcttgaggacgtccggcctgaggaagcttccgacgacgtcgaagcggaacggggagttgtgcgtgtacggcatgacgggacccttcgtctggaggttggctttgggccgggtgggcggttcttctcgcccggcgcgtaccagtatggccgtgacgttttcgatagaaaactatgcgttatctagtcatatccatagacaatagctatgttcgcgggcgagaagaacggggccggacgcgctcgcatccgaccccgttggttgcatctctctgcgccgcgtgacccgcgcggccgggagcgcctacttgaagtaggcgacgcctccctcgaagagcttctggtacttgttgcccgggacgttctggtacaggcccttgccggagcgctccgtgtggcccatcttgccgagcacgcgaccgtcggggctcgtgatgccctcgatcgcgaggacggagccgttggggttcacgtccaggtccatggacggcacgccgtcctcgtccacgtactgcgtggcgatctggccggccgcggccatctgggcaagcagctcgtcggaggccacaaagcggccctcgccgtggctgatggcgatggtgtcgacctcgcccacgggcacctgggacagccagggcgagaggttcgaggccacgcgggtgcggacgagcctgctctggtggcgtccgatggtgttgaaggtgagggtggggcacttctcgtccatgggacggatgtcgccaaacgggacgagtcccagcttgaccagcgcctggaagccgttgcagatgcccagcatcaggccgtcgcgcttctggagcaggtcgcgcacggcctcggtcacctgcggcgcgcggaagaacgccgtgatgaacttggccgagccgtcgg

SEQ ID NO: 155 - DNA, 15433 bp, Unknown
  Metagenome-assembled genome
tgcaccgtggtgccacggtggttggcgtccagcacctgctggcgcgtggactggatgccaacctggatcttggtgcagcccagcttgcggaagagcgtgaggctctgcggcgtgatggcgtcgggccgcgtctcgatcacgaggccgaccacgcgatgggccgcggtctcgttgcggcgctgctcggccgcgagctcgtccgcggtcgcatgcattattgcggctgcctgcctaaagcgctcgctcttctcgccccaggggtcctcgtttgtgggaacgctgccgtacaggcgcgcgaaggcctggttgtaggtcaggaggcccgcgttgaccagctgctgctccggcgccacctcgcgcgcgagcgtgaccgggtcgttggagatgccgagcttccggtagtggtcgcggcgcgcctcgagctccggcgtggggacgggccagctgttgagcgcgcggaagagctcgcgcacgaaccagagctggtaggactccgggtagtcgctccacgtgccgcccaacacgatgagctcgaccttgtccacggagtggcccatctggtgcagcgccgtgagccgcgtggtgacctgcaggaatgggtcgaagtagttttgctccgcgcgctggcaggcgggctcgtctgccagatagctttttggcatgcggaggtcgttggggcagtacacgcaccggccggagcacgggtgcggccgcgtgagcaccgtgatggtggccacgccggacgccgtgcggcgcggcttcatgcgcagggtacgcagcagccgccgctcgagcgcggggtcaacgccccacgcgcgccagcggtccggctcctcctgcttgacgcgcaggtagaagggcagaatgtagcgcttggagaggtgcttggcgttgttggagatgccgcggttgtgccggcggacgatgcggtccaggtcgagcgggccgagcgagccctcgcccggcaggtcgggcaggcggcgcagcgcgtcaagtatgtcgagcagcaggtcttccatgtggctaggcgtcctccgactcgtacagaaccttgccgtcgcgcgcaatctcccggcgaagctcgtccgagacgtgcccgtccaagttgacgatgtccagctcgagcaggctccagagttcgtcctgcaggcggtcgtacagcgcatagaaatccgggcagccctcaatcgccaggtcgatgtcgctcttggggcggttggtgccgcgcgcccgcgagccaaacaggatgacgcgcctggcaccggcctcgcgcgcgaactcggcaatctgccgatacacgtcctctatcggcacgctgccgcgcgggacggaggagtccggcccacgtaggaagtccttctcgcccagaggcgtggcagcgcgcggcatgggctagcgcccctcggggatgatctcgatgcgctggccctcggggtcgcagataaagtaaaggcccatggccgggttctcgaagtcgatgcaacccatctgctggtgcagcttgtggtaggcgtcaaagtcgtccaccacaaaggcgatgtgctggtcgcgaccgccgttgtcgtacggctccgtgcgaccgcggttccacgtgagctcgagctggaacgggcagccgtcggcctccatgaacgtgttggtccacgagccgtccgcggggccgatctcgcgcacaacgtggaagcccagcgccttctggtagaactcgatggtcttctgcttgtccagcacgtgcgtgcagcggtgcacaaagcgagccttcatgtcggtttccttccgtcgggatgggcgttgcgggtttccgtcccatcataccccgcgggcgagaaggacgcccgcgccggcgggagccgggcgctgtggcgatggggttactggcgcggggactcgtccttctcccccgcggcctcggcagcggcgcaggcagggcacacgccgcggaagatgagctggtggtcgaggacctgccaaccggtcttggcggacacgcttgcgtctagctttgggtcgtccgccgcgagcgggacgtccaccacggagccgcagcgcacgcacaccatgtgcgggtgcacgtcgcgccgcaggtcaaagtgctcgacgcccggcgccttgatcgagaggatctggccctcctgcgccaggaggtgcaggttgcggtagaccgtggcctggctcacgcgcgggtcgcgggcgcggacggcctcgtatatctgctcagccgtgggatggtcgcagcgcgagcggacctcgtccagcaccatctggcgctgtcttgtgttgcgtcgcgcaggggcgtgggcgcgcgttcttctctcttccatttccggctccaaaaaaatccgatttgctattgacacggggtcatttacggcaataatgataatcgttttcgttaggaaaggaaaacaataggaaggaatcaccatgaagtttgtttgccccgtttgcggttacgttgaggagatcgacggcgacgagctgcccgcggactacaagtgcccccagtgcggctgccccggctccaagttcaccaagcaggctgacaccctgacctgggctgccgagcacgtcgtgggcgttggcaagctcgagggcgtccccgaggacatcgtcgaggacctgcgtgccaacttcaacggtgagtgctccgaggttggcatgtaccttgcgatgagccgcgtcgccatgcgcgagggctatcccgaggttggcatgtactatcgccaggctgcctttgaggaggccgaccacgcctcccgctttgccgaactgctgggcgaggtcgtgaccgactccaccaagaagaacctcgagatgcgcgtcgaggccgagaacggcgcgaccgccggcaagaccgacctggccaagcgcgccaaggccgcgaacctggacgccatccacgacaccgtgcacgagatggctcgtgacgaggctcgccacggcaaggcgttcgctggcctgctcaagcgctactttggcgagtaaccgctggtagattgactgtttgagtccacgcgactctattgggacccgctggctgggctgcatgcccggccagcgggccccattcttgtgtgacgcacgtctcgtcctgcggagccattaccaaaggccgttcaacggtaaccagggaaccacgatcgacgggtcagttcggtcggtccgaatagattcggtcaccatttagttttcttggcgaaatgggtgttttggaaatccgcggagtgtcaaatcaggcctccaaacgcacagaagacctctcccagctgagaaatgatggcgttctaggtgttttcgagtcgattccgatgctctcgcggtgtaattccataagaaatagaactacaaaacacccagaacgccataaattttcaatggaggctaaaagtacctagccttgggcctcgtcctccccgtcgctcggcgccggcgtgatggcctcgcggtcgcgctcgcccgtgcggatgcgcaccgcgcgctccacggggtaccagaacaccttgccgtcgcccggctcgcccgtgcgggccaccttcacgatggcgtccgtcgcgacctgcgcccagtcctcgttggataccacaatctcgaacttgaccttgggcagcatgttcatcgagaccttgctgccgcggaccaggtgcgtgtagcccagctgcgtgccgcagcccatgacctggctcaccgtgatgccgcgcacgtccacggcgcgcagggcctccttcacgtcctcgagcttctcctcgcgaactattgcctcgaccttgatcatcgctcttctcccttgcgcttgcctgccgtgccgcgcgacgtcgcgagggcgccgccaccgcatagcttagtcgtcaagccccgtgaacgaggggtaggcccgctcgccgtgctcggacaggtcgagcccgacgcgctcctcgtgctcgctcacgcgcaggcggtcgtggcagcacacgcgcacgagcgcgatgcacaccagcgtgccaagcaccgcccacacgatggtaaccacaatggagaggagctgcgcgcccagcaggttggcgctgccaaacaccaggccgttccagcgcagcgcggggttgaccgccttgctcgcgaagagccccgtggcgatgccgccccagatgccgccgatgccgtggcagccaaacgcgtccaacgcgtcatcgtacccaaagtgcagcttcatgcgagagcaggtgaggtagcagatcacgctgcccacaaatccgatggggatggccgcccacagcggcacaaagccacagccgggcgtgatggccaccaggccgatgacaagtcccgtgcaggcacccacaagggtgggcttgtcggaaaggatcacgtccatcatcatccaggcaagctcggccgccgcgcaggaaagcgccgtggtcgcaaaggcgtgcaccgccaggccgttggccgcaagggcgctgccagcgttgaagccaaaccagccaaacagcagcatggtcgcgccgatggccaccagcggcacgttgtggactcggtagttaacgttcttatagccgatgcgccggcccaggaacacgcacagcacgaggccggagaccccggagctgatgtgtaccacgttgccgccagcaaagtccaccgaacccagcgccgcgagcgcgccgccctggccccacaccatgtgggcaacgggatagtacacggcaaacgtccagaacagcacgaacaggaacagcgccttgaagcgcatgcgtcccgcgacggcgccagtgaccagcgcgggcgtgatgatggcaaacatcatctggaacagggcgtatgccataaacgggatgctcggcgcgtacgggccgatcttagtggtgctcacgccgttcatcatcacgtacttgaagccgccgatgatgccgccgtggtccggcccgaacgcgagcgagaagcccacgaccacccacagcaccgtctcgagcccgatggtaaagacagacgcaagaatgttgttgaccacgtttttgcgtcggcccaggccgccgtagaaaaacgcaagtcccggcgtcatgaacagcaccagggccgcgcagatgagcatgaatcccgtatcggccgcactcatggtatccccttccgccgttggcgaagcgaccccatggtcgttcaggttcgttgcgcgcccgtgacgcaacggttgccgccagcctacgatgccgtgaccatcgcgcgaagtcgcagatgtctgccggggtggcataatctgcatgtgggcgagaagaacgggggcgttatgcagaaacacgcacggggcatgcaccacgaacagtgggcgcagcgcgacatgggccttgcgacggcgcgccggatgaacgagctcaacgcgaggttctatcgcgacaacgcgacgtcgttcagccagaccaggcagtcgggctggcccggctgggagcgctgcctggcggaggcgggggccgcgggcggcagcgtggccgctgcgtcggccgacaacgcatccacatccgccacgcgcgtgctcgacctcgcgtgcggcaacctacgctttgcgcgctaccttgcggatgcctgcagcggtcccgtcagttacctgggaatcgacaactgcccggagctgggcgcaggcgtctctcccacggacttcccgtccggctggcagctgcgcacggcacggctcgacgtcgtgggcgcgctcctttccggcacgctcgcgagccagctggatgccgcgctcacgcgggcatggggcacggcgggcgccggtcccgcagccgccaatctatcggttgtctttgggtttctccaccacgtgccaacgtttgcggcacggctcgagctgcttcgcgcgctgcttgcggcaacggcgccaggaggcacgtgctgcgtgtcgttctggaggttcatgagcaacgagcacctcgccgcaaaagcgcacgccacgacggagcgcggcctgcgcgagctgggcctcgcgcccggcgacctggggcatgacgactatttgcttggctggcaggacgtgcccgggtcgtatcgctactgccaccacttctgcgagcgggaggtcgacgcgctgctcgcagggcttggcgaccaggcgcagccagtcgcaaggttcacggcggacggccgctccggcgacctcaacgcatacgtgttgctcaggcgcctatagcgcgcggctcgtcctcgtccggaatgctctgccagtcctgtagacccaggcgctggcgtgccttggcctcctcgagggatatcttggggatgtcgtcctcaaggtaggcgcgaagctcggggatgccctcccccgtcgcgttgtccaccaggaagatgcgctcgcagcagcagtcccgcagccactgccgcaccatggggatgttcgcgttcggctcgttgatcttggtgatgatgccgatcagcgggcggttgaggaacgcgttgctgttgggcgcgaacagcgtgaagggctcgttcgccgcgatgaggattgccacgacgtcagactcgaacgagaagcacgcgagccccacgcccacctgtttggactcggagtactcgcctggcgtgtcgatggtgtcgccatcggcataggtgtactgcgtcttgtggtagtgcagcttctctccgcgcagtgcctgcgtgagcgaggtcttgcctgcctcgctcctgcccatcaaaaacagtcgcttcatcccaacctacctgtgggtcatcttgcacacgtgaaagtcgagttcgcgatcaaagtagtccaggatctcgctttcggcgctctcaatctccgctatcggcccacatagtatgagcgagccgttgaaccggtccataaagcccagctccaccgagccatgcttcacggcgatgtccgccgcaaccacgacggcctcccacggcgtgaagcgcatgaagcccagcgcctcgcccgtgtggtcctcgcccgcgtgcgtgccgatgtcaaggccgagcgtctcgcacgtccggcgcgcggacgtccccatcacgtgcgcgaggtcgatctcgcgaccgggcacgcgcacgcgcgtgatgcggtactcgccattctcgtcgcgcggagggttcccgtggaacacctcatcgaagaactcctgccttgtgatcctctgcctcgccatggctggcctagcgcttcgtgaccttgcaggtcacgtatcccagcgtgtcgtggaagaactcgacgacttccgtgatggccgtcgtgacgtccgcgatttcgccgctgatgatcatagtgcccgtgaagcggtccgcaaagcccaggtagacgtccgcgctcttgaccgcgatgtcggacgcgatgaccgccgactccggcggcgtgatgttcatgattcccagcgcgctcgtgtcgtagtccaccgacgggttgaggcccagcttagtgtagatgatgggctccggacctccgatgacgtgggcaagggtgatctccttgccggagacggtctcttgtacgacgcgaatctggccctgatcgttgtccacgctcacgacctccgtttctaagtagctcagtcgctcttctctttcttaagggattacctcttgtgagtgtcaagcaccccatcgctcaatggcaagggtggccctcccagtgcatgcgaagggccacccacccagggagcaaaggatggcgagaagaacgtggacgtggcggttcgagggaaccgccgtgtccgtgggtccgtcctagccgttgtaggcgtcgcgatacaggttcacgaggtcctgcttcgagacggggcgcgggttggtcggggtgcagcggtcgtgcgtggcggcctcggccatgtcgcccacgtgctcctcgaacgcggtcgcgtcgatggtgcccaggtccgccagggtgtcctcgatgtggagctccttgcgcaggtcgatgaccttcttgaggaactcgtcggcgtcggccatgcccagctcgtgggcgaggcggttgtagggctcgcggtacttgtcctcggacatgtggaagcgcatcacgtagggcagcaggatggcgttcaggcgaccgtgggccacgtggaagcggccgcccagggcgtgggccaggctgtggttgatgccaaggccggcgttggtgaaggcgatgcccgcgacgcaggaggcctcggccatgcggccgcgggccctcatggcgtcgccgtcgtggtagaccgtgggaaggtcctggaacacgatgcgcagcgccttgacggccagcgcgtccgtgaaggtagtcgcctggttgctcacgtacgcctccatggcgtgggtgagcacgtccatgcccgtgtccgccgtgatcttgggcggaacggaacgggtgaactcggcgtcgagcagcgctccgtcaggcgcgagagcgtcgtcaatcagcgcgaccttggtggtgccgcgggtgatgacggcaaagttcgtgacctccgagcccgtgcccgccgtcgtggggatggccaggaagtagggacgctccatgcccttctcgcccgcgaagtacaggatggccttggtggcatcgatgcacgagccaccgccaaaggcgatcacgaggtcgggcttgacgtcgaagatcatcttgacgcccgcgtccaccagctcctggctggggtcgggcttgacgttggagtacacgtgaattttggctcccgagggcaggtactgggtcatcttgttgaccatgcccgactcctgcaggaagccatcggtgatgacgaggacgttcgtgcacttgagagtgccgaggtgctccaccgccttcggaccaaagaacagctttgccttgagatagaactcgctcatcgtctactccgtttctgttggtagaaggatctccgtcacgaaaagttctgggttgttggtagtccaatagtccgacacgaagcgctcgatcgccgtgcccgacagcttgtagccattgtcacgcgcgtattcgaggagccggtcaaaggccgaactcatctcctcgaatgcccctacgtggtacgtggtcagatacatctgccctgggcttgtccaggcgttttcaggcttcagaggcctgatggctttctggagcaaccttacgtcgcactccctgccatccgatgccgccgccttggcgtcatctaccgttgggaactccatgatcaccgggccagtgatggcattgtctatggcactcacgtaagcagcgaagtccaggctgacgatggactccgcgaagctgccggtaaagcgcgacggaaggcacaggagctcgtggggaggggaatacttcacgctcacgtcggtgggacggacctgaagcaccgtgttggcctcgtccatgaggttgttccagtcgacgatggccctgcggcgctcggcaagtgctcgcgcctcctcgtcgcagatgtccaggtgctgggcgaacagcctctttgcttcctggaggtcggaatgctgctgcatcgtagcgatctcgtcaagcgagaagcccatcatcttgaggtagtgaatcacgggaatcttcagcatggtctctcggctgtagtagcgatagccgttgtcacccaccacatcgggcctcatcaggccaagctcgtcgtagtgcctcaatgtgcgctgagatataccaccgatcttgctgacctcgccgatctggtacaggtcatccctgccaaacttcttatgggaagtcatgccttcgcctccgttgacttgaggatccgcgcagaaaggacgtagcttagtgcgatgggattctggttgcaaagctcggcccgcagcacgtcccgcagggcaaagactgttcccagcgagtacgtggcgacctcggccatgaagtagtcgagcgacgagaccctgccgtccgcggaggcgtcggggcgcgcatggcgatgggactcgggaagctcgcttgcggcctcctcaagcgcgggcgagaggagcttgcgcacgtcgtcgagcgcctgtgccttcacgggagagggcgccccaagcctcgcggcccagtcacgctgatagcccgatgggtcggtgacagccatcatgcgcgcgtacttctcctccacaaggttgcgtccctcgctctccgcctgctcgaactcccccaggatgcgggggatcatctggtgcgggaaggcaaggtactgggcgcagcggtaggcaaagaaggggcgcgggtcgtcctggcagcttgcgcgtccgccggcgttgagcaccgagtcgaactgctcccactccagggtgaccaacctctccaggaaggagcggccctggtcgtccaggccgcactcccccatgagggagacgacgtttggaagggagaagagcgtctctatgccgcggcggcggcaaaggcgcctgccatacgagttgttgttgcactcgcactggcccattatcgatacgccccctcgttgagcggacgttccctgaggtaggagttgggaatgccctgccacacgatcgttgcggcgtcgagcaggaagtctgagtcgcttgttgcccacccaagagcgagcacggtgcgcagcaccacgccgcagaggagctccacgtcctgcacctctacctcggccaccggcacggacgcgatgcggctcaccagctcgcacaccggcgcgggcacgtgggcgcgctccgagagcgagcggaaggaccacttgtagaacggcatgtaggtgtgagagagcaggtgcagcgccgccatggcagcctgcaggaatgcggaccgcgcggtgttggcggccacgaggtcaccgcgacccaggcagcgccataggttgtactggccggactgggccattacggccatgttggccgcgaccttcttgcggacgaccacctcgggatagaagcccaggaggtcccggcgcatgcgggagaactgcccgctggggtcggagaacacctcgccgtcggtggcggttgcgaggagctgctcggggatgcgaagccactcggcaacgctctgaggcgagcgctccagacccgtgaatgagcgatagaacgactcggtctcgaacacgcccacgcgctggcccgcgagcggggtctggacgcgctcatgccccaggaactgcttgggcaaagagtcatagcggtgtgccagctcgttcccccactcgggatagagctcgcggggaacccacacgcagaagccggggccaaagtcgtggtcctgggaggtctcgtcgtcgaagcccaggcattccgagccagggcccacgaggccgaaggcaagctgcctctcgacgttgtacgggagcccgaaaacgagaaggggctcgaactcgccgaagtagcgccttgccagctccatgcccttcatgtcgcacctcccgaccgtatcgaacctttccgcccgcccaggtaacgcgggtatcccgtcgctcagggtcgcctgagcgcccccatgcgttccgcctctcgctcgagcgcccgcacgttgggggcgtcgccgagcttgtcgcgcagtacgtcggctgccttcctgtacaggtcctcggcctccccgtaccgcccgcgaaggtaggcgatcttcgcggcagtcgccaacgcgtggggcctgtggacgtcccttccgcccgagagcgtgcgatacgccgcgagtgccgggacgatggcctcctctgcctcgtccaggcgcccctcgtccaagagcacctgagccaggttgatggcgttggtggcgcgcctgccttccgagttgggaaccgactccaggagccttcccgccctcctcaggtcacgtcgcgcctccgcgaagcgaccaagcccgcgaagggaggcgctgcgattgttgcagatagcgctcacctcgtagggatgctcgtctccgcttcctaggagcgcctcggcgcggtcgaacgcctcgaccgccttctcgtggcgaccctgggcaacgtagacgtcgccaaggttgatgaggacgcgtgccctctcgtcaccgctcgcgccaagtccctcgagctttgccagaacctcctcgtagagctcctcggactcgtccaaatcgccacgcagcctgaggacgctccccagctcgttggcggcagcgacgcacatcctgccatcaccagcgagccgggcgcgccgcagggcctcccgaaggaagcccgcgacgtcggcacccggctcgccgtacaggcggtcgagctcgtcgtataggcccgagagatccaaggccctaggcgttcagatgcgggatgatgagctccacgtcggagtgcggacgcgggatgacatggacggagcggagctcgcccacgcgctcggccgcagcagcgccggcgtcggtggcagccttgacagctgcgacgtcgccgcgcacgaacgtggtgacgatgccgccgcccacgtttactttgcctacgagggtgacctcggcggccttcaccatggcatcggacgcctcgactgcgccaacgcagccgaccgtctcgaccatacccagtgcctcgttcattgttcagctccttgcctcaatgtcttacggtcgagaagaccgcgttacctactctccgcggaatgccgcgacgagctcgttgaccatcttcttgagctcctcggcatcgatggtgtcgctcgaagcctggggctcctcctgtggggcgtggctgccacagcagttgcagcccaccgagtagctgataccgctcgtgccgtgtccgacgggcgtgtcgatgctcttctcgtggctctcgtgaacgggggcgcagcttgcctcggagcacccacagccagaagtggtcgcgtgcgtgtacttggcggccagctcggggtgccacttcgcgaaggtctcgtcggcagcggcgacctggtcgggctcgatgatgccgttggcaatgcgcttgatgttgatcaggtgctgcggaccaacgttctcggacacggagctgccaccccaggtgccgcagcccagcgtgagcgcgacctcgaggccagtggagagacccgtgccgccctgggtgccgcccgtgttgatgaggatgcgggaagcgggcttgaccgagaacttgcggacgatctccttgtcctcggtgtggatgttcatggtgtggccgatgccgttttggaggagcgcgatggagagatcgcaggcctcgtgccagtcggcaacggtatagaagccgagaacggtggtgagcttctcgtaggagaggggccagtcgggtccgacgccatgctgctcgccgatgaggaccttggtgtcagcggggatgctgataccggcggccttggcgatggagactgcggtgtggccgacgaacttcggactcatggagtggccgttgcggaagaggatggcgcaaaccttcttgcactcctcctcgctcatgaagtagccaccctgcttcttgaactcggcgacgacctcgtcgtggttgcaggtctcgcagattacgctctgctcggaggcgcagatggtgccgttgtcaaacgtcttggatgcgatgatctggcgtacggcatcatgaacgttggcggtgcgctcgatgtacgagggcgagttgccggcaccgacgcccagggcgggcttgccggagctgtaggcggccttgaccatgccggggccgccggtcgcgatgatcatcttgacctcgggcgcgtgcatgagctcgttggttgccgcgatggtggccatggagatgccctggatgacgttctcgggagcgcctgcggccacggccgcatcgttcatgagcttgatcgccaggttggtgcacttggctgccttcgggtgcggcgagaagacgatggcgttgcgcgacttgatggcgatcatcgacttgtagaggatcgtcgaggtggggttggtgcaagggacgatgcccatgatcagcccgacgggctcggcgatggtgatgacctggttcttctcgtccacgtcgatgacgccaatggtcttcttgtccttgatctgctcgtagagcaggccggaggccatgtggttcttgtaaatcttgtcaggcacgttgccgtaggtggtctcctcgaccgccatctcggcgagctgctcggcgttcttctccgcgacctcgaccatggagcgaaggatgcggtcgatctgctcgacgctgtagttggcaatctggttcgcagcaacctgtcccttgcgtgccaggtcacgagcagcctggatgctctggaggtcgtaatcgtattcctgcatcatgcctctttccggttagcagacgttctgggatatgggatctcgctactcggcgtggggcaggatcgactcgaccatgccgtccgggcgcgggatcacgtggacgctcagcagctcgcccacacgctgggccgcggccgcgccggcgtcggttgccgccttgacggcgcccacgtcgccgcgcacgaagacggtgaccaggccgccgcccacgcgctccttgcccacgagcctcacgttcgctgccttgaccatggaatcggcggcctcgacggctccgaccatgcccttggtctcgatcattccgagtgcctcaacggcgttggccattctggttacctccttggtgggttgaggctccgccttcatgggctgtgcctctgtcttgggtgcctgcggggcctttgcggcctcgctgtcgttctttggtgcaggggcagccactggcgctgcctttgcctcgggagcctgcttctccgcctggggggccttcgcagctaccgccgcaccctccttgcgtgccgcggacgtgcgtgatgacctccgcgccggggcgggctttggagcgtccgcggaaggcttaccagccgcagcgaccttgcccgccccgctacgggcggaggtgcgcttgggagcgccctcctgcccggacttctgcgcggccatctaactacgcctcggtgtggggcaggatcgactcgaccatgccgtccgggcgcgggatcacgtggacgctcagcagctcgcccacgcgctgggccgcggccgcgccggcgtcggttgccgccttgacggcgcccacgtcgccgcgcacgaagacggtgaccaggccgccgcccacgcgctccttgccaatgaggcggacgttagccgccttgaccatcgcatcggcggcctcgacggaacccaccatacccttggtctcgatcattccgagtgcctcagtcgtgcttgccatctgtgttcctccctgggtttgccgggcgctctgcccgaacttgattcctcttgcttccgctcgctactcggcgtggggcaggatcgactcgaccatgccgtccgggcgcgggatcacgtggacgctcagcagctcgcccacacgctgggccgcggccgcgccggcgtcggttgccgccttgacggcgcccacgtcgccgcgcacgaagacggtgaccaggccgccgcccacgcgctccttgcccacgagcctcacgttcgctgccttgaccatggaatcggcggcctcgacggctccgaccatgcccttggtctcgatcattccgagtgcctcagtcgtgcttgccatttttcctc

SEQ ID NO: 156 - DNA, 5100 bp, Unknown
  Metagenome-assembled genome
cgaggcccgcgggttggagggactcgagcgtcagggcgtcgctgccggcggagctcgtgtcgttcctggactccgagcgcccggcagacctcgccgccgacctgagggtgctgcgcgacgagagcgcggagcgcggctggtccgccgcggtggagggcatgtcgcgctcgctcgcggcgaccggcggcctcgaccgcgccagcgtcgcgctgtccgcggccagggccgcctcgggcgacgagcgcgtcgagtacgacgaggaggtcgacctgggcgtctacgacggggcgctgaggctgctcgagggaggcggtcgccgtgccgcagacgagctcggagcgtgaggccgcgcaggcggccttccgcggcgccgcgagggcgctcttcatatccggcgacaccatcggcgccttcctcgacgccgcgacgcccggccaggtcgcggcgtgcacctcgatgctcgagtcggagatcgcccaccgcgacagggcgaagcgggcgcgcctgcccgggcaggcgaggttccccgtgccgaagtccatcgaggggttcgactggtcgaacgtcgccttccccgacggctggggccgcgaggacatgtgctccctcgcgttcgtgcgcgacgcggaggacctcgtcttctacgggcagacggggcgcggcaagacgcacatggccacggcgctcgggatcgccgcgacctcggcgggctacccggtgaggttctggcagaccgcgcagctggtgccccagctcggcaaggccaagcgcgacggcacgctcgacaggctgctcgccgacgtggccaaggcaaggctcctggtcctcgacgagttcggctacgtgcccttcgacgtggacggggcgaggcttctctaccaggtgatatccgagagctacgagaggaggagcgtgatattcacgaccaacgtcgagttcagcaggtggggcaccgtcttcgcggacgacaagctcgcggcggcgatcgtcgaccgcgtcgtgcaccacggcaggctcgtggagttcgggggcccgagccacaggctggaggagagcctgatgctcgggaagtcgggaaggtagggaggcgccggcgtgcccgtgacgaaacccgaaaaactttcgtgcacggacccgaaagaaatccatgctcaaaggggactgcggtgggaatcctggaccaaaacgggacaggaaggacgccgcatgtacagcgctgagcagagaaagatcgcgatagataccttcgtcaagttcgaccatagctacgccgacaccatcgcagagttggggtatccgacgagggcgtgcttgcgcaactggtggaacgagtacagggataccggcgaggtgcctataagcaagttcaccaccaacccgagatacaccgcagagatgaagcggcgcgccgtcgagcactacctcgagcacggcaggagcctggcaaggacgatgcgggcgctcggctaccccaagagccgcgaggtgctcggcgactggatagacgagatcgccccggggcagcgcaagtacaggggcccgaacccgaagcgggaccccgttcccgtggagaagagggtgcaggtcgtggccgagctggaggcgaggacgggggcagccgcggagatcgcggagaagcacggcgtgtcgcggacggcgccctacatttggcgcagggagatcatgggggataatggcggggaccccgagaagaaaggcgtccccgtgagcaaggaatacgacgacctgcccgacgacatcgaggtgctgcaggacatgctgcgagaggcgaagacgcggctcaggaaggtgcagctcgagcttgacgtgcgccaggcgaccctcgagatagtaaaaaaagacccgggcgccgaaccggagctgctgaccaacgcggagaaggcggcgatggtgacggcgcttaggcccaggtggaagctctgcgaggtcctgcccgtggtgggtatggccaagagcagctacgagtacgcgaggagcgcccaggccaagggcgagaccgaggagcacgcggccgcccgcaaggccgtggtcgaggcgttcgaggccagcggcggcacctacggctacaggcgcatatacgcgcaggtcaacgccgacgcggaggacggcgcggcgatcggcgagtggaccgtgcgcagcatcatggaggaggagaacctggtcgcgagggccgccaagaagaagcgccggtacagctcctacgagggcgagatctcggaggcgccgcccaacctcttgcgcgacgaccggggcaagcatcacttccgcgcgaacaggccgaacgagctctggataaccgacgtgaccgagctccgcatccccgccggcaaggtgtacctgtcgccgatcgtggactgcttcgacggcatgccgctgagctggtcgatctccacctcgccggacgccgagatggcgaactcgtcgctgctcggcgcgtgcgtgtggctcaatgagggcgatcaccccaagatccactcggatcgcggctgccattaccgctggccgggatggataaggatatgcgatgagaacggcctggtcagatcgatgtcgaggaagggatgcagccccgacaacgcgaggtgcgagggtttcttcggaagattgaagatagagttcttccacggctgcgactgggccggggtcacgatcgaggagttcatggaaatgctcgacgcgtacctgaggtggtacagggacgtcaggatcaagagcgacctggattacaggagccccatgcagtatcgaagggatttgggcctagcagcataggatggttttggtccaggattcccaccgcagtcccaagtcgaaagtcaggcttgactaaacacagcccgagcaggaaggccttccagctccccccgactccacgtagccctcctcgcagccgatgacctcgcggaagcccttgtcgttcatgcctatggccacgagcacggcgacaccctcgtaggccccccagttcctctgatgtacgtcccgtcaaggtaggcgtaggggtagtccccctcgagcctgcggtggcgccaatcgtcgacggcgccgaaggcttcgcggttcagcttggagacggtagagggcaagacgctggcgccccagaggatctcggacacgtcctcgatcctcctggcggagacgccggcaaggcacgtccccgtcatcgcctcctcgacggaggtctcccgcctgcggtagcgctcgatcaccttggacgcgaaggtcgcgcccctcagcttggagacgctgagcgtcacgtcccccccgacgtcgtggtgaggttccgcccgtagtgccccgacctgtacgcctgccgctcgtcggtgcgcccgtggcgcccggcgttcacgatctggtcggcctctgcgtccagcaacgcgttgagggcgtcctcgacggacctcctgacgaggtccccgaggtactccttcagctccgcgtcgtcgaatgacacgatttcgtgtgacatggtcccgtctcccggtgtgagtggtttgcttggtcgcttccaatcgtaccgaggcggggccatgtccctttatgcggctatccggttttcaaaagtgcgaaagaaactgaacgtcatcgcttggggttccgtcaatagtctttcgcactttcgtcagccagggttccgtctcggtcgtcggagctaggattcccgttgtcccttgagaacctccctctcgtcccatccgtccagcaggtcggtgtcgaggtaacgcctgctgccccagccgccctcggcaacgtacttgcacctggccgccgcgagcatcaccgcggcgtcgcccgcggggaagctccccactgcgtcggtcctgcgcttgatctcccggttcagtcgctcgatgccgttgttggtgcgtatcctcctccagtgctcgggcgggaagagggcgtaggtgagcgtctcctcgacgccggactcgaccaccctggccgcggactcgagcttcgaggccctgagctcggcggcgacctccccggccttggccaggcacttcgcgcggctctcctgcgcatggatcgcctcgggcgaggcggccacggccctcctcctggtcctgggcaccttgtcgagcacgttgcggtagaagtggacggtgcagcgctggtacatggcgtgagggaacacgtcctggatggcgccgagcatgcccgcggacttgtcgcccgtgaacatgcggacgcccctgaggccccgctccctgagcccgagcaggaactgcttccagctcccctccgactccacgtacccctcctcgcagccgatgacctcgcggtatcccctcgagttcacgcctatggccacgagcacggccacgccctcgtaggcgcctccccagttcctcttgatgtaggtgccgtccaggtagacgtagggatactcgcccgagagggtacgctggcgccactcgtcgacagccccgaaagccttgcggttaagcttggagaccgtggcgggcgacacgctcgcgccccacaggatctcggacacgtcctggatcctcctggtcgagacgccggcgagatacatctccatcatcgcctcctcgacagaggtctcccgcctttggtagcgctcgatgaccttcgacgcgaaggtcgcgcccctgagcttcggtatgttgagcgtcacgctccccgaggtcgtggcaagcccccgcttgtagtgccccgacctgtacgcctgcctctcgtccgtccgctcgtagcggccggcgttggcgatttggtccgcctcctcgtcgaggagggcgttgagggtgtcctcgacggtctttcgtactagctccccaaggtactcctgcagcttcggctcgtcgaatgatactatctcgtgtggcatggtcccgtctcccttggtccgttggcttgcttggtcgcttccaatcgtaccgaggcggggccatgtccctctatgtggctatccggttgtcaaaagtgcgatccgagagtagcgaatcgtgcgggtcgcggtaacctccccgcacccgcctgacaccactcggggtaccatggggatgccaaacatagatttgcccaagcggccacccggtcctatgtttggcgaca

SEQ ID NO: 157 - DNA, 4400 bp, Unknown
  Metagenome-assembled genome
ttggctcgttcttctcgcccaccgtgcgcttgtcttgcgttgcgttcgtcatcgcgccgcctcctcgatcgcggcaggtacgaggtaggttgcgcagttcatgggcgtctcgtacacgtccacctggctgacgggcaggccgcgcgcgatcaggcggtccgcaaagtaacgtgcaaggttttccgacgtggtgcggaacggcagcatcatgagggtgaagccctcctcgcgcaggcactcgagcgtcttgggcatgagcgagccctcctcgaccaggaacatgtggtcaaagcggtcgacctcctcgcgcaccgtgcgcttgaagcggccaaagtcgatcaccatgtccttctccgtgccggcggtgcccagcgactcctggcggatgtagaccaccacgcgccagcggtggccgtgcaggttctcgcattttccctggtagtcggtaagaaagtgcgcgccgtcaaactcgcgctccgtcttgagctcgtacattgggcctcctacctttccgcgttggcgccgggccaggggcgccttccctcgtcgtcgaacacctggaccctgggcctgtggtcgtgccggccgcgtgggcgcacggggcccgcggcgttctgcacgccgggacgcaggatgcccgcgacctcgccggccgtggtgatggacccgcaggcaacgtacgaggttccgtcaagcgcgtgcacggcctccgccacggagccgtatacggcgcgcggctccacgccggcgcggcggaaggcatccgcaagctcggccgccggaagcgcgcggtcggagctggtctgcgtcacgtacacggcggggaactcccccgccagcgcgttcacgatgccctggacgtccttgtctgccagcacggcgcacaggagtgccggcctgctggccacgttagggtccacgccgcggaccgccgtgaggaaggtctgcacgctctgcgggttgtggcacgcgtcaatcagcacgggcgggtcgggaaccaccaggtcaaagcggccgggcgtggggcacgtcaccacggactggtacagcgcgtctgcgtcgagagcgcgtcccaggaagccctccgcaagcgcgacggcgcaggcgatgtttgcggcctggtacgtgggcttgagggcagaaagctcgcggtacgtggcaaggggggtcgtgacgtcgagcgtgagcgcgccgccaatgcggttgggacgctccgtcaccaggtaggaggcgtgcggcaagtccgcgtgcgcgcgcgggacgccggggtgcatttctcccctggcgtcatccgggcgcacggggcgcagcagcaccggcgtcacgccctcgcggccacactgctccaggaagacgtcctccacgctgtcgggcgtcgccgtgcccacgcccagcacgcaactgcgcccgcgcctgatgatggcggccttctcgcccgcgatctgctccagcgtgtcgcccaggatgcgcatgtggtcgagcccgatgcccgtcacggccacggcgcggatgttgtgtgccgccgaggtcgcgtcccagcggccgcccatgccgcactccagcacggccacgtccacgccggcctcggcaaacgccaccagcgcggccacggtcagcaggtcgaactccgtcacgtcgtacgggcgctcgcccgcggcgctccgccgcgcgttcacgcgctcgcccgcgaccacggccgccgccacgccgcgcgcgaaggcggcctcgctcacgggatggccgtccacctccatgcgctccgtaaagctcacgagctcgggcgaggtgtacagcgccacgcgcagcccctccccgcgcaggatcgcggccgtgtagcgcgccgtcgaggtcttgccgtttgtgccggctatctgcacgctcgcaaaggcgtcgtcggggttgccggcctccgcgagcatgtcctccacgctctcgagcaggggctgtatgccaaatctctttgtgctgcgaagcgcgtccatcgcctcgccgtacgtccaatcgggaatatcgaacggaacctgatacaagctgctctcctcaaagttgcgggcggctcacggccgccctgcggaacagtagcattctagacgatatgtagcggggcggctggggcctcgctcgcgaagcaggggccctctggggggcaacgtgggttaggcttcagctgtcagcagtcggcttaccacattcgcgggaggtcccagccatgatctatcgtaccagcgtagggctcgacgtacacgcacgctccatcgccgccgcggcgttcgtgccggagacgggggaggtcgtgacgaggtcgttcggctacgacccctcggcggtcgccgagtgggtcctgtcgctcccgcagccgtcgaggtgcgtctacgagtccggccccaccggcttcgacctccagaggaggctggagaaggccggcgtcgggtgcgtggtcggcgccgtctcgaagatgctccgcccctccggcgacagggtcaagacggacaggcgcgacgcgatcttcctggcgcgcatgctcgccgtcggcaacgtcgtcgaggtggccgtgcccacggaggccatggaggcggcgcgcgacctggcgcgcgcccgcgaggactgcaggcacgacctgacgcgcgcgaggcacctgctctcgaagttcctgctcaggaaggggatcgtgtacgacggcggcggggcgtggaccaaggcgcacgccaggtggctctccgggctcgagttcgcggaccccacggagcagctggtcttcgacgagtacctcgagggcgtcaggtcgctcgagctcaggcgcgacaggctcgaccgggccatcgcggagagggcggcggagcccgacctcgcgccgacggtggcggcgatcaggtgcctgaggggcgcctcgaccgtgacggccttctccgtcgccgccgaggtgggcgacttctcccgcttcccgacggcgcgctcgttcatgtcctacgtcgggctcgtcccgtcggagtcatcgagcggcgagacggtgtcgcgcggggggatcaccagggcgggcaacgcccacgtgaggacgctcctcgtggaggcggcgtggcagcacgcgcggcccctcagggcgctgtcgccgaccgcggcgtccgcctacgcggccgtgccggcgggcgtctccgaggcggccgcgcgcgccaacaggcggctgcacgacgggtgcgcccacctgaggggccgcggcaagcccgcctgcgtcgtgaacacggcgatcgcccgcgagctcgccggcttcgtctgggccctcgcgcgcatggccgcgtaggcgcgaacggcgccggcgccgcccgaaacaggcgtccccccggggcgccgtgcctgcctcgatggcgcgtggggcaatccgcgaaaccgctatgcgcagccctcgcgggccacgcgcgaccctagacacgcgggactccccagccgaaagcatcggaatgcgctacccaacgcgcggatatcagactcgcagtcgtgcgtcgaatcagacacgccagatcagcggcgaggcgcccccgggaccacatagcgaaccgccccggccccgattcccctcggggttggggcggatttggcacttgacaggaagagctacatatcagcggttggctttgtgggcgagaaggacgcgcgtcccccgccccgcggccgctgccaagggggccgtccttctcccctgcggcctgcgcggcggccagacgccccgccgcattgggcggggcatcaatttgcgcggatgacctgcgcctccgtaacgaccgcctgcaccggcaggtcgtgcgcgtcgagcacgagctcgccagcagcgctgagctgcgcctcgcgacagatgccgacggaggtgccgccaaagcccgcaaggaaggtgtcatagaagccgcccccatagccaaggcggtagccgcgcgcgtcgaacgtgagccccggcacgattgcgagcgcgttcgacgcggcgttggggtcgagctccgcggtggggtcggccatcggctcgagcacgccgaacttgctgcgctcaagcccgtcgaggctctcgacgcggtaccagcgcatcagccgcgtgtgcggcacgcagcgcgggagcgccacgaccttgccacgcgaccatgcgtcgcggatgatgccgcgggtctccacctcgtccccgatggagaggtaggtgagcaccacgcttgcacccgcgtaatcggcaagcgaggtcacacggctcgcgatggcggcatccatcgcggcccgtgcctccgcaccaagctcgcagcggacgtcaataaagtgatggcgcagctcgcgcttacgtatatcaatcttcttgtcgcccattgcaagcaccctatgccgggacttgattattcggagttacgtcaaacctgaatcccaaggcattc

SEQ ID NO: 158 - DNA, 43073 bp, Unknown
  Metagenome-assembled genome
gcggattcgagaacggaaggtgcgagagccggatgcttgcggagaggtattccgcctgggtgctcgagggcatgccgatgggcgtcgaaaacccggaaagcgactcttgacatctataggagcgtcggttttgcgacgagtacggctacgacccaggcgagatgccgggcggcggccacgatgcgttctgagaagctcacgaggaagcgcgcctcagagctcctcggagtggcaaggtccaccacctattacgagcccaaggagaaggtggaagcaacgtctgatgaggacgagcgcctcatggccaagatcgaccggatacatctcgagagcccggcctacggggcaaggaagatcgcgagggtgctcagccaaaggggatatgaggtcacccgctggcgcgtggggcgcctcatgggcgagatgaacgtgaggccctgctgccccttgccgtccctttctgtgcctgccgggcactccaaaaggttcccctacctcctgaagggcaaggagatctcgtttcccaaccaggtgtggtcgacagacatcacctatgtccagatcggaggacgccacatgtacctcaccgccatcatcgactggtacagccgatacatcgtctccttcaggctctctgacaccatggtggcaggcgaggtcgtgaggtgcgtagaagacgccttcagacggcacgggacgccttccatcatgaactccgaccagggatcggtcttcggctccaaggagtatgtcggcctcctcgagagcttccacgtcgtccagtccatggacggcaaagcccgctggcgggacaacgtgcttgtggagaggtggttccgcaccctcaagagcgagtgcctgaggacggcggaatactcaactccctcagagctcgaaaggctgatatcaggcttcatctcctactacaacgacacaaggatccatcaatccctcggctacgagaccccctcatcctggtacttcacaggcatcaacacgaaggccgcctgacgatctaggatgtggtcaccatcaaccatgggctttcgtaaggaacagctcattcgtgtcggacatactcagccagttcactcggtgattcgcgatttcgcacctctaatcaaaagtattcgacacagcgcctgccgtctcaacgattagctgggaatctaggccatgtatccttcttgtcagatcgttcccctccccgccgtcgttaggtgttcctgacggcggggagggcggccgcgggagggcttggctgcggccgtggcgggaggagattggggccgcccgggacttccccgagcggcccctttccgaccgtgagcggttttttatcgtcctgacgtcctaggtcacatgcgctccgcccactgccagacaccgacgaggtggcgcagcttggcgcggcgctctcccgtgatggcgatggctacggcgtcgtggcgtatggcgtccacgtcgccgtggtccgcgaggtagaggaggcacgcgtggcgcatggcggcgacgtcgtcgtccgtgaggtcgagcgtcggcagggcctcggagccaggctccatcgtcgccctgacggtgacgaggacggtctcgccgccgtccgtggccacgatgcggtcgccgtcgacggtgacgtcgcgccagcccctcccctcgaggtagtcggtgcagaggtggagcgccgtgtcgcgcagctccttctcggtcatggtggcgttctcgttctcgcttgtggtggtcatggctgaccccttcctaggacgtgggggctccctttgcccccgttggggcccagggagcaagccacggcgccgcgggggacgcgcccttgcgggcgtggcgctgcgggctccgcggtgacgtggcgccagggggcgggaagaggtgcttgccccctgtgctaccttggtcccaacgggggccccggaggtcgtgcccttgccctttacgctcttcgcgttttcgacggggcgagaggataggggacccctcacagtccccggcgcagcggcgtgttggaaacgctgctctatgaaagaggagcggggacgcgtggctgatatgtcacgcgtccccgcggcgattctccggttgtaacctgcgtccgcgtgatggattagtcacacggacaagctgccgttcatatctacggaagcctgcccttgtcgaggagctccttctgcacagtcctcctgttgaccctgagaagaccgccaacgcggatgtgcgggagggcattgattaactggtagctcttcgtcctcccgacgccgaacacctcttggatgtccctcggcccgagccactcgggcctgtcgcagagcggcgaagtgtccgaaagtgacctctctgtgggacccgttggcttcctgtccatctcgcgtacctcctccttcgagattccgtgccatgccgaaacgttacgccgcatgacgaagtgtgcgaccgtcgcctcggggcgatgcgtttcccaggcttcccatgcgttccccaccagaaaggggacacaaccgcccggctacacaacgcgcagcatcgactcgttcccttcgtcttgcccgtcgccgggtcttgctgccatctgctcggcaatcgtcctggcggcggacctcctcgcgtgcgggtcggcgctcgcgtatgtgttgagcgtcatcgccgcgttcgcgtgacccatgagcgagctcacggtcttgatatcggtgcccgctgcgacgaggtaggtggcgtaggtgtgcctgaggtcgtgcagcgtcaccctcctccccgtggtgcccaccaggtcgagcatcttcgcgatggaggcaaactccttcgtgaggcggtctgggtagtagaatgcgccgctggagtcgcccaggacgtagaggtcctctattgcctctggccttccgccactcagcgtgacgaggcggcgcctgcgccttgcgagcctcgacgccaggtccggctcgagcgggacctcgcgccggctcgttggcgtcttgggctccttcaccacagccttgccctcgcactggcagactgcgaccctcacccgtaggacgccgtggtcgaggtcgacgtccctccacctgaggccgcacatctcctccctgcgcagcccgcaggcgagccccagccttatcgcgagcgttacctcggtgtcctgcatggagtcgagtgcgagcagcagcctctcacgcccattggcgtcgagggcgttcggctctctcgcctcgcgctttggcggcttgatccgcctcgtaaaggggttccgctcgatgattccgctgtctgccgcgtactggagcgcctgcttgaggaagcgatgtgccttggcgaccgtgttgttgcagagcccgtcctcgaggagcgccgcctgcatctggaggatggtgtccccggtgatctcgtctatccgcatggcgctcagatagcgcgagacgtgcttcgcgcagtggcggtagttcgcggcggtggtctgggcgattcctgccccgctctcgagcgagcgaatgtaacgctcgagaaaggtgggcacgaacatatcctccctcgtgatgcctagggggagctcctgccggcgcacctcgtcgtcgagctcttttcgtatctcgtctgctctcctcctagcggcacgcttccccgacgcgcgaaagctacgggtggtctggtgcctcttgccgtcttccgtgcgggagtatcggcacttccagcggccatcgccgaggtctatcagcgacccctcggaccagatgtctccttttgcctgatacatcccctacctccatgccatgctgttgcgggcgcctctgtcggtttcctggccctcggaacctgcaagcggagggaccatgtatgcgaaaagcgacactccgccccgagtgcacgcaggtgcacgcgaagagtgcacgaggagtgcacgcaacccgcctgaactcgatacgaaatgatacttggtggacggtcatctggcctgtctaccagcccttttgacacgatttggcatgaatgagcacgatgcggataccccatataagcgttctgacacggaagaggtcagaagttcaaatcttctaacgcccaccataaactcgcaggtcagagggtatgtcctctgacctgttttgtttggtccacttttggtacgcgattttggtacacactattttgcgagataccaaatgcgctcgacaaccctgtcattccgcgtggaattgcgcatagtgcgcgcgtaaaaacggccgtaaaattttgcgaccgtttctccaatagccaaggcgtatcgcagaagtgacactacctcgatcgaagttggccagcttaagctgaaggacggcatacgtacgagaaggtcgagggtccgaccaggaacacttatgagtctcgatgttccaagatggggttgagattttcgagagacagccaaagtctgaggtttacgagaactcgattcgcgtgacgcttcccctggcgagcaaggaactgcttctctcggaggacgagaagagagtttactgcgagctcgtcggaaagtcccttcgcatgtcggagctgactgcggcaacgggttttgggaggacgaaagtcctttccatcctgagggcccttatcgatgggggtacgcctttgtctcctgggctggaagaggggcgaggtattctgcttcaagataggttctgttcgagcttggactccctcgtcagcatcgatatcgagcctttgaaatgaaaatggcggccgaccaccacgagctgacacggaagaggtcagaagttcaaatcttctaacgctcaccataagcttgcagtcagaggctatgttctcttgtctgttttcgtttggtgcgcatgtttgcggtaccgacgggcgagccgccagtcgcgaccgtcttcttcgtcgactggtgcgaaatctcgctggtcgcccgttcccgtggggaagtggctggatgccctgccttgttgtctgcatagcttgcatgctaatagatgacggattctgtggtagatatgaccgtttaaggtggcggattctgcagtgaatcgcgataatataggtggtggattctgtagaaataccagctatatcgtttgacctctatctgattggtggtggctaaatgcacagtctctacgaacgcaagctctatcagaagatgcttgaatggaagaacgactccaacggtcgcagcgcccttctcatcgaaggtgcacgccgcgtaggcaagaccaccatcgttcagaagtttgcagaggaggagtaccaatcaagtctgtttatcgacttctcccaagtggacaatgacgtgcgcgacatctttcgtaatcatcgtggtgacctagacacgatgctgcgtatgctccaactctactttggcgttgacctgactccgcgtcactcggttgtaatcttcgacgaggtgcagcagtttcccaccgcccgtgagatggtaaagcatctagttgcagatggcaggttcgactacatcgagactggttcgctcgtctcgattaaaagaaacgtacaggacatcgtcattccgtccgaagaggagcgtcttcagctttggcctctcgacttcgaggaatacctttgggcgctgggacgcaaggcgttggcggacgaaatacgtcactcccgggatagcctcgagccgctgcctcaggcgcttcacagccaagccatgagattgttcgacgaatacctccttgtaggcgggatgccacaagcgattgaagatttcctcgagacggggaccttcgtgcgctgcgacaagacgaagagacagatccttacgctctacgccgaggacatggagaagttcggcggtcaagatgcacgacgtgcctactcgattttcatggggattcctggacagctctctgcgggcagcaagcgattcaagttctcttcgctgggcagtggctctcggtacagggactacgagtccgcattgcgttggctcgaggatgcccatgtcgtcaatgtctgcaggctctgcaatgaccctaatgtgggatttcgactcactgccgacgaaagcgaggatagctcgctcaagtgctacatggccgacactggcctcctcgtctcaagcgtgttcgacgagggtccagagactgaaggcatctaccgcgcgctccagtttggtaagacctcgatcaatgggggcatgttcattgagaacgccattgcccagcaactgagggcgaacggaagaccgctcttctattacacatggcaagagcctcctatggcggagggcaagaagccacggccgcgcgaggttgactttctcataacgaagggtttctcggatgcggcggggaagcccagggtgtgtcctatcgaggcaaagtccaccaaaacctactcgacgatttcccttgatgacttcaagaggcacttcggcaagcgggtgggtgatgaggtggtgctgcatcccaagcagctcaaggtggatggtcatcgtgtgtatctgccgctctacatggccttttgcatttagcaagtgctgttatctcggatgtgggcatccatggcctgccagcagcgctccgccaggtcgtttacggcgtccctgcgcgtcagagtgggatccggccagatggctggcagacacgtgagcgtcaggcacggccgacgcttgagcacacgccataggccccggcgtgcccgctgcgtgaccaccagcggcaccacgggcacacggttcctcacggccagccagaacgcccccgtggcaaacggccgcagccgctcgcagtagggcataagcgcggtctccgggtacacgtgcaccacgcgtcccgcgcgcaacgcctggctcatcgagtgcgccatctcgcccagctggcggaggtggggcgataccggcaccgcgcccgcccaccgcacgatgtgcgcgcagaagggcagcgcgaagttgtcctcgatgctcaggatgtaggagcgcctgccccgcagcgcctgcagcaccatgccgcagtccagcacgtgcacgtggttgcacacgctcacaaagccgccgcgcagccgcttcacgttctggcgccccctcaggcgaaaccccagcacgacgcgggtgacaagggcggcggcaacgtccagcaccgcgcggaacatgcgggtgcccacgcgctggagcggagaatcccgcaggtagtcgaacccgaccggggtggaaaacgttccccagtgcggcatgtgcacaacatgctccggcttggccttgctcacgtgctgcgggttcggctctgcgcggcgggcaggctcctgcggttggcatggcacgttcttctcgcccgaaggagccggccgctcgggtgacgcgggtgatgctgctggctttggtggggcgagaagagccatgtcgtcgcggatgccgggtgccggcgtgtggccgtcgcgcgcgtcacgcgcggcctcctccagcatgcggcggaaccgggcgacgcagtcgcgcaaccggtagcgctcggcctcgcgggcgtaggcgtggcccatgcgctcgagctcgtcgggatgttccagccaccagtccagcttacgggccaggtccgcagcgtcgccggccttaaagaccgaccgatcgtccagcgcgaactgcgacgttgccgaaagcggcgagtccgaaaccaccggcaccaggcccgtggcgatggcctccatgcagctcatggcctcgctctccatgtcggaggcgtgcacgtacacgtcggtctgggccagcacgtcgcgcaggcgcggcgggtccagaaagccaaagcgcgcgtccacgccaagccgacgcgccagccggcgcagcccgcgctccgtgggaccctggcccgccagcacgagcacgatacggtccctgtgatgcgaccgcgcgacggcgcgcagtacgatgtcctgccgcttctcgtgcgagtagcggcccaccatcgtgaccaccagccgccccacaaggtcgccgtccttgggcaggcgccggtacgtgaatgacgggtcgatcccgttgctgatgacgtgcagcgcgttggtgtaaccgtgcgccaccagctggcgcgccatcatgaggctggggcactgcacgtggtccacgtagcgatacaggtatgtgcgatccagccggaagatgaggttgttgagcggcgcgacccgccccatccggatggagctggaaaggttctgcggctgcacgtggaaggccgcggtcgcaggcacccccatctcgcgggccaggcgcgccgcgtggtaggagaggtccgacgccatcaccaggtggacgacgtcgcaccacttgagcgcctcgcgcagcgcgtcgtcgtttggacgggcaaacgccatgccctgctcgtcgataagaccctgcaccagcgggtagcgcagctcctgctgggggtagacggcaatcttgaacccgggttgcggcttcgcccacgcgacaccgtccgggccgggcgccgcgtcggatttgcacacgacgcgcacgtcacagccagtctcctgcaggatccgcgcgaagcgctgcgtcgtcatcgtggtgccgttggtggccgagaggaactggtccatcaccatcaggaccctcatgccatcgcccccaagccacgttgcaaaaacccacacggatgtaggtatacccacaggtgttcagataatacgagccgtctgacacgacgtcaggggcagatgccgggtcttgccgcaagtgctagggcatctcccgggtaggggatgacgtacgcaagacttttccaatagcccgcctttgggccatatggggcaggccatgcaataagaggcgagaaggacattaacgggcttcgaagatgccacgcgtgatcctctcgccgagagcgcccagctcatccgcgctcagcctctggtctcctgatagccagagcctgatcgctccatagatgccgttccagaggaatgtcctcacgagcggcacttcctcggggcggtagccctccggcttcatggagtccttgaagcgggcctcgaagagcctgttcgcgaaatcggagtcaggcccgtaataggagaacacgaggcgcgcctcgggggagtgacaagagatgcttcggcagatggcagctatctgcttcgagagtggcacgctttcgggatggtctcccagtgctccctccatctcgtcaatcacgtcgtcacccatctcgtggagcacgtcatactggctgccgtaatgggcgtagaacgtggagcggttgattccggcctcctggcagagctcgctgatcgtgatcttgtccacgcccttttgctgggcgaggtcgcagagcgcgttcttgagaagcatcttcgtcagcttcacccgctggttctgccgtcctgctttcttgctactggaatgctcttctcccatggccaccagatcttctttcttcggtgtggaatcgacaactgcgctcgttctgtcggacttgcatctttcttaacgcaaccgtttgttgtgaaaacaacacttgtctattacattcatcgatggtactggacatcggcgagaggggcaaggcatgaacgagcatctgcttcagaggggcaacatcggaggggtcgagctgaagaaccgcatcttcaagccggcggcccaggacttcccgacctatgacgggttcgtgaaccaggaccttgtggagttctgcgcagagcaggcgcgtggcggtaccggcctcatctacacgggcctcttcaacgtgaacccgcacgagagcgagatgcgcacaggtcatcctcgcatcagctcggacaagtatctttgcggactcagcaagcttgcccaggccatccaggagaatggcgccaaggcagcgctccagcttgggcactacgggtctcacggcgagccggtcgaccccgcctatggctggaggtgcgtctctcgcgatggcgtgaagaacgagcactggctgccgattctcttcccgcagttcaatgaggggaactatccccacaaggagtacgccgaggacgagatccacgagcttgttgccttttacggcgacggagccctgcgtgccaagcgtgccggcttcgatatggtcgaggtccactgcggcaacatgcacggcctcaacacttggatcacgcccctcatgaaccacaggaccgacggctacggcggctcgcgcgagaagcgctgccgcattctcttcgagattgtcgacgacatccatgcaaagtgcggggatcgctatccggtgaccgtcaggatcaacgcggccgatatcaagccgggcggtaacaccgtcgaggacacggcctggattgcccatgagctcgaggagcgcggcgtctctgccatcaacctctcctgcatgaagagtggcatgcccatgcaggtgccgatgggcgagattcttgaatacgccaagccggtcaagagcgccatctcgattccgctcatgattgcgggctccatgaacaagcccgagatgggcgagaaggccatcgcggatggcctctgtgactatgtgggcatggcccgccagctctatgccgacccgtattggccgaagaaggtcgcagagcagcgccccgaggagattcgcccatgcctgcgctgcaacgagtgcctgaatggtgccgggaatgccttctgcggcaacctccagtgcacgatgaatccgcgtctcggcaaggaggactcccttccgatcgtgccggcgaagcagccgaagcacgtggccgtcgtcggcgccggccccgctggcatggaggccgcacttgtcgcaagcgagcgcggacacaaggtgacggtcttcgaggcgaggaaggttggcggacgcgtcaacgaggcggccgtgccttccttcaagtcggacctgaagaggcttctttcctacttcgacacgatggcggggaagggcatcttcgaggtgaggcacgagaaggcgaccgcagagagcctcaagcagtatgacgccgtgatcgtggcgaccggcgccaagaaggcagagctccatgtgccgggctgggacggcgagaacgtccagaacgccatcgactggctcgatacgcagaagctcaggggcgactcggtcgtcatcatcggtggcggcagcgtcggtgtcgagaccgccctccatatcgcacagggcggacgcaaggtcacgattgtcgagatgaccgacacgctcatgcgtggcgagtatgccgtgacgcgcgggatctatctcaacatgcttgccatgctcggcgtcaccgtgctcacgagcacgaggctcgagtcgattgccgaggacggcgtcacggtcatgagcgatggcgaggagcggaagattcccgcaaccgatgtgctcatgtcggtcggtctcaagcccgatttgacgctccgcgacgagctcgatgcgctccacggacccgaggtgctctatgcgggcgactgcgagcacgcgggcctcatcttcgacgccatccatgccggcttcattgcaggtagggaagtctagcagcggcggaatatatctttcaccttgcggcggggtcaggcagcttgtgcatgcctggccccgccgccattaggttgtggatgaggctagcgccaatcgtcgaggatcaataaggggactgtagggctgtgcattcctgacgcggaagagtccggaagttcgtctgctggcagattggccctacaggtaggtgaccgtctgcccgaggtccttgcgcgagccgtggttggggagcggtcccacgccctcggcggcgtagcccaggtcgatggcgcagagcacctcctcgttcttgggcaggccaaacgcctcggccgcccttgcggggtcgaagaggttcacccagcagctgtccacgccggcgtccgcggcggcgaggatcatgtgggttgcgacgatgctcgcgtcctcgatgccggagtcgcgctcgccgcccgggtaggtgaagacgttcgtgctgtcgaaggcgaccaaaaggacggtcggcgcaccgtagcggcagcgcgtgaggccgtcgaacttctcgagcgcctcgggggagcgcagcacgtagacgtgttgctcctgcaggttcttggccgtgggtgccagccgcccggcctcgaggatggccgtgaccttctcgccctcaagtggacggtcggcgtacttcttgcatgagtagcggtttgcgatgacgtccttgaattccatggcgctcccttcgtcgcgtggttgcgtccagtatagggcgggggcgctttcgcgttgccgcgggaatgggctggcgtcgccgctagctcctcgccgctagccccagagcgcgtggagggcgaggtcgcggtagacggcgcgggcgcgtgcgaggtcggcgaggggcacgtactcgttgggcttgtgtgcgacctccaggctgccggggccgtacgaggcgcagttggggttgtggcagagccccgccaccaccgcggaatcggtgtagcccgtgaacgtgcccgtctgggcctcctgaccgcacacgcgccgcgtggacgcgagcaccgccgcgagcagcggcgagtccgggtgcgacgggatggcgggccggtcgcccgtcaccacgagggagccccgcgtccccggcacggcctcctccgccgcggcgatgcccttctccaccagggcacgcgcgtcggcgggcgtcgtgggcggcacgaggcgcatgtcgatccacgtggtgcacgagtcgggcaccacgtaggggcgatagcctccccttatctgcccaaacgtcacggtcgtctggcccagctccgcgtcgcgggggagggcgagcaccgcgtcgcgaacgtgcttgatggcctccgcgctcgcggccacggcgtccgcgcccctccacggggtgctggcgtgcgccgtgacgccgcgcatcgtgagctcgaaccacgtgcgacccttgtgggccatgcgcaccatgccgtccgtgggctcggtgtccagcacccactgcgtgccgtcgagccagccctcgcggatggccgcctcggagccgcgcatgaagtcctcctcgtcgcaggtgcacaccagcgagagcccgcgccgcggccgctcgccgcgctcggccacggctgcgagcgcgtccgcgaacgcgagcatcgcgcaggcgaggccgcccttcatgtcgcacgcgccacggccccacagcctgccgccgcgcacgacgccgccgagcgcgggggtgtccgcggcccagccctcgcccagcgtcacggtgtcaaggtggcagagaagaacaagctcgccgccgtcggcgggcccggggacgcgcgccctcaggcacctgcggtcgggtaggggctcgatctggtccagcgtcgcgagcggggcggcgccgtgccccgaggcggtaccgtgccccgaggccgcgatcttctcgcccagccagtcgcgcacgaaggcctcgatctgcccctcgtaggcaccggggtcggaggagtcggtccgcaccagccgctgtgcgagctccgtcgcctcgcggtcctcggccgcacccgtggccgccaccgcgcctgtcgtaccgttatccatcctgctgcatctcccgtcgccgctcacttgcggaggctcatatggcgtgcgatgtttcgcgtttgcttctgtttggcatcgcgttgggaccgtacgccggaaagtcgcccgcaccccttgacaccttacgtatagtcatatcagcaaacaaaaagtttgtgagtcagaaaaaacattagttctggcaaaggggtggggcgcacgcaggcgtcccaggaaggagagggatccccatgagtgagaacatggcacagggggccgccaaggacgacgaggcccaactgttccaacgcgacggaaagccatctgccaggctgttcgttccgctcgcgctgcagcacgtggtcgcggccatcgtcggcatcatcacgccggccatgatcgtcggctccgcgtgcaaccttcccgaggacgagcgtgcgctcctcatccagtccgccatgctgttctcgggcctggtgacgctgctgcaggcgcatcccgcgttcgaccgcatcggctcgggcctgcccgtcatcaccggcgcgtcgttcgcgttcgtgcccgtgctcaacaacatcggcggcacgtacggcatcgcggccatcatcggcgcgcagttcatcggcggcttcgtggccatgctgtttgccgtgttcctcaagcagatcaagaagctgttcccgcccgtggtcacgggcacggtcgtgttctgcatcggcctctcgctctactcggtggccgtgggctacatggccggcggcaccagcagcgcggacttcggcagcgccaagaactggatcgtggcgctcatcaccctggcgttctgcatcttcttcggcaacttcaccaagggcgtcaccaagctgggctcgctgctgtttggcatgctcgtgggctatgcggtcgcgctcgggctcggcatggtgaacttctccggcgtgggcagcgcctcctgggtcgccctccccaagttcctccccttcggcatcgagttcaggcctgacgccatggtctcgctcggcgcgatgttcatcatcgccgcggtcgagatgatcggcgacttctccgcggtctccaacggcgcgctcggccgcgagccgacgctcaaggagattcgcggcggcatcctgtgcgagggcatcgcctccaccgtgggcgcgctcttcggcggcctccccaccgccaccttcgcgcagaacgtcggcatcgccacggtcaccaaggtcgtgaacaagcgcgtgttcgcctgcgcggcgggcatcctcatcgcgtgcggcctcatccccaagttcgcggccgtgctcgacaccatccccatgtgcgtcatcggcggcgccacgatcaccgtgttcggcaccatcaccatgacgggcatccgcatcctcaccaagggcggcctcaccaaccgccgtgccagcatcgccggcctctcggtcgccctgggcatgggcatctcgatggtgagcggctcgctcgcgggccccggcatcccggcctgggtcaccagcgtctttggcggctccgcaatcgtggtgaccaccctcgtggccatcatcctcaacctgatccttcccgaccccgacggcgagaaggcccaggacgccaaggaggaggccaaggagctgggcgagtagccacagtcacgcagcctaggaggcaggggagaagagcgtccccctcgcgcgggcgggccggcagccagatggcagccggcccgccttgcgttgtcccgtgccgcgcccggccgcgcccgtggccctgcggcgcgaacgcccgctccgcacgaaggagggtccgcatgcgcgactgcgcacgcggcccccgccaacgtcccggatgcgaccacgtggcctcgtccttctcgcccgcggcatgccacgggaagagggcgcgagcccgggcgtctcactccgccttggaccccttggcctcgtccatgtagctgtacagcgtgtactttgagatgccaaagtagttgcacaccttctggccgctcttggtgacgaggaacgcaccggcgtcgttgaggaagccgatggccttgaccttgtcctcgcgcgtcatgagtgcgacgggcttgcccacgagccgcacggactcctcgatcagctcgtccaacaggtcggtcacgttgtgcgggatggtctccgtgacctggctctcctcgggctcggtgagcctggtgaactcgcgcagctcgttctccagcgcccagaagaggctggtgtcgtagttgatggcgaagatggcggtgggcttgcccttggagtcgcggaagaagatcgtggacgacttgaggacgcgcccgtcctcggtcttggtgaggtacgcgagcttgtcgtgcagcttggaggggtcagacttgagggccttcagcaccacgttggagggcccgtcgcccagctttcggcccgatacctcgccgttctctatggccacgatggtgctgtcggggtccttggactggaggtcgtgcaccacgacctcgcacttgttgccaaactgggcggcgacgcccttggcgagcctcttgaggaagtccaactcctgcttggtcacgatgctgcgttcccttcttgagcacggcccgtccggtcgtgctggcctaacaatctgtttggtttcaatcctagcaattaggtcggctttcccgaacggggatttgccgccttgccgcccacggtgcggaatcttgccgttcgccttacaaaaacgcaacgtctcgggaaccgttgtgcccaatatcgctaccgttcggcgcaaaaacctgccgtacgccgaggcccgtcgtgccgctcgcgcgtgtgacgtatattgcaacggagcaaaataaaagttagtaagcaagactaacttttagactgtacgggggagaagaactgcccccgcggcgtggtcggggggccacgcgcacgcgggaccggcgcccgcggcccgccctggggcggcgcagatgccgggggacgcggcaagagagggccgggtccactgccgttttttgccgtagctgatctgcggcgcgtagcaaggaggtctccatgctactcgtaggtaacggccgcgtcgtgacgcgagacgaggccaacccgttcgtggaggatggcgcggtcgccatcgaggggtccaggatcgtcgaggtggggaagtacgacgccctgcgcgccaagtacccccaggcggagctgatcgacgcccgcggcgggctcgtcatgccgggactgatcaactgccacacgcacatctactcgggcctggcccgcggcctctccataaagggctgcaaccccaccaacttccttgagaacctcgagcagcagtggtggaacatcgaccgtcacctcacgctggacggcacgcgcgcgtgcgcctacgtcacgatgatggagtcgttccgcaacggcgtcaccacgatcttcgaccaccacgcgagcttccgccagatccccggctcgctcttcgccatcaaggacgtggcgcaggagatgggcatgagggcctgcctgtgctacgaggtgagcgaccgcgacggcaagcagaagctcgaggagtccatccgcgagaacgcggacttcgcccgctgggcggccgaggaggactcggacatgatcgccgccatgttcggcggccacgcgctgttcacgctccccgacgaggccctggacgccatggtcaaggcaaacgacggcctcacgggcttccacgtgcacgtgtgcgagggcatgaacgacgtgtacgactccgcccagaggcacggcgtgagctcggtgcaccgcctcctcgaccacggcctgctgggcgagaagaccatgctcggccactgcatccacgtctcgcccgcggacatggacatcctcgcgagcacgcacaccaaggtcgtcaacaacccgcagtccaacgccaacaacgccgtcggcaccgcgcccgtgctcgagttcttcaagcacggcatcaccgtgacgatgggcaccgacgcctacacgcacgacatgctccagtcgctcaaggccttcgtgccgctgcagcgcctcaactccgccctgcccaacgtggcctggggcgaggccatgaccatgctgttccagaacaacgcgcagatggcaagcatgtacttctcgtccaagggcgacggcaagcccatcggcgtgctcgcgccgggcgccgcggcggacgtggccgtgttcgactatcccgctcccacgccgcttggggcggacaacgtggacggccacatcctgtttggcgtggagggacacgactgcaccaacacgatcgtcaacggccgcgtggtctaccgcgaccgccagctcgttggctgcgacagggagaggatcgacgccttcgtgatggagcaggcaaagctgctctggggcgagctcaacggcaggacctactaggcgccaggggcgtagggacgcccccgccttccatcacccgcgcggatcccgtggcgccgcgcggggcagaccatccccacggaaccttccggagaggaaacaccaactatgagcgacatcatgcatcccatgccgttcgaccagctcatgagctggatcctggacgagtacgccaccaagggcaccatctttggcgagcgcaggctgccccgccgcgaccccaaggccgcgcgccccatctttggcgagcgcgtcgagacgccctttggccccgcggccggccccaacacccagctggcccagaacatcgtggccgcctacgtgagcggcgcccgcttcttcgagctcaagaccgtccagaagatggacggcgcggagctttccgcctgcgtcaacaagccctgcatcctcgcgggtgacgagggctacaactgcgagtggtccaccgagctcaccgtgcaggatgccatggcggagtacatgcacgcctgggtggcctgcaagctgctggcgcgcgagctcggcctgggcgacccggacggcttcgtcttcaacatgtcggtcggctacgacctcgagggcatcaagacccccaaggtcgacggctacatcgaccagatgatggacgcctcccactccggcgccttcacggaggccatcgactgggcccttctcaacctcgaccgcttcgagcacgtggacgaggacttcgtgaggtccatcagcccgcgcatctcccgctccatcaccgagtccacgctccatggctgcccgcccgacgagatcgagcgcatcgccacccacctcatcacggagaagggccttaacacctacatcaagtgcaaccccacgctcctgggctatgactacgcgcgcaagacgctcgactccctgggctttggctacatcgccttcgaccgtcaccacttcgacgaggacctccagtgggccgacgccgtgcccatgttcaggcgcctcatcgccctctgcgaggagcgcgggctcgagttcggcgtcaagctcacgaacaccttcccggtggacgtgacccgcggcgagctccccagcgaggagatgtacatgtcgggccgctcgctctacccgctctcgctctccctcgcggacaggatctcgcacgagttcgacggcaagctgcgcatgtcctactccggcggcgcggacgcgctcaacatcaagggcctcgtggacgccggtatctggccggtgaccatggcgacgaccatcctcaagcctggtggttacgcgcgcctcgcgcagatcgcggacgagttcggcgagaaggacgcggccgccttcgccggcaccgatccccaggccatcgacgccctcgtggacgacgcgctctccaacccccgctaccgcaagcccgtcaagcccgagcccaaccgccacgtgcccggcgagctgccgctgaccgactgcttcatggcgccgtgccgcgaggactgccccatccaccaggacatccccggctatctgcgcgccgtgggcgagggtcgctacgccgacgcgctcaacatcatcctcgagcgcaatgcgctcccgttcatcacgggcacgatctgcccgcacacctgcggcaactcctgcatgcgcaactactacgaggagcacgtgcacatccgcgacgcaaagctccttgcggcacagaagggcctggacgaggtgcttccgaccctctcggcccgcggcaaggtgcagggcgtgcgcgtggccgtcgtcggtgccggcccggcgggactcgcggtagcctcgttcctctcgcgtgccggcgtggacgtgaccgtgttcgagcgctccgagcgccccggcggcgtcgtcgccaacgtgattcccagcttccgcatctctgacgaggccatcgccaacgacgtcaggctgtgcgaggcctacggtgccaaggttcagaccggcgtcgaggtggcggacgcacgcgaccttctctcccagggctacaccgacgtcgtggtcgccatcggcgcctgggcgcccggctgtcccgtgctcgagggcgcgcacacgctcgacgccatcgagttcctgcaggccttcaaggcggacccgtccgcctgcgagctggggagcgacgtggtcgtcgtcggcggcggcaacaccgccatggacgtcgcgcgcgccgcgaagcgcgtcccgggcgtcaggaacgtccgcctcgtgtaccgccgcgaccgccgcaacatgccggccgacgaggaggagctcgtcctcgctctcgaggacggcgtcgagttcctggagctcctctcgccccgctcgctcgagggcgacgtcctcacctgcgacgtgatggagctcggcgagccggacgcctccggccgtcgtcggccggtcgccacgggcaagaccaagagcgtccccgcgaccgcggtcatcgcggccgtcggcgagcgcgtcgagggcggcctgtacgccgcgaccggctgcgacgttgaccagaagggcctccccgtcgtcgactcccacctgcgcaccagcgtgccgcacgtgtacgccgcgggcgactgccgccgcgggcccgcgaccgtggtcaaggccatcgccgatgccgcgaccgtcacgaccgccatctgcggcttcgacttcggcggcaaggcgcaggagaacgtcgcgcccgacgcggacaaggtcctgtccgaccgcgcccgcctcgaggccgactgccagtcgctcgccaagacgcgctgcctcggctgcgcgacggcgtgcgagacctgcgtcgaggtctgccccaaccgcgccaacgtcgctgtccgcgtgcccggcatgcgcgaggcgcagatcgtccacgtggacgggatgtgcaacgagtgcggcaactgcgcggtgttctgcccctaccagggcgggcgtccctaccgcgacaagctcaccgcgttctggacgcgcgaggacttcgactcctcccagaaccagggcttccttcccgtggaggacggcatgctggtgcgcctggacggacgcgtcggcacctacgacgtggacgatgagggctgcggcctgccgcaggacgtgcgcaagacgatcgtcgccgtccgcgacgactacggctacctgctcgcccgctagcgacgagcaacgttttgaccggacgcggacaggcatggggggtgcctgcccgcatccgggtgtgaggagaggaacatggacatgagactcgttgcagtggtccactgctcgggaggcagcccgttccgggaggatgtcgactcgtcatccctgccgtcgagctgtgatgacattctcggcgcgtatccgctgggcacgcgcgtctgccggtttggctgccttgggggcgacacgtgcgcggtcgcgtgcccaaagggtgccatctccgtgggggaggacggcatcgcccacgtggacgccgtcctctgcgacgggtgcggggagtgcgtgagcgcctgcccgcagcaggtgatcaccctcgtgccgcgcggcgacgacatcacggtgcgctgctcgaaccacgacaaggtcctgcgctcgctcaagaactgcgagaacgtgtgcgtgggctgccgcacctgcgagcgcgtctgccccgtggaggccatccacgtggaggacttcctcgcgaagatcgactacgacgtgtgcatctcgtgcgggatgtgcgccaccaagtgcccgttcggcatcatccacgacgccaacgggcttctcgccagcagataggagggggagaagagcatgtcagagagctacatcctctacgtgaacggccaggagcacgtcacgacggagaacaagtcgctcctccgctaccttcgcgacgacctggggctcacgtccgtgaaggacggctgctccgagggcgcgtgcgggacctgcacggtggtcgtggacggcatcgccacaaagggctgcgtcatgaccaccaagctcgcgcagggcaagcgcatcctcaccgtcgagggcctcagcgaccaggagaaggacgccttcgtgtacgccttcggcgccgtgggcgccgtgcagtgcggcttctgcatccccgggatggtcatgagcggagcggcgctggtgcgccagaaccccgaccccaccgaggacgaggtcaagtgggccatccgcggcaacgtgtgccgctgcacgggctacaagaagatcatcgagggcatccgcctggccgcggccatcctgcgcggggacgagaagatcgaccccgccctcgagcgcggggacgactatggcgtgggcaagcgcgccttccgcgtggacgtgcgccgcaaggtgctgggctacggcaagtaccccgacgacctcacggtgcgcgactaccccgacatggcatacgcatccgcggtgcgctccaagtacccacgcgcccgcgtggtcaagatcgacaccgccaaggccgaggcgcttcccggcgtgctgggcgtgctgcgcgcatccgacgttcccgtgaaccaggtcggccacctcatccaggactgggacgtgatgatcgcggagggcgacatcacccgctgcgtgggcgacgccatctgcctggtggtcgccgaggacgagaagacgctcgccaaggccaagaagctcgtcaaggtcacgtacgagaagctcgagcccgtgcgcaacatagccgaggcaaaggcgcccggcgcgccgctcgtccacgagagcttcaacgcgtttggcaaccacgtggtgctgaaggacaacgtgtgccagagccgccacatcacccgcggcgacgccaagaaggcgctcgcggagtccgcctacgtggtcacgcgcgacttcgagacaccgttcacggagcacgccttcctggagcccgagtgcgccgttgccttcccgtacaaggatggggtcaaggtacagagcacagaccagggcgcctacgacacgcgcaaggagatcgcccacatgtttggctgggacgacacccccgagcgcgtcgtggtgcagaccatgctcgtgggcggtggctttggcggcaaggaggacgtgacggtgcagcacctcgccgcgctggccgccatgcacttcggccgcacggtcaagtgcaagctcacgcgccaggagtcgattgacctgcatcccaagcgccactacatgtacgcgacgttcacgctcggctgcgacgaggaggggcacctcactggtctcgactgcgaggtcaacttcgacaccggcgcctacgccagcctgtgcggccccgtcctggagcgcgcctgcacgcacgccgtcggcccgtacaggtaccagaacacggacatccgcggctatggctactacaccaacaacccgccggccggcgcgttccgcggcttcggcgtgtgccagaccgagttcgccctcgaggcgtgcctcgatcttctcgccgagaaggtgggcatatccgcgtgggagatgcgctggagaaacgccatcgagccgggcgcagtccttcccaacggccagatagccgactgctccaccgcgctcaaggagacgctcctcgcggtcaagaagccgttcgaggagaacctggggcacgtgggcatcgcctgcgccatgaagaactcgggcgtcggcgtgggccttcccgacgcgggccgcgccaacatcaaggtggaggacggcgtcgccgtgatctactccgccacatcggacatcggccagggctgcaacaccgtgttctcgcaggaccttgccgaggccacggggctgcccaaggcctgcatcgccaacggcgagtgctcgaccgaggtcgcgccggactcgggcacgacgtcgggctcgcgccagacggtcgtgaccggcgaggccgtgcgtggcgcctccttcctgctccgcgacgcgatgctcgcggtcgaggcgggcaagcccgcgcccaaggcgcccgtgcgcgcgcacggcgacggcaagaccatcgagtacgccgacggcacgccctaccgcgacgcgttcgaccgggacggggccgacctcaccgttggccatgccgtgcatcccaaggaccccgttgccgcgctgcgcaagctcgacggctgcgagtttggctacgagtaccttgaacccaccgacaagctgggtgcggacaagcccaaccccaagagccacatctgctacggcttcagctccaccgtggtcgtcctggaggacaagggcgagaggcgcgggcgcattcgcgacatctatgcggcgcacgactcgggcaaggtcgtgaaccccatcgccatccaggggcagatcgagggcggcgtcctcatgagcatgggctacgcgctcacggaggacttcccgctcaaggacggcgtgccgcaggccaagtacggcaccctggggctgctgagggcgacgcagatccccaacatccacgccagctacgtggagaaggagcacctgcttcccgtctcgtatggaggcaagggcatcggcgagatcgcgaccatcggcaccgcgcccgccatccagaacgcctaccacaacctggacggcaagctccgctggaggctgcccctcgaggacacgccgtacagcaagagccgcaagctgggcgacgagcgcctctccgagctgagggccgccgccgaggacggcgacacggagtctcaggagaaggccggcgagtagggcgggcgtccttctcgaccgcatgatatggaaatgggcaggccccgggacactcgcgttgcgcgaggcccggggcccgctccttgtgcggggcgaacgcgtccagttaccgaacaaatagttttgaagatagacaaattgttagtatcagaggcggcgttgaccacgagcgtggctaacggccgcaaggataggcacgtggcagagtggcttggccgggcgcggggacgctcggcggcaggagaggaaaagcctatggctgacgagaagtacgactacgtgcccatgtgggagggcctcgggatggacgtgaaggcccacgacggcctgctcgctgcggtggggcagatgtacggggacgcgttcctgacgcagaagaaccgccccgcctcgaccgcgtacctggacggggtggccaacaacctgcactcggggcgcatccgcgagctcgtggacgggaggaacgcgggcgaccccaagaaggtcatcggcacgttctgcctgtacgtcccggaggaggtcatcacggcggccggcgccgtcgaggtggggctgtgcgccggcgcggactggcagccggacgaggccgagcgctacgtcccgcgcaacacgtgcccgctcatcaaggggttcatgggcttcaagctgggccgcgtgtgcccctacatcgagagcgccgacctggtggtgggcgagaacacctgcgacggaaagaagaaggcgtacgagcagtttggcaagctcaagcccacgtacgtgatggacgtgccgcacgtgcgcaccgacgagacgcgccaggtgtggcgaaacgaggtccgcaggctcgcgcgccgcatcgagcaggagaccgggcagcagatcaccgcggagagcctccatgcgggcatcaagctcgcgaacgacaagcgccgtgcgctccagcgcctgtaccgggtgaggtcggcgtgccccgcgcccatatcgggcctggactccctgctgaccgtgcaggccgcgttcatggacgacagcgcacgcctcacgatggcgatcaacgccatggccgaggagtgcgagcagcgcgtgcgcgacggggtgggcgtcgccccgaagggcgcgaagcgaatcctgtacaccggcacgcccatggcggtgcccaactggaagctcttcaacatcatcgagaagtccggggccgtcgtggtgggcgaggagtgctgcacgggaagccgctactacaaggacctggtgagcgaggagggcacgaccgtcgaccagatgctcgacgacatcgccgatcgctacctcaacatacagtgcgcgatcttctcgcccaacaaggggcgcgaggaggatgtcatccgcatggcaagggagcagcacgcagacggcatcatcgactgctcgctgcagttctgcaccctgtacgacatggagtcgtttgggatgcaggaggcggcacgcgaggcgggcatcccgttcatgcacgtctcgaccgactatggcagcgacgacgacgggcagctcaagacccgcatccaggcgtttgtggagatgctttaggtggccaccgctcgggcggtcaggcgcgccgctcgcgaagttgtcgagaagacccttgaaaactcccgcggctgtgctgtaatggagaagctaacaaaaagttaggtcgtaagacaaacagtaattatcctggccgcgagcgagcgccagggggaaggggagagcatggagccgcagattggctgggtcatgaaccacatgcccaaggacgaggacaagaacctgcccatcatgtcggtcgagaacgtgagtaaggcacgggccttccaccggagcttcccgcagtactccgtgacgccgctggccgacctcgagggcatggccgagcgcctgggcctgggcggcctgtacgtgaaggacgagagctaccgctttggcctgaacgcgttcaaggtgctgggcggatcttttgccatggcacgctacatcgccgagcagaccggccgcgacgtgagcgactgcgactttgactaccttacgtccgagcagttggagaaggactttggccacgccacgttcttcaccgcgaccgacggcaaccacggccgcggcgtggcgtgggcggcgcaccgcctgcaccagaacgccgtcgtccacatgccgaagggctccaccaagacccgctttgacaacatcgccaaggagggcgccaaggtcacgatcgaggagctcaactacgacgactgcgtgcgccttgccgccaaggaggcctccgagaccgagcacggcgtgatcgtgcaggacaccgcctgggacggctacaccaagatcccgtcctggatcatgcagggctacggcaccatggcgtccgaggcggcggagcagctgcgccagctggaggtcaaccgcccgacgcacgtgtttgtgcaggccggcgtcggctcgctcgcgagcgcgatggtgggctacttcagcaacctcttccccacgtgcccgcccaagttcgtgatcatggaggcgtccgccgcggactgcctgtaccgcggcgccaaggcgggggacggcaacccgcgcaccgtgggcggcgacctcacgaccatcatggcgggcctcgcgtgcggcgagcccaacaccatcggctgggacatcctgcgtaaccacgcagacgccttcgtgagctgccccgactgggtgagcgccaagggcatgaggatgctcgccgctcccgtcaagggcgaccccgcggtgacctcgggcgagtccggcgccgtgggcatgggcgtgatctcgaccatcatgtgcgaccccgcctacgcggagctgcgcgagcagctggagctgggcagcgagtccaaggtcctgctcttctccaccgagggcgacaccgaccccgtgcgctaccgcgaggtcgtgtgggacggcgcatggcagagcgccgacgaggcaaagtagcgagcgagaagaacgatggggcgggtgcggggcgaccccgtgactgcctgcgatggcggcgccgggcccatgggagatggggcccggcgccgtcgcgcttctcgccctcttggcctggcgcttgagagcgatgcggaacggttcgtgccgtccgcctttccaaaacgaccgtttgcgggaaaaacaatttgtttggtaaaccggcttgattcccgcgcccggcgtgctttaatggactcagccaaacaaaaagtttggtaagcagacacattgtctactgccaggcaacggaacgtcgcaatgcgcaaggaggacccaatgaagcagctcgactacgagaagatcaaggatgcggcaaaggcgtacaacgcggacatgaccgcgttcctgcgcgccatgatctctcaccccagcgagtcctgcgaggagggcgacgtcgtcgcctgcatcaaggccgagatggagaagctcggctttgacgaggtcaaggtcgatggcctgggcaacgtcatgggcttcatgggcacgggcgagaagatcatcgccatcgacggccacatcgacaccgtgggcatcggcaaccgcgacaactgggacttcgacccctacgagggcttcgaggacgaccagctcatcggcggccgcggcggctccgaccaggagggcggcgtcgcggcggcgacctacgcggccaagatgatgaaggacatggacctcatccccgagggctacaagatcatggtcgtgggctccgtccaggaagaggactgcgacggcatgtgctggcagtacatctacaacaaggacggcatcaagcccgagttcgtgatctcgaccgagccgaccgacggcggcatctaccgcggccaccgcggccgtatggagatcagggtcgacgtccacggcgtctcctgccacggctccgcgcccgagcgcggcgacaacgccatctacaagatggccgacatcgtgagcgacgtccgcgcgctcaacaacaacggctgcgacgagtccacctccatcaagggcctcgtcaagatgctcgaccccaagtacaaccccgagcactacgaggacgcccgcttcctgggccgcggcacctgcaccgtcagccagatcttctataccagccccagccgctgcgccgtggccgactcctgcgccatcagcatcgaccgtcgcatgacggccggcgagacctacgagtcctgcctggaggaggtccgcaacctccccgccgtcaagaagtacggtgacgacgtgaaggtctccatgtacatgtacgaccgtcccagctggaccggcgaggtgtacgagaccgaggcctacttcccgacgtggatcaacaaggagaccgctccccacgtcaaggcgctggtcgacgcccacaaggcgctgtttggtgacaagcgcatcggctgccccaagtccatggacaagcgcgagggacgtcccctgtgcgacaagtggaccttctcgaccaactgcgtgtccatccagggccgctacggcatcccgtgcgtcggctttggccccggcgcagagtcccaggcccacgcgcccaacgaggtcacgtacaagcaggacctctccacgtgcgcggcgctctacgtcgcggccgtgaacctgtacgaccccagccaggccaccggcgacgccacggagtaccgcggaacgctgaccggaaacgacatcaagtaggacgccagacgcaagccacgaggcgcgggggccaacctgagccggtccccgcgccgcacgcccaaggaaaacgccaaggagacagcaatgagcgagaagaacatcaagccgtacctcgagaagcttgccgagctcgacttcaagaacatgtacaacaacgacttcctgcacacgtgggacaagacgaccgacgagctgaaggccatgtacctggtggccgacgccctgcgcaacctgcgcgagcgcaacatcagcacgcgcatcttccagtccggcctcgcggtctccaacttccgcgacaactccacgcgcacgcgcttcagctttgcctccggcaccaacctgctcggcctgcagctgcaggacctcgacgaggccaagtcccagatcgcccacggcgagacggtccgcgagaccgcgaccatgatcagcttcatggccgacgtcatcggcatccgcgacgacaagttcatcggcgagggcgacgcgtacatgagggaggtcgcggagtccgtcgagcagtcctggcgtgacggcatcctcgaccaccgtcccacgctcgtgtcgctgcagtccgactccgaccacccgacgcagtcctccgccgacatcctgtacctcatcaacgagtttggcggcctcgagaacctgaagggcaagaaggtcgccgtgacctgggcctacagcccctcctacggcaagcccctcagctgcccgcagtcgctcatcaccctgctgccgcgctttggcatggacgtgaccctggcccatcccgagggctacgacctcatgcccgagctggtgcagaaggcgggcacctacgcaggcgagacgggcgccacgttcacccagaccacgagcatggccgaggccttcgagggcgccgacatcgtgattcccaagagctgggcctcctacgccgccatggagaggcgcacgaagctctacgcagcgggcgaccaggccggcattgacgccctcgagcaggagctcctcgcccagaacgccacgcacaaggactggtgctgcacccagaagctgatggagaccaccgccaagggccaggacaccatctacatgcacccgctgcccgccgacatcaacggcgtgagctgcgagcacggcgaggtcgagaacgaggtgttcgactaccaccgcgacggcctgtacaaggaggccagctacaagccgtacgccgttgccgccatggtcttcctgcagaaggccaaggaccccatcgccacgctccaggccctcgaggacgccgcgacgccccgctggaaccagcgctaggcagaggcggagtccttctcaaccaagacttcgggacgacccatcgcatggccgctggccggcggcgggtcgtcccttccgtacgcgatggtacgctcttctctaacgtccgtgccctgactcctcgaaagggggccctgatggaaccaagaacggtctgctacctcatgcgggacgagggggaccgcgcctttggccccggcccctgccggctgctggagctcgtgggcgagaagggcagcctctcggccgcggcgaaggccatgggcatgagctacaccaaggccacccgcctggtgaggaatgccgaggagagcctgggcgctcccctgaccaggggcgtcgtgggcggcgagggaggcggcggatcgagcctgacccagcggggcgaggaggccatccggcgctaccgcctgtgggaggccagtgtgagcgatgcctcgcgccaggcgtaccgcgtcgcgtttgccggcgagtgcggcaacccccgcataccgtgcgtggtcatggcggccgggcacggcgagcgctttgggggacagaagctcctggcgcggctcggcgggcgagaggtgctcgcgcgcacgctcgcgtccgtcccgctcgacgtgtacgacgtcgtggtcgtgacccgcgcgccggaggtccgggcgctctgcgagcgatacggctttacgagcaggctctcggcgggcgacgagcagagcgacaccatccgcgcggggctggagtgggccggcaacgcacccggctgcctcttcctgcagggggaccagccgctcgtctcgacggcgagccttcgtgccctggccgaggcgttcgcccgtgacccgcggggggtcgcgcgcctctcgtggcaggggaggccgggaagccccgtgatctttcccaactggctctttggcgagctcgcccgcaccacgggcgaccggggaggctccgcggtgctcaaggcgaacccggcactcgaacggctggtcacgctggtcccagcggcagaggagtgcgagctcgaggacgtggacacgccggacgacctcgagcggctggaggcgcacctcgagggggaccgcggccacgagccaggcggggcgagcgggggcgcaaggccataggcgccgcggcgcagcggacatgcgagcggggaggttccctccccaggggagatgatcgacatgagcgagcagaggcggaccgtcgtgaggggcggcaacctggtgacgccaggcggcgtcgtgcggggcgacctcgtccttgcgggcgagaagatcgagtccgtggtgcccggtggcctcggcgagggcgagctcgggggatgcgagacctacgacgccaccgggtgctgggtctttcccggcttcatcgacgcccacacgcacatgcagtgctggacgggtatggactggacggcggacagcttcgagaccggcacgcgcgcggcggcctgcggcggcaccacgaccatcgtggactacgcgacccaggaccgcggcatgacgctgcaccaggcgctcgacgagtggcacaagcgcgccgacggcacctgcacctccaactacgccttccacatggcgatatcggactggaacgaccacacccgcgaggagatcgcggacatgcgcgacgcgggcatcgtgtcgttcaagagctacttcgcctacgaccacctgcgcctggacgacgcgcagaccatggagctgctcgaggccatccgcccgttcgacggcatcctgtgcgtgcactgcgagaacggcacgctcgtggacgcgctgcagcgccgcgtgctcgcccgcggcatcaccggccccgagggacaccccctcagccgcccggccgagtgcgaggcggaggcgataggccgcctcatgtacctggcccagctcacgggcgcgcgcgtcaacgtcgttcacctctcgaccgcgctcggcctcgagcagatccgcgccgccaaggcgcgcggggtgcgcgtctccgtggagacctgtccccagtacctgctcatggacgacacccgctacctcgagcagggggaggacggcttcgcgggcgccaagtacgtgatgagcccgccgctgcgcaggccccacgacgtcgaggtgctgcgccaggcggtgtgcgacggcgaggtcgaccaggtctccaccgaccactgctcgttcaacctgcacggccagaaggaccgcggcaggggcgacttcaccaagatccccaacggcggcccgggcgtagagcaccggccggccctcatgatgaccagcttcgagggacggctcggccccatggactacctgcgtctcctgagcgaggggcaggcgcgcgtcttcggcatgtacccgcgcaagggcgccctcgcggccggctcggacgcggacgtgtgcgtgtgggacccgtccgtccgctggaccatcggcgcgtccaaccagcaccaggccgtcgactacaccccctacgaggggttccaggcccacggccgcgccaagtacgtcttcgtcaacgggaccctcgccgcgcgcgacggcgagcccacgggcgagaagcccgggcgctacgtggcccgctgaccctcccgacggcacccgggcacccgcctggcggcctgtacaatacgtttcgtaagacgcccgcggacgcgggcacgagagaaggagcaacaacatgagcaagaccgccatcgtcaccgacaaggcccccaaggccctcggcccctattccgcaggcgtcgcctcgaacggttccgtcaacgtctccggccagctgggaatcgaccccgccacgggcaagctcgctggcgacgacatccagtcccagacccgccagagcctcacgaacgtgcagaacatcctcgcggcggccggcgccacgatggacgacgtggtcgagaccaccgtccttctcgccgacatcaacgagttcgcggccatgaacgaggtctacgccgagttcttcaaggcgccgtatcccgcacgcgcggccttccaggtggcggcgctgcccggcggcggcagggtcgagatcaaggccgtggccagggtctaggcagccgcctctcatcgagcccaccggggggggcgcctcgccgtcgtgcggggcgcccccttgtcgtctcgtggggcgccggggcgctccacttccgcgcgcatagcgcggcgtcccgcaccccgcggatttccttacgctcacggggggataccgggggatatgggatggattcgggcaccaagggcgtctcggacggtatccttgaacccgtgggtcccgcccgcggcgcctggatgcgtgcgggcagcggtgaccctctcccggcgcccgaaggtggcgccgaggcggccgaggtggggcagcggaagtcccgggccgcttcaagaaacggagacgcatatggaagtgggtaggagcctaacccgcgtggacgcctacgacaaggtgaccggacgggccaagttcacggacgacctgtgcccgaagccgtgcctcgaggcaaaggtgctccactcgaccatcgccaacggcgtggtcacggccatcgacacgtcggaggccgagaagatcgagggagtcgtgggcgtctggacgtgcttcgacgtcccggacatccagttcgggaccgcggggcacccgtggtcgacgcggcagtcgcaccaggacatccaagaccgcaagctgctcaacgcgcgcgtgcgctgctacggcgacaacatcgccgccgtggtcgcggaggacaccgtcgccgccgaccgggcgctcagggccatcaaggtcacctacgacgagtacccgccctgcctcgacacggagtccgcgctgcaccccggcaagaccggcgagctccaccaggagcgccccgacaacgtgatcgcccacatggacctcaggtccaaggtgcgcggagagcgctaccagagcatcgagcagatcctggacgacccgtcgctccatcacattacgcagcacagcgcgaccccgcgccagagccaggtgcacatcgagtcgtgcacctcgtggtgcaagatggagaacggccgcatcacctgcgtcacctccacccagatcccgcacatcgtgaggcgcatcatcgcgcaggcgctcgggatcggctggggccaggtcaaggtcatcaagccctacatcggcggcggcttcggcaacaagcaggacgtgctgttcgagccgctcaacgcctggctgtgcatgcaggtgggcggccgtcccgtgcgcctggagctctcgcgcgaggaggtcttcttcgcgacgcgctcgcgccagccaaagacgttcgacgtggaggccgcctacgacgaccaccagaacctggtggcgcgccactgcgtggcctactccaaccagggcgggtacgcctcgcacggcaacgcgctcgtggcgaactcggtcaacagcttccgccagctctacgacatgcgcgagctcgcgagccgcgtcgaggccacgacgttctactccaaccagataacggcgggcgccatgcgagcctacggcgtgcccgagggcaactgggccgcggagtgcctcatgggtgacatcgcctacgaccagggctgggacggctgcgacttccgcctcaacaacgccatgaccaagggctacgtggacgagttctggcccggcaagctcgcctgctacaccgacggcctgcgcgagtgcgtgcgccgcggcaaggcggacatcggctgggaccaaaagcgcgccgagtacgcccaccaggagggccccatccgccacggcataggcgtcgcgctcttctcgtacaagaccgccgtggcggccctctcgctcgagacggcgtccgcccgcatgatcctcaaccaggacggctcggtcatgatggagctgggcgccacggagatcggccagggggctgacacgatcttctcgcagatggccgcccaggccatcggcatccccaccgagtgggtgcacgtggtctccacccagaacacggacacgagcccgtacgactccggcgcctacgcgtcgcgccagacctacgtctccggtacggccgtccgcatggtgggcgaggagctgggcgagaagatcgtggcctacgcgcacgagatgcgcccggacgccggcgacctcaggcttgtcgacggccgcatcgtggatgccgcgggcgagcaggtgctctcgctcgaggaggtcgcgcaggagtcctactactcgctcgaccatgcccagcagctctttgccgaggacacggcccaggtcaagtccaacacgttcgccctgggctgctgctttgtggacctgaccgtggacgtaccgctctgcaaggtcacgctcgaccgcgtggtcgagtaccacgactccggcatgatcatgaacccgcgcactgccgagcagcaggtccatggcggcatcgcgcagtccctgggcatggcgctttccgaggagctgctcacggaccccgcgagcgggcgcatcctcaaccccaacctgctcgactacaagatcccgaccgcgatggacctgcccgacctcgaggccggcttcgtggagacgtacgaccccacgggcccgtacggcaacaaggcgctgggcgagtgcccgtgcatcccggcggcgccggcggtgcgcgacgcgatcctcaacgcgacgggggtcaagttctacgaggcgcccatgacgccgcagcggctgttcgagggcttcaagagggaggggctgatctagcgtgtatgacatcgagtacctgcatcaggcgacgtcggtggacgacgccgtggcggcccttgcggcggacccgctggcccaggtcatagccggcggcacggacgtgctcgtgaagctgagggacggcaagggcgcacccgcgcacctcgtctcgatccacgggctcgcgggcgagctttcgggcgtgacgctcttggacgacggttgcgtccgcatcggtgccaacaccgtgttccattccgtcaccacctcgccggtcatccaggagcgcatccccgtgctgggcgaggcgtgcgacacgccgggcggtccgcagctgcgcatagccggcaccatcgggggcaacctctgcaacggcgtgacgagtgccgactccgcctcgacgtgcatggccctgggcgtccttctcgacctcgttggtcccgagggcaggcggaccgtgccgatcgacgagtggtacgcgggacccgggcgcaccgtgcgccgtcgcgacgagctgctggtggcaatcagggtaccgcgctcccactacgagggctttgccggggagtacatcaagtacggcaagcgcaacgcgctcgagatcgcgaccatgggctgctgctgcctggtgaggcttgccgaggaccatgacacgttggcggacgtgcggctcgcctttggcgtggccgggcccgtgcccatgcggtcgcacgcggccgaggacggcgtgcgcggactttccgtggcccaggcggcggagcgcgtaggggagctggcgctggaggacacgcgcccccgcgactcgtggagggcgtccaaggccttccgccagcagctgatcaaggagatgtcgaggcgtgccctcatgagcgcggcgcgcaagggaggcgcgacggtctgatggacatgaggatcctcaagtgcacggtcaacggcaagccggtccaggtgggctacgacccgcgcgagtccctgctcgacaccctgcgcaaccgcctggggctcacgagcgtgaagcgcggctgcgaggtgggggagtgcggcgcctgcaccgtcctgattgacggcgtggccacggacacctgcctctacctcacggactgggcgcagggccgcgacatcctcaccgtggagggcctgcaggcggcggacggaacgctccatcccgtgcagcaggcttttattgacgactttgcggtgcagtgcggcttctgcacgcccggtatcatcatgagcgcggtcgagatcgtaaacacgggcaagacctacacccgtgacgagctgcgcaagctcctctcgggacacctgtgccggtgcacggggtacgagaacatcatcaacgcggccgcggacgccatcgagcgcgtgaacggctcgggcaggcccaagccggcgcccggtcccgtcgtggtgccgcccaggccggaggacgtgccggacggggcgccgctcaagcccgagctcgtcgcgggggcggagtagggaatcggccccggcggtccggcatgcgaggcggtgcgacggcccgcggcacgtcgtctttctcgcccgcgccctaccgccggggcgggtactcgtgccactcgcggcagggtaagaaagtttgtttggctgactcaaacaatgttatatcctgtagacgcgtggggacgccgcggcaacctttgtgatggaccgccgcggcaccccttcgcgttcgtacaaccgttgtccatcgcaaaacataacgcctgcaccgcagctttggagacattgccacgataggaggaagggaacgaagatgcagatcgacgcaagaaacctcacctgccccaagccggtcgtcctcacgctggaggccctccccaagctcatgccgggcgagagcctcacggtgctggtgaacgacgaggtcgcgcgcggcaacctcacccgcctggcgagccagaaggactgcgagctgtccgtcgagtccaagggcgaccacgatgccctcacgctgacgccgcgctccgcagtcgttgccgagtctcccgcggaggtcgaggcccaggcatactgtgacgtccccgccaagtcgggcgccgtcgtgttcgtggacagcgacacaatgggccgcggcgacgagaagctcggccacatcctcatgaagggcctcatctacgcgctggcccaccaggacgacgttcccaagaagatggtcttcttcaacggcggcgcgcacctgacctgcgagggctccgagtccctggacgacatccgcgagctggagagccgcggcacgaccatcctgacctgcggcacctgcctcgacttctatggcatccgcgagaagctcgccgtcggcggggtcaccaacctgtacgagatcgcgaagacgctctcgggcgagccgggcgtcacgacgctgtaggcgcatcgccatggtgtacctcaactgcgcggcgacctcgtaccgtcgcccggagtgcgtgatcgcggcggtcgagaccgccctacgcgagttcgggagcagcggtcgcggcgcgcacgactccgagctggacgccgcccgcgccatagcgacgtgccgcgagcgcgtggcggaggtgctcggctttggccaccccggccgcgtggtctttggggccaacgcgacccagggcctcaacatggcgatcctgggatgcgtgccagacggcggccacgtggtcgcgacggactgggaccacaactcgatcctgcgcccgctgtaccgtctgcgcaagaggaggggcgtccgcgtcgacttcgcccccgccgacgcggcgggccgcctagacgtggactcgctcctctcgctcgtgacgccgggcacgagcctcgtgtgcctgacgcacgcctcgaacctcacgggcaacgtgcttcctgacgcgcagatcacccgcgtggccgaccgcgcccacgaggtcggagcgcacgtccttctcgactgcgcgcagaccgccggcgcccgtcccgtgcgcatggatgcgctcggggtcgacctggtggccttcaccggccacaaggcgctcatgggcccgcagggcacgggcggcctggccgtcgccccgggcgtgacggtcgagcccgtcctgtgcggcggcacgggggtcctctcgttcgaggagtcccagcccgccgcctacccagagcacctggaggcggggacgctcaacggccacggcctggcgggcctctcggcggccgccgggtgggtgctctcgacgggactcgacgcgatccacgcgcacgacctcgcgctcacgcgcaggctggtcgcgggcctccgcaggctcggccccgccgccaccgtctacggagacctcccgcgggaccgcatcggcctcgacgcgcccgacttcgaccacgcgcccgtcgtgtcgctcaacctggacggctgggactcctccgagctcgccgacgccctcggccacgactacgacatcgccgtgcgcgccggcggccactgcgccccgcgcatgcatcgcgcgctcggcacggagcacaccggggcggtccgcctctccatgggctggttcacgggggagaaggacgtggactacgcgctcagggccctctcccagctggcggagggggacgacgcccccgcgcccgaggggacgggggaggcgcccgatgccccggcgcaggcgtgagccgcgcgccgtcgccgcgttcgactccacgcacgacgccctggaggcggagtcggcgtgcaggcaggaaggggtcgagggcaggctcatccccacgccggtgagcatcacggccgactgcggcctcgcgtggtcgatgcccccggcggagcgcggtcggttcgaggtgctcgccacgggacgctttgacgtcgccggaatctacgatctggagctttgagcgggtgcgtgcccgcggaacgggaggaatcgtgcttgttgtgatcaggggcgccggggacctcgcctcgggcatcgcgctcaggctgcaccgcgccggatgcgacatcgtgatgctggacgtcgcggttcccacggcggtcaggcgcaccgtctgtttcagcgaggccatccgcctgggcagggcggaggtcgagggcgtggaggccgtgctcgcgcgcgacgtcgcggaggccgcgtccatagcgtccggccacgagcgcatcgccgtgctcgtggaccccgaggggacgtgcatcccggcgctcaagccggagtgcgtggtcgacgccatcatcgcaaagcgcaacctcggcaccaccaaggacatggcgcccatcgtcataggcgtgggccccggcttccatgcgggcacctcgtccggcgcggactgccacgctgcgatagagacaaagcgcgggcactacctgggccgcgttatctacgacggctcgcccatccccaacacgggcgtgcccggaaacattggcgggtacacgacggagcgcgtgctgcgcgcgccggcggacggcacgttcgagccctgcgcgagcatcggcgacatggtgaagaagggcgacgtggtcgcccacgttgcgggccagcccgtgcgcgccaacatcgacggcgtcctgcgcggcctgctgcaggagggcgtccccgtcacgcgcggcatgaagtcgggcgacgtcgacccccgctgcaaggcggggcactgctgctcggcgtccgacaaggcccgggcaatcggcggcggggtgcttgaggcgctgctgcacttctcgcacagactggaggggtagccatggcagaggacgtcaagctgaccaagctggcggagtgcgcgggctgcggcgccaaggtgggcgcgggcgagctcgcgaagctgctggcagacatcaaggtgcagcgggaccccaacctcctcgtgggcttcgaccgctccgacgacgcggcggtgtaccgcgtgacggacgacctcgcgctggtggagaccgtcgacttcttcccgcccatcgccgacgacccgtacacctttggcgccatcgcggccacgaacgcgctctcggacgtctatgcgatgggcggcgagcccaaggtcgccctcaacgtgatggcggtgcccgaggacatgccctccgacgtcgtgcaccagatcctgcgcggcggctacgagaaggtctacgaggccggcgcctccattgtgggcggccacagcatctacgaccgcgagcccaagtacggcctcgccgtgaccggcttcgttgacccgcgccgcatgctcaccaactcgggcgcccgtcccggcgacgtgctcgtgctcaccaaggccctgggcgtgggcgtgataaccacggcggagaagggcgggcttgccgggccgcaggacgtccgtgccgccgaggcgcagatgacgaccctcaaccgctgggcgcgcgacgtcgccgtgaggcacgaggtgcacgcggccacggacgtgacggggttcggtctcatgggccacgcgctcgagatggcccagggctccgacgtgcggctgaccatcgaccccggcgcgcccgcgcttctcggccaggcgcgcgagctcgccgccatgggcgtcctgcctgcggggatgtaccgcaaccggcacttcgccgaggcgagcgtcaatgcgacgggggtcgcgcaggacctgcaggacctgctgttctgcccggagacgtcgggcggcctgctgctgagcgtggcgccgggggatgccgacgcgctcgtggtggaccttctggcggacgggcgcgtcccggacgcacgcgtcatcggcggggtgtctgcctacgagggcggcgcgcggatccgcctcgggcagtcgaaggacgataccaaggagaagggcaggtagacgatgtcagactctcacgagaccatgcgagatccctcgttcgtggggcgcctcctggacgaggcgcgctcggggaggcccttcgcgctggcgagcgtcctggcgacacgcggctcgatgccgcgacacgcgagcgcgaggatggcgctcctctccgacggcacctggctgggcaccatcgggggcggccgcgtggagcagcagatgcaggagaggtgccgtcgcgtgctggcaggcgaggagtccggccggctggagtggatgacccacgagaagacggggatggcctgcggcggcgacgcgctgtgcggcgtcagcctgtgggagcccgatgtggcggagccgctcctctccgagctgtcgcgacgtctctcgtccgagcagccgttcgtgatcgcggagggctgggcggaccccacgcacgtcgcagtgaggctcgcctcgatatcggagctgggggacgaccccgcggccgcctgcgacgtgtccgcctgggacgaggcctcacagacctacacggagcccgccggtcccgaccccaaggcgtacgtgttcggcggcgggcacgtggggcgtgccctcgcgcccgtcctcgcgagcgtcgggttcagggtcgtggtcgtcgacgaccggcccggggtcgccgtccccgaggactttcccgcggccgagcaggtgacctgctgtgacctgcgggacctcgcctccggcggcatcaaggcgaccggccgcgactacgtggtcgtcaccacgcacgggcacgcatgggacatcgacgtgctggagcaggtcgcgcccgcgcgtcccgcctacgtgggctgcatcggcagccgcggcaaggcggcctacgcgcgcaaggtcctcaaggagcggggcgtcgaccccgactgggtggacgcgatccacctcccgatcggggagccgatcctcgcggtgacgccgcctgagatcgcggtctcgatcgcggcagagatgattcgctgcagggctgagctccgccccgtccgtccgcactcgtcccactcgggagggaggggctagggcagctgccttccatggtgaaggcgggcgtgataggcaccaccaagcgcccgaaaatacaaacgaaaggttaggttctacgatgttccacaacgcttcgcatgacgcatgcgtcacgcgcaggtccttcctgctcaccggggcggcaatggcggcgacgctcggtctcgccggctgcggc

SEQ ID NO: 159 - DNA, 14533 bp, Unknown
  Metagenome-assembled genome
gaagcccatgttcatctggcgctcgtagttccaggagtcctggatggcccagctgcgccagaagaactggctgatcttcttgcgagtagagacttcgttcgtagccatgtccttctccttactcgtcgtcttcgagggggtcgtagtcgtcggatgcgggaagcgcggtcgtgccgccacctgtcgccgcaaccttgtggccgaacttgaggtccatcagcacgattgccgcggcaacgccgagcagggagaccgcggtgaccgagagcttgaggtaggcggccagcaggaagccgatgaagaagaaggcgcccatgcccttcttgagcgagagggagaggagaagcgcgagtccgtaggcggtgagaagcttggtggcgacgttcagaccggtggtgagccaagcggggatgaagctcacgatgctcttcacgaggtcggtgccaaggaggatggcgaagaacgtgggaacgaagtacatgagggaatagaggatggtgccgaccacgatgtgcatggagcgggccttcttgaagtcgccctcctcgattgcggcatcggccacgtggccgagcacggcgatgaccgagcggaacacgatgccgaggagctggcccaggacggcgacgggcaccgcgatggtcatggcggtctcggcggtggcgcccgtgaggcaggcgaacgccgacgcgatgatgccgccgagcaccatgtctgcggggacggccgcaccgacctggacgaggcccatgctcacgagctcggtcgcggcaccgacggcgagtccggtcatcgggtcgccgaggacgacgcccacgagcgtcgcgccgatgagcggctgctcgaagttgaggcggccaagcaggcgcgagtcgagcatgcagaacacactgaccaggcccacgagcagggcgctaacgaacatgttcattgcttctcctttcgaaagccgtgccgggggctacagcctttcggtcacgtccacccgcgggagtgcgggagtctgctgcacgaagatcttcacgcccatgtcgagaagggcgttgacgtctgccttctgggcatcgtccaggaagacggaggagcccttgccgccgatcatctgggcaccgtcgtggttggcggtcgcgccgaggttcaccgggcccaggcggtaggactcgtagaacctgcgcagctcggacgtgctgccaaagacgaacatgaccttctcgcccagcgtgttgagctttgccatcttcttgagggcacggtcgacggtgaagacgttcaggcgcacgccagcgggcttggccaggcgaagtgcacccttcctgacctcgtcgttcgcggtggcgtcatcgaccacgatgatccgctcggcacccaccttcgagacccaggagaacacgacctggccgtggagcaggcggtagtcgagacgcgtgaggacgatcttcgcgggtccgccgttagccttgggacgtgacgcggcctgtgcctgcggctcctgcgccggggcgtcgggatgggcgcagtccacgatgccgcgcctcccctccgccacgaggtcgcgcaccgcggcgtcgtcgagccgcttgtccgagagcgtaagggtcaggatcatgggcatgttcattccggcgatcacggtgacgtccgggtggcttgcctggtactcgacaatcgagttgttaacgctcgagcccagcatgtccgtgaggacgtacacggaatcctgcggatcgaactcgctgacgagtcgctcgaccttgctcgtgatgggctccttgtcatcgcgaagcagcgagactgcgtgcacgttgggagcatcgcccacgatcatgtggacggtgtccagcgctcccgccgcaagcccgccatgagacgcaaggatcacttggttcatgtgcgctcgacctcctttgttggtctgacattacagtcatcatatacgtcttatctctaacgtaatagtggtctataacgtcttgtaacaaacggttacttttccgccgcgaacggttccacgtatggaaacgagccagccacaatcgcacgtgactagctcgtttgccgaaggagcgggcgccggcgctacaccggaatcctgggagagacccccgccgcctagtaggcgaccttccacatgtagcggcgcgtgttgtagtccttgctcgtggcggcggagagggcgcgcatgtagacgttgttgaggattggcgagaacaggatgtggttgaagtactcgctcacggtgtccggcaggtcgttcaggccgatctccttcccatcgagcacgtagacgttctccccgccatagcgcttgaggaagtcgagggcgcgctcgtcggccgcgcggcagcgtccgacggagaccagcaggaagaccggcttggccttgtcgagcacctcgaacgggccgtggaagaactcgcagctgttgatcgtgggcgagtcgatctggagcatctcctcgatgttgcagattgagaatatgtacgccgagccgtacgcggggcccgagcccatgacataaatggtcttctggccggccatccgggcagcccactcgtgcgcgagcggctgcgcgtagtcgaaggccttgcggtaaatcgcgtccaccacgtcaaacgcgcgcatggcctcgtcgtagtgtgcatagccctccgtctggtcggtcaggctcatcgcgatcatgagcgcgacgctcgagttgacccgctcggtcctgctctcgtcgagggcgatggactcgtaggcgatcttctggtcgcacgtcttcgtcaggtcggactcgttcacgtagagtgcgacggttgccgcgccgcgctccttggcgaccttggcggcaacgcaggtctccttggtgccgcgcatggagcagataacgcaaagggtgtgctcgtccacataggcgggcgtcgcaaggacgaactcgttgctggtgtacatgtgcgaggcaatccccttgcactcgcgctccatgaagtagtgcgcggcgtagaagccaccgttcgaccctcccgcggcgacccacgccacgtgcgtgacctcgcgctccgcaagaacgttggacacgacgccggccacctcgtcctgaatcctggttcgctcgtccttctcgcccatgacagtctcctccctgttgcagcgcgaacctcctcgcgcttcgctaggtagactatatcatatacgttatatacgtttgatatctttagacgagcggaaggacaaggtcgcgggcgagaaggacgcgccgccgcagccgacgcgctagaatgcatgccatgggcgacgcggtcgccaccgtcgcggggaggggtttgccatgggacttgccgaggagcttgggattggacgcggaatcaccgcggtcatcgggagcggcggcaagacgagcctgctcgacgcgctcgcgcgcgagctcgacggcactgtcgtgctcaccacgaccacgcacgtgctgccgtttggctgccccgtgcttacggacgcggacgagaaggacgtggagcaggcgttctggtacagccgcgtggtgtgcgtgggcacgccgaccggggacggctcgggcaagctcgccgcgccgcgcctcaagatgcgcacgctctccgtcctggcggactacgtcctagtggaggcggacggcgccgcgcggcacccgctcaaggcacatgcggaccacgagcccgtcatcccccaggaggcggaccgcgtggtgcaggtcgtgggcgcgtcgggctttggccggcccgtcacggaggccgtgcaccggcccgagctcttctgcaggctcgctgggtgcgacgcgacggacgtcgcgacgccgcagctcgtggcacgtgccgtcgccgccgagcatgccgcggggctgagggcggacgtccttctcctcagccagatcgccgcaggtggcggggatgacgcaaccgccttcgagcaggcgctccgcgcggagggcgaccaggtgcccgtcgtgaggtgggacgcgctggcctagcccgcgggacgccgcccgcgcaggcgcctagcgcatgaacgcgggcatctcgcccgtgggggccgccgccgcgatctgctcgagcgcggcggcaacgctgtcgtcacgcgaggggccgatgtgccagcgcgcggccgcggccacgtccggcgtcgcgttggcgacggccacggagttgggaaccgcctcgatcatggagaggtcgttttccgagtcgccaaacgtggcgacctcgtccatgcccacgcccagctcgcgcgcgagctcgcacacgccggccaccttgtcccagccgtgcggcgtgatgtcgatcagcatcgccgtggggctgggcagcacaaagtcgagcttggggcactcctcgcgcagcatgtcgcgcacgcggaccagccgctcgcgcgtgccgtccacgtgcacgttcgacttgatccagggcgtgtcgcccaggctcggcatcgtgccgtggcccacgccgccccgcttgacctcgcccatcacgccgggatggccctccaggctcttgacgttgcgcttgaccagggtcgccaggccgtcgcccctcacgtcgtacacggccagtgccgcgccctccacgtcctccagcacgtcctgcacgtgctggagcgagtcgtggtcgagcacctccgtgtgcgtgagctcgccgtcgatgtagaccatctgcccgttgcagaacgcgcccgtggagcagcaggcgtcgtcgccgttgaacatccaggccatggccgtgggcacgcggcccgtgaccggcccaaagtggagtcccgcgtcgatcatggcgtggatcgcggcgatcgcgcggtcggacacgcgcggcgcgccaacggggatgagcgtgtcgtccatatcggtcagggcaagcttgatcatgttcttctccaaagcgtgaaaactagcggtcgagcaggcccgccacctgggcgggcgacttgaggggcaggggacggtcgacgcgcgtccccacgggcttctccatccagaccatgtcgtaccagcggccaaacttgttggcgcagccgtggaaccgcccgacccactcgaagcccaggtgcgtgtggaactcgatgctcgcgcgcgtgaggtgggggtcgtccgtggtgggcgggtaggcgatgcacgccgtgagggtcgtaacgcccatggccacgagcaggcgctccagcgtgccgtagagcgcgccgcccacgccgcggccgtgcgcgtcccgcgacacgtagatgctgagctcgacggcccagtcgtaggccttgcgcgcgtggagcgggcccgcgtaggcatagcccagcgcgcggccgtccgcggactccgccacaaggtagggatagcgctcgagcgtgtgggcgatgcgcgcgcggaactcgtccacgcccggcacgtcccactcgaaggtgatggccgtgtcgcgcacgtacggcgcgtagatcgcgagcagcgccaccgcgtcgtccggcgtcgccatccttacgcgcgggccctcccctgccgccgcgccggcattttcctgcaccattgccctcccgtcgctcgtgctcacgagcacaagactactacgggaggatggacggcgggcgcgggcgtgccacccttcacaaacgggacgacagcgctttggagaagcgcagagtcgaattctaacgccagcttagagctgaagctcttcgatcagcttcctcatcttgagcgcccagcccagttgttctgcaataaacccaggccattcgccctcgttgttcttaatcttgcagccgtccttgtagaagcgcagacccgacgcctttttcgcgtcgaaaggcttggccttcagtccaagcctcacctcgaaaagcgatgcgttttcgattgcattatgaccaatgtctttatcgtctggcacataaaactcgataccggttcggccgtgctgcgtgtcaatcaggagcgctatgtgataggcacttgtgccacaccggagagtggaccagtggtccttcgtcggcttctgcggactaaacaccttaagaaaattgggagccgaacgtgcaatctcgcgatacttcgtccaatacgacagcttgacacgctcggtctctgacagattctcactcaacctcaaggcctttgtccactcgtttggctgctctacaacgttgaagcgggggccggcttagagtctccaatagtccaaagctcaatctcaacaaggaagaagccaaagtcgttgtcgctgtgctcgttaagccactcaatcgcttgacggtgctcgtcacgcgcatgggcgacaacccagattatgacttgggcgcccttgccggcagcataggtaaacaccttgccaaggtggtcgtgattcgtttcctcgagctgattctcgatgattaccttacgtccggtgccggcttcctgtgcgtagatgtccacgttaaatgatcccacagaggattcggtctcaatgagctcgagctctacgccgaccgcttcgcccagcatattcaagttggctgggctcgaaagccacttggtgaaatcaagcgcctcatgtggccagaccttacgcagctcgaccttcttcagatgatcaaggtcatagcccatctctcgcgactccattgccctacgtctacgtcaccgacaagcgaatcatactcttggagaaccatgtcagggatttgggctggctgccggcccataggaagccgatcccttacccatgtgggaaagtacagtctaatagtggaatgggaattcccttcgaggggcgagcgccacgttggcgaagagtgcgtggctgttacagccggcaggctgatactctgttagcgtccaacaagccgagaggagccaagcgatgaaggcgtacatccagagcataaacgggatgccgcgaggcatgagccaatacaccgcgtggctcgggttcaagaacatggggttcgagacagttccattcgaaaccgttgacgacctagatgcctgcgaccgcgaggatgtggtcgtgggtggcctcggcgtcgtccgtgccaggctccgcgctcttagcgcagatacgagcgagattaactacccagaggagctgcgtccgtttctgggtaggaggctctggaagacgacgattgaccatgtgagcaccgaggtgagctcctggcccctgttcgtgaagcccgtcgagggcaagcggttcaccgggtgcgtggttgccagcacgaaggaccttatcggcaagggctgctgcggggaggacttccccgtcatctgcagcgaggtggtcgacttcgtctcggagtaccggtgcttcgtaaggtacggggagatcctcgacgttcgccgctaccgcggggactggtcaaaggcgccgggcagggaggtcgtcgagcgggcgattgccgcgtatgccagcgcgccggccgggtacgcagccgacttcggcgtcacctcggatggcaggaccctgctcgtagaggtgaacgacggctactcgctcggcccgtacggcctgtggcccgagctgtatgcgcagctgctgtccgcccgctgggcccagatggtcgggaccaacgacccctgcgacttcggcgtgcctgtgccgaggatgtagagaagcgcataaaacagcaggtcaaggagtcagcgtagagacatcacgcatctctcgcggcttgagaagcttgcggctgtagcgactcatatatatcgcatttcagtgagcgaagagttcattttcgccaggtgctttctcggacagcccttctcacgctacgcgtttagtcgccgaggtcggatgatgcaatcgatgtccgcggagacacccctccggcgccggcctgcacgaagcagtccaggaagcccgcctcctccacgtccataacgtcggcgaggagcttgatgccgcggtcgtggttgaaggccttcgtctcgtaggcgaagtcgatcgagcccgccttgtagcccacgttgcgggtgtagtcgccgagccccgtcacggagaccttcgggatcatgatctccttcgcgttgcggcccgtgcgggccatgcgcgccggcgagttcaggcacgagctcgtcgcctccctctggtacacgcggtcgaggatggtcgtgtagttcttgattgctgcgatgttgctcggcatgctctactccttgccctcgtcggcgaggccggcgatcctctcccagcgcctcatgttgcattcagtcaagtagaagtcgacagaggggactgcggtgggaatcttggaccaaaacgggacgggaaggaagccgcatgttcagcaccgaacaacgtaaaattgcgatcgagaccttcatcagattcgatcatagctatgcagacacgattgcggagctggggtacccgacgaggcattcgctcagggcctggtacaaggactatctggagcatggggaggtcaggcccccgaagcggcagcgggagtccaagttcaccttggagatgaggcaggctgccgtggactactacctcgcacacggaaagagcctcgccaggaccatgcgcaggatgggctgtcccgccagcagggagtacctctgcgactggatcgacgagctcgcccccggacagaggaaatacagggggccgaacccgaaagcgggtcctgtcccgctcgcagagaagatacaggcggtggccgagctcgagtcccgcagcggaaccgctgcggaggtcgccgagaagcacggcgtgtcgcgcacggcgccctacatatggcgaagggagataacgggcgataatggcggggagcccgaaacgaagggagagcccgtgagcaaggaattcgacgacctgcccgacgacatcgaggtgctgcaggacatgctgcgagaggcgaagatgcagctcaggaaggtgcagctcgagctcgacgtgcgccaggcgaccctcgagatagcaagaaagaccagggcgccgacccagagctgctgacgaacgaggagaaggcggcgatggtggaggcgctgagggccgaatgcaggctctgcgagatcctgcccgtggtgggcatggccaggagcagctgcgaatgcgccaggaacgcccaggccggaggcgagaccgaagagcacgccgcagcgcggaaggcggtcatcgaggcgtccggggccagcggcggcacatacggctacaggcgcgtgtacgcccaggccagcgccgatgcgggggacggcgcggcgatcggcgagtggacggtccgcgacatcatgagggacgagggcctggccgcctgcgctgccaagaagaagcggcgctgcagctcatacgagggcgagatctcggaggcgccgaccaacctcttgcgcgacgaccggggcaagcatcacttccgcgcgaacaagccgaacgagctctggataaccgacgtgaccgagttccgcatccccgccggcaaggtgtacctgtcgcccattgtggactgcttcgacggcatgccgctgagctggtcgatctccacgtcgcccgacgccgagatggccaactcgtcgctgctcggcgcgtgcagctggctcggcgagggcgaccatcccaagatccactcggaccgcggctgccattaccgctggccgggatggataaggatatgcgatgagaacggcctggtcaggtcgatgtcgaggaagggatgcagccccgacaacgcgaggtgcgagggcttcttcgggaggttgaagatagagttcttccacggctgcgactgggccggggtcactatcgaggagttcatggacatgctcgacgcctacctcagatggtatagggatgtcaggataaagggcgacctggattacaggagccccatgcagtaccgcagggacttgggtctgctagcagcgtaggatggattcggtccaagattcccaccgcagtcccgagcgaactgtcgacttctacttgactgaatgcacgcgccgcgggcctgcgcgcccaaggaagcgtcacgaacctgcggggagtggcccggggcgcggggcttcgcgtgcgagcgtgccagagccctcgtccggcggcgggcggtgggatggcaaacggcgtcgcagccatcgctgtcccgacgcccctatactcgaaccttactcgcacttactcttacctgctatgccctcatgggaagggctcgacggcccctgctgcccgcaaagccccttccaagctatgcccgagcccttacctactctgccctgtgaaggtcatagtactgggaggggtcggtcgcgctggtgccgtgccagtcgaggatgcgcttgtcagcgagcgatctgagcgtcgcgcgggccactttgctgctgcgccccagatgttctgcgagcccccttaccgtcacccgccccttcccatacgtgtattgcacggcggcgagctcgtactcgctgaggtccccgtacacgccctcgcccaagctttccgccacggcgtcggcctgcctcagcacgcgcgaggtgatgctgttctccagcaccaggcgcaccgacatgccgttgggctccgagtacgttggctcgttcaggaagaaggacgccatctcgtcgtagatgcgctgcacgccctcgttgagctcgcgcacccagccgaactcgacgagcgtccgcgctatgatcgggttgcgcgaccacctggtgtacctcatgttctccaaggtcaccatgttgggcaggccacccgggctagtgatctccaggcggtcgccgtacatcatcacgcgtatgtggtcgccgctcatggcgtagtcgcggtgcgtaacggcgttcaccaagccctcgaaccaagcgaactcggggtactcggggataatcttgaacctgccgtcgtcccccaggtactggaactccctcagctggctcgatatgaaccccttcgcgccctcaatctgcttgggcagcggcccatcgaaggtcctgtccttcacgatgttgagccgcctgcccgtctccatcttgttcccgtcgaagcggattacgcgcacccgtgcccaaggtatgaaccgcgtcgggttctcggagaagagcaggacgcccgcgttggtgaggtggccgtcctggaggaacccgcggctgcgcagcacctgctcgtcgctcgcctcggtgccaagctccgccttgtagcgcgccaccacctcggggtccacgtcctcgacggaggagcgctcctgcacctcgtcctcgtagcgccgctggttcttgtcgtactcgagcgccagcacctgctcgcggtccagctccacgctgctgtcgcgctggcggaggaacacggccttgtcgcttctcctggcgatgacgcgcccggtcgagctggcgacctccagcacgagaatctggtcgtcctgacccttggcattcttcacgggcaccctcatcgcgcgcaccacgggcgaggggtcgcagcctacgatcggcgcctgctcgaactcctcaatgtcccgcgcgccgtcgcgcttgaagcctgttatctcgccgttgtcctcgatgccgatgaccagcttgccgcccgaggcgttggcgaaggcgcagatgtgccgcgccgtctccttggcgttgaggcgcgcgctcttgcggtcgaagtagaggttctctttctctttggagaagagatcggggtcgttccgggtgatgggctgctgcatgggcgtctcctaaatatgtttaatgggagacattttaccgcatggcctaggggcggccgatccccggacgtcttgccaactaaagaccccagcaccctagaacaggcacgcgtcgatggtcgccttgccgagaagtgcgtcgagccactcggccggaatgcagtccatgccgtacacgatgccggcgagccctcccgccaccgcggcggtggtgtccgcgtcgtcccccaggttcaccgccgtgagcacgcactcggcgtagctcgaggtgttggcgaggcaccacagggcggcgcgttcggtgtccagcacaaagcctccggagcgaatctgactcgcgggcacgcccacaaggctgcccgcgacgtcgtgcagcccctcgccggcgatgagcctgcgggccacgtgcaccatgcgaacgcacgcctcgcaggagattgcgtgctcgtgcgtgatggcggagacggcgcgcacctcgtcgtccgtcgcatccgtgaacgcgagcggaaggatgcgcatgagggacccgttgccgttgtcgcgctcgcccgcgcgaccgtgcccggaggagagcgcgtcggcggtggtgccgccgatgtcgaagaggccgctcacggtgtacgcgccctcgcggtaccagcggacgaagcgctcccgcatgtcgcgcacgtcgatgcggcccgtggcgcggacgctgtcacaggtcgcgagtgccatggaggtgtcgtcgctccaggtgccggcgggctggttgtgcgaaccgtgtcccaccatgcccgtgcactcgaacgtgccgcggacgcggaactcgtagggaacgccgagggcgtcacccacggcctggccgtagacgcagtcgcgaagggtggggattcgggatggtgagccattagtcataatgagactccttcatgcagaggcggtgcgcagcaggtggctggagcctcaatcgagtgattcaaagtccggcgtccagaggcgcttgacgatcgtcccaagcagctcggtcctctctgatatctggtctcggccaaaggtctcataaggcttgaagtcgaagccggacttgtcaatgaaccgcttgaattggggattgtggttgtaatgaccaggagtgagggcggcggagagcacgttccctttctggctgccataggtgtccatcttgtcggcatacctgctgtcgttgagcgaggcattagtggacttgtcgaggagcagcaggttaccggggctgttccggaagctggcgaactcctcgcggctggcgtattcgtcctgataccattcgtagtgatcggtgatgatgtgctcgacctcgaaaggccgcttgctcctctgcgccacgtagtcgaggtagtggccgggcaggccgcaccctcgctccacgtagtcggtgatgcgggcgagcatgtgcttgatgtacttcttcgtgtactggttgagcctgaagtcctgccagccgccgtcgatgctgatgcccaggtcgtcaagctccttgccaagctggatcgcgaggtcgcccaggtcgagtccgcgtatgcgcttggtaagctggaacatggcgtacttgatcgtggagtagtcaaggctcttgtagttgacgacgcgcgtgtagatgtagaggtcgatgaaacgtgacacgagcttcagcttccgtctggcaatctccgagctctccccggcccgcacgggggcaaagcacagctgggactggagcgtgaagctaagggcggcgttgtagtagaggaagggttgatcggggctgagggtaccctcatagcccttgatgcgtgagtagaggtcggcgaagtagaagaactcgttgatgaacctcacgtagtcatcggagccgttgagaccgatgcgggtgtggctgtcgcgtacccaggtgtgaaagctgccgccgatgaggtcgaagtcctccggctccgcgcccttcttgttctcgcggatggaatcggcgtacttggcgcgcagccaggcctttatgcagtcctcctcctcgccgttaccaagctccttgagggcgaagaccttttccttccacgtgccgttgagcttctcgcgcagcttgtcatctgagacctcggagagcaggtagcccttgagcatctccgccgaggtgaggctcaggccgcgatcgttcatggtgacgaacaccttgtaggcgtcctgctcggtctccgtggggatctcgatgaagtagaccttttcggcgagccagtcggcgaagtaaggcatggcgtggtcgtcgatcctctcggggaagaggtcgacgatatcctggtagcggttgtggaggttcacgacgctctcgccggagcccgtagtgtcgaagtccttaccgtcaaagagcgcgcggaggcaatcctcgcgctcctcgaccgagatgttgaaggaggacttgccgtagctctccgagtagaccatctggtcgatcttgttgatcgtcatgccgatgtcgagaaggcgccgacgcacgtagatgagcagcagcgtgagcgaggagaggcgctgctggccatcgatgatggcgttctcgcgacccgcaagtacaacgcttcccatgaaatagactccgtaattggtgacgtcggagcgctcgtgggaggggtcgtagtaagttaagaactcatcggtaaggtcatccactagctcctgtacctgttttcgctgccatgcatattctcgctggtaatagtggatagaatacttcgtgttctgaagaagctccttgagtgacttctcgtgtccctcgatttttctcatgcgttacttgcccttttcgctgtttgaactggctgagtctgttcgacacgaattagcgttttctaccgaaagcccttgcctgatggtgttcccagcttagctgttcttgcccttccctatgccgccctctggttgattcccgagaagtacc

SEQ ID NO: 160 - DNA, 6993 bp, Unknown
  Metagenome-assembled genome
cgcgtgtccgtcacggtgctgctgctcgcgctcgcgatcggcctgttggtggggttcttctgcatcggcgcgctgtggtgcgtggaccaactgcaggagcagatctggaaccacgccgtcgcggcggcaggtcgctgggtggcgctacccctgtgcgtggtcggaggcctcgccgtgggcgccgcaaccaaccgctttggctacagcctcgacacgctcgcgaccgtggtcacgcgctgccacaaggagggcggctaccgcctgcccggcacactcgcccaaacgctcctgctgtttgcgctgcccatcgcgtttggcggggccgtcggtcccgaggccggcgtgtccggcctggtggcggccctcgccacgagcggcatccgcatcctgcgccgctccggcgtcgccgcagtatgcgacccgggccacccgctggcggccgcgctctccgtcgtggagccaggcaaccgcacgcccgaccgccgctacgcgcgcttccccaaggtcatcctctggggtgtggccggcctcggctttgccgcgggcgcggcgctcttcgcacgtatatttggtcccgcgggaagcctcccccgctttgacgcgattccctacgccgcgctcgacgcaccggcgatcgtcacggcggcgctcggccttgtggttggctgcgcgctcgcgatgctctccaaggggacaaaggcccttctcgaccgcgtcgagcccaggctggaacagagggacgcgcacgcgacgctgaggcgcgccctcgtctgtagcgcgctcatgggcgccgtggcctgcgcgctgcccgacgtgctcttctcgggccagtccgccacctacgcgctctccacgtcgtggcagacggccggcgccgccacgctcctcgcgacggccgtggccaagatcgtgctctccaacgtgtgcgttcgctcgggctgggtgggcggagagttcttcccgctcatcttctgcggcgtggccgcgggctttgccctgtctgccatcacgggtgcggaccccaggctcgccgtggccgtggcctgcgcggcaacggtgtccggcgccactggcaagtggctgctctcgaccctcgttcttgcactctgcttcccgccggcgagcctgcccgtcgtggccgtcgcagcctacgtggcggcgcggctgatggcggcgtacgaccggtgcggccacagcatggaggccggcaccaggcggtagcgggcgtcagtcggtggcggcgtccttctcgcccgcgtcattctgccccgcgtcgcgcgcgtgcaggtagtcgatgtaatgctggccccaggcctcgacgtcgtccagcaccggcccaaacgatcgccccagctccgtgagcgagtactcaacgcgcggcggcacctccgcaaacgcctcgcggcgcacgaggccctcatcctcaagccgcttgagctgcgacgacagcgtggagtgcgtgagctccggcatcatgtgctgcagctcgccaaagcgcttggtgccctcgctcaggcagtgcagcagcacgatcgtccacttgccttgcagcagccattgcgccgtgacgtagggacacaccccaaaccgctccggcgcggccttccttcccgccatgtggctccaacctttcccgtcatggtactaaacgcgatacctgcacgcgcaaaagatactacttgcgcgcctaaattgtcatctctatagtatcagttaacgacatggtatcaacttgatacctttactggaaggaggcgcaaatgggcgagaagaaccagacccccaagcagccggcactgttcgtgggccacggcgaccccatgatggcgctacgcgaggacgacgtggcacgcggcctgcgctccgtgggcgagcgcctgctggtcggcaagcccaaggcgatcctggccgtgtccgcgcactggtacacgcgcgggaccctggtgcagagcgacccgacgccgcggcaggtaaacgacatgtacggcttccccaaggagctgtacgcgatcaaataccgccccgccggcaacgcggagctcacgcagcgcgtactcgacctgcttggtgacgacgtgcaggtagacgacagctggggcatcgaccacggcgtgtggacgccgctccaccacatgctgccgcaggccaacgttcctgtggtcgagctgagcgtgaacggccttgccgacgcccgctacgcctacgacctgggcacacgcctcgcgccgctgcgcgacgagggctttgtggtgctgggcagcggcaacgtggtccacaacctgcgcgaggcggactgggacaaccccaacggcacgccgcagaacgtcgcgtttgacgaggcggtgctcgcggccgtgacggcacgcgacgacgaggccgtcatcaactaccaggcgctcccccacgcggactacgccgtgcccacgcccgaccactacctgccgctgctcaccgtgctgggcgcagccaagggagagaaggcggaggtcttcaacaaggtccgcaacctgggcgcgatatccatgacgagcttcgcgttcggcctcggccgctaacgctcgcgcccgccgctggcagacaacgtaaagaaagacgccccgcagacggggtcatataagacacaaggcaacacgcaaaacaagaaggagaagaacatggcagacaagaagaacgtcctctttgtggttggcaccctgcgcaaggacgggttcaacctgcagctcgcgaagcgcgcggagcagctgctggccggccgcgccaacgtgagctggctcgactactcgcagcttccgctcatgaaccaggacctggagaacccggagcaggaggccgtagccaaggtgcgccaggcagtgcgcgacgcggacggcgtctggttcttctcgccccagtacaacgcgtccttccctggccacgtcaagaacctggtcgactggctgagccgcccgctgcccggcaagggtcgcgacaccgcggtcgccggcgggatgaaggccacggtcagcggcgcgggcggacgcaccgccaccgcacagatgcgcaccgcgctcgactcgctgctcgagtttgtgggcgcgagcgtcatgcgcgagggcgagacgggcgtcgcgctgtccggcgcgtcgtggggctcgggcaagctcgagctctccgcggacgacgaggccgcgctcgccgcgcaggcggacgcgttcctcgagttcatcgcgtagcgagactacagcaggacccccagcacgacgagcgcgacgcacgccaccagcacggcggcgtcgcgcccgtgcatggggtagcgcttgaagctgcttgcgcgcgtgcgcaggtagaagccgcgctgctcggccgcgagcgccgtcgcgtccgtcttgcccacgctgctcaccaggagcggcacgcagagcggcagcataaggcgcagcttgcggatggggttcttggtgtcgtactccacgccgcgggcgcactgcgcctccatgatcgcgttcatctgctggccaaacaccgggacaaagcgcagcgccgtggtgaacgtgaacgcgtagcggtacggaacgtgcagcacctccacgcaggcatttgcaaggtcgttcagcttggtcacgctcagcatgagcaccagcggcagcgccacgcccaaaaggcgcaggcacgccttgccggcggagtcgagcccctccgtcgtcatccacagcagcaccgtcctgccgccgcgcacgaaggcgcactgcagcaacagcatgacgatggcgatgggcaccaggagcttgagcagcgtgacgagcttggacgtggtgtggctgtaggccgccagcgcaaaggtaagcgcaagcagcgccacgagcatgccgtacgtctgcgcgcagaacgtcgccacaatgatggccgcggcgatcgcgagcttggtcacggggttcagccggtgcaggagggtttctcccggaacgtactcgatcacgctaaccacgactgaccagctcccccgtgaggtcgactatgccggatacctggctgatgcccgcgtactccgggctaaggtcgcgcgcgagcgcctgcgacagccgtgtgacctgcggcgcctccacgtacgcccgccgcatgagcggctcgtccgcaaactcctgcgccgtggggccgcgccccaggatgcgcccgtccgccatgaccacgacgcgctccgcaaagtcgctcacgacctccatgtcgtggcacaccatgatcacggcgcagccggcatcggccatctcgctcaccgtgcgcatgaccgtcatgcactcgcggtagtcgagcccgctcgtgggctcgtccagcagcaccacgtccggctccaccaccacgacggaggcgagcgcgaccatctgccgctgtccgcgagagagcgagaagggcgactccccctccggcaggccaaacctttcaattaccttgtgcgcgcggcggcgcgcctcgtccgcgtcgaccccctggagctccagcccgaaggcgacctcgtcgagcaccgtgttcttgcacagctggcagtcggggttctggaacagcgtcgcgcagtgcgcggcgatgcggctcgtggggacgtgccgcgtgtcgagcccagacacgagcacctggcccacagctggcttgagcaggccgttcaggagcttggtgagcgtggtcttgccggcgccgttctggcccaccacgcccacgacctcgccgggatagacggccatgttcaggtcctccaccgcggcgccgctgccggggtaggcaaagcccacgccctccacgcgcacgacgggttccgcgccctccgcgtgaggccgcggtaccgccgcgtggggcgagcttgccctgaaggccgcgtcgcgctgcgcgtctgccacggggcccgcctgcgcgccgccggcaaggtgcggccgaacgaggccctccaccagcgactccgcctcgctcacggtcaggcacggctcgccgggcggcaggaggcccttctccaccaggctgttgtggacgcgcgccatgcgcgggctgtccacgcccagctcgcgaagctcgcgcgcgtggccaaacacctgccgcggcgtgccggaaagcacgatgcgaccgtggtccatcacgaggatgcggtcgcagtagcgtgagaggagcgcgaccttctgctcgatcacgatgaccgtgatcccctgctcgcgcacggtgcacagcgtgtcgaacaccaggcgcgacgacgccgggtcgagcgcggcggtcggctcgtccagcaccagcacgcgcgggcgcatcgcgaggatggccgcgatggagaccttctgcttctgcccgccagaaagcgtcgcgatctcgcggtcgcgcaggtccgcaatgcccacggtctcgagcgccccgctcaggcgcgcctcgatctggtcgtgcggcacgccaaagttctcgaggccaaacagcagttcatcttctaccacggacgccaccatctgagcgtcgatgtcttgcagaacgctgccgacgacctggctgatgtccgtcagggtcacgtcgcaggtgtccttgccatccacgtacacggcgccatagagctcgccgcggtagtggtgcgggattgcgccggaaagcgccgccgcaagcgtggacttgccggcgcccgagggaccgatcacgcccacgaactcgcccgcgcccacgctcagggacacgtggtcgagagcgcgaggcgcgtccttctcgcctgcctgcgcatacgagaaggacacgtcatccagtctgactatgggattctggtcagtcattcgcacgcggccccagcctacgcctcgaccttgagggccttgcagatgggcacgtagagcgcctgcaccaggatcgcgttgaacacgccggtcgcgaacacgacggggagcatggcggcggcgagctgcgccacgacgccaagcatcgccatcttgatgaccatgaagatgcagccgctcacgacggtggtgatgaaggtgccgatggccgggacgaacttcttggcgttgccgcgcatggcggtgcggacgatgacggccatcagcatggccgcgacgccctcggccgcgaagtcgatgaacggcgaggtggtggtgatctggatgaccgccgcggagatgaggccgatcacgagcgcctgcgggacgctgggcctgacgacgaggatcgtgaggcagaacgccgagatgatgaactcggggctgatgatgccggcggtgaggctggagattgccttgcccaccgtgaagttgaggatgaagccggccgccaggagtacggcgaggaggacgagcgagcggacgtcgagcttgccgtggtctgcagtgttgacggtgcgggcctgctgggtggaagcggtggtagccatgagtttctccttttatgaattcaatccgatgcgttggttttcgttcttatgtacttgcacttgtctgtggttgccgtcagccgcgccatcgacgcgtcagttgattcttggttcccatggtttcctccaatgtgggcaaaaaatccgagcgatgcgtaaaagaaaaggaccccggccaaaccggagtccttcagatttgcgcaggcatgtggcgcgagagactcacgatcgaccgttcgagagagagttgcgccaccaccagttgttgttggacttgcagacgtttgcgaagcacatcgtggtgacctcctctcgaaaatctctaccgcgccaggcggactctcgttcattggttcgcactataggtcattcgcgcacgctgacgcaacccgcaacttgtaaacgttttgtttctgccaacgttcaggaatccccgcagcggcgcgcagccagtgccctcatacgcagttgcgcaggtagaacacggctatctgggtcctgttgctgaggtcgagcttcgtgaggatcgacgagatgcggttccgcacggtaccagcgctcatgcacagctcgtcggcaacttccgcgtttgtcagcccgtcggcaatcgcgcgcacgacctcacgctctcgctccgagag

SEQ ID NO: 161 - DNA, 5756 bp, Unknown
  Metagenome-assembled genome
tcccacacctgggtcatcccaagcttgcggccgagaatagtgttgaccattcctggtcctttccttaggtggtcatgggacccatgagacgcatcctgcgcccctccccagcggaccacatccaacgagtgttgcctttctgagcagcgcgtcctcctcgcgggcaggcattccctcacaggacgggaatgagcgatttagacacagttgcccaattgcggcagcctgtctagaatacactcaccgcgccccgttcacaattacttctcacaaattcatggggttcctatctgcgtgtttgcataccacgagctcgggcgtatccatagcccttctcccccgcccgcaaggcatgtgagcgagaagtgcgcagcggaccaacatccgccgtcacgcgctccggcggccccgccgcgcgtacaatgtccacgccgcatccacggaggaggaatcccttggtcctgccaattgtcacgtcacgcgtcctgctgcgacagccctcgacggaggcgtcgcgcaacgacgcacccatcgcgcgcgacctgctcgataccgcgtccgcccatgcagacgtctgcgtggggatggcggcaaacatgataggcagcagcaagcgaatcatcgttgccttcagcggaagcgcgtggatgctcatgtacaacccgcgcatcatacagaagagcatgccctaccaggccgtggagggctgcctgtcacttcagggcacgcactcggccacgcgttaccgccgcatcaaggtgagctacctcgaccagtccttccatccacacacgatggagtttcgcggcaagctggcccagatcatccagcatgaggtcgaccactgcaacggcgtgctgatatagccggcgccacgaccgagcgatgccagccgcgaccctacagcgtctgctcggtgcggccgatgatgtcgtcctgcgtctttttggaaagcacgttgaagaaggccgagtatcccgccacgcgcacgatgaggtccttgtgcgcctccgggtgcgcctgcgcgtccaggagcgtctcgcgcgagacgatgttgtactgcacgtggtagccgtgcagacggttgaagaaggcgcgaatcagcatctcgagcttctgttggttctcgggacgcgagagcatcgtgggcgtcatcttctggttgagaaggactccgccggtgatcttctccgtcggcagcttcgtgacggatttgaagacggcggtcggcccctgcctgtcgcagttgtgcgcgggcgagcacccctcggcgagcggctccctggcgtttcggccgtcgggcgtggccatggtccccatgccctggccaacgttggcagaaatggagctcgtgccggcatagcggatcccgccgatgggaccgcggccataccgcgtggtcttgtacttcgcaacctcgtcgatgtaggagtcgtacgcctgcaccacaagctggtcaacgtaatcgtcgtcgttaccgtactttggcgcgtcgtttatcagcatcccctggatgcggcggttctcgggtgactggaagtcgtcgaggatggcatcccagagctgccgcggcgtgagcttgccctcgtcaaatacgagacgcttgatcgcggccaagctgtcggccatgttggcgatgcccacctgcaggccgctgatgaagtcgtagtgtgctccgccctccttgatggtcttgccgcgctcgatgcagtcgtccacgagggcggagcagaggacgtcgggcaccatgcgctcggacgccttgtcgataaagttctcggtgatcacggaatagcggcacatctcgcgtatggtcttgtcccatgcggcaagcagctcgtcgtagctcctcatgtcggtgaagtggccatagtcggccgtgaagcgacgaccggtcgtaaggtccacgccgccgttcatggcaacaagcagcagccgcgggaagttgaggtagctcatgccggtgcagcggtatccccatttgccgggtatcgccgtctcaacgcagccgatggcggagtagttgtacgcatccttggggtcaacgccccagttgatgaagctcgggatgatgacctcgtcgttgttgaaggcgggcatgccaaagccgagcttcatgacctcgacgcactcgtcaaagaagcgcttgtcgatgctggcgtggtagcgcacggtgaggttcggctgcgtaaggcgcgtctgcgcgacggactgcagcaccagatacgagagctcgttcaccgcatcctcgccatccgtcgtctgcccgccaatggtgacgttctggtacatggggcttcccgccgaggagagcgtatgcgactgggagcgaatcttctgcaccgtaaggagcttgatccagaggttggtgagaagttcgagcgcctggtctcgcgtgatggccccacgctcgacgtccctcttgtagtaggggtacatgtactggtcgaaacgcccaaatgacaggctgtgaccgttggactcgatctgcaggatgacctgcatgaaccagcacgtctgcacggcctcgtagaacgagctggcgccctcccagggcatgcgggcgcacgtggcgctcatgcgctcgagctccgccttgcggacgggatcgtcgcaagccgccgccttctgggcagcgagcttggagtagcgaccggcataggcgtggacagcctcgcacacgatcatgacggccttgtagaactggtacttgtcaatggaatcggggtcggtgaggtcgagggcctccttggcgtccctggcgcgctggtagtaggatttcagtccctcgcgcagcagtcgggcgtggttgatggcgaggtgcgcgtcgccggcgttgagcttgccctccatgccaaagagccccgtctccatgaagacggcgacctcgtccggcaactgggccatgccgtgctcgcgcagggtcttccccttccagaacggggcgagctcgcgcagccgacgcttgtcctcgtcggtaacgtagaacacgtcgccgtcgcgcttctcgaagctgtcgagctcatcgatgatgaagcccatcgtgtattcgggaaacacgggtgcgttgcagttctttgtcgcctggtttccggcgatgagcgtctggtcctcgatgtagatggtcatgttctcgagcacgttcttgagtgcgagcgcacgctgcatgacgggaggctgctcctgatggctgcgatacgactcggtgacaagtaccgcacgctccgcgtccacgtaaggcttctcgttcagcacgtcggtgcgaaactcctgcattcttggggtgagcttgccaaagcgctccgcgttctccatggtcgtctcctgtcgcatcccctgcagcatcggtcgccgcagttccacgtttttctggagtatacgcggaagaagtgcctaggtcaacgttcgaagtctcttaatctttcgttcgaaagtatcatgcattggtttagaatgttcctaaggacgatgcttggagaaccatgcagagagcgacagttttcaacgtacagaagttcagcctgaacgacggccccggaatccgtaccgtggtgtttctgaagggttgtccgctgcactgtgcatggtgcgcaaacccagagagccagtcagccctcccccagctcgaatggaaggagagcgcgtgcattggctgcggcgcctgccttgctgccgcgcccggcgcaagggcgcgcgagacctctggaaagcgccacgtagacgttcggaatctgcgcggcgactccgacgaggggcgtgccgccgtatcggcgtgtcccacacgtgccctcacctgtacgggcaagatgacgacgaccgacgaggtcctgcgagcctgcctgcaggacaaacccttttacgaggagtcgggaggcggggtcaccctttcgggcggagaggcgctcctttggcccgacttctgcgaagagttgctcgtccgcctgcacgaggaggatgtggacacctgcatagagacggaggcacacgtgagcccggatgtcttccagaggattgccacgcatcttgaccacatgctcgtggacctcaagcacgtcgacgcagccaggctcctcaagcataccggtggcaaagcagacctcatgctcgacaacctgcgatgggcacttgccaaccatccggacgttacgccacgcacacccgtcatccccgggttcaatgacaggctcgaggacgcccatgccatggcgcgctggctgcgcgaggctggcgggacccgcgtgcagctgctccccttccacaactttggcgagagcaagtacgatctgctcgacatcgactactccctgcggggagtgcccaacctccatcccgtggacctgcgcgactaccagcgcgcctatcggaacgagggcattgacgccttcttctagcgccgtgcgggatgagtgcccttgatgtgagctgcgcccgcgccccacagcttcgccactcatgccacagcttcgcactactttcgttcgtaatatactggtagacaattgataaccatctgagccacgaacgaaatggaagcgcatgtcgaaacgcgacacgaagatactcgagacactcaccagtcgcggtcgcactgaggtctcggagcttgccgaacagcttggcgtctccgccgtcaccatgcggaaggacctcgatgccctgcaggcccaaggcctcgtcgtacgggagcacggcttcgccacgctctcaaaccccaatgacgttggcgggcggctcgcctaccactaccaggagaagctcgctatcgctcggtgcggtgcggagctcgtttccgacggggagaccgtgatgatcgagaacggcagttgctgtgcccttctcgcccgacagattgccgacaccaagagggacgtcaccatcgtgacaaacagcgtattcatcgcggaatacgttcgcgatgcccccgacgtacacgtcaccttgcttggcggcgcgattcaacctgactcccaggttgccgtgggtccgctcgtgcgcacgtgcgcccgcgagttcgtagtggaaagcctcttcattggggccgatggctggatcgacggcatgagcttcacgaacaacgaccagatgcgcgccgaggccgtacgcactatggcggagtctgcggcacgcgtggtcgtgctgacggagtcggagaagttctcgaggcgaggctcggttccgctgcgcctggggagcagacggatttccgtcattaccgaccagcttgtacctgaggcggcacgcgcgagcctcgtaagggacaacgtagacgtcatccttgcagagccagacacatacaagtgatccgagacggcccgaccaccggaaacagtcgtctggcgaatcttctaggcagctcttgtccgtaccggatgccgccccggcgggtgaaaaaagcccccgaccttcaatgggaggtcgggggccttgctacacgctatcgctctttagcgactggacttagagcttgatctcgatgtccacaccagcgggcaggtcgaggcgcatgagcgagtcgaccgtcgaggagctggggtcgaggatgtcgatgaggcgcttgtgggtgcgcatctcgaactcctcgcgggagtccttgtccttgtgcggcgagcggatgaccgtgtaaaggttgcgctcggtgggcagggggataggaccagagacacgggcgccggtcttctgcgcggtgtcaacgatgagcttcgcggactggtcaacgacctcgtgatcgtagcccttgaggcggatcctgatcttct

SEQ ID NO: 162 - DNA, 5326 bp, Unknown
  Metagenome-assembled genome
gaggtcatggcgttccccaagacggcgagcggctccgacctcatgagctccgcgccgtccgaggtctcgggcaagcagctcaaggaggtctcgctcaggctcctgtaacagccgggggagaagaacagaaccattgctgggggtcgtcctgcggggcggcccctattttgtggccaggccgcgggcgaggcggcacgtccttctcgcccgcgccgcagagtgtatgcgtccgcgtgctatgctcctgacgacatcaaggtacgaacgacccaaaacctgggaggaacacatggacgagaagagcagcatcacccccgaggaccttgccgcctcgcgcgagcgctttggcgccgagcgcgtgaacgccgtcgcgaagaacgccgtcacctcaaacggcatccgctccgccgcgcgccgccccgagggcgtcgccgcaaacgcgctgggcttcgacctcgaggtcacgcagggcgaccggtgcgatcagcagcgctctggccgctgctggatgttcgcgagcctgaacaccatgcgctaccgcgtgatcaagaagtacggcctcaagacgttcgagctctcgcaggcatacccgctgttctgggacaagctcgagaagagcaactggttcctgcagaacatcctcgacaccctggacgagcccctcgacggacgcctcgtgtccttcctgcttgccgatcccatcggcgacggcggccagtgggacatgttccgcagcctcgtgaagaagtacggcgtggtgccgaaggaggccatgcccgagaccgcctgctccaggaacacccgcgagctcgaccgctacctcacgcgctacctgcgtggcgccgcaaagcgcctgcgtcagagccacgaggccggcgtgggcacggacgacctgctcgcaatgaagaagcagatgatggacgaggtctatcaccttctggcagtgtgcctgggcgagccgcccgcgtccttctccgtgcgcctgcgtgacaaggaccagaagctcgcgctctccggcaccttcacgccgcaggagttcttcaagaccgcggtcgacatggacgtcgacgcctacgtatcgctcatcagcgcgcccacggcggacaagccgtttggccacacatacacggtcagccgcctgggcaacgtgtgggaggaccacggcgtgcgctacctcaacctgccgcctgcggagctcaagcgcgtggccatcgcacagctcagggacaacctccccgtttggtttggctgcgacgtcgcgcaaagcttcctgcaagacgagggcatcatggacacggcggcgctcgacgtggacgcgctcttcggcttccccgttgagggttgcatggacaaggccgagcgcctcgactacggcgagagcctcatgacccacgccatggtgcttgagggcgtccgtctggacgagaagggcgagcccacgctctggaaggttgagaactcctggggcaaggaccatggtcgcgacggcttcgacacgctgtccgacgcatggtttgacgagtacgtctaccaggtggtcgtcgacaagaagtacctgacggaggaggagcgccgcacctacgagacggaggagccgacggtgctcgccccgtgggacccgatgggctcgctcgcgtaggcgtatcggtcggaccgcggccagcacgtgcaatccatgcgctaaaaggtgatcgccagtcccgggcaaccccgaggctggcgatcttgtttgttagctcttttctctatctcttgctactaagacctccagttgatggtgaccttgacgtcggagcccatcgcgcccctcagcatcgtctgaaggttctgcttggcgaacgtcttcgcctgatcgatgagccctccattgagcgcgtctttgttgctttgctcgatgcagtgcttctgcaggtcgacaacgctgtctggatcgatggggttgaggatgttgttctcctggtccacgatctcggtcttgtccatgtcgggcgtgttcgagatgatcttgggcgcgtccaggtcaacgacgacgctctttggcatgccgctcttcttgtccttgttctgagaagtgaacttggcggtcttaagattgacgcctgcctgtatggtgcccacgtagcgcatccagtacttgttcttggtgaagggaacgtcaaacagattgagaaggtcacggttcgagctctcgacctttgagtagaggtcatagctctggctggcgcacacaagtgtgccttgggcctggacctgctcgaagaccgcatcgacagtggtgactcgctcgtttctggcctcgacgccgctcaccttggggctcatggccgacccgatgcggtagcctgcgtatcctcccaccacaatcagcacgaggattatcacgataaggggagccctgttcttccgtgctgtctcgatggtggagcgaatcttggtgtcctgttccatttcatttccttccaagcggtgtgggcgacccgtcgccatgtttttctcaccctagatgagaggtcggggggggggggtcaaggactttttcagctagtgcgcgcgaagccggttgatggtgcaagccggcttcgcgcgcggatcgtggtgaccgcgtcagtagctatttggagatcttctcgacggagagcgtgatcgagctgatcgactggttgatcgccaggttcgagtactccgtgccgtcttcgtccttctcgtgctcgaacgtgagctcggtgttttgctccacgctctgggcggtcaccctgtactggctgagggatttgctgtcggacacgtccacgtagctgccgtcgttcgcgttgacgtcaagctgaacgtagcttccgccggtatagccgtcgacaaacttgcccgtcatcgatatgtagccgcagtcggcgaggtttcgacccacgtaatcgcggatgtatgcggtgctgttgttgggcgacgccttgatcttggtcatgtcgatcgaattcccgctcttgcccacctcgtccacggcaagcacgatttcgtcgatgctgttccagatggtcaggtcatactcctcgccgtcctcgtccttatcgaaggcggacttgattttcgtgttaggcgcaacgttttggcttgaaaccctgtacttacgcagcagcttggactcagagtcgctggagtctatgtgggttccgtccggggtcacgaagacgatcacgggatggacgccgtttccatactcatcgtgccttctgccgtccatcgccatgtagcctacgttggcggcgttcatacccacgtagttcttcacgtagtgggtgtacttgtccggcgacttctttatctgcacggtctttgtctgctgtgccggcgcgctcgccgtggccttgccttggcttccggccggcgcattgccgcaggcgctcaacgccacgaggatggctccggtcgcaaccgccgccgtcagtttcgtcccatgcattctctttcctttcgctcgtcttcctgcgttgaaacggacctgctacagaagtccgcgtatgccctcgtagctgccgggtccgtacatcaactccaccagcagctccatctcggggaggtctaacgcggagtccggcccgtcgtcccccgcaaacgtcagctcgaacgcgacgatgcgcctgaacagccgctccagtgcgttccgatccttcgcgtggccaagcgctagcgccttgtggtacctgctcacgttcctctcgatttcctcgcgcaggaggtccacctgctcgtccagaatcgcgtcggcgtccgagtgtaccctctcgaactccctcttcacctgggggagggtcatgccgcgttccctcagcagggccaccgcgtacagtaccttcaggtcccgcgtcgagtacacgcggtatccccatttggtctcctttggcgacagaagcccaattccgccttcgccctggtagcagacgcgctgtatgtccctgcggcttagccccgtcagcctttcgacctcagagatcttccagccggcctggcccagcttcttgtgttggtgccttggcttcatgctgaattccccctgagaccaataaatccgttcaagagttgaacagcaatgcccatttggctcgaatctgcccttgggcacccgtgcgtgactcatgtcaatctcctcatttttatagaagcgacccaacgcgcttctcctatgagggggcgtgtttttttcgcgagaagggcggcccctcctcttgaggctgcgcacacaagaaggccccggcgacatgtggtcgccggggcccgagggctgttcttctctgttagttggactgagcgagacgcgttactgcgcggtgtagccgccgtcgatgtagaggtgcgtgcccgtggtgaactcgttctccaccaggaagacgacgccgtgggcgatctcctccgccttgccgaggcgtccgagcgggtgcagcgactcgaggcgcttcatgccgtcctcgcccatggtcttctcgttgatcatgcccgtgtagatgtagccggggttcacggtgttgacgcggatgttgtacttggccagagcgagcgccgcggactgggtgagcaggttcacgccgccctttgccgcgttgtaggagggcaggttggggtcgccgatggtgccctcgatggacgaggtgctgacgatggcgccgccgtggccctgcttctccatctggattgccgcgtacttgatgccgtagaacacgccggtcaggttgatggagatgagcttgttgaagtcctcgtcgctcatcttgtccacaggcaggaagtttgcgatgcccgcgttgttgtacatgatgtcgacggagccgtaggtcttgaccgcgaaggcgatgaggtcctggacctgcttggagtcgctcgtgtcagtctggtggaacaccacatccggcgagacctgcttgagctcctcgagtgcctttgcgccgcgctcttcgttgcggccagcgatgacgacctttgcacccttctgcaggaacgcctttgccgtggcgaggccgattcccgaggtgccgcccgttacgactgccgtcttgcccttgatctcgaacatggtgcctccaaacgattgcgtaccaacatctgtcggttcgttggggcacgtacccgttcccttaagacagcctttcgttcaggtttgcgagcggctgggattgcggcttgggcggtgaagaattgcaattagacatgtaaatgcttcaataggacactgcacaaagctgtaattttgcgctatagtaaagcaaactgaaatagctttaaggtaggaggtcccccatgagagcatttcagagggcgctccgtgaatgtgtgcttgttg

SEQ ID NO: 163 - DNA, 7401 bp, Unknown
  Metagenome-assembled genome
cagcgcgcctacctcgagattcacagcggagactccatcttcctcgacatctcgaggacgaactccttcctcgcggacatcatcgcgaggggcgacaagcaggtcatcgtcacgaccaacatgatcgaggtgctgcagaagctctcgaacctggaccacgtcaccgcgctcggcacgggcggctacctcaacgtgcagctcaacggctttgtgggtgacacgacgatcagcctgctggaaccgctgctcttctccaaggcatttattggcgcaagtggggtcgacctggacaacgcggccgtcacgtccaacaacatcgacagcgggtccgtaaaggagcgcgtcatacataacgcctcgtacaagttcctgcttgcggactccaagaagttccagataaagagcatgttccgctttgctgccctcaacgacttttccgccgtcatcacggactcgcaggacccgatggtgctcgacaagctgcgccgcttgggcatccccacctaccggacgctcacgtcctgacgcagaccgccacggacaggcagacgcaagaccgggggcgccacccgcgcaatgcagagtggcgccccgttggttatcggatactgacgcttatatataagtgaggttacgcgcggagcgtcgtgcgtccgtaggccttcttccagtttgccgtgaactcgtccaccgcaatctggacgccggggtggccgatcaggttgtaggccacgtccacgggtacggtgaccgcctggatgccggccgcgatgagctcgtgcacctggtcggtgttcttgaacgaggcgcccagcaccttggtgccagagttctgcatcgcgagcatgtcgatcaggtcgcacacgtccctcatgccgccgccatagttgcacatgcggttgacgtagggtgccaggtactcggcaccgttgtgcgccgccatgaagccggcgtccgcgctgtagatggaggtggccaggcagtgcacgccctccgcctcgagctgcttgatggccctcaggccattgtgcgagacgggaatcttcacgtacatgttctgggggcgcagacccgcgatgaagcgcgcctcctccacgattccgtcaaaatcggtggaaacgacctgcgcaaagatcttctggtcggggcggaagtagtcgattatctgcccgagcgcctcgagcggatccttgctggacttggccaggatgctggggttggtggtgacgccctgcacgttgagcaggccgtccaggtccttgatggcgtctatgtccgccgtgtccagatacagctcgaagtcgtccattgcgcgttcctttcggttttattggacgggaatgttggcgccatactagcagggcatgacgtgaggtggttcgtcgaatcgcccagcgggtatactcagctcacggtcaggctccctacggaaggaaagacatgctcgccatcgtcatcatcgcgatagtcgtagtcctcgccatctggttcatatccatctacaacggcatagtccagaaggacaaccgctgcgacaacgcctggcagaccatcgacgcgcagctccagcgcaggaacgacctcatccccaacctggtcgagaccgtgaagggctatgcctcgcacgagtccaagacgctctctgccgtgacgcaggcgcgctccgccgtcgccaacgccaccacgcccgaggacaagatgcaggcctccaacgtgctctccggcacgctcaagtcgctcttcgcggtggcggagtcctaccccgacctcaaggcgaacgccaacttccagcagctccagagcgagctgtctgacacggagaacaagatctcgtacgcacgccagagcttcaacgactgcgtgctcgagtacaacaacgcgatcgagaccttccccggcaacgtggtcgcgggctccaagttcaagacccgccagggcttcgaggtcacggacgactccgtgcgccaggcaccgcaggtcaagttctaggcgcgcaactcacataccgctgctttccaggggagaagaacagccgatttgggtcgttcttctcccctgcctttatgtgccgcgtggccgcaacggggccttggacatgcgcagaggttatgtgcggcttacattgcccttgcagcagcttggtcgaaacgtgtgggtcggcgtgtacaatacgttaggttttatggtccgcctggtatgcagccacgcggacggtcctgttggctaggagaagggtcattgatgaaacctcgaccgtacagtcgatgaccccagtgcgtcctggttggtcgcgcttggggtgttctgaaagcacgttcgggcactgtgcgatgcctgaaccggcaccaactaaggagttcgcatgatctatctgtcccagatgctgggcaagcccgtcgtcgacctcgatggagagaggatcggcaaggtcaacgacctcggcatcgccacgggcgaggtgttcccgcgcgtgaccgccctcgcgatcgagggtcccggcaagacgccgctcatgatttcctggcgcaagtacgtcgactcgtttgacgacgacgaggtgcgcctcaaggtagtcgcaaccgacatccgattctcgtacctgcagcccgacgaggtgctcatcgcgcgcgacctgcttaacaagcagatcgtcgacacgcgtggcatgcgcgtcgtccgcgtcaacgacctgaagctgagcgacacgagttcctcccagctgcgcctgctgggcgccgaggtgggcgtccgcggcctgctgcgctcgctctcgccgcggctcgagcgcatcgtgctcaagatctcgcgcgcgctgggcaagcccatccccgagaagatcatcgcgtggaactacatggacctgctggacagggacctttccaacgtgaagctctccgtctctcacaagacgctcgacgacatgcaccccgcggacatcgcggacatcctggagcggctcgacccgcgcctgcgcggccaggtgtttgcccagctcgacgacgagcaggcgagcgagaccatggccgagttcgacgacgacgcgatggctgccgagatcatgggcgacatggaggagaaggacgcgtcgcgcatgctgtccgagatggaccccgacgacgcggccgagctcgtgagcgagctggactacgacaaggccgagaagctcctgcgcctcatgggcgtgaaggagcagaaggcgatcaggcagctgctgggctaccgcgaggacaccgccggccgcatcatgacgtccgaggtggtctcgctccccgaggacgccacggccacggacgcggtggacaagctgcgcagcctgcccgatgacttcgagacggtccactacctctacctggaggacgaggagggtcgcctgagcggcctcgtgacgatgcaggccctggtgaccgccgaccccggcgacaagctttccgacctcgcgatcgacgaggacctggtcacggccagcccggacgaggaccaggaggacgcggccgaggacatcgcgaagtacaacctgctggcgctgcccgtcgtggacgacaacaagaagctgctcggcatcgtcacggtcgacgacgcgctcgacgtcctggaggacgagcacgcggaggacctgcagatcgcgggtgccacgacctccgactccgagggcaaccacaacctcgagagcgtcatctggctcatgcgcaacgaggcatggttcttcttctggatgctgggtgcggccgtgctgtccgcgctcttctcgcccgacctgggtgccatgccggcgctgctgctttcgctcgcgctccccgtggcgatcatcgcgggcaacgacgccgccaactacgccaagaacgccttcctcgagtacgaccccgacgacgaggactccccctccaccctgggctttgtgctcaagggcatcgggatgggcgcgctgttctccatcctggtgggcctggtcgcgggcggcatcgcgagcgcggcgctgggcaactccatcgcggcgctcaacgtagccaagacgagcaccgaggccgcggtcgcgagcgtgatggtgtcgttcgtgagcatgcccatctacctgcacgtgctgaggaagagggacgagaagaatctcgagacctcgggtacgacgctttccataatcgcgatggccatcgcgctcgtggtgtttacggttgtctgcatcgtcctcgtcagcagatggatggtctagcgtggcggccaaggcggcgggcaagacccgcgtcggcacgaccgacaagcaggacaagaagatggatgccaagagcaagacccagctcgcggccatcctcgcggcgatgggccccggcctcctgaccgcctttgcgggtaacgacgccggcggcatcgccacgtactccaccacgggcgccacgtacggctttggcatgctgtggaccgttcccatcatgtgtctgctgctcatcgtggtgcaggagacgtccgcgcgcatgggctgcgccacgggcaaggggtttgcgtccctcattcgcgagcgctttggcgtgcgcgtgtctgcgctggccatgctctcgctcatcatctcaaacttcacggtcacgctgtccgagtttgcgggcatcgcgtccggcatgcagctgtttggcgttcccctgcaggtgagcgtgcccgtaagcgcgctcgtcacgtggatgctcgccatgagcggctcgtaccaccgaatcgagaagatcctcctgggcctgagctgcgtttttctcacctacattgtgtctggcttcatggcgggtcccaactggggccaggccctgcacgacacgatcgtgccgcagttctcaaacgacccgcactacatctcgctcctggtggccaacatcggtaccacgatatcgccctacatgatcttcatggtgtccagcagcgtggtggagaagaacctcgacgcgtccgacatccccggccagcgcgcggacaacatctccggcgccatcgcggccgagatcgtgacctggttcatcatcctcaccacgggcacggtgctccatcccgccggcatctcgatcaactccgcggcggacgctgccaaggcgctcgtgccgctcgcgggcaagtatgcctcggtcctctttgcggtgggcctcgtgggcgcgtcgttcctggcggcctgcgtgctgcctggcatcacggccagcgccgtgtgcgaggcgtttggctgggagcgcggcgcggaccgcacctggcgcgaggcgcccgtctaccgcggcatcatcacgggcatcaccatcctgtccgcggtgatcatcctcatccccaacgtggacctgtttggcatcatgatggtctcgcaggtcatcaacggcgtgatgctgcccgtgctgctggtctgcatggtgctcatcgcggcggaccgccacatcatgcaccgtcacgccaacggcaaggtgtggaacggcctcacctggttcacgatcatcgcagtgacgttcttcacgatcatcatgttcgtgctgcaggccctgggatactagcaagcctcataaagttacgtgcgagaagagcggcgcggcctcctgatggggaccgcgccgccttgctatttgccgctgatgtgcgcgccaagcagctgcaggccatgcacgcccacaaggacgaagtatcccgagtagaggtacaggtagcgcgaccgcgcctcgaacaccatgaggaagagcgccatcgccccgatggtgaagatcatgatgacccacgacgtgcgcgcacccgcatcgctcccctgcgcggcgtggcgtccagcgggttgtcccgctcttctcgccagtagacagagcgggatgccggccaggcagacaagccaaagcgtctgctcgacggtgcagaacaccgtgtagaagttgggacccttgtagtagcccttgggataaatgtagctgcggaagaagttggtcttctcgccaaacgagccatggtgcggcatgaggaagaagtggccctcggccgtccaggcaaacgtgccgtcgttgaagctgacgagcgtcttcttgccctcgtgcctgaggaggccggccggtccgtaggcggcgagccgctcccgtatcaccctcaggttcatctgcttgcgcgcgtccacgttgggctccgcgatgctggcgttgacgtcctgctgcgagaacacgccgtcggtctctttgttgagccccatcatcgcaaagtgcgtcatgccgaaccttgcgttcttgttccacgtgattccaaggctcccgacggcaagggagacaatgcaaagcgtgaggatgagcgaggcgataacggcacccaccctcttgaggactgctgccgcggtccccctgcgcagatccgtcagcagccacgccacgatggtcgcaaggacaacaaagatgcaggtaggctttatgttgtaggcgatgccgccaagcaccccgagcacgatggccgccaccagggagggcttggtgcgcgtggcgacgcagagcatgagggtgcagaaaaacagcgagtacgtgtccgagtaggggatcatgtaccagggagacagccccaccagcacaaagaagatcgcgttggcggtccaggggaacgggccgcgcggcaggagccttccggagatgcgcgtgaatataaaaaatgatgcggacacgagcacgatggaaacgtacgcgaggaacgcccgtatggcgatccaggggaacagggcctgacggatgacctcctctgccctcagcacgattaccaggaagatgttgttggggtaggtcgagaagtagaagtacagccccgcatcctttggtaggctttgagaaagaggagatgggagaagaacggccccgcgtattgccccagtgtcccagcccgagtaaaagcccgcgtacttgaaggaagcggcctggtagcagagaagtgcaagcgtcgccaccagcgcggcaagcgtatacctgcgggcggcgtggggcggttgcacgcaagccccaccagccttgggctgcctgcgtcgcctgatggccagcacgacaaccacgacgccgaccaccagcgcaaacagaacccagttgggggcaaggggcacgttggaatcgctcccccagtagcggacgcgcctgtcgacaaacaggtccaaggcaagaatcacaaggtagagcgccagaacgatggtggcaagcacactggcgatgcgctggccaacgctgcgtccggcttcgtgcgatcctgtcgtcatgcatctcccatccgtaggcagcccgtccacaccgggctggtgcttgcgtacaagaaccccggctcgctaatcgagctcgacgtcgactatgtagcgcgggcgccccttggtctcgaggtaggccttgcccacgtactcgcccgtcacgcccagggacgtgatgatgaggccgccgacgagccatatcgacaccatga

SEQ ID NO: 164 - DNA, 13111 bp, Unknown
  Metagenome-assembled genome
aggggaggcgatccagatgctactgctcattatcgttttcgcactgctgctcgtggtgggactccagctcgtgcgcggcctcctcttccgcggcatgggcggatggggatggggacgccccctgtggggcggttggtatcgcccgtggggctggggccctggttggagaggctatggcatgcgcggctacagctggcccccggatggcccccgcggtccccgctatgcctgcccgcgcgggggattcgacggcctcggtggtcccgatggccgcggaggtcccggcgcacacggcatgcgcccctgacctggggtcaggcccaacggcatgaagtagcggcaacacttgcgcggattggaggacacgatgagcatgatggcgcccgaggtctttatcgacgagcttgacggcatgacgtaccaacagatgatggcgacgcgcgagggcctcgtccgcgagctgcggcgcctggagggcgagttctccagctcggacgccggcgcgggcaccgccggtcgctccgacccgtccccggccctcgtctaccgcatggacctcatctacctgtccgagctgctgcagctcatggaggtccgcgtgcaggaggccatgggggccgtcgcacaggcgtagcggtaggggagaagaacagcttccgcagcggcggcatagatttgaagtttgattctcgtttacatgatgctggcttgcatggccaggtacggccagggcgcctcggaggatttcctccgaggcgccttttcatgttccgatgggggagaagaacgcgcgcccactccccggatgtcgttacgtgactgcaatcgcagccgagcccgtacgcctcgtccttctcgcccgcagtagcatcccaaacggcgcgccgcaagcgtcgtccggcgagtggtattccctcgtagtgcacgttgtcattcgggcatcattttgcacgattaagacacattcgtggtacctgaacaaccacacatgaatattcgtgatacgttcagcttgtggcaaggtttcgacggaaggggaatgatgagcagcactaatattcacaagctgacgggcaaggtttgcaattcccacaagcgcgcgctggcctacgttgcggcgacggcgcttgcgacggccgcgatttcggtacctgtcacggcccttgcggaggaggcgccggcgactcccgcgaccgacgacgcaaagcaggccactaccaacacccagcagcaggctcccaccgactcctacaaggtgacccagaccgtggagaaggacgagaagaccttcgacacgcaggccgacgcccagaagtacctgtacgacgccacgcagaaggccgccgacatgggcaagtccgacaccaagtccacgtacgacatcaagaccactggccccacccaggtcacgaaggacacgactcacgaggtgacctcggtcgtggataagggcgagaagacctttaacaacgaggccgacgccaacaagtacgttgcggacaagacctccggctacaaggacaccaccgacacgaagtacaccaccaccggcaccgtgacccagaacgaggccggctccaaggttcagacgaccgagggtgctcatagcggctcgcaggacggcttcgcaacccagaaggacgccgaggactgggtcaaggaccagacgaagggctacaaggacacggacgacacctcctacacggtgcatcccagctaccagaacaatcctacgaccgagaaagacggcgatccggttcaggtcgactctaagacgaccacctcgcaggagtttgacagcaaggcagacgccgaggccgcgctccagaaggataaggacgcggatcccagcactgacctgcacaaggtcagcttctccgacgtggaggagaagacaacggtcgtaaagcccgaaagcacacagaccgacacctaccagagtgacgactacatgacggcaaagaaaccgcgacgccgccatgaagtacgagatcaagaagctcgaggccgatggctggacggtcatcgcgaccacatctgacacggatccttctgccaccatcggcaggtgcttcaccaagatcgatcactcttggtccaaatatcggattcctgccagtacgtacgtcatcgtaaagcaggcgacttggtacgcgctgtggacacctcagcaagtcagcgaggacgtcacgaaccagattaaggatcttatcaactggggcgaccccagcacgaggggtaagtccttccactctggcaactacggcttcgactcttacttccagaacatcgggacccagggtgcaggcagctactgggtgcacgacaacggagacggtacctacaccgttcatgcctcgtgcgccaagatctcccacctggactacggctgcatccagtaccagcccggcgagtactccttcaagctggacctcactcgtacggtgcctgcggttacgaagaccacgtatcactatacgaagaccgtcgcggactacacccagcccacgaagaccgtggaccactggaaggcctcgtactctgtggacgagaccaacgtggtgcccgtgtacgagtacgttgtcagctataaggtcagccagaccaagaccgtgcatgacactggctggaaggctggctacgagatcacgaagacgaccgagtacgccccgaagccggacaatccgactccggtgacccccacgcctgacaagccgacgcctgagacccccaagaccccggagactccggccaccaaggcttccgccgagacgcccaaggcaactccggccgcaccggcaaccgtgaagaccgccgcggtcaagaagtctgttccggcgaagtccgaggccaagagcgccctgcccaagacaggcgactcttccgccagcaccgtcgcggccgtcgccgctatgggcgctgccattgcggccctgggcctgagcctgcgccgcaaggggcagaggaactagcgactgagcgctgcaagttgacgcttgcgccctcgtgctagacagcaacaagtctcatttcacacaggcgggcctccgacgatcgcatcggaggcccaccttgctgtgttctcatataaaatgtcgtaacaatacgacgcaacgggaacggagggcgcgatggcaactgcacagggcgcggcgcacgcgggcgagaagaactacgacctcgagcccgagttccgcgtgccagggttcgacggacgcccgcgcccccgggcgagaagatcacctacgtgcaggcatccgtccgcaactaggcaaccagtaagggcgagagggcgagaaggacgagccacaaccaaggcggctcgtccttctccgctagttacgctgcgtcctgactgtgcctacgcaagctgcctagccgcgtcctcgaggatgcgaatctgcgcgatggtctcctcgggcttcacgagcggctccgcgccgttgaccagcgtctcgtacagggcgtcgtaccactggctgtaggtgctgcgcaccgtctcgacccgctcctcgtgcatgtggccggcgtcgtcctgccagcgcagctgcccccactgctcctgcgagtccaggccaaagtcgtcgtgccccttgggaaggtagaagtgcttgaggtcgcgctcctgctggtccttgtcaaacttgacgaaggaacctctgtccccatagacctcgaagctggggcggaggtaggcgctcatgtagttggcgtgcgccgtggccttgaggttgcggtcgtcgtagtacaggtcaaagtcaaagtagtcgttcgccatgcccctgccctggagctgccgcagctccccgtggacgcggtcgggaatgccaagccagctgatcagctggtcaaggcagtgggtcgcgtgtccgtagcctatgccgtcaatcggcctgttctgctccagcgtcttgccggccatcatccagggacgccagtagtcgtagctcgtcacgatctcgaagacgtgcccgagcctgcccgaggccacgaccttctgcgcggtcaagaagtcggagtcaaagcgcctgttctggtagcactcgatggtcaggccccgctcggccgcaaggtcaaacagctcgcgggcctcccgctccgttgcgcagaacggcttgtcgaccacggcattcttgccggcaaggaggacctgtctggcctgctcaaagtgcagggccgagggcgtcgtgatctccaccacatcgacctcggggtcacccaggacgtcgtcaaggttcgtcgtgtagcaaacgccgggaatctgggcccacgtatcatggccgatgtggcgggcatacatggtcttgatgcggaacttcttgggacgcgctagcacgaagggcgcgtggtatcggtttgcgctcttgccattgccgatgtaggcaacgttgaggatgcggtcagacatgtgtgcctccagccctcggacttggtgcttgccaagcaaagtatacgagcgcgggcgagaaaaacgccagtgcgtgccgcgacggcatgcctaccgtctgccccttgggcgcccttgaggatacctgagtggcggacaatgcttgcaatgggtcggatgccccaatgggtcggatgccccggcggcatccgcatcgtccacactggaggccactacatgaagctgacggacgacgagcttgactggatgctgggcgaggctgacctcgaactagcgcagccttacgccaagaacggaaagtatcgcaaggacgagtacctcctcacgcgctgcaagatatgtggtaccgtcgcacactaccgcctcaagtacatcctcgacaagaacgaggtgggggaacgggtctgccgtgcatgctactggtcgcagtggtacggcgacacacgtgcgctcgcgcattccgcgatcaagcacctgctcgacaagggtgccaacctcgacgacctcgtggaccaaggcgtcgtcaccgcacgggaggccacgtccttctccgatgccaagcgccttgccaacgagcatggctacgagcttgtggacctgctgacgggcgagcgccccggcgaggagctcctggtcgtgcggtgcaaggcgtgcggaaggcagacggtcgagcggccggaagacgtcacgtttggctgcagctgcagaggtaaagcaaagggcgtcctgtttggggaggagaaggtcaaggtccagagaagcgcgactcccgtggcttcggggcgctaccaggacggaaccgagcggctgctcgtgcgctctggcgcagagtgcctgggttggtgggacatcgaggccaacggcgaggtgccgcaggacctgacgtgtctttcccgccgtgagtaccagtggaagtgcccggagtgcggctgtcgcttcagggcgcccgtgtacattgcctactcgcacctgttctgccccaactgcgttgcatggagcatcgcggagtccgacgccgcttgggagattctctcgcgcatgactgccgtggactttccggacttgcttgcggcgtgggatgacgtgcgcgatccaaggacggtgccactgaccagcgaccgaatcgtccacctgcgatgccccgagggccatcacaccgcacagacgctctatagctacctcacgcgcggctgcggaatatgcgagggccttgcgaccaggcagctgcgcgacaaggacaggcagtacctcgccacgacggacccggagctcgcggcggagtgggtccggccccgggacggcggcaactggacgccgcagaacgtgagggacggcagcaagcggaccatcgtgtggcgctgcatcacctgcggccatatgtgggaggccaccgtgcacgcaaggcagctgcgcatgaacaaccgctgccccgcctgcggcaaggttatgggctcgctcgcctggaagtacccgcagctagccgcggagtggagcccaaacaacccaatcagcccatggaacatcaagcccttcaacaagctcgacttcacgccggaatgggtctgctccaagaacccggagcatgtctggcgcatgacgacgaacaccaggatcaacaagggtcgcggctgcccattctgcgagaaggagaagaacgggcagtcctgattaggtaccaaaatttatctgcctgcttctgccaacgcctggcggcaaacggagcgaagtgggcgagaaggacgagccacagccaaggtgactcgtccttctccgctagtgacgctgtgtcctaccagcgcttactccactacattcccgttggcgtcgtacttgtagaagccctcgcccgcggcgatgccggtcttgcccgcgtctacgtagcgccgcagcagcgcgacctccttgcccgtgggggtcgaggggtcgtccgcgccgggcatcatggacgtgatcttgagcgccagcggcaggcccaccttgtcgatcttgcggaacggcgtctggtcggggcgggcgccggtgtccaggatccagcactcgtcgacggtggcggggtcggtcacgccgttggccaccaggtacatggccgcctggaaccaggggatgagcagcgtgttgaggatgtagcccggctgctccttgttgagcttgagcggcaccatgccgatggcgcgcgagaacttctccgccagggcaaaggactcgtcgctcgtgcggtcgtggcgcatgagctccgtcaggttgttgcgccagatctggttggcgaagtgcagcgtcatgtagcggtcgggccggccggtcgcgtccgcaaaggtgctgggcaggaacgtggaggagtcggtgagaagaacggtcctctggggcatgcggtccgctaccttctggtagaacgcgcgcttctggtcggggtcctcgttgatgcactcgatcaccacgtcggcgtcgccaaaggcctcgtccaggtccgtggtcaggcggatgttcgaaaggcgctcggacgcctgggccttgagctgctcgatctgctcggcggaaaggtcgcggtcgtcagagagcccgcggcagtactccgccgggtccttctcccacgcgtcgagcgccgccaggatctgcttgcggacggtctcgagccgcggcttggcgcgcccgatcgagccctcgctgcgcagccagaccgtggtctggaagcccttgtacgcgaccatcgacgatatctggctgccctcggtcccgcagcccgcgatggttaccttccgcacgtcctcgatgtccattggagtcgcatcctttcgtgcctcgctactggcatgtgccctggctgcactataggtcggcatgagatagccattctcacgaaatgacgcggcggcacgatgctctcggtcagtgcgaggggcggaatctctatggcagaattcaaatacgaggagaagaacaggcaccaaccgattggggaccaccatgcttgcagactaccacgtgcactccggctactcggacgactccgactatccgatggagcaggtcgtccgtgatgccatccgcctcaacctggacgagctctgcttcaccgagcacgtcgactacggcgtcaaacccgactgggacaagccagcaacggcccgcttcgagaacggccaccccgtcaccaactgcccgtaccccgcgtacttcgcggagctcgagcgcatgcgcgaagcctacggcagccagattcgcatcgctcgcggacttgagtttggcgtgcaacatcacaccatgggtgccttcaaccgcgtgtacgaggcctacgccgaccggctcgacttcattctcctctccatccaccaggtgggggacaaggagttctggaccggcgacttccagcgcggccacacccagcgggagttcacgctcgcctactacgaggagctcctgcgcgtcgcgcgcgacttcgaccattggtcggtcatcgcgcacctggacctcatccgtcgctacgaccccacgccgacgggccccgtgcccttcggggacgtgcgcgacatcacggcggagatcctcaaggttgccatctcgcgcggccgcggcattgaggtcaacacctcaggttggcggtacggcctgggcggcccccagcccaccgaagacgtcctcaggctctaccgagacctcggcggcaccgtcgtgaccatcggctccgactcgcacaagccctcgcacctgggctcgtacctgcgtgttgccaaggacctcctacgatctgtcggcttcgagcgcttctgcacctacgagctcatggagccccgcttccacgagctgtagtcggctccaccttattgttctgtgtgtattggcgcccgcctggctagcccagcaggcgtcgatacatttactcatgtaccaatgtcttcattccaacaggcaaaataagacaggggagaagagcatactcatagtttctgagacgccttgctcgcctcagcccaaagaggtctctcgtgagctatgggaatccgtgtctgtcgtacttcatgctcagacattcgatggcgaaaagagcttccttcgatggtgctgccgtcgtcaaatgctcccgcatcgcattaagtcaagccagtgagtgccgcgtgccatcgtaccatttcgaatcgtggcgtatttgtacgatgtgcactttggcttcagcttcaatgtgatcatccagttacgcgaatggcacgcgatagcaaatgacttatgacttgagaccagctcccgcatcattttgataagagaggcgtgttggatgttgcttctgcatcggtcaagtcacaatcgcgaagaacattggcagcagcgcaggctccgaggcgcgactgggttctcgatgtgcttgacgacgagggaatcgactacgtcgaccgtcgcgcggatggtggttgcctctgggtgcctgggggtagcaatcttgaaagacgcctttgcactgtaatgaagcggggcgcgggcttcaggtacagcaagatgggtggtagggccacgcacggcaggcccgcttggtggctcaagggttatcccgaggaacgagatgctaagccagagagtctgctcgtatccaaaagcggagctcgatgctctcgacgtgggtgacgccgtgttccacaaggcgttcggctacggagaggtcgtcgacctgagcgacaagtacgtgatggtgtcttttgagaacgacaaccacaaaaagaggccattccgacagttcggattcccaggtgctttctatcaaggattgctacgaatcgtctgagcggtgacggatattgagctcttgacggttgatttcttagatggattgctgaattatcccggactgacgggtagcccctaatagatgactgctctagaatttgccgctcacgggtctccgcgatttcaaatatcagtccattggctctaattatccttaaaatgattcgagtccactgaaagaacttcagtgcctggttggaatcggatgagaatcggattcagctcccacctgagccaagtgcttggtggggactgttgcatctgtggagctctgagctgttgatgcctggcatttcaaaagaagatatcggaaaaatagagaagcttctggagcaatacgatcgactatcacgaaagattaagcgtctaaaggtgccgacaacaatagatcagaggcataaggttgcatctgaagttgacgaattgcgccgtcaggtgacactcgacatcatgcggggaatacccgtacaggctctttcgcctaccgatatcactgcttccgagctccaagaggtggaggaccttcacctggataacctggcacaagtagttgagtgggaccctgaggaaggtagtcctcgaggcacccggcatgcgcgacacctggcacaaacagttgaaaaggactccgagaaaggacctgagaccgctctttctcagtccgtaatgcaggtatcgaaaggcgtcttttctaatattaagaagctagttggagtccacgtcgacgaagtcggtaagcctaggctgcaaggtcagatgctatatgacctttgtctaatcgacatggcagctccgttccaacctcgccttaagagcgtaaaagatagattcgaggacctaaaggatctcgagaatgaattgcggcaagtcccaacgggaataggccgtattttcattggacgcaagcggcgagaaaagataacaaacaacatagccttgctaagcaagggaatcaattcaataaactatagtctaagcatcattgacgataacgtgctggctgcgctgtccttctcccttcaagatgcctggcaagagtactcccgaaataaagaagagtttgaatcggccatcaaagagatttcgggtgtcggcgtcacggatacgctgccagttagctcatataacctagcgctgaccgcgcgtctttttttaggacggatagacgccgtaaaggcagattccagctcactcgacatacccgacgacgagaagtatagacaagaagcctttgccgcaataaacaggcttcgcgatttagaggtacagaagcgactggagaaactagatatcgacgtccttgcgcaaggtggcgcaaggattgggagcctcaagtcagcgggattccatagtgtcggcgatcttgtggggctatcggcttacaacctgtcgcgctattcaagagtgagctttgatactgctcagatggttagcattgcggtgagcaacatcagtgccagtctgcggaaatcgaccagtgtacacttctacatcgactctaggtccgttgaacagacagagctgcttcgattgctgtacggatggaatagatggcccgagctaagggcgaaggcggcgagcatacggtctgatgctgcccatttggaaaaggcgacatctgatttgcgcgtggtcaagactggttggctggactcgctggcaatgcttcccagccagttggaaaagctgaacaatcttatttgcagtaatgattacctcctgtcatctcttgaggagcggcaggcgaatcttgctgaggaatgcgacaaagtcgctacggtaacggacgatgacgtttggaatgacttcagtcatcacgtggccgattactacacgcttcttgaacagctaggcggcatggcgacagagctgccggctggcgagctgcctaaggagctggtcgagcaggtcgtatcgctcgatcttgacctctcgcgaatgaagaaaccgatacgtccttaccagaaatttggagcacagtacgctctgcatcaaaggatgtccttaatcggcgacgagatgggtcttggcaagaccgtagagactattacggcaatggcacatctcagcgcaaagggggagaagtgcttcgctgtcatttgtcctctatcggtattggttaattggactagggagattgcgcaattctcaacactgcgctcggtcgttctccatggcaacgacagggattcggcaatgcttgaatggatccatagaggaggggttggtgtaacgactttcgggaccgtatccaagttgccttggcatctgctcaatggacgggcaatcggactgcttgccgtggacgaggcacaaaatatcaagaacccaaatgccatacggactcaggcattgacacatatggtaatgccccacgcaaaagacgtggtccttctctccggaacgcctctggaaaaccgggttcaagaaatgaacacgctcgtatcgtatctgaacccgaccgttgcgaacgaggtcagctctgatgaggtgctaatgaacccaatcgaataccgaaagagactggcacctgtatatctgcgcagaaagcgcgaggatgtgcttcatgatcttcctgacaagattgagaaggaagattggtgcaccatgaccgacgtggacgagcgggattatcttgttgccctcagacaaggcagcttctctgccatgcggcgagttggatggcgacataccgacatcgatcactccgccaaggctgcccgcttgttagagatatgtgatgaggcacgcgaaaatggcgacaagattctcgtcttttccttctatctagatacgatcaataaggttgctaggttagttggcgaccagtgtgctggcgtgattaatggaggtgtagctggtccggagcgtcagaggattgtcgatgagttctcgtcttctgacaagtctgttttggtggcgcaggtaattgctggaggcgttggactcaacatacaggcggcaaacgtggtcgtcttctgtgagccacagataaagccctcgatagaggatcaggctatcagtcgtgcctatcgcatgggtcaaccaaaagcagtgatggtacatcgcctgtatatggatcagacggttgacgagaaaatcagagagatacttgctaggaagcgtcgagactttgatatgtatgccgacaagtctgagatagggcgacagtcgctcaaggtcattgacacggatgcgattatgcaaatcatccaggaggagcgtaaacgtcatggtattgatccgagcctgccggtgaacgcgaaggactctgcaaagagtgacacgtaagccgagtgatgattgcgtttctcatttgtctatcaattgatttactttgcgcggatggtggagcatcttgactgttcgtcatgaggctgcgctcgtgctaaagtgttcctgaagaaacgggggctggcgcacgccggctgagaatgggtccatcgcgaccctgaccgtaaacctgatccgggtaatgccggcgtagggaccagggcagacgttcgggcacctacggaagcgtgggtgccttttttggtgcccggaagggagggcgcatgaactgttccgttgcgatacagtttctgcccatggacgcgcagaccgacgacgaggtctgccgcgtggtcgacgcggtaatcgcctacatcgattccacgggggtcgactactttgtgggcccgttcgagaccgccatcgaggccgactacgacacctgcatggagatcgtgaagaactgccagctggtgggcgccaaggcgggctgcaagaagatggccacgtacgtgaagatcgactaccgccccgacggcgacgtcatgtccacggaccacaagatcggcaagtaccaccccacggacagcgagtttgcccacaagaagggccaggtggcctaggtggcaaccgagccaacgggggagaaggacggcgcgt

SEQ ID NO: 165 - DNA, 1619 bp, Unknown
  Metagenome-assembled genome
gcctcgacggccgcaagatgagcaagtcctacggcaacgcgatctccatcagcatgaccgcggaggagaccgccaagctcatcaagaagtccaagaccgactccgagcgcttcatcacgtacgaccccgaggccaggcccggcgtctccgcgctgctcaccaccgcgggcatctgcaccggccgtgaccccaaggacatcgcagccgaaatcggcaacggcggctccggccagctcaagaagtacgtgacccaggccgtcaacgactacttcgcgcctatccgcgagcgtcgccacgcctacgagaacgacctcgactacgtcaaggacgtcctgcatgagggcaaccgcaaggccaacgccatcgcgcagcagacgctcgacgaggtccgcgaggccatgggcatggtgtactaacgcccaacggcagcgcatcggcacgcgagggcgcgtccttctcccccaatcacacgggcgagaaggacgcgcctttcttgcatatgccttgtgcctacagcacgaccatcgcgatggcgagcaccaccacgttcacgacggccgtcgcgagcacgaccttgcccacgaacttgagccacgtgccgtactccacgcgcgagagcgcgagcccgcccatgatggcgccgttggctggcgtgaagtagttcacgacgccgctcgcggacgcaaagacgttgatcatgatggcggggttgaagccgagcgactgcgtgagcggccccatgatcggcatggagatcgtggccatgctcgacgtgcccgggatgaggatggaaagcaggaagtagagcacgtagctgccgagcgcgaagaccacgggcgacgtgcccttgagcgcggcggacacgtggtggagcacgaagagcgaaagccccgtgtcacccatgaggatggcgacgccgcgcgagaggcccacgatcatcacgacgcccatcatgtcgccgcagcccgcgaggaacgtgtgcacgagctcgtgctcgtccatgcccgccgcgacgccgatgacgatcgccatgagcaggaaccacgtgttggactccgagaagtaccagtctcccagcggcgtgcccgtcaggaacgcggaccatccgccgttgtcaaccaccgtggtcctgagcgtgccgtgcgcgtccttggggatgagcctcagggtgcccaggtcgtcgtccgcgtactgcttggcgatgtccgacgccgtgacgcgcgtcgtcaccacatgcgagctctcccccgccgtgaacgcgttgacgccgagcttgccccacggcacaaagccgatgatcatcacgaggaacgagaggccaaagagccagagcaccatcttctgcttgcgcgtgggctcgctgtacgccgacttctccgccgcggcgtcaccgtacgcctcccgcgcggcctcggtttcatccgcgctcatgagcgacctctgcctgttgccgcgcacacgcttcgcgtagcgcatcacaaagtagacagccacaacgtacgaggtgacgagaaggacgaggccaaggccgatgacgattccctggttcgccacgatgccgcacgagctcaggacgtcagacgcgatgcccgtcgcgaacgggttcaccgtggagccca

SEQ ID NO: 166 - DNA, 7937 bp, Unknown
  Metagenome-assembled genome
aggccccggcgacatacccccgtcacgggcggccgccggccgcctggcccctcgtgccggaaaacaacgttccatatccggttgtcaaggtgctggaaaggccgaagttggcctggctaacctgttgacaaatccatagctggctcccagccagccccgcaggcgcgcatgacccgcgcccgcggccacggccaccgtcagacaaccgatagaaagagggcctccgacaccctggcggcgccggaggcccagcatgcgttaccgaggagaaggacgcgttcttctcgcccttgccttacctgcggtgagcgcggtagtacgcgatgagcgccttggtggaggcatcctgcttggcgaggccctcgtcgtcgtggaaggcaggggtgatctgcttggcaagctgcttgcccagctcgacgccccactggtcgtaggagtccagaccccagaccgtgccctcgacaaaggtgatgtgctcgtacagcgcgatgagctcgcccagcgcgtgcgcgttcagcgtgtcgccaaagatggacgtggtgggacggttgcccgtgaagacgcgggccgggaccatccactccggcgtgccctcggcgcggacctcgtcggcagtcttgccaaaggcaagggccttggtctgcgcgaggaagttgcccaggaagagctcgtgcacgtcctggtcgccgtccttggtggggttggcggtgttggcgaacgcgatgaagtccgccgggatgaggcgcgtgccctggtggatcagctggtagaaggcgtgctggccgttggtgccggcctcgccccagaagatctcgcccgtgtcggaggtgacgggcgtgccgtcccagcgcgtggacttgccgttggactccatggtcagctgctgcaggtacgcggggaagcggtgcaggtactggttgtagggaagcaccgcgtggctggcggccttgaagaagttgacgtaccagacgttgatgaggcccatgagggcgaccacgttctgctcgagcggggtctcgcagaagtaggtgtccaggtcgtggaagccggccaggaagtccttgaacatctgcgggccaaacgcgatgatgagcgacaggcccacggccgcgtcgacggagtagcggccgccgacccagctccagaagccaaaggcgttggccgggtcgatgccgaactgctcaacgagctcgagattggtcgagaccgccacgaagtgatgcttgatggcgtcagccacggaggcgtcggagccgtcgatggcgccggaggccttgaggccctcgagcagccaggtgcgagcctcgcgcgcgttggtcatggtctcgagcgtggtgaacgtcttggagacgatgatgaccagcgtggtctcggggtcgaggcccttgaccttctcggccatgtcgttggggtcgatgttggagacgtagcgcacggagatgcctgcgtccgcgtagggcttgagggcctcgtacaccatgaccgggccgaggtcggagccgccgatgccgatggacacgacgttcttgatggccttgcccgtgacgcccttccactcgccggagcggacgcggtcggcaaacgcgtacatgcggtcgagcacctcgtgcacgtccttgacgcagtcctggccgtcgacaatgagcttgccggcgtcggacgcgggacggcgcagcgcggtgtggagcacggcgcggtcctcggtggtgttgatgtgcacgccgttgaacatggcggtgcggcgctcctcgaggccgacggccttggccagcgcgaccaggagcttgacggtctcgtccgtcacgaggttcttcgagaggtcgaagtgcaggtcggacaggtcgaacgagagcttcttcacgcgctgcgggtcactcgcgaaccagcccttgaggttgatcccggcctcctgcagcttgtcgtagtgggcctggagggccttccactccggggtttgggttgcatcgatgggtgcgggtacgtctggcatgagcgctcctttgcatgactccaagcaagacagggccgcagcaagccgtgtgcgacccacatacagttttattttaccccgctcgccgaaaaatgcaccaccgggatatagcgcgggcgagaagaacgcgggccctccgtcgcggcgggcgaggggcgcgcgtcagatgggctcgccgagcggcggcacgcgcttgaggcgcgcccacatgatctgcttctgcttggggtccgcgagcgccgcctcgaacccgcccaggttgaggaagcgcatgcccagcacgtccgccaccacgccgggcgcgagcatggcgcaggcaaagtcaggcaggctcgcgagctcgtccgcgtaggcgtcgcgcaggacgttggccgcggcctcgtcgcaggcgatgaccgtggcggggtcgagcgtcgtcacggcaagccgcacgaggtcgcggcccacgggctcgccggagtcgagcgtgcaggcaagtgcgacccagtcctcgggcgcgtagccgagcgccgcgagcgacttgcgcagcgcggtcccgtccgcaccagacagcggaggcgccccgttcctctcgccctcgttgggctcgcccttcacaaagagcacgggcgagaaggtgtgccccgccatcacgaggccacgccgcgcgagctcgcccacctcggccttggcctttgccacgtacgccgcgcgccgaagctccctttccgacggcatcgagcctccatccatcacgatttctcctcttccgattctagcgccgcatgttggcgagatttgggtataagcgccgcagagacaagctgcgtgcagaggcacgccctacgaaggagcagacatggcaaaggcaatcacgacggcggacttcgactccgtgctcgccgcgtccgacaagcccgtgctggtcgatttctgggcatcctggtgcggcccgtgccgcgcgctgggccccgtggtcgagcaggttggtgacgagatggcagaccgcctgacggtctacaagtgcaacgtggacgaggagggcgacctcgcacagaggttccagatcgtgtccatccccaccctcatcctcttcaagaacggcaagccggtccacacgctgatcggcaacatgcccaaggcggacctcgtgaaggagctcgaggccaacctctaaggcaaaggcaaggctcgggcgggcgtcctcgcgggcgcccgtttttgtatgcgaaggcagacgcaggcaggagggcgaggcggcatggcagacagcggcaaggcaggcggcagctcgcgggcgcgcggcgtgctcgagcggatcgtgcgcgagcggcgcgtcctcataggggcggcggcggtcctcgtcttcatctggctgctgttcgagatagaggagaaggacatcttccggctcgaccaggcggcctactacctcatcgtggtcaacatgcggcagccgtggctcacgcccatcatgcgcacgctttcggacctggcgacgcccatcgtgctcgtggtgatgctgctcatggtggaggagtttgcgcccgggcgccggcccggcctctgcgcggccgtgaacctgatgctggccacgctcataaaccagctgctcaagcacctgatccagcgcccgcgcccggcgggctaccgcctcgccacggtgagcggcttcagtttcccctcgggccactccatggtggcgatggcattctacggcctgctcatctggatggtctggcgctacgagaaggacgccttcgtcaagtggctgggcgtcctggggttttgcgccgtcatcgtgctggtgggcttcagccgcgtctacctgggcgtccactacgcgtccgacgtgctggccgggttctgcgcgtccatcgcgtggctggccgtctacaccaagctcgtggcgccatacctcatgggcgagcgcacgggcggcacgggcgagaaggacaaggccccgtccccggcagatagccgctagctccgcacggggccgctagcgccagtccaggtccttatcgtccagctcgatgatcttggcgctcacgatcttgccgtcctccgcgatgatgcgacccatggtggggccgccggcgcgcgggaacgtggggctgccggggttcatgacgaggacgccagtgcgctcgtcgcgcgtgacgaagggccggtgcgtgtggccgcagatggcgacgtcgcaggtctgcaggtcaaggcgctcgcggtagtggcagacctcccagcgcagtcccgcggagaagaaccgcactgtgggcgtgacgaacgtgtcgtactggaagccccagtcgttgttgcccttgcatgcgtgggtgaaggcgatcttgttgagcgtctggaagtcggactccgagcagatgtcgcccgcgtggacgatgaggtcggcaccctggagctggtccagcagctccttggacaggtagccgtgagtgtcagatacgatgtcgaagcgcatgtgtgatccgtgtccttctcccccgccggcgcctcgcgttggcgggaccggcggcgggaatcaacgtgtcgctacagtccgagcgcgcgcttgaggggcacgacgcggcggcgggacacggggatcttcttgtcctccatgcccttgatgcccagctgcaggatgccgctggagatgacctccacgtcctccacgtggtcgaggttgacgatgtagccgcgatgcacgcggaagaacccgtgcggcgtgagcttctgctcgagcttggcgagcgagatggtcgaaaggtagcggtcctgctccgtgtagatgcaggagtagtcgtccttggcctcgatgtagaggatctggtccaccgggacgagcaccttgcggccgcccttctccaccgggatgcgctcctgcgaggggtggttgctggcagcgggcttgacgaaggcctccaccttgtcgagcgcgcggttgaggcggtcggtctcgacgggcttcatgaggtagtcgacggcgtccacgttgaaggcctcgagcgcgtactcgctgtaggcggtcacgaacaccacgcagggcgggttcttgagcttgtgcagcgcctccgccaactgcatgccggacgtcttgggcatggagatgtccaaaaagatcacgtcgatgcggcggtccgagccctccttgctcttgacgagggactccaccgcctcgcgggcgttgcgcgcctcgcggatgaggtcgacgcggccggtctcctccagcaggtacttgagctcagagcgggcgggcgcctcgtcgtccacgataagtgcgttcaacaattgatatcacccaactttccggaccgcatggttcaaatcttgcggcgcagggcgccgcgctagagtcaacattccctattctatccgagcgtcatgctcttttggtgcggcgttggcaaggcgcagcgtgacgacggtgccctcgcccaccttggacatgatctcgaggttggagttgccgccgtagaagcggcgcaggcgctccgccacgttgcgcagcgctatgccggcccccttggcgcccttgctcgactcctgcgaggagcgctccagcaggcggtcggccacgtcctccgtcatgcccaggccgtcgtccgccaccgctatgagcacgtcgtcgccatcggtcaccacctggatgtcgatggagagcgggccctcgtcgcgcatggcgtggcgcacggagttctccacgatgggctgcacgatgaagcctgggaccatgaccttctcgcaccccggctccacggactcgctctccaggatgcggtcctccccaaagcgggccttctcgatcttgaggtagcggcgggtctgctccagctcctcactgagcgggatgagcgactgcgagctttccagcgtgcggcggtagaacgccgagaactcgcgcagcaggtcgcgggccttggtggggtccgtgcgcgtgaacgcggcgatggtgttgagcgtgttgaagaggaagtgcgggttgatctgggcctggagcgccttgacctccgcgcgcgccgtgagctctgcctggcggtcgagctcgtaggcggaaagctgcgtggagaggagctcgccaaagccgcgcgcgatggtgagctgcgtacggtcgaccatgctgccgttgttgtacaggaaggcgaccgtgccgacggcgtgctcctgcaccacgagcggcacgatcacgcccacggggtactccttgccgcgtgggacgtagtcctcgtcgtcggccgcgtcgagccagtcgctcttgcttccgtacgagaaggtctgcatccttccgctggagatgacctcggcggtggaggggtcaatccggtcgccggcgcgcacgcggatacgggcctcgtcgccgcccacgatcgcgaggtactcatggtcgtccgacatgacgatggccgcggccgtggtctcgggcaggagcagctggcccacggccatgcagttctcttccgtcaggccgccgttcatgtgcttgaggacggaggacgacacgcgcagcatgcgctcggtcgcctgcgagcgcaggtcctccgggacgaggagcaccacgctcccgccgatcacgatgtccacggcaaggccggcgcccgccacgacggccgccgtcaggttcgcgttgatgaggccccagacgaggagccagatgagtgcgaccgtcagcacggcgatcgccacggtggcgagcgtgcccctatgtgcgatgcgtctcacttgcctgtgccctcgtccttctcgcccgattgtgccgtcgtgcccatggcctccagcctctgtgcaagctccctgctgtcccagagcgacgacatgacctgcggccagtacgtctggaagctaaagtagctgcgagcgacccgcttggcccactgctctgccagcttgcggccgcgcagccagatcttgaggtagtccagccgctccggccccgtgacggcgcggcgcagcgacgtgtgcgcgatgcggttgcgcaccacggtgggcgagatccagtccgagggatacgggcgcagcgactccgggcgcacctggcgcatgcccttgatggagttggccacgcggagcttctcaacctcgtagttccagcggaagacgtcctgcatgaagcgcgacgcgtgcgagggcgtcttgggcggcatgtggcggacgcgccacgcattgtcaaaccacacgtcaaagccgtgcatgcgcaggttgaagaggtagtccaggtcctccccgcgcgatatggtggggtcgaagctcaccttggtgaaggcgctcgcgcccacgcagaagcagccgccgcacacggtgttggagcggctgatgcgcgtgccggaaagcgcgcggtgcatccagtggttgaactccacgcgcttggaccaatagcgctcggaccagcgcggcttgccgatgtctgcgtacggggagttgcgctggtcaaggtacaggccgctctttgcggatatcttgaggccctggcgcgtggacatgcccatgccgtacacggcgtctatcaagaagttctcgttcagggcgacctcgtcgtcatccaggaagaccacgatgtcgtggttgagcactgccgcgacggcgagccccatgttgcggatggctccgtagccgcgaagcgacaccgggtcgccctcgatccccggcacgcaggcgtcgatggcgccgcgtatgagcgcggcctccggcgagccgatgaccagcggattcaggcgcggatgctgacggcagatgccctcgacgcgggcacgcgcgctcttctcgcacgactggtcgcacaccagcagcacgatcacccgcagcacgccgcgcacgccctcgagcgagtcgaggcaggtggcaagctcgggcacgggctttgtgatgggcgtcgcgtgatcgtagacgcccacctcgccaatccttgtgggggcgtcgctttccgcccagtatgagggaatgacgatgactggattcaagggcccacccgctcctcccg

SEQ ID NO: 167 - DNA, 72493 bp, Unknown
  Metagenome-assembled genome
gtcgccgcgtcctatgacgtcgtggtaatcggcggcggtgccgctggcctcaccgctgcaatctgcgcgggcgagaagaacgcgcggaccttggtcctcgagtcctcccgggagtgcgggcgcagcatcctcgccacgggcaacggccgctgcaacttcagcaacgtcggcctcgcggagaagtactacaacgaccccgagttcgtcggggcagtcttcggaaacgacccgctcaaggacgtgctgggcttcttccgccagtgcgacatgcgctggtgcctcgaggaggagcgactctatcccctttccaagcgcgccgcctccgtacggaacgttcttctccgccgcgcgcgcaacgccggcgttacgctcgcgcccgcccggagcgtcacctccgtcaggcgtgaaggcgatggctatgccgttgcctttgcagacggcttcggcaacgggtcctcgcacgaggtctctgcgcgcagcgtcgttctcgccgcgggcggcacccagtccgatggaaagctcgacgtcgcacgggacctcggtctcaggaccgtccccacgtcgggcgttctctgccccgtgggcatggagcccaaccccatgctcgagttggatgggcgacgtctcacggcgcgcgtccagcttacccacacgcgcttccccatctggagcgagcgcggcgaggtgctcgtcagaccctacggactctcaggcatcgtgatcttcaacatgtcgcgccacgtcgagcctggtgaccttgtggaactcgacctccttcccgacctcacggcatcggagctccagcagatggtcgacccgttcttcaagggcaccttcgagagcggctgcctcgacggggtcctcgacccggatctcgcagcgattctcgaggggctggcacggtcgcgctggtcgctcgatggcaacgggaccgccgatgccacgaccgactccaaggcgctcgtggcgctcgcgaagtcctatccgcttcgcgcgacgggcactacggaggttgcccaggcacaggtactcaggggtggtctggcaaacgaccagttctccccgcagacgctcgagtgcctctcctcccccggcttcttcgtggcaggcgaggccctcgacgtggacggcgagtgcggcggcttcaatctgtcctgggcttggaagagcggtatggtcgcaggtacgagcgcagccaccaggtaacgtcccacggcattcgtccgcaatcccatgtcaccgggcaggtcatcaatcacgcaagcgtcaggagtcgaagtgcttgacatctctggaatccgcattcccgtcgaccagctcgacggaacccttcgcaccgaggagcttgccctccgcaaggccgtgcggcgcaggctgcacatcacgcccgatgacctcctctccgtcgagcctcgcaagcgctcgatcgacgcccgcaagaagaacgacgtgcacttcctgtacaccgcacgcgtagccctccggggcggcgccaatgccgagagggcccttctcgcaaagcttcgcgcccaccatgcggagaagaacgtacgcaccgcaactgacaagcccttcggcctgccggcccacctcggcgcgcagcccgccaagcagcctgtcgtcattggtgcaggatgcgcagggctcttctgcgcgctcgcgctcgcagaggcagggctgaggccgctgctcgtcgagcgcggccaggacgcgacacgccggagccaggcaatcgagcgcttcaaccagacaggcaagctcgatcccgagtccaacatccagtttggcctcggcggcgccgggacgttctcggacggcaagctcgccaccggcacgaagagccccgcccaccggttcatactccagacgttcgtggacgcgggtgccccccgcgagatcctgtgggacgcaaagccccacgtcgggagcgacatccttcccaccgtcgtcacgaacatcctcaacaggatccgcgacctgggtggagaggtgcgactcgagtgccggcttacggacataggcatcgcacgtaatcccagtccgcacgtgacctcggtcacgcttgaatggcgtgacgcggagaccggcctcgtggtggaggagcaggtccccacggacaacctcgtcctcgcgtgcggccactccgcccgcgacgtcttcgagcttctcaaaggtcggggcgtcaccctcgagcgaaagacctttgccatgggcgttcgcatcgagcacctccagtccatggtcgacaagtcgcaatacggtcccttcgcgggtcaccccgcacttggcgccgcgccatacaagctcgtgtcccaccttgcggacggtcgcagcgccttctcgttctgcatgtgcccgggcggttacgtggtggcagcggccagcgagcccggcggcgtggtcacgaacggcatgagcctttccgaccgggctggcacgaacgccaactcgggcttcctcgcaaacgtgttccccaccgacctccccggcgacgacgtgctcgagggcgttacgctccaacgcaggtgcgagcgagcggccttcgaggctggcggcggcaactacgtcgctcccgcccagctcgtggccgacttcctgcagggcgtttcctccagcgcacagggatccatcgtccccacctacccacgaggcgtcgcctggggcagcgtcgagaagtgcctccctccctacatcacggagacgctgcgtgcctccatacccaagatggcccaccaactcaggggcttcgacacccccgacgccgtgctcaccggcgtggagacacgttcgagctcgcccgtccgcgtcacgcgtgggaaggactgccagtccgtctccacacacgggctctggccctgtggtgagggtgcaggttacgctggtggcatcatgagcgctgcaaccgacggcctgagggtcgcccaggcgctcgtggactcgctccgctagcgctcatgtgcctcggcggggaggccgttcttctcccccgcgccttgcgatgcgacagccagccaactgccgcaagtgttgcgcccgtcgcgaggatcagcatgcggtagggcggcacggacaacgccccgttgacggaggaccgcccctctcccccgtcgtcgcaaacgcgacggccagtcacgagcagcctgtggtcgtttatcccgtagggagtgcaggtcaccagcgtgcaaaggtcgcttccgcgcttgatctccaagtgcttcacctcctcgggcaggacgaccctcgtctgtaccacctcgtatctcatcctttttccaagcgtccagaggtagaagctgtcgcccctgcgcagcctccggatgtcgtcgaacatcctgctgcccagaaggcccgagtgtcccatgagcacgacgtgggtcgaggcgccgcccacgggaagcgacgatccctcaaggtggcccgcgccggaggacaggacctcttccgacgtgcccagcctgaccggcaagtcgatgccgacgcttggaatcttgatgaccgagaccacaccctgcccctcgcccatgagctgcctcccgtacggcaggatcctgcttgtgggaatggaggtcctctcgcccgcgagcacgtggttgtaggcgcgggcctgcgccaggagttccttcctgacctttgggtccatggcctcggcctggtcggtcatggtgctgacggcctcccgcgcccgcaacccctcccagaggtcgagcgcgagaggcaccgcaagcaggccaagccccaacgcgacgcccagcacgggcactaagcgccgcaacctcccgcggcgatgacgcggcttgggcttggcgggtgctacgtcccgtcgcacgcacgggagcacgcccagggccgcctcatgctccgtcatggtcatgcggacgcttccgtcgtagagcccggccacttgttgcgcagcgccgtagcgaaggccgcacaggcggcacccatgccggccacccaaggcagcgcgccggagtcacccgtccgtgggactccagagccgcccgcagaggcggcacgcgcatcgcacacctcgagcgtcaccgtgccggaccctgcatctaccgaggtcacgcgcgcggaggcatgctcgcacgtcgcgtcgagcgtccgcctttcggtatcgccggcgacgctcaggtggatatccccctccagcttggcgtacccgtcaggcgcctcgacctcgcgtatggcatactcgcccgagccaaggcctgcgagcgtggcctggcccttctcgtccgttgcaatctgcgccttcgcctcgtccttcacccacgtgcctgagggcgagaggaacatgccgtccttcctcgcgacgacgaacttggccccggcaagcgccttgctcccatccgcgtcgaccttgccgagcgcgacgcggtacgtgtggaccgtggcgccatccgtcggcgtgatgcccttctcgccgtcgtggccgctagagtactcgatgcgcgccacgttcctgttcccctccgtcaggccgaccttcgccttgtcggccacaaggcgggcaacatactgcacgacgacgcggtccccgtaggccgccttcggacaggcggagcgcaggttggcaaacgccacgcgcagctggccatccttccaggccacgtcatacccgtccctcacttcctccgtagtgccgtccgcgtgcgtcacgctcacggacaccgagtccaggtctacctcgagcgcctccgagggctcgtccacaaaggcatagcagaagctctccagtgagtcatagtcgcttggcagcgtccctaccaggcaaaagcgcacgctgtcacccgtggaggcgtcgcaggcgcgcacgaactcccgatcgccgcgggtgtcgttccgcacgcgcttctcaaggctggggcgcacgcccttctcgctcacggtcacgtccttggcgcccatgggcacgatgatcggctgggcatgctcgctcgtcaggagccagacgccctcatcaagcggcgtcgcctcgcccgtgcggatagtcagtgggtccggcacgccgtctgcctcgcgcgcccatgaggcaagcttggcaaggtatgccgcgccgtccttctgcacgccccgctgtaccagcgcaagcgcctcctgcgcattgcctgcatcgcccagacgggagtagaagtcctttcccatgcatcccctccacgagacaccgcgcacaccaccgtcatcttccacggatgccgagaagagcctgtaggcctggtaggaatgcccctcgccggcgggggcgatggtcagccggcccgacgactcccgcgcctgcgccgaggccgccaggatcgcgagtgcggtcaggagcgtcgccagcgccacaagggcgaggtcgacgcgggcggttacgccatggcgacgcacaccagccgtacctgccgagtccgtggatgctcccgtaacgtgattcacccgcatcgaccatcaccccttctactcttccacgtccatgtcgcgcctgtggttcattgcgatggcggaaatcgcgatcacgatgagacccgtcccggccgccaccgcgatgccctggccacccgtgatgggcagggtcgtcgtgaggccgtcgcccacggtcacgcgcacgatgccagccttggcgtccacgatcttctcgctcgcgtccgtctggtcgatcttgccgtcgccgttggcgtcgatgccaccctcggcgtccttgccgtcgaccttggcggaaagcgagtaggagctcgtgccgtcctgtccggtgttgatcgagttgggcatgatgtacgcggccctgatctgcagcttgacgtcctcgatcttgtcgtaggtgccggagtcggacttgggcgcctgcgtctcgtgcaggaggtagttgcccgagtcgatgcgcgccacgctcaggaggcccttctcgttggtctcgaactcgtgcggctcgtcacccagggagccgtccgcctgcaggtacttgcccgtgggctgcccgtcggccgtgtactcctggatcgtgaacttggcgccggggagcgccttcctggtggccttgtccaccttcgccacgtcgagctggaaggtgtacgtgtccgtcccgggcacgcgcaccgtgcctttgctgtcggagttggggtcgtttgagaagtgcagggtcagcttgttctcgttgccctcggagcccacgaccgcgttcgcgttgacctttgccttgtacgtgacctcgagcctgctgagcccatcgcccttgacctcctgcagcgcctttacgtcgtcgcaggtcacggtcatggtcgtcgtcccgtcggcgttgtccttcgtcacgacgctgaacttgctcgtcacgtccgtggggacccacttcttcgcgtcgccgtcaaagcgcaggacgttgaccttcacgtcaccctggtacgtgaggcccttggagagcgtgtcctcaaactggtaatagtacttctcgtacgcgtcgaggttcgtgggcagcgtgccccgcaggcggtagttgagcacatcgcccaccttggcgtccacggagctggtgtcacggcccgactcggtcgcgaccgtcttctgcccgctggggacggacgtcttggcgtacaccgtgctcgcctgggtgcccacaagtgtgaagatcggcgccgtgcccgcgacgcccgccttgccgtccgtcgtggtcgaatcactcacgaagagccagtagccctggctcagcgcctgcgactcgttctccttcaggcgcacggtgctcgccttgccctgcacggccttggcgatctttgccgcggcgctttgcgcggcaaccacgtccgtgttcccggtggagaagtgcgacctcatccacagggcggcgtcctgcgccgtcgtgcccgcgtacgacttgtcctccgacttgatgacgccctcgaccgcggccttcacgtcgtcgtttgcccaggcgaggtcgctcacctcgctcttctcgctcacgttggccgtaaagatctggtagccctggtaggcgagcgttccctccgacccgcgcgacacgacgtccttgatcgtaatcgtccccgtgccctcggccagcgccaccgcgggagcgacctggcccgcggccatgcaggccgccagccctcccaccacggcaaggcgccccatggacctgccaagaccagcgaacctcgcgtgctttgcctcaaaagccatgcgttcctccaaacatcgaaccagcttgtccatgcttccctccgcgcgctcgaaggcaggaccagagcttgcgcccagccgcttgcagttggctgtcccatgtctatccgcagtctttaggcagccgtcattcccgcatcgctgcaggtaaaggccgccgtttttctcacccgcaagacccttgcccgcgcgcccaaaacgtgcgtcgcagattctccacaactcggccctccgagggcctgtgggacgcgtcgccagacccgtccccaggcccaccaccacccgccgcccgcgttcaggtagttgggcaaacggaccgtccagcctgctagaatctggtgccatgcacaggattgggactcatgagtgcagaggagaggcaatggcaacaggcgatcacgcggacgagaaggacgtggccaccaaggcggcgtcgtacgcgcccggtgcaaggaccggccgcccggaggcgccctacggcggcgccacggtcgaggagcgcgcgcaggacatgcgccgcggcatgacggacgaggacgttgcgatccgcaaccgcaggccgcagctggacgaggagggcgtgccgcgcgtcaacccgcagggcaggccgctcaggatcatcaagaagaaggaggtcttcgtcgagaacgacgaggccaggcgctacgtgccctcctcccccgacgcaccgggaccggcatccgcggagccgcccaagccgggcgtgcttcgcgaggccgccaagataaccgaccgcatgctccacaagaccaactacgacgaccccgactactggggcctcgcctccgtcatgaccgaggaggaggccgagctcacgcgccacatgaagcgccgcgtgcccgagaccctggagcaggttgccgagggcgcgggcgtctccaaggagcgcgcgcaggagctgctcgactcgctctcagtcaagggcgtgatcgagtacaactgggagaacctggacggcaagaaccccaagggcgagaagcgctacgtcctgcccatgttcgtccccggcgcagcagagttcacggtcatgaaccagcagcagctcaacgagcatcccgagctgggcagcttcttcgagcgcatgacgtacctgccgctcaccatggccaccaagatggtcccgcccggaggcgccggcgtgggcatgcacgtcatccccgtcgagcacgcgatcaagcacgagaaccagtccgcggacgtcgagcacctctcgcactggctcaagaagtacgaccacttctccgtgggcgcctgctcgtgcacgctcgcggagcgcgcgcgcacgcacaacgcgggtcgcgacccacagaactggtgcatcggcgttggcgacctggccgactacagcgtcgagaccggcaagggccactacatcacctacgacgaggtgatcgacatcctgctcaacgccgagaagaacggctacgtgcaccagatcaccaacatcgacggcgagcacaagatctttggcatctgcaactgcgacgtcaacgtctgctacgcgctgcgcacgtcccaactgttcaacacacccaacatgagcgcctcagcctaccgcgcccacgtggacgaggagaagtgcgtggcctgcgggggctgcgtcgaggtctgccccgcgggcgccgtccagctgggccagaagctcctgaccaagcacggccgcgtctcctatcccaagcagccgcttcccgacgaccacgcctggagcgagaaggactgggacccggactacaaggaccacaaccgcatcgagtgccacgagaccggcacctcgccctgcaaggtcgcgtgccccgcgcacatcgccatccagggctacctgcgcatggccgcgcaggggcgctaccgcgacgcgctggcgctcatcaagaaggagaaccccttccccgcggtgtgcggccgcatctgcaacaagcgctgcgaggcggcctgcacgcgcggcctggtggacgaccccgtcgcaatcgacgacgtgaaggccttcatcgcggcaaaggacatggaggccgagcaccgctacgtgcccgagccggtcatctcctccaaccgtggccgtcacctggagaaggttgccgtggtgggcgccggccccgcgggcctcagctgcgcctactacctggccaacatgggctacaaccccgtcgtgttcgagaagaacccccttcccggcggcatgatggtctacggcatccccagctacaagctcgagaaggacgtcgtcgctgccgagatcgacgtcctgcgcgagatgggcgtggagatccgctgcggcgtcgaggtcggcaaggacgtcaccctggacgagctgcgcaagcagggattccgcgcgttctacgtggccatcggctgccagggcggccgcaaggccggcgtcgagggcgaggacgcaaagggcgtctccaccgcggtcgacttcctgcgctgcgcacttgacgacccccagcaccaggtcgagggctcgaccgtcgtcatcggcggcggcaacgtggccatcgacgcggcccgcgtgtccaggcgctgcggctcctcggacgtgagcatgtggtgcctcgagcagccggacgagatgccggcgctcccgctcgagatccaggaggccgaggacgacggcgtcaccatccacaacggctggggtcccgccaaggtcgaggtggacgaggcgggccacgtgcgcggcgtcacgttcaagcgctgcacgcgcgtcttcgacgaggccaagcacttctcgcccacctacgacgagtccgacaccacattcgtgccgtgccagaacgtcgtgctctccatcggccagtccatcgtgtggggcgacctgctcaagggcagcaaggtcaagctcgggcgcggcaacggcgccgtggccgaccccaagacctaccagaccgacgagccggacgtctttgtgggcggcgacgtctacaccggccccaagtttgtgattgacgccatcgccgcaggtcacgaggccgccatcagcatgcaccgctttgtgcagacgggctcctcgctcacgctgggccgcaacccgcgccactacgtcgagctcaacaaggacgaggtcgtgctcgcccccgccgactacgaccactccggccgccaggtcccggcctgccagaaggtcacctcgatcgaccacaactggcacgacccgcgccgccagttcacggaggagcagatccgcaaggagacggcgcgctgcctcaagtgcggcgccagcatcgtcgacaccaacaagtgcatcggctgcggactctgcaccacgcgctgcgagttcgacgcgatccacctcacgcgtgacgtccccgaggcatccaccatgtacaccgccgaggacaagatgaaggccatcctcccctaccaggccaagcgcgccgtcaagatcgtgcgcaccaggcttgcgggcgagaagaacgagggttccaagtagcggcgggcccagaggccacacacgagggccccgggactccacggcggcatgcgcttcgcgaaatgtcgccttaggagtcccggggccccttcttgtcgatgggtcagtagctggaatcctttgccctgcgctactcgcccatgacctcgacgtagaccgtgcgacgctgtggaccgtcgaactcggctaggtacacgtcctgcgccccaccaagaagcgcgcgtccgcccgtcacggggaacatgcagctattgcccacgagcgtctgcttgagatgcccttgcgagttgttgcccgtggccccgtagctgggcaggaagtgcgcgtgcgcgtatggcgcgtcaagcggaaccatgcgttcaagcatctcctgcaggtcacgctccacgcaaggcagtccctcgttcacgatgacgccgcaggtcgtgtgggcgctcatcacggcaacgagtccctcgctcacgccagacgcctcgacctcgcgacgcacgtcgtccgtaatctttacaagttgcgctgcctcgctcgtgaggtaagaaagcttcttcagtaccaccatggctactcgcctcccaggtactcgagggcgttagcggtaagaagtgtctcgcgcgcatagtcgggtaatcccagcgcatcaatggcacgaatcaacttgaaggcccggaagcgcggggtgttgctgccgaacatcacctggtgcaacaaactgcgctggaaccaccgcgagcccatgtcctgcgtgaagaggcgattgatggactcctcgggagaatcaaggtacagggccgagcactccgtgtagcaattgggatacttcagcatgagcattaccatctccctcacccacggccacgcaaagtgggacaggcagacgcgcacgttggggtgagtcatgatggcctcctctattgcgagagggtgaccgtacttcgtgggcgcattcggctcccacgagagcccggcatccaccatcatcggacggtcgtacttctggcacagctcgaagagcggctccatgcaggcgtcggtcatccagaagcgctgctttgcgggatggagcgacagaccacgcgcccccagctccacaaaggcgcactcgagtacctcgggcgcatccggtcggttggggtccacgctcgcaaagcccacaaagcggtccggatagtcagaaacgatgcctgccacctgctcattcgttgcgatccatccgcctgccgtcgtggtgaggtcaagtgggagaagcacgctcttctcgatgcctccgtagtcgagctccgcaaacacctcgtcgtaatccatgggacccatgtgtcccatgccgaactcgcgctcccaaaacgcaaaatcgtcctcgctgtagatagacttgtacagcagcggatggacgttgacgtcgattgccacgatggacctcctaatagggttcgaactttgtgatgacccggcttgccagttcggcgccgctgcgctggcaggcaggtatgtcccaaccgttgatgagtccaaaggtgaaacccgcgatgtaggagtcgcccgcgccgacggtgttcacgaccttgggcggcgcgacgatgcctccctcgtagtagcggttgccgtcaaagctgagcgaaccccgctcccccatcgtggccgtcacgatgcgcggaccgaagccctgcacgtggcgtatccattcgcggatgtggtccatatcgtcaccgtcgtagctcatgaagacgtagtcgacataggggaagtagtcctcgcagtggtaggcggggtcctccgagaagaccgagaagtccatcaccccaagcatcccggactcgtgccatggtttcaggtaatcgagcacgttgccgaagagatcggtatggaacatctgatgagaccggacaaaggcatcgtcctccagagtaagcgaatagctcgccatcacgccctcgatctccttgagatggacccggtcgacgccgttcttgagccccatcagcatcacgcaggtgtcaccgtcctcgacgcgcaggtgcgagatgtcgatcttctcgcccgcaagggccttgcgcatccccgctccatattcgtccgttcccacgacgctcacgacggagacgggcacgcccttgcgggcaaggtggatgccccagtcgacgccgtttccagtgggatagaacctcccgaggtcctgatacacgtcggcgcagcagaaccccaccgccacgacgctcttcacatccgtcggctccatgattcgcctcccaaaaggcgggccccacatgggacccgccatcagatgtcgctagtacttgaggccgtgaccccagctgccatcctgcgcacagcacacgtcagaggcgaactccgccgcgaaagcgaggccggccgtgtacgcatcctcccgggaagcacccctcttgagggtgtcgagggacttgaccaggaaggacgtgagaaacgagtccccggcgcccatcgcgtcgcgcatgtgctcgacgggcttggactcctggcggtagtagcgctcaccgtcaaaggcgtagcacccgtccacgccgcgcgtggccgagacccagcgcggcccaagctcgtggaccttgcgcaggcgctcgcgcgtctcgtccacggtaaggtcggaggccgagaagaacgcgtaggtcacgttgggggcaacctcctggaagtactcccacgtggagtcgtccgagaagtcgaacgagagcgggatgccggcgtcgtgaatcttgtggagctggcgctccgtgtaacagtagtttccggagtgcaccacgtcgaactggcgcaggtactcgatgtcgaagcgatcgagcacgtagctggtctcgcccctgatgccacccttgttgtagtcgccccagatgcggtcgccatccggcgcgatagacacgcagctgtagccgttctcgcccaggagctgcttgcacttgaccgtctcgacgtcctcctcgtggaggctgcggatgacgtgctccgcacggtcgtcgctcccgaagtagcccatgtaggccgccctgcgcacgcccgccttcttcgcgtacaccgcgaagttgacgcagttgccgcccggatacatggtcctcacgtgctcgtacacgtccaccacgttgtcgccaaagccgcacacggcgacgtcgaggtcctgcttctgcatgaacttgcccctttcccgcatcaacacctgtgcgagcgcagccccgttgtcgtttgggctccgcacgctcggtcttctcccctagctagtactcgacgatgcccatgtagcgacggacgtcgggatcgtggccaaacgccttgccgcgcacgccgcgcagggagacgttcatctcgtagaagaagatcgggtcgaggtaggtgcgcacagaggcgtcgacgttggccatgccgtactcggcggagtcgagcaccatgagggtgtccgtgtgggtcttgaggaagcgctccgcacgctcgtcgatggggcggtttgcaccggagcccttctgcaggaagtagaagacgccgtcctcggtgcactcgaaggggccgtggaagtactcggccgagttgatgtaggagcagttctgccactgcatctccatgagcgagcagatcgcgaagccataggtctggcagaagtcgggaccggagccgaggacgtagaggaagtcgtgcttcttgcagaggtctgcgaagagggggccgagctcggactcgacgcgcggctttgccgctgcgttgatgccgtcgagctggtcgattcccctcgcaagcgcgtcggtgtccgcatagccgtcctgcgccgccatgaggtccgccgcaagggtaagcgagaagcccgcgggacgcgcggactggggcgtgtcgtcctcccactcgtacacccagcagggccactctccgttatcgatcttggaaccagcgcggttggtcatggtgaccacgcgagcaccccgatcctttgcgagacttgtcgcctcgatggtctcggccgtgccgccggagtggctgcaggtgacgaccaggctcgagggaccgagctgcgcgggcgggaaggtgttgaactccgctgccgtgtgaatggcgctcgtcatgctcttgctgttggcgttgatgaggcagttggcgggatagaggtcgatgaccgacccgccgcaagccacccagtacacctgggacacgtccccaccagccaggacctgctttgcgtaatcatgtgcgttcatgttcttctcctattccgttacaaacgcatttgtaccttttacctgcaatgatgcgaggtctttgttcgcctacggcacaccacggctaaagctcgtcttcgaagtagcgctcgagattgtggaagttcctgaaatctgccgccgcgggattggtgagatacctttcgtccgtaatctcctgtcccaggaagcctgagtagccgtatttctcgagcgtggccacccaatcccctagattgcgatttccatcaccccaaacgagatgaccatagggattgcagtccacaaagtgcatgttcctgatatcgctacccagggactcaaaccattgctcgagcgtctcgcctgacacgctcatggcaaccgtgtccaccatcgctttgaggttaggatgtccgacttcctcaagcatgcgtttctcatcctcaagagtcacaacgagttggctttcctgcggcctgagcgtctcgagcgtcaggatgatgccctcttgctccgcaacctccgcaagcgagcggagcatgtctcgacttctcttccacgcctcctcgcggttctcgttccaatagccccatccggagttaatcgaaaggtacgtgcagcccagctcggcggcacaacgtatcgcgttggtgaagtagtcacgacagcgcgatgcatagaggtcctcctgtgggttcacctgatagggtgaaatgacgttctcgggacagaagacatttgccgtaagtccacgtgactcgatcttgtggcgaatcgtcttggcatcgtaatagcctagacagtcaagccacaggtggggcatggcaccccagagctcgattcccgtgaagccaagcctttcctggcaatcgaggaaggcgtccagcgaccattgggaccagtggatgttcatgccgtcaacctggtcgcggcgaatggtcggcgcactcatttcgtttcctcccccacaatgaagcgactaagagattggtagttccgacaatcggcctccttggggttgtcaaggtagcggccgtccgttatctcctggccgagcagcccctcgtagccaaactcgttgagcacgtcaatgtatcgctcgagcggaaagagcccatcgccccaaacaaggtggccgtaaggccgaccgtccgcaaaatggcagtgcacgatcttctcacccagacgctcgaaccactggcgaggagtctcgcccgcaacacccatggcgacggtatcgagcgcggcgccaagattgggactccccactgcgtcgacgagtgtcgccacgtcatccagcgtgttgcagaccttggactcctctgggcggacagactcaagcgcaaccgtcacccctgcctcccgagcgtaggaagcgatttgtccaaagtgcctgaccgcacggtcgaaggccatgtcgtggtcctcgtctagcgtcccgccgcaggcatttgtaagcatcatgtccgcgccgagcttcttacacacgtccatcgcccgtttgagaaactccatcgagcgcttgtgcgccgccacgtctgcatagttgttacgccactgcatacaggagcactccggggtgaagagggcaaccctcatgcctcgcgcctcgaccttgcggcgcacttcacccggatcctggttccaggactcgtccatgtagaagtgcggcgcctctcctaccagctcaattgcctcgtagcctgcctcagcatgtccgtccagcatgtagtcgagcgggtacatgatgtagtgaattcccagcgcgcaaagctgacttctcttgatgtgtgccatgtcctctaccccagctcgtcgtacacgacgcgaccgtcgctcacggtaagggcggcattgatgccgcgcgcatccgcgggatccatgtggagcacgtcgccctgcagcacgactacgtccgcgagcttgcctggctcaagcgtacccagcctgtcctccgagtagcagtcgtaggcgccgttggcggtccagaccgtgagcatctgcgggatggaaagcatgttctccaggcgggcggtcccgccatcgtcgaaatgcccgccacagccgcagtagatcgactccccaatggacggcagcataagtggcaggtccgtgtcgcccacgacgacgcagcccgactcccacatcttgcggcgcatccagtagtggcggtagcgctccggaccaagctgagccgtcaccatcgactcgaggtctcccttgcggtcgagcgactgtatctgcgggtagacctcgcagattccacccagcgcgccgagcctctcgatgtcctcggggtcgctgaactccatgtccgtgatggcgtggcgcatcacgagacggccacggccatcgcggcgacacttctcgtagaggtcaacgacatgtgccactgcggcatcgccctggcaatgcagggagaacctgaaccccgcctcgtcagccgcaaagagctcgcgctcgatgaggtcccactccacgggaacggcacagcgactcgtcggatccgagaggtacggctccttgagttcggccataccggaggcgatggacctgtccgtcatgcggttgaatcccgagaaggacaggaagtcgcccccgagtcgctccctcatctttcgcccgtgatccaggtccatgccgcgacccacgggctggctcatcagcctgacacgcacggtgagctcgtcggacgcagccattcgttccatgacgtccacgaagccgtagtagtcgtcaaacgacatctccttgatctgcgtgatgccgcaggcgttgagcatgcgcatgtagtcgtgatagagaccaggcatctcgggcaacgtgaggtagtcacgcatcatgcgccagattttctctgcgtagcactcatccggcgtgaagccatatcgctcgcgagctgccgagttcatccagcacgtgtcgcgatcggacgtgaaggcgaccacgggcctcttggggaatgccgcgtccagggcgtcttcggcgtcgtcaccgaactcgtccgcattccaaccgtggccgaacacggggacatcctcggaaagagtctccacatatgacgcaagtgccgcaatgccctgctgcgtgtcatgggcgtcggagaggtcgcatcccaggcgctggagcgcccagccggtaaagaaagtatggttgtccgtcatgccggggatgaccgtgcggtcaccagcatcgataacacgagtcgcgtcgcgaacgtagtcatctgcccctgccctttcccccactgccatgattcggttgccatccgttgccacgaagccatcgaggggttccgcacccgtcgcgtcgaacacgttcctcgagaggataacgagcctgtcgggtctttctgccatcgccttgcctttcacctcgttgcgtcgcttcgccctgtcctctttcgcatcgctcgaaccgtgaggctatgcggggagaaggccggagacagccgtcaccacgatgccaagcaccgcgatgagcaggatgaacttccagcaggtcttccaccattggccaaagctgatcttggagaccgagagcccggccaccgtcatgcccgccgtggggcttatggagttgatggtctgattggcaaggcagagcgccgtgaccgctgcctcggtgttcacgcccataagctgggtgaggggtccgaggatcggcatcgtcagcgcggcaaggccagaggagctggggacgaggaacgaaagcaggccgagcacgatgtagaggagcgtggtatagacgggcgtcgggacgccggcaagtgccgtagccatggcattgagaatcgtgtcgatgatcatgccgttctcagcgataacgagaattgagcgagcgagtccgataatgatagccgcatacgcgaagtccgcgagacccttgacgaactcctccgccatctcccgctcaccaaggccgccgacaatgccagagaggacgcccatgccaaagaagacggcactgatctcgtccatgtaccagccctgcgtaacgaggccccagatgatgatgcccataccgaccgcaaacacgataaggacgcccttctgacgtgcggagaacggctgctggatagcatcgtcctgaacggagaactcgacgcgcttggcgatatcgtccttgtaggtaatggagctctgcgggttcttcttgaccttcttcgcatagcgcatgacccagatgattgccaagatggtgaatacgacccacacgatggcacgcagccacagctgcggattgccctttattccgacgatgccctgagcaatgaggacgttgaacgggttaacagtcgaagcaatgtaaccgatgttgggacccatgaagcagatgaggaacgccgtcatggagtcgtaacccagtgccatcatgataggtatgaatatcgcgtagaacggcaacgcctcctcggacatgccgaacgtcgttccgcagatggaaagcagcaccatcacgactggaattatgaggatgtccttgtccttgaacttgccgattacgtggctaagacccgcgttgattgcgttcgtcttcgtgatgatggcaaaggatccgccgatgagaaggacgaaggccacgacgtcggcagccgcctggatgccctgggtcggtgcctcgagcagctgcatgacgctgcagcggaggtcgaccgtctcgcccgtcttcttgtccgtatagaccttgctcgtaggcttgtaagtgcctgcgacggcgacttccttctcgcccgccgcggtctgcaccgttttacgctcatacgagcccgaggggattatccaggtgagtaccgcgaagataatcatgagcaggaacacgatcgtgtacacgtgcggcaaacggaactgatgcttcttcttgggtgaagcgacctcttctgccatgcgagcctccataacatccttgttgccaccccttgtgctgacaactcgttatataaggttatagtacgtcctatgacgtgttacaaatgagacccacagagtttcgactgccgaaacgtatcttgcggtgagcggtagaaaaagacggccagattgaacccagccgccacgttgcgctatatgagagtgtccattggccctagatattaaagacgtacaggctgcacacgatgtactgcttgcctatcaggaacggcttgccgtcctggtccgtgaagttgatcttctcgtagaagagcggctcccccacggccacgttcagctcggacgccttgtcgggacttgccctcaccacctcgagcgtgcagaggtcgtccccgcggggcctgcggccgcacctcttctcgacgtagtcgaagatcgacgcgtcggacaggtccgcgttgagcaggaactcgaagccctcgagtgggaagtagttgttctcgagcatgatggggacgccgtcggcggtgcggagacgccgcacgtgcacgagctcggcaccctcccccaggcccaggaacgacgcctcgctctcatgggccctgacggtctcgattcccaggaccttggccccggccacgcggccgtcctcggcacaagtgtcggtaaagctctggatctcgctcttctggtagatcttcctggtcagcttgcgctggcacacgaaggtgcccttgccctggcgcttgacgaggtagccatcgtccacgagctcggacaccgcgcgcctgatggtaatcctgcttacggagtacgcctgcgagagctccgactccgaggggattttgtcgcccggggcgaactttccgctgtctaccttgtcgcgaatgtcctccattacctgctggtaaagcggggtaagcgacccctcttcgatcttcatgtgcccgcccctcgaaccactcgcgcccgtaccgtgaagtccctacgcttgcattatatatgtccacagagaggcccgcccactgagcggcacaccgccgactcctggcatccaaccaggcatgtgatgcgcaaccgcagcctgttgactttgacattatataacgtaatatgatgttccaatccacagtcgccgtggccgcacggccgcctcgcatcaggctgcagacggaaaggcaatccaatgaagacgctgagttcgcgcgacaagcaagggcacatgcggaaggaatgcgccgccgcagcccccatcagaaagacgctgggcgagaaggactgcgtcgcctgcggcaagcgcaccgaacacgtcgccaccgtctaccttggcagacaagtggccaacgctgatggcacgtcgggcatcgagtggcagccctacacgaaggcgctctgccccgattgcgcagcgcagcaggtcgacagccgtgggtttggggtcttggtctacgtggcgctgcaggtctgctgggttccgctcttcacgcacggcccctctgggctgggactgggaggtgcggtcattgcaggctgggcgctcgtatgcctggcaagagccgccatccagtcggtatggccccgcctgcacaaggatgacggcaagcccatgccagagtggctgcgtgccgaaagcgccgaggagagggacagtcgggccctgcgtgagatccttcgcacgaacgcacccggcaccggcctcctcgtggagacgctggcggagcatcgcaggcacgcaggctgagcgggccccgcaaagaacgccacaagaatcgcgagcagccacagggacgcccctcgggttcctaaggcgacattttcgcgaagcgtatgtcgccgtggaatccgaggggcgcctgccttagtgcttcttccgcttgtagtgccgcctcgtagcgtgggccgagcccttcctggcacctgccttcaaccggtccatcacgtccttctcgctcgtgccgtccagacgtgcctggagctcgacgatctggtcgcgcagcttggccgcacgctcgaagtccatgtcggccgaggcctggagcatctcgtcctggagcgagcccatgacctgggcaacctcctgcttgggcagggcgaggagctcgtccgccacggactggatggtcctctcgcgctcgccctccgcggcatcgagggcctcctggctctctcccccggctgccgtgaagaacttgccgtccacgcgtgacttggagcccagcgtctggtctgcctccgcgatgaagctcgtgacgtccgtgattgacttcttgatggtcttgggcacgatgccgtgctccttgttgaacgccatctggatgctgcggcgacgggccgtctcgtccattgcctcgcgcatagagtccgtcacgctgtccgcgtacatgatgaccttgccgtgggcgttacgcgccgcgcggcccatcgtctgaatgagcgagcgtcggttgcggaggaagccctccttgtccgcatcgagaatcgccacgagcgagacctcggggatgtcgagaccctcacgcagcaggtttatgcccacgagcacgtcgatcctgcccaggcgcaggtcgcggatgatgtccacgcggtcgagcgtcgcggtgtccgagtgcatgtagttgacgcggatgccctcgtccagcaggtggtccgtcaggtcctccgccatgcgcttggtgagcgtggtcacgagcacgcgctccttgcgcgccacgcgtaccttgatctcgtccagcaggtcgtctatctgtcccctcacgggcctgagctcgacctccgggtccaagaggcccgtgggcctgatgacctgttcgacctcattctggctcacgttctcctcgtagtcgcccggcgtcgcggagacgtagatgaactgcggaatgcgctgctcgaactcgtcaaagcggagcggtcggttgtcgagtgccgagggcaggcggaacccgtgatccaccagcgtgaccttgcgcgagcggtctccctcgtacatgccgcgaatctgcggcaccgtcacgtgggactcgtcgatgatgcagagcatgtcgctcgggaagtagtcgatcagcgtgtagggaggctcgccgggtttgcggccatccatgtggcgcgagtagttctcgatgccagagcagtagcccatcgtctcgagcatctcgatgtcgtagctcgtgcgctgcgagagccgctgcgcctcgaggatcatgtcgttgtccttcagctccttgacgcggtgctcgagctcctcttcgatcgtcttgatggcgtggttgatcttggggcgcgccgtgacgtagtgcgacgccggccaaatggggatggcatcgtactcgcgcacgatctcacccgtgacgccgtcgatctccgcaataagctcgacctcgtcgccaaagaagctgatgcgcagggggttctccgcgtagggcgggaagacgtccacggtgtccccgcgtacgcggaacatgccgcgctggaggtcgtagtcgttcctgtcgtactggatgtcgatgagctccttcacgaggtcgtcgcgctcgagcggcacgctcttgtccacgttgggcgccaggcccgcgtagtcctgtgggctgccgatgccgtagatgcagctgaccgacgccacgacgatgacgtcgcgcctgctgaggaggctcgacgtggcctggtggcggagcttctccacctcctcgttgatggaggcgtccttctctatgtacgtgtccgtctgcgggacgtaggcctcgggctggtagtagtcgtagtagctcacgaagtacacgacggcgttgttggggaagagctcgcgcatctcgctcgcgacctgcgccgcgagggtcttgttgggctccatgatgagcgtgggccgctggaccgcctctatggtcttggccatggtgaacgtcttgcccgagccggtaacgcccaggagcgtctggtagcgcaggccgtcctccacgcccttggcgaggctctcgatcgcctggggctggtcgcccgcaggctgatacggcgagaccaccttgagcttctcgtccccatgctccaggccaaagcgcttgagctccgcgccgtagcgctccttggcctcgggcgtgcccgccaggggctcgtaggtgacggtgtgcccctgctcgtccacgaaggacctgtctgaacctgcttccttcgccatcgctcccccaactcagtctatcaaggcgagaagaactagattagaacaagtgtacccatattggcagtggggcttactgggattcggatattcccgaggggtagaactgcttgtagcgctcgtaggcctggttcacgcgcacgaggtaggaggccgtctcggagtactggatgtgctgcgagatgtcgctcccgttggcgagccactttgacacggagcccagccccgcgttgtaggccgcgatgacctggtcgcgcgtgctgaggttcttctgcaggtaggcgaggtaggccgtgccgtacatgatgttggttgtggggtccgtgaggttgtccggcgagtacgtggagctgtccacggtgcccatcttggcaacggcctcggacgtggacggcatgagctgcatgagccccaccgcgcccgcgtttgaggtcgcgctcgcgtcccagtttgattcgcacttgatgaccgcgcagatgaggtactcgtccacgccgtagcgctgcgaggcctgctcgatcacgtccgcgtacttgacgggatagaacaccgtccgtatgaccttggacggcagcaagttggaggcggcggacaacacgcacgcaaggagcatgcagacgatgggaatcgtccggtaccagcgccagaagcgctctctcatcatgatctgccgctcacccccttcgcgtcttccagccgtccgcctcgtgcgcctgccaccaggcgtcaacctggcgcaggaggtccttctcgtccccctcgttcgcgagctcgacgtccgccttggacctgaggtagtcgtccgtaggctggcggcgcgcccgcgcgtcaaagtcctcgggatccatgccgcggccctgggcgcgcaccctcctgaggccgagggggcacgtcacgcacacgacctcgtccgcgaggtccagcgcgtcctccatccggtcgagcagcggcacctccaccacggcgaccctgggcgcgcccgcggcgtccgtgcagccgtcgtcacccaggacctcctcgagcctgcgccggatgtagggtagctcgatctgctccaggcgggttgcgccctcgtccgtggcgaacgcgcgccgcgcgaggagcccgcgcctgagctggcccgtcgtggggtcgagaaggtcatcgccaaactcgcgcgctatcgcctgggtgcactcgcccccgggctccagcacctcgcgcgagaccctgtcgaggtcgatccgccacgcgccgagccgctcgagctcgcgcgccacggtggacttgcccgacgcgatgccacccgccaggaacacgacgtacatccggaccccctccgtcacgagccgctaggccccatggaacttggacccactatcttcccacgccatgcggccccgcgggacccttctagaaaacgaacagacagaaggcatgtgggcgcgtccttctcccccgccacggcggcatacgcaacgtgccgaccgcacacctggtgcgaccggcacgcattctacctgcaagtccgtgcaatggccgtgtggcccgccgttacgagtgaaggtcgaacttctgcttgcagcgcgggcacgtgatgcggatgtggcccttgcccctggggacgcgcaccctctggtggcagttagggcaggtcgcatgcttgtaggtgcgcgcgttcttgtatgccgcggcggggttcgagatccacgggcggacgggtccgagcttctccgcaaaggccatgctctcgcggcggcgctggttcacgttggtcgagaccatgcggaagatcgcgtaggccaggagtgcgagggtgatgacgtagatcacgccgttgcctgcgaagatgttgatgatcgccaggatcaccgcgagctcgaggcaggccacccccagctcgtccgcgccgttgcgcccacgcatgaattcctcgagcttgcccttgaagttgtccatgaaaccagcctctcgcagtttcccctcgcgcggcccggccgcgctctctagccgtagtctctatcctgccccattatgacaggttcttgcacgtcaacgccaagaccgcggcaaagcatccaatcgagaaaagcgaggggccgcgtctgcgacccctcgccaaggttcaggctaggaacgagtgacgactactcggcgtcgttcttctcgtcctcctcgggcttgtccagtggcttgacctcgacctcgaagcccagggtctcggcggcagccttcatggacagggagatgcgacgacggtcgaggtcgatctccatgaccttgacctggaccttgtcgcccacggagcagacctgcgacggctggtcgacgtgctgcttcgccatctcggagatgtggacgaggccctcgacgccgtcaccaaggtcgacgaacacgccgaaggtgacgagcttcgtgacggtgccctcgacgatggcgcccacggggtacttcttgacgagggtacgccaaggatcctcggtggtctgcttgaggccaagggagatgcgctcgcggttgaggtccacgtcgagaacctgaacctcgacctcctggccgaccttgacgacctcggaggggtggttgacgtggttccaggagagctcggagatgtggatgaggccgtcgatgccgccgaggtcgacgaaggcgccgaagtcgacaatcgaggagacggtgcccttgaggcgcatgccgggcttgagcttggagaggatctcggagcgctcggccttgcgggcctcctcgaggacgacgcgacgggagaggacgacgttgttgcggttgcggtccatctcgatgacgcgggcctcgatgcgggtgccgaggtaggcgttgaggtccttcacgcggcgaaggtcgacgagggacgcgggcaggaagccacgcaggccgatgtcgaggataaggccgcccttgacgacctcgatgacctcgccctcgacgttctcgcccttgttgaacttctcctccacgcggttccaggcgcgctcgtactcggcacgcttcttggagaggatcaggcgaccctccttgtcctccttctggagaacgagagcctcgatggtgtcgcccagggagacgacgtcctcggggttgacgtccttgcggatggagagctcgcgggcggggatgacgccctcggacttgaagccgatgtccagcagaacctcatcgtgctcgatcttgacgacggtgcccgtcaccaaatcgccctcatcaaagtcggtaatcgtaccgtcgatgaggctgttcatctcctcgtcggacatgtcatccagagagaagacggacgagttctgaatctcactcaaaggtggacccctttcgaaaacggggccccgatcaacatgaccgctgccgggcgctcggcgtggttgcgtttgcgcagttggaaacttacatgctctcgggggcctacagatacgtttgcatgggcattttacccatgcgtgtgatagggtaccttttgtgtggcacgtttatcaagccatacctgtggatttcaggaatttcatctcccaaccaaaactcctcccgccgccggccccgacccgtggagtaaagtcggatggcacaactcccctaggaaggacgcgtcgtgatcaaggcggttctcttcgacctggacgacaccctactcgacatcaacctcgccgctttcgtggcacgttacacgacgggaaaggcgcgcatactcgcggatgcctcggggctcccactccccacgatcctggcgcgcctcgcgcagagctacctcagggtgaacgaccaggccaggaccgaccagttcacgaacgagcgcctgctggacgacacgttcttctcgctcacctccatccccctggacgacccagccatcgccgacgccatcgactactacgagcgcgagtgcctggagcccctgaggggcggcatcgtgatggcggcgccgcgccccggcgcgcgcgagacggtggagaaggccatgtccatggggctgaccgtcgcccttgcgacgaaccccaccctcacgctcgcggtcgaccacgtgcgcatgcgttgggcaggcgtggacgacctgggctttgcgctggtgagccacataggcaactccacgcgcaccaagccctgcgcccgctactaccaggagttcgcggcgcagctcggcgtgacgccgcaggagtgcctcatggtgggaaacgacgcggcgcgcgactttccgcggccggacatcgggatgagcaccgcctacgtgggccacggctggccccggcgcgcggtgtggaggggcagcatcggcgagctgggacgccgtctgcccgagattgtcgaccttctgaactcccgcgccgacctgcgcgcagacatgagcaaggagcccaaatgaaccaggacacatacgacaaccacgtccgcatcctccgcgaggagctggtgtgcgccctcggctgcacggaacccatcgccgtggcgtacgcggcggcgctttcccgcgcggccctgaccgcggatcccgagcgcctgcacgtcgcgtgcagcggcaacatcatcaagaacgtgaagagcgtgaccgtgcccaactccggcggcatgcgcggcatcgaggccgcggcgacgctcggcgccgtgggaggcgaccccacccgcgacctcgaggtgctgcagtccgtgggcgtggacgacatcgaccgcacgcgcgagctcgtgaacgcgggcttctgcgacgtggagctcgcggaggacgtgcccaacctgtacgtgcgggtcgtcgccacgggctcgggccacacggccgtggcctgcatcgaggagcgccacaccaacgtggtcgagctcacgctggacggcaggcccaccaccgccgcaggcaagtccgcctcgggcgagaagagcgaggccacgggctcgggggcggaccgcagcaggctgtcgctccagtccatatgggactttgcccacgaggtgcgccttgaggacgtggacaggctcatcaccaaccagatcgagacgaaccaggccatctcccgcgagggcctcaccaaccgctggggcgccaacatcggcagcacgctcctcaagagccgccccaacgacatcagctgcaaggcgcgcgccgcggcggccgccggctccgacgcccgcatgagcggctgtgccatgcccgtcgtgatcaactgcggcagcggcaaccagggaatcacctgctcgcaacccgtgctcgagtacgcgcacgacctctggagctcgcacgaggagctcgtccgcgccgtcgtcttgtcagacctcacggcggtgcacgtcaagtacttcatcggcgagctctcggccttctgcggcgccgtctccgcgagctgcggcgccggcgccggcatctgcatgctgcgcggcggctcgtttggccagttcgaggcgaccatcgtcaacaccctcgccaacgtgggcggcatcgtgtgcgacggcgccaagcccagctgcgccgccaagatctgcgcggccgtggacgcggccatcctcggctgcgacatggcgctttccgacgacaacttcctcgcgggcgacggcctcgtgggcgccaacgcggaggagaccatccgctccatgggctacgtgggccgcgtgggcatgcaccccacggacgtggagatcctcaacatcatgatcggcaagcgcgacgtggacactgacgcctagcgtcggacggccgccggccatccggccgcgcgcaaagccacgtgcaacataagggcgggggtgcgagccaacctggcatcgcacccccgcccctttgcgtcggttcgtcccctaacggctcgcgctagcctacgacctggtagccggcgcgacgcaccgcggcgcgcatggcgcgctcgtcaagcggctgcttcgcaaacacgtgcgcgctgccgtgcttgaagtccacgtccgcccaagcagtgcccgcgctctcgagcgcgccggcgaccttgttggcgcagttctggcagtgcatgccagagatgctgaggtcctcctggtaggggtagttcttctcgtccagatccgccggacgctcgcgcctctttgcggagccgttgtcgcaggcgccaccgccgcagcagtcgcgcttgccactgaacacctggatggcgcggcggcccgcaagggcgaaggcgaccaccacgatggcgacgattatgacgttgatcatgcatgtcctcctcactatgttaactgacgctaactatagcgaggagaaacccaaatgcaaccgccagtttccgattgcctgacccaaaccacagtccggccgtggcccgcagcgctagaagccctcgtcctcgatgaggtgggcacggtcgtcggcggccgtggtggccagctcgtcgcagcgctcgttgagctccgtgccggcgtggcccttcacccacacaaagctgaccttgtgcggcttctttgccgcaagcaggcgcttccacaggtccgggttcttgacgggctgcttggaggcgttcttccagccgcgcttctgccagccggcgacccagttcttgttgaacgcgttcaccacgtactgcgagtcggagtggacctccacctcgcacggccgcttgagcgcctcgagcgccgcgatcacgcccatgagctccatgcggttgttggtggtcttgcggtagccctggctcagctcgcggcggtgcaccactccggctgggtcggtgtacagcagcaccgccccgtagccgccgggcccggggttgccgcgcgaggagccgtccgtccacaccaccacgtgcatcctgccgggagccacctcgcgcacggtgccggggtgctccctcacaaactcgtcaaagctcgccactacttcgcctccgcccagttcttgccgtagctcacgtccgccagcagcggcacgcgcagctccaccacgccctgcatggtgtcgcgcaccagctcggacagcgcctcgatctcgtcctcgggcacctcgaagtcgagttcgtcgtggatctgcagcacgagcttgctcttgaggccctcctcgcgcagacgccccgggaccctggtcatcgcgatcttgatgatgtccgccgcagtgccctgcatggggtggttcatggccgtgcgctccgcaaacgagcgcagctggaagttcctgctgttgatgtccttgatgtggcgcttgcggccgtacatggtgatggcgtagccgttcttgcgcgcaaaggccacgcggtcgtccaggaacttccgcacaccagggtacgcctcgaagtagcggtcgatcatctcctgggcctccgcgcgcgggatcttgagcgaggacgccaggccaaacgcctgctggccgtacacgatgccaaagttcacggccttggcgcggctgcgcagctggggcgtgacctcctccaccggcacgccaaacacgcgcgccgccgtggcgcggtggaagtccgcaccctcgttgaaggccgcgaccaggtgctcgtcgcccgagaggtgggcaagcagcctcagctcgatctgcgagtagtcgcaggcgagaaaaacgcagccctcgggaaccgtgaaggccgtcctcacgcggtgacccagctcggagcgggtcgggatgttctgcaggttcgggtcggagctcgagagcctgcccgtcgcggcgacggtctggttgagcgtcgtgtggatgcgcccgtccctacggatgagctgcggcagcgcgtccaggtacgtgttcttgatcttggcgcgctcgcggtagtccagcacctcgcgcacgtacttgctcgcctcgtagccgccctcggcaaagccctcgatcaccttggcgttggtggagtagaaccccttgcgcgtcttcttgaggccgcgcgtcggcaggccccacacgtcaaacagcacatggctcagctgctgcggggagtcgatgttgaagtcctcccccgccgccgcgtggatgtcggccaccatctggtcgatctccgcgccgagcgactcgctctgctcgcggagcttctccgggtccgcgtgcaggccggtgcgctccatctgcagcagcaccaccagaagcggcatctcaacgtcggcaaacagcttggcggagccgtccttctccaacagctccgcaaggcgcggcctcagcgcgagcgccgcctgcgcctcgatggccgccgcgggcgcgtcgtccgtggcctcgggcagcgtgccgcccaggacctgcgggttctggtacagctcctcaaccttgaagtgcccgctgtcggaatcgagtaggtagcccgccacgccgcagtcgaagatcctcgcggggtccacgtcctcgggttgcaccagggcctcgtcggcggagtccatggggcacacctcgtggagaagcgccttcacgtcaccggcaaccaggtgcccctcgcgcgtgagcctgaccagggcggacgttgccgcatcgccctcgaacctcatgagcgagccctcggtcgcggcccagagcacgcggggcttctcctccgcaaagagcgactgctgacccctcttgggggcctcccgctcgagcgccgccgcgacccaggagccggcggcaaccgccttgtccaggcacttctcggccgcgtcgccctccaggcgctccgccttgggaagcgtgggcacgggtgcggcctcctcggcggcggcatcgccctcaagccgcacgaggcgctgcgtcatgcccgtgaagcccagggcggaaaacgccttcgtgacctcggcggggtcgaaggtcgggaacttcgcgtccttgaggtcgaggtcgatgggggcgtccgtgcggatcgtggcgaccttgcggctcagcagcgcgtcgtccacatgggcgcggaggttctcgcccatcttgcccttgacctcgtccgcgtgcgcgatcacgttgtccaggtcgccgtactgcacgatgagcgcggccgccttcttgggaccgatgccgggcacgccggggatgttgtccgagctgtcgcccttgaggccgtagaagtccggcacgagcttgggcgtgatgccgtggtagaggtcgtccacgctctccggcgtcatgatcgacacgtcggacacgcccttcttggtggcgacgatcttcacgtggtccgtcgcaagctggtacatgtcgcggtcgcccgtgaagagcagcatctcgtagccctcggcctcgccgcggcgcgcgagcgtgcccaggatgtcgtcgccctcccagccctggagctccaccacgggcacgtcgagcgcgcgcagcaggtccttcaccatggggaactgctcgtgcagcgccgggtccatggggggacgctgcgccttgtactgcgggagcatgtcgatcctgacctgcggcttgcccttgtcgaacgcgcagatcacgccatcgggcgagaaggactcgacaagcttgatgaacatgttgaagaagccgaagagtgcgttggtggcccgcccgtccggcgccgtcatgggctggcggatggcgtggaacgccctgtgcatgagcgagttgccgtcgatgacggctatggtcctgggagccctcttggcttcgtcccccatggtttctggcatgtgagcctccttgcgctcgcctcggccttgctgccccctgattgtatacgccccaccggacgcgaacggcaacgccacatttgcgcgggccgggcgcgggaggccccgacgacaccggtcctagcccagtagcgccttcagcccgatgaggatgagcacacagccacccacgacctcggcgcggtcgcccaggatgtgccccagcttgtggcccacgaagagcgccgccacgcagcacgcggccgtggtgatgccgatgaccgtgacggcgaacgcgaggttgaccgcctgggcgcgaaggctcacgccaacggcgaacgcgtcgatcgcggtggcgaccgcctggaacaggagctgcccgatcgtgaggtggtgggccttctcgcccgtggggcaggactcctcgcgctcggggtgacggatggcccccacgccctcgcgcaccatgttgccgccgatgatgcccaggatgacgagggtgacgatgccggagtagcgctcgatgagcgatgcggccaggccgcccaggaagtagcccagcaggggcatgagcgcctggaacgcaccaaagaacacgggctgcagcgcgaggcgcgagcggcgctcgtcggcatagcagaacgtgttggaaaccgtgacggcaaacgcgtccgcggacagcgccacgcccaggacgacgacctcgagggggctcatgcggagttccttccgacctgccgcgacccgcggcgccgaatttgcaatttttcaagtctacacaacattgggctggccaagcccgcggacggcagaaacatcacgcgcgcacagcaaaatcgtgtaatctatacacaccgtgcaacatcgaccgatactgggagcgcgcatgcctgcccttatcactcatcatctatttggcgagaaggccctggacctcatccccgagggcatcgtccgggacgaggaggagctcctcgccttcctgcttggaaaccagggtcccgacccgttctttgtccgcttcacggccacgcccgaaaacgcttccgcctgccaccgcctggcgcacgacatgcacgccggcaaggtgcttcccgcgttctcctcgctccgcgagggcgtgtcgcacctcccccaccacgacgagggcgtgggccgtgcctttgcgctgggcctgttgggccactacgtgctcgacagcacggcgcacccgttcatctttgcgcagcaggacgccatctgcggcgccggcgtggggctcgagtccatgggcagcgaggtgcacgccatcatcgagagcgacctcgacacctggatgctctggagcatgcgccgccagaccgtggcggaggtccccacggcaagcctcctcgcgcggaccgagcggatcgaccgcgtgggaggggcgctcttctcgctcatcgcgttgcagacgtttggcctgaagctctcgcccgagcagtacgcgggcgccacgcgcgactacgccacgttctaccgcgccattgagccgcttgggtcgcgcaagagcgcggccgtggtctccatcgagcacatctttagctcgcacgccatggcggagtgcatggcgcaccgcacggaccccgtggacgagtgcgcgtcggccaacctctcgcaccaccgctggagcgaccccgcgacgggcgccgcgcatgacgagagcttccccgacctcttcttcctcgcactggacaggtggaagcgctctgccgagcgcttcatgcgcggcgactttgacaccctgagggcggacttccgcaacctcaactacgacggcgtccccgagaccgcctaggggcgccctcgacctccccgccgtccggcacggcgtccgtagcctcgccctccatccgcgcgaagtactccgcggacgagaagcgcctgccctgccggtggatggcgctccgctccctgtggaagcggctctggcgctcgtggaacgtggccatgtgctcgcgcatgacctcctcgagcggcgcctcgtggtgtgcgagctcgtgggctgcctcgacggggtcgacctcgtccaccacgcgcacgaacgaggtgaccacggggatcacgagcacggtgagcgccgcggacgtgacgagcacggacgccgccgtggcggagagcacgccgttgtcctgcgcgatgcccgtgatggccacgatgagcggcagcgccatggtgcagtaggcggaggtggagaagacctcgcgccagctcatggcccgcgtgccggggtcgatgcgcagcgacaccgcgaccacgatgccgcgcaccacgatgagcgccaggatgaagccgaagagcagcggcaggtccctcgtggcggccgcgaggtcgaggcttgcgcctgacaccacaaagaacaccggctggaagaagccgttggagagcacgtcgatctttccctccagcgcctcgctcccctccgggaagagcgcccgcaggatgaagccggacgcgaacgcgccgagcgccgcgtcgaactggaagaccacggtcgcgagcagcagaaagaccagcaggagcgaaacgaccctcatgagcggctggctcgagctgcccgcgttctccacgaggaagcgccagaagcgggcgcccgcgttcctggcccgcgacgtgatgaggtacaccgcgacgcacacgagcacgaagctcacaagcagcacgcccgtgcgcttgacggagcgcgacgacagcaggaacgccatcgcgagcacgggcaggatctcgccgagcgagccgtacacggagaccgcgcggcccacgcgggtccccatgagcttgcggtcgctgatgatgggcgcgagcgtgccgtacgccgtggtggtcatgcagatggcgagcgccacccacgatgactggccaaagccgagcctggacgagaagagcgagaccacggcaaagccaagcgcaagcgacacgagccacgaccccgtggcgatggcgcccgttctgcccagaaggtcgcgcgcgtcgatctcgtagcctgccttgaggaagaggaagcccatgcctaggtcgcccaggagctggatgggctcgaggtcggggtcgattcccctgagcacgccgtacttgcccaggagtgcgccgccaaagaccaggaacaccacctcgggcacggcgcggccggggacgaggctcgccacgaagggcgcgagcgtcgccaccacgagtatgcagaagagcgagaagtagatgcttgccacggtgcggcctccggtcgggttccgccgaggcgaggctgcggcgcccggcgggatgaacgttcgtccgcacaggatagtgcagactcatgcgagtgcggcaaactgggcaaaaccaacagacgcgagcgcgggcgcaacaagcctccccaaagcaagcggcgcccgggccgcatagcccaggcgccgcgcatcttgtatctgtctgttagagccaggccacatcgtcctgctcgtcctcgtgcgtgcgcgggaactgcagcgtcctcgagaccgtggcgagccttccctcctcgttcagctcgcccagctcctccagccacgtctgcggcttttctcgcctgaacggaacggtcttgccaccgtcatcatcatccaaccaggctagaatgtgcccgcccttgctgccaccagttgactccatagtgcatcagccccctgaactgtctggctcgacgttgtctgccatgcattgtagggtggcgggtttgcaatgcccgcgtaagccgcccgttgtgaacggagttgatgcccatttgtgacattcccgaaattttatgcagtttggttgtcgatatcggaactatatgcggttcagggggtacttctattcatcacgcggagggacctggcccgtgctcagtatgccgtcgagcgcggcctcgtcgagcaccgggacgcccagctgctcggccttggtgagcttggagcccgcggccgcgccggccaccacgtagctcgtgcgctttgacacggagccggacaccttggcgcccatcgccttgaggcggttgcccgcctcggtacgggtgtacttctcgagcgtgcccgtgagcacgaaggtgaggcccgcgagcgtctggggctgctccggctcctcgccaaagccctcctgctccatgctcacgccgctcttgcgcaggcgctccaccacctcgacgttcttggggatggagaagaactccctcacgcttgccgctatcttcggcccgatgccgtcgatctgggagatgtcctcctcgctcgcgagcatgaggcgctccatggagccgaacgtgtttgccaagagcgtcgcgacgttggcgcccacgtgacggatgcccaggccaaagagcacgcgggccaggccgcgcgacttggactcctccacctgcgccaggatcttgcgcgcgatggtcctgcccaccacgatggagtcgcccacctcgtggtccttgccggccgtctcatagctgcggcccgtgtcgagggatgcgagctcgtcctccgtcagcgtgtagaagtccgccacgtccagcagcagcccctgctgcaccatgcgctggacgatctcctcgcccaggccgtcgatatccatggcgttgcggctgccccagtggatgaggcgctccgtggcctgcgcggggcagtcgatcgacacgcagcggtaggccacctcgccctcctcgcgtaccacggggctgccgcagctggggcaggtcgcgggcatctcccacagcgggcgggccaggtgctcggcggagtccgggtccttggggcccacgacctccgggatgacgtcgccggccttgtgcaccacgatggtgtcgcccacgcgcacgtcgcggcggcgcacctcgtctatgttatggagcgtcgcgcgcgcgatggtggaacccgccaccacgacggggtcgaactccgccaccggcgtcagcacgccggtgcgtcccacctggacgcggatctccctcaggacggtgctcttctcctccggcgggaacttgaacgcgatggaccagcgtggcgcgcgcgccgtgaagcccaggttggcctgcgcggcaaacgagtccgccttcaccaccacgccgtcgatgtcgtagtccaggtcctcgcggtgcgcgagggcatcggcgcagtactggtgcacctcggccgcagagtccacgcggcgggcgtgcgggttcacgctgaagccgcacttgcgcagccaccccagaaagtcgctctgcgtgtcgacggcgagcgggccctcgtccgccacggcgtagatgaaggtctccaggtcgcgcgcgcccgtgaccttggggtccttctggcggagcgaccctgcggccgcgtttctggggttggcgaagggcgcgcggcccgcggcgtcgttctcctcgttcagccgcacaaaggagtgcttgggcatgtagacctcgccgcgcacctcgatggagtggccaaagccgccgtccgccaccagcgcgaggccctccggcgcgagcgtccgcgggatgtcgcgaatggtgagcgcgttctgggtcacgtcctcgcccgtggtgccgtcgccgcgcgtggccgcgcgcaccaggcgcccgtcctcgtaggtgagggcgatgcccagaccgtcgatcttgagctcgcaggtgtaggcgacggggttctgcggcgtggagcccagggcctcgtccgtgcggcgcagccactcgtccagctcgtccaggttcatggcgtcatctatggagtacatgcgctgcgcgtggcgcacgggggcaaactgctcgctcacgtagccgcccacgcgctgcgtgtaggagtccggcgtcaccagggccgggtgctccgcctcgatctgctgcagctcgcgcaggtagcggtcaaactgcgcgtccgtcatctccgggttgtcgagcgcgtagtaggcgtaggcggcatggcgcaggatgcggttgagctccgccgcgcgctccgccggggaggccttgcccttctcccccgcacgcgcgggcggctcctgtcccccggttccaaagagcgagaactgcgtgccctcgggcgccgagcccctgccatcctgatctgccatgccatcctccaaacgtctgggtgcggactagagcttaccccaaccccgggactccaggtgcctctgcacaaaccaccgcgcgagcgagccctcgggcatggcgcccagcacctcgtgcgcgtccacccagtgcgcggagtcgacctcgccctcgttgaggtgcacgtcagacccctttgcccggcacacgaagttgaccatcagcgtgtttgagggcgagaagaacgagcttgcgttgtaggtgacggttgccagctccaggcccgtctcctcgcggacctcgcggcgcaccgtggactccaggtcgtccccgcgcgccacgtagccggccacgaggatcccgtgcttgccgtactggtcgatcgtgaggatgcgctcgccgtccgggtggtacacgatcatgctcacgcccacgctgaagtgcgggtagcgccacgcctcgcagtgggggcaccacggctgggggccgtcctccggctgctcccgcagcacgagccgctccccgcagacctcgcagtacgccgggtcctccgcatacgccatggcaatccccctcccgccgcggcatctgccgcggacgccgtccttctcgcccgtatgctagcagatgccccggacgccatcccgccggcgcgcggcacggcaagggggcacgccccgtgggacgcgccccctgtgatgcaccttgcctgtctgccagccgcccgaacgctagctcttggagctcgacgtgctcgtggtggacgtggtgcccgtggtgctgtacgagccgccgtggttgtcctgcaggtactggtagatctcctgcagcagctggtcctgcgagtcgctgttgcccgagccgtcgccgttcgtgttcgtgttggtgttgttgttcgtgttgttgatgtccgtggtgccgttggagctgctctgctccttctgcagcgcggagtcgtcgcccagcgtgacctcgaccgtcttcttggtggtgccacgcatgaacgtgaccttgatcttgtcgccgatgtcgtgcgagcgcaccgccaggatcatgccatccgcggaggtgatgtcctcgccgtcgaccgcggtgatgatgtcgcccttcttgatgccggccttgtccgcggggctgccgctcgtgacctcgaccacgtaggcgccctcgctgaccgagaggttgttggacttggcgttctgcgagttcacggtctgcatggagaggccgatgtatgcgtgcgtgaccgtcttgcccgcgatgatcttgtccgcgatcttggtcgcgtagttgcccgggatcgcgaagccgatgccggcgaaggagtccgtgtcagacgagaagagcgtgcagatgcccacgagctggcccttggagttgacgagcgcgccgccggagttgccggggttgatggccgcgtccgtctggatgaggttggtgtagatcgtctcgcccgaggaggactgcatgacctggttgcgcgagagtgagctcacgatgcccgcggagacggactggtccaggccaaacgggctgccgacggtcatgacccagtcgcccacgacgagcttgtcggaatcgccaacctcgatgggggtgacctccgtgtcgcccaggttgaccttgatgaccgcgatgtcgctcgaggagtccgagcccacgaccgtggcgtcgtagctcttgttgttgatcgtgacggagatggaggtggcgccctcgatcacgtggtagttcgtgatgatgtcgcccttcttgtcatagatcacgcccgagccgaggccggagccgctgctcgtggtgacgttcaccacgacgacggacggcagcgccttggcggccgcggcctgcgccgtggtggcctcgtcggtgttcttgatgttgatggtcttgcccgcggtgctgctcgacgtggtcgacgagctggagccattcgcgaagaagcccatgccgttgagcgcgaacacgacgagaagcgcacccacgatgccgccgcacagacccaggatcgcgttcctcagggcgtggccgtgcttcttcttgcccttgccatccggcgcctctggcccgttggtgcccggcgtgcccggcacccctggcccgttggttcccgttcccgccgctccctgggaggcatcccccgtcggctgtgcctgcggcgttactagctgcgcggtcggctggaccgcggtctggtccgtcccaggaatcggtgggcggccgttgtcgctctcgctcatgctgaccccttctctcatgggcgctgtcgcgccttacgtctttgtccacaacctgactctacccttgcacgtgcggatgaattcgcgcctgcccatgcgacacgtctctggaacaacgcttttggattcctgaaacgccaacggcatcgcgcccgtccgtgcgtttccgcacgaaaaaagcgccccggcacaaccgggacgcaagcgaatcgtatcgttcttctcccccagggacatgccagggagaaatgcgggcgctagagcttgaagaggtagccgacgccgcgcaccgtgacgatgtgcgaggcgacctgagggcccaccttggagcggacgcgcctgatgtgcacgtcgaccgtgcgcgtgccgccgcagtactcgaagccccagacgcggtgcagcagcgtctcgcgcgagtaggcgcgggaggggtgcgtcgccaaaaacgagaggagcgagtactccatgagcgtgaggtcgacgggctcgtcgtcgatgtagacctggtaggtggccaggttgatggtcatgttgtccacggtcacgatgtccgcgggggcgctctcctcgcccggccacagcagcagcgcgcagcgcacctcgaactccgcctcgcccgcggaggagaggatgaagtcgttgcggccctgcgcgggcatgtgcagcgagctgagcttgctctcgtcctggatgatcagcgtgggaatgaagccgttgtcggagacgtaggagtccacagcgttgagcgtatcctgctccagcccgttggagtccagtactacgaggtcaaactcgtgtccggacgaaatcgcctgggagaaggtctcgggcgtcgtgggcagaatggaaacgtcgagggcatgcttgagttcgcgcatgcggtcgatgtaacgtgaggtctttgcgaccagcaggatgttcttgtggtgcatccatgacctccaaccttggtacgctcctgcaaaaaccggggatgcccaagggcatccccggtaaggttagcataaatctttggcacgtttgcaaccgcatgcaatgtcaaagcagaaaacaggcttttggacaaagcataacgggttatcgccactagcgaatgtggcccaggaactccttggtgcgctgcgccttggggtggtcgaacacctcgctgggcaggccctgctccaccacgacgccgccctccatgaagacgaccctgtccgcgacgtcgcgggcgaagtccatctcgtgcgtgacgacgatcatggtcatgccgctgtgcagcgccaggtcgcgcatgacgttgaggacgtcgcgcacgagctcggggtcgagggcggacgttggctcgtcgaacaggatgaccttggggtgcatggccaccgcacgggcgatggcgacgcgctgctgctggccgccggagagctggggcggcttgtagtccgcgcggtcggccaggccgacggccttgagctgcttgagcgcctcgacgcgcgcctcctccttgggcttcttgaggaccttgacctggcccaccatgacgttctcgagcgcggtcatgtgcgggaagaggttgaacccctggaacaccatgcccaggtcgcggcggagcttgttgacgtcggtcttcttgctaccggtaatctcctggtcctcgatcaggatgtggcccgcggtgggcgtctcgagcatgttgatgcagcgaagcatcgtggacttgccggatccggacgggcccagcacgacgacgatctcgccgttccagacgtcgaggttgacgtcacgcaggacgggcgtgtccgtgaacgtcttgttgaggtgctcgatgcggacgatggggtgctcgcccggcttgaaggtgtgcttggtgaggccctggtcgtgctcgtaggccttgcgcgcggcctcctccgcgtccatcgcgggaggtacctcgagctccttggctccagacttcatgaatgacttcatctgctaggcctcctgacttgcgtgggagcggaacggtgcggcgagcgcctcgaacgcgctggtgtccttgggctcggcgtcctgctcggcggactcgcccttctcgccctcggctgcctcgacgcgcttggcggcacggccgcgcggcctggggccaacgccgttctcggcgtccgcgaggtgcttctcgacgatgctgacgaccttgatgagcggcagggtgacgatcagatagtagatggcggcggccatgtacggcgtaatgttgccggtggtggtggtgaggttcttcgagaacatcatgagctccatgacgccgacggaggagaggagcgaggtgtccttgtaggacgtgatgaagtcgctcgtgacggtggggatgacgcgacggaccatctgcggcaggatgacggtgaacatggtctgtgccctgttcatgccgagggacgccgcggcctcgtactggccattggggatcgagaggatgcccgcgcggtagatctctgcctggtaggcggaggagttgatggccatcacaatgacgcccaggacgttgttgtcgatgttgatgccaatcatcggcaggccgaagaacatgatgtagatctgcaggaagagcggcgtgccgcgcaggaggttgatgtagatggacgccaggccgcgcaggaccttgaagcgcgagatcttcatcatggcgaacagcaggccgagcgcgatggcgaacgggtacgagatgaccacgatgagcaggcagagcacccagccgccgaagagcgagacgaaagaggtcacgaggagctgcggcttgaagaacatgttgaggaagggcacggagttccaggcggtgacccagggctggccgtcaagccacatgacgatctgctgcaccggggtgttggagatggtcttgatcttcgcggacgcgggaagcgtgcccttgacgccagcagcggtcgtgtagctgcccgtgacctggtacttgccgccctggttagggaacttcatgtccgtgatctcgagcctgaggagcgacccgttgggaattgggctcgcgaacttgatcgttaccgtgttgcccttggccgtggccttgccgtcgatgttgacgcgcgtgaggcccttgagcacggtgaccttggtggtggacccctcgaacgaggcgtcgctcgggagcttcagggtgacggacgagacgccgtcctcgaccttggtggtggcctcccacgtcaggcgcgtgttgatgccgccgatgacgcggtcgccgccgtcctcgttgggacgtgcggtcgccttgctcacgaccacggagccggcgtcgccgttcgtcgtggtcgaggtggccgcggcgctcgcggactgcgcctcgtagtcgacgccgaaccacttcttctcgaacgtggacagggtgccatccttgcgcagttgcttgagtgccttgttgagggccttcgtgagcgcggggttgtccttgctgacgacgatgccgtactgctcgccggtcgcgatttccttcgcgacggagaggctcgtgtaggagttcttcacctcgtactgcatgacgggcaggtccgcgacggccgcgttgtacaggccggtcgagacgccggacagggccgagattgggtcgtcaagcgccacgaccttggcattgggcaggttctcctctacccaggactcgcccgtggtgccggactgcacggcaaccgtcacgcccgacttgttgaggacgttcacgtcggacccgaccgaggatgccgtggccttgctggtcacgatgccctggttggagtcgatgtaggcgtccgtgaagtcgatctccttcttgcggtcggcagtgatcgtgaagttggaggcgccgacgtccgccttgccgccctgcttgacggtggggatgatggagtcgaacttcatcgggttcaggtagttgaccgtgagcccgagcttcttggcgagcgcgtccatcagctcgacctcgaagcccttcttggtggtgccctccatgtagtcgaacggcgggttcgccaggtctgacgccaccgtgagcttgcccttgtggaccaactcgatcttctcggatgccttcttgctcgtgctcttgctagacgagctcgacgacgagcagcccgtgacgaacacggtcagcaccatcgccagcgacattgccatcaccaatggcagtgcacgcaatcggacgcagctgtttctcttcattccagtctccccttcaactcgcgctgaagtcccctacttgcagccgtgcaatacggcggacggccagacgagctggccggctcgaccgcggacgcagttcgcttgaaagccccctgcgaatgtccccaatggtatatgaaacgtgattattgttcccatccatatatcactttttcggttatcgaaatcgaatggtcaaaaatcgcgttcgtgttcgaaaccgtacaccaccaaatatgagggcgaccgtcccattatgtggacggtcgccctcaatccgtaggcaggtcatgtttcagtaacccaccctttatactatcggccacgcgctattaacaatcaccccgcgggggagaaggacgcggcgcctcagccgacgcctacacgccggcgtagtacttcctgcgctcccactccgtgacggtggagcagtactcgtcccactcttttctcttctcctccgcatagaagtccgtgatgtggtcgcccagcacctcgcgcacgaagctgctcccctcaaagcgctcgatggcctcgccaaggtcgcgcggcaggcgctcgatgccagccgcctggcgctcggactcgctcatcgcggcggggtccgtcatcgcctcgggcggaagctcgagaccctcctcgatgccgcggatgccggcggcgagcgtcagcgcgatggtgaggtacgggtttgccgtgggatccgggttcctgagctccacgcgcgtggactggtgcttgcccggcttgtgcgtggggatgcgcacgagcgcggtacggttcttgcgaccccacgtggtgtagatgggaacctccccgttgggcacgaggcgcttgtacgagttgacggtggggttggagacgagcaggctatcgggagcgtacttcaggagtccggccacgtagtgctgcgcgagctcgctcaggtgggcgtcgttctgggtcttgggcgcccagaacaggttgttgccctcgtggtcgaagagcgactcgtacaggaacatgccggagcccaggtagccgttgagcggcttgggcatgaacgaggcaaagagcccgttctggtgggcctcctgcctgatgaccacgcgtgcggtcatgatgttgtcagcgcagctcctggcctcggtgtagcgcagctccaccgtgttctgcgacggcgccgtggcgtggaacgagtacgccacggggatggacatgcgctcgagcatgagcgtggtcgagcgacggaggtcagtcgccacgtcggacgtcgtgagctcgaagtagccgccgttgtcctgcgggatggggtccttgtcgtttccaaagtagaagtactcgatgcgcggccccacgttgagcacgtagcccttggcgtccgccatgcggaacacgcgctccaggcaggagcgggagtcgccctcaaacggctcgcgcgacggcgtcttgatgtcgcagaacacgcgcgcgacgccgtgctgctccggcctccagggcaggatctggaacgtcgtggggtcggggaacgccagcatgtccgactcctcggaggacacaaagccctccacggacgagccgtcgaagccgataccctcctcgaaggcctcctccaggtcctcggacgatatggcaaaggacttcagcctgccaaggacgtcggtaaaccagaggcggacaaagcgaatgtcgcgcttctccaccgtcctgagcacaaagtcgacattcctatcactcatgccagatccttccgtagtgcgtacgggcacacgccgagcagtcagtcataccagttgcaccttggcacatgcagattacgcgtctgttaccaaggggcattgggtctgcgagacgcggcctccacaaggcaagcggtcgcctccggagccccgtcgcgcaaacgttcaaatcttaatacaaatggaccgcgggcgagaaggacggctccccctacttgcgcttccctgcagacgagagcgcggcatccgccttggcgaccatgtccttcgcgacggggcacgtcttggcgccacctgcatgcgcggggcaggttgcctcctgcgcgcagctcgagcagctgccgccgcccttggccaggctcctcacgcacagcacgaacgccacggcgatcgcggcgacgatgacgaggtccagcagcatttgtacctccttcacgcccgtgcggtcgagccgctcggacgaagtatttgttagcctggtataactatacccacatccgcgccgcatcccacgtggaatccggtgcggggcggcctctactcccccccctcacgcctcgaccaccgcacaaagatgccccgccgacgaaggaagggggtcgtcggcggggctgggacccagtcttgcggggagaggatccgcatcccgggtagaggtaagcgatgtgttagcgggggttcccgcttgacgagtacatggtatccgacggagcgtcaaaagtaaagcgcggttaactctacttccgtcatcacacgttcgtcacaatccacatttacatcgcgcactatacgattgcgtgctatagttatggccaacgggaggggccctacccccacccacacgcgacgtgcactcacatatatgtaaggagaccgcacatgagctacttcgactacaccgtgaccaagcaggacggcaccaccacgagcctcgacgcctacaggggcaaggtccttctcatcgtaaacaccgccaccggctgcggcttcaccccccagtacgacgacctcgagcgcatctacgcaaagtaccgcgaccgcggcttcgagatcctggacttcccctgcaaccagtttgccggccaggcgcccgagtccgacgacgagatccaccagttctgcaccatgaagttcggcacggagttcccccagttcaagaagatcgaggtcaacggcgacggcgccgaccccctgttcagggatctcgcgaccgaaaggccgttccagggctttggcaagggcgtcaaggcgctcgccctcaagaagttcgcggacgcaaacaacaggaagtttggcgacaaggcctacatcatgtggaacttcaccaagttcctcgtggaccgcgacggcaacctccaggcccgcttcgagcccacggtcgacatggcagaggtcgagaaggccatcgcagcccagctgtagcctttgcgaaggcgcggcaatcccccacgccgcgcactagactgggctcgagtcacacacaccgggaggcggtcgcacaccatggcggccgcctcccctcatgagaaaagacgtgcattcatatgacagcgcaggaagagaagaacgtgacgcaggacaggggcatggcctcgggctcgccgcgcgaggcgaccatcgtgcgcacgagcgtgctcgggatcgcggcgaacgtccttctcgccgcattcaaggcggccgtcggcatcgcgacacgctccgtcgccgtgacgatggacgcggtcaacaacctctcggacgccatgagctccgtcatcaccatcgtggggaccaagctcgcgaccaagcggcccgacaagcgccaccccctgggctacgggcgcgtcgagtacctctcgtccaccgtcatctcggtcctcgtgctgtacgccggcgtcacgtcgctcgtggagtccgtcaagggcatcgccttcccgcagacgcccgactacacgcccgtctcgctcgtgatcatcgcggcggccgtcgtggtcaagctcctgctgggccgccacgtcaaggcgacgggcgagcgcgtcgactccgactctctggtggcctccggcgcggacgcgctgttcgacgcggtgctgtcgctctccacgctggccgcggcgctggtcttcatcggcacgggcgtcgcgatcgaggcctgggtgggcgctgcgatatcggtcgtgatcgtcaagtccggcctcgagatgctgggctccaccctcagccagatcctgggcgagcgcccggacgaggacatcacggccaaggtcaagggcatagtcgaggcagaccccgacgcccacggcgcctacgaccttctcctccactcctacggccccgagcacctggtgggctccgtccacacagaggtgcccgacaccatgaccgccgcgcagatcgaccagatgacccgccgcatccagcgtggcgtgtaccaggccacgcagggccgcgtgctcatggcggccgtgggaatctactcgcgcaacaccgcggacgacgcggcggccgcgctgcgcagcgacgtcacgcgcatggtcatgtcgcacgacggcgtgctccagatgcacggcttctacctggacgagaagagccactccctccactttgacgtggtgctggactttgccctgcccgaccgcgaggcgctgtaccaccagatcgtggacgaggtccgcgcggcgcaccccgagctcacggtgagcgtcacgctcgacgcggacgtggccgactagcggcgcctccgccggcttcgagcctgccctgcggcgcggttgcccacggattgccgtccatttgggacgcgcgcggacgccgcaaacttgatgcgcaagcgcgcgtgcgcgtgccttagaatgtagggagtcaagtgtttggcgcaagcgtttctacagaaaggaacaggcatggcagaagacactatgaagctcgtcatcatccgtcacggtgagtcggagtggaacctcaagaacctcttcaccggctggaccgacgtcgatctgacggacaccggccgcgcagaggccgcagctggcggcaaggccctcaaggagcagggctacgactttgacgtctgctacacgtcgctgctcaagcgcgccatccacaccctcaacatcgtcctggacgagatggaccgcgcatggctgcccgtccacaagacctggcgcctcaacgagcgtcactacggcgcgctgcagggcctgaacaaggccaaggccgccgaggagcacggcgaggagcaggtcctcatctggcgtcgctccttcgacgtccagccgcccgcgctcaagcccggcgatccccgcgacccgcacatccaggaccagttccgcgacgtgccgcaggaggacctcccctacaccgagtgcctgaaggacaccatcgcccgtgcgtggccgtactttgagcaggagatcaagccccagatggaggccggcaagcgcgtgctcatcgcggcccacggcaacagcctgcgcgccctcgtgatgcagctcgagcacctcacccccgaggagatcctcaaggtcaacatcccgaccggcgtcccctgctcctacacctttgacaaggactggaacatcctcgacaagcactacatcggcgatcccgagacgatcgagaagaagattaacgccgtcgccaaccagggcaaggccaagaagtagcctcttccccaagggatgacagcgagccccgcgtcgcacgccggcgcggggcttcttttatggcccggcggcgggcacggggccacgtccttctcgcccgcgccgccatgggttcagaaaagtgaaagaatacccgtataccgtgcgtgaccttcccacaagtgggtagacaattattgttaactaaagcttactttaggagtcacctatgaacggaatcgcacaacgggcgcgggagcgctttggaggaaagaggacgggcggccacggcggcctcgagatcctgaggagcatcgggccgggcctgctcgtgaccgtggggttcatcgaccccggcaactgggcgtccaacatggcagccggctcgcagtttggctatgggctgctgtgggtggtcacgctctccaccgtcatgctcatcatcctgcagcacaacgccgcccaccttggcatcgccacgggcgagtgcctggccgaggcgaccacggcgcacctgccgcgctgggttgcgcgcctcatcctggcgagtgcctacctcgccaccgtcgcgacggcgctggccgaggtcctgggcggtgccgtcgcgctgcagatgctgtttggcctgcctcttcccatagggagcctgctcgtggccgcggcctccacggcgctgctgatgagcagctcgtacaagcgcgtggagcgatggatcatcgcattcgtctcgctcatcgggctgtcgtttctgttcgagctcgccctcgtgcacgtggactgggcgcaggcgggcgccggctgggtcacgccgaacctccccaaggggtcgctctccatcgtgatgagcgtgctgggcgccgtggtgatgccgcacaacctcttcctgcactccgaggtcatccagagccagcacttcgaggcgcgcggtgacgacgtggtgcgcgatcggctgagtcacgagtttgtggacacgctcttctccatgggcgttggctgggccataaactcggccatggtgatactggctgccacgacgttcttcacgcacggcatggtcgtgacggacctcgccgcggcggcggacacgctctcgcccatcctgggccaggcgtccacggtggtctttgcgctggcgctgctgctggcggggctctcgtcctccatcacggcggccatggcggcaggcaccatcagcgccggcatgtttggcgaggagtacgacatccacgaccggcattcctccctgggcgtgctgctttgcatggtcgtggcggcgctcgtgtgcctgcttgtgcgcgactccttccaggggctcgtgctcagccaggcgctgctttcgctccagctgcccatcaccgtgttcctgcaggtgtacctcacctcgtccgagcgggtcatgggcaagtggaagaacaccacgaccaccaaggtcgcactcgtaatgatcggcgtgctggtcaccgcgatcgacgtggtcggcctcgtgggatagggcctccttcaagggcgtccgcgcaaacagctggcggtttggacgaggtctcgaattcgcaaaccctggttcaccgcacaatctcaggccctctccttctctctcacaccagtatattggtcaaatatttggctataattattgccaattgggaaggagatagacatgcatgcaacgacgattggcctcgccgaggcaaagaacaatttctctcgcgtgacggcggaggtgaaccgctccgggaggcctgtcaccgtgctcaagaacaataagccctgggtgaccatctctccggcagctggcgttgccaacccggacatggtggacgtcgctgtggacttcatggacgagtacgccgacgtcttcgaggagcttgccaagtgagcgcattcccagatgacatttcgcgcacatgtgccatggctcacgtcacacagagttctgcgaggtgatgctcggcattgccgccagcaaggtatccctagatgagtttacgagatgggtccgtagccaagtggcatagctgcatgagcggtcctcaatagtccaagccgtgagagaatcacactccaccgttggcatgacccgtacgacggagtgtgactatttgcatttgcgttgcgaaaccctaccccaccaggtccaggatttgcgacagccccttcttcccaaacgtgacgcgctcgcccgagccgtcttccaccacaaggcacggcacgctcatcacgtcgtagcgctcgcgcagcgtcgggaagcggttgacgtcgtacacgtcggccgtgacctgcgggttgtccgcggccatgcgctggcaggccaccaccacgtccgggcacatggtgcacgagagccccacgagcaccttgagccccaccggccgcgaaatccgcgcgatggcctcacggtcgcttgcggcgatgggttgacccggacccgcggcgttgtagatgcccagcacgaacgaggtgaactcgtgcccgcccggcacgccgtggaacgccatgccacacgccgtttcgtccgcacgcaccagctccacaaagggaagctccgccgggtcgtcggcggcggcgtccgccacctccacggagagccggtcgctcagccccgcgagcgcgtccatgtacgctcgcagctccgcggaggcgtccgacccatcgaggtgcaccctcagcgtcacgtcgctttccatgcgcgagaagaccgcgtcgagctgggctgccatcgcctcgtcaatgggcgagtcgccgcccgttgcacccgaggccggagccgaggtcccggccgcagcagcgggcgccacgtccttctcgcccgtcgcgacgtcgcgcgtgcgactcgcgggctgccgggggacgatgcccgtgcgctcctgggcgcgcttgaggtagcgctccatctcggtcgccgtggcagcgccctcgcccaccgcggtcgccacctggcgcaggcgcttctggcacacgtcgcccgcggcgaagagcccgtccgcgctcgtcatctggtggtcgtccacgatcacgtagccatggtcgtccagccttgccacgcccgccacgagcgaagtcgcgggcgcatatcccacaaagacgaagacgcccacgggaccgccgtcctccggcgcaaagtcgcgctcctcccccgtcacgcggtctcgccagcggacgtcgcgcaccgcggagtcgccctccacagccgtgagctcggcgttggtgtgcacggtgaccttggggttcgcgcgcgtcgcctccgccgtggcggccgcgcaggtgaagtcctccccgcggaccagcaccgtcacgtgcgaggcgtacttggtcaggaacacggcctcctcggcggcggcaaagccgccaccaaccacaaagaccggtcggcccgtgaagaactcgccgtcgcaggtggcgcagtacgccacaccgtgaccgcggaacgcgtcctcgcccgcgaagcccgcggacctgggcgaggcgcccgtcgcgagcagcactgccaggcagcgcacgtcgccgcgcgaggtgcgcaccagcttgacgtcgcccgtgaggtcgagcgactccacgtccgcgagcagcatctccgcgccaaaggcctcggcctggcggcgcatcgtgtccgtgagctccgatccgctcgcgctgagcacgcccggatagttgacaacctcagacgtgatggtgatctgcccgccaaagtgctcgcgctcgaccacgagcacgcggtagcgcgcccgcgccaggtacagcgccgccgtcagccccgccgggccaccgcctatgatcaccgcgtcgtacacgttgtccacgttcttctcgtccatgttcttgcctcccccgcggtcccggcgtaagggcgggcccgccgacgcagccgacgggcccgctcagccatcccaaaaattccgctcgctatcgattagagctgtccgaccaggtcgagcgagggcttgagcgtctccgcgcccggcttccacttggctgggcacacctggtcgccgtgctcgcgcacgaacttggcggcctgcaccaggcgcaggagctccctggcgttgcggccgatgccgcctgccgtgacctcgtacacctggatgcgcccgtccgggtccacgatgaaggcgccgcgctcggccaggccgtcgccctcgatcagcacctcgaagtcgcgcgcgaggacgtgcgcggggtcggccagcatcgggtaggtcaccttggagatgcgctcggactcgtcgtgccaggccttgtggacaaagtgcgtgtcgcacgacacggagtagacctcgcagccctctgccttgaaggcgtcgtagttctccgcaagctcctcgagctccgtggggcagacaaacgtgaagtccgcgggatagaagaagaacagcgcccacttgcccagaacgtcagccttggtgacggtcctgaactcgccgttctggtaggcctggacgctgaagtcgccgatttccttgttgatgagtgacatggttcgcttcccttctttcgtgtgccgttgcgtctctaccattattggtattgagtcttattatcattataatttgcgacagcgcaagccccaaacccaactttttcgggattcggcggcgggcgagaagaacggccccctcgcgccgacgtctgatcccaatcgaggcacggttacatgacggcaacgcatccgccgcccatggccaaagtcaccggcacggcactacaatcgcatgtcgtgtatggcgagcgtcagggggaggcagcatgggctctgttctcatcggactcgtaccggccctcggctggggccttcagggcatcgtcatgcagaaggtcggtggcaccgccgccaaccggcagatgggaatcgtgctcgccgctctggtctcgggcgtcgtggtcgcgcttctcgtccccatacgctggacgccgacgctcgtggcagcggcggccgtcaacggcatcccctggtccctggcgcaggtcctgcagatcaagagcttcgactgcctgggcgtcgcccgcaccatgcccctcaccaccgggatgcagctgatcatgacgtccatcatcggcgcgctctgctttggcgagtggccgcacgcctggcaggtggtgctgggctccgtgggaatagccgtcctcgtcgccgggaccgtcctcgtcgcctaccgggaggatgctccggacgcgggacgcgccacgggagctgccttccgcaggggcgtcgccatcaccgcgctctccgcggcgctctacgtggcctacggcacggcagcccgcctcttcagcgtcgacagcttccagatcatcctgccgcaggcgctgttcatgttcgcggccaccctcgcgatctcgctgctcgcgggcggaaagtcggctggcggagcgaccggcagcatcagcagcgcctttggcaagaagtcatggcagaacatgctcacggggttggtttggtccgtgtccaacatcacgctcctgttctcaaaccagctgaacggcgtcacggttgccgccaccctcgcgagcatgaacatcatcgtctccacgttgggcggcctgttcatcctgcacgagcgtaagacgccccgggagctgcgcttcgtcatcgcgggcatggcgcttgtcgccgccggcggcatcgccatcggcgtgacgaagctctgaggcgcagtccgtccccggtcacatcgcgcggacgagaagaacacgctccctttgtagagtgtgtcacctttgtgcgcaacgtgtgcgaactgagcattcgccgtcgcctgcgttgacgctatcgatatgtggtcctaacatcttccaatccaccaaaccactctgcacgagcccgacggggccagcacgcgcggtgcgagtccacgcccgccaaagtcaggaggccggacatggaaagaaggaacacgcgccagcgccagctggtgctcgacgtggtgagggagctgcgcgaccaccccacggcggacgaggtttacctcaaggtgcgcgagcgcgacgcgcatgtgagccgcggcacggtctatcgcaacctgcacgtccttgcggaggagggcgacatcctctccgtcaagatgcccggcggcgagcgctttgacctgcgtacggacaggcacgcccacctcgtctgcaccgagtgcggaagcgtggtggacgtgccggcgcccgactatggcgactaccgcgagcgcgtcgcgcgccagacgggctacgccaacgtcaaagcgacgacgctcctgacgggcctctgcccggactgccaggccaaggcggaccgtgccgccgcggcacagggcgagaaggactcccgcgccgactaacggcgcggtgcgccaactcttctcccccagggtcgccgccggctagagtaccgactgggcagcgcgcggcggcaagcatgtcgacgtccatcgtatgcaccaccttatcgtgcgaatgggtcgtttgcgaatgggtcgttgggttctggccccgtccggccctagttcagcaggggtaaagcccagatgagagtgacggcccctcccccgcgttgcgacagggaaggggccgccctggtgaagcaatcgagcgagcctaggcgacgggctcctccgcgaggctgccgaggatgtgctcgtccttctcgtcccacttgggcatggggcggaagagctggaacagtatcgccgcgaggaacgcgaaggccaccacggtccagaacccgaagctaccgaagacgaagagctcgtagaactggttgatgaggaggccgacgacccagccgaagccgcactcgtagccgatggcgaaccagaaccacttggggtcgtccatctgcctgcggatggtgcccattgcggcgaagcagggggcgcagagcatgttgaacgcgacgaacgcgcacatcgcgccgacgtggagcgtaccggcgatcgtgaacatgttggcgaagccctgccacatggtgacggagttctccgtcgcgctgccgaggccgtagaggacgccgaacgtggagacgaggttctccttggcgatgagggcggagatggtggaggcggttgcctgccagttgccgaagccgagcggcatgaagatgaagctcagcgcgccgccgatgccggcgaggatggagtagtccatgtaggtgtcgggtgcgccggccatgccctggaggtagccgaaggagccgctaccaccctgccagctggcgatgccgaagttggagaggaaccagatgccgacggcggccgcgaagatgatcgtgccggccttcttgacgtaggcgctcacgcgctcccagatgtgcagcgcccaggagcggatgctggggaagtggtagtcgggaagctccatgacgaaggggacgggctcgccctggaagggcttggtcttcttgagcatgacggccgagacgatgatggcgacgatgccgaggaagtagaacatcggggcgacccaccaggcgccgttgtcagcaccgacgagcacgcccatgacgagcgcgatgatcgggagctttgcggagcaggggatcatggtcgtgagcatggcggtcatgcggcggtcacgctcgttctcgatcgtcttggtggacaggacgccggggacgccgcagccggaggagacgatcatggggatgaaggacttgcccgagaggccgaagcgacggaacacgcggtccatgacgaaggcgacgcggctcatgtagccgcagtcctcgaggaagcagaggaggacgaacaggacgaagatctgcgggatgaagccgaggacggagcccacgccaccgatgacgccatcgaccacgagggatatcacgacgtcgctcgcgccggcgttggtgagccagccggtgacggcgttggggatggagtccacgaagccggagtagtcgtgctggtcgggggcgggggtgctcacggccttcttgaagtcggcaagcgtgaccttgctgatggtgtcgagcttctggccgctcttgaggacggggttgccgtccttgtcgagcttggtcacgagcttgccgccgttgtaggtgaggttgccgtcgccgtcgtgctcgggcacgttggtcgcgacgacgcccttggcctcggcctttgcctcgaagctcttgaggagcttcttgtccgcggaggagatgtcgccgtcggacacggcggcctcgaccttggaggtgctgatgcccttcttcttggcggcagcgaggaagccgtcgatcttgtcggagtagtgctggctgtcgtaggccttctggtccttgttgtactgggtctcggaggtggagttcacgaagaagccgtcgctgaagaggttgtcgttcacccagtcggtggcgttggtgcccacggtgccgatggcgatgtagtacacgaggatcatgatcgcgatgaagatcggcaggccgagcacgcggttcgtgacgatgcggtcgatcttctgcgacgtcgtgagcttcttgggggccttcttgacgcaggcgtccatgacggtcgcgatccagtcgtagcggtcgctcgtgatgatggactcggagtcgtcgtcgcggtccttctcgaccttggcgatgatctcctcggaggcgtcgagctgctccttggtgagggcgagctcgccgagggcgtcggcgtcacgctcgaagaccttgatggcgtaccagcggccgaggtcctcgggaaccgagttggcgatgatcttctggatcttctggagcgcgtcctcaacctcgggcgagaagcacttggggcccttggccgcgacacccttcttgccgagctcgacggccttcttcaggagctcgtcgaggttcttgttgtggagtgccgagacctcgacgacggggacgccgagcatcttggagagctgcttggtgtcgatgacgtcgccgcgctccttgagcaggtcgcacatgttgagaccgatggccacggggcggccggtctcgaggacctgcgtcgtgaggtagaggttgcgctcgatgttggtgacgtcaagcaggtcgatgaccgcgtccggacggtcgttcaccaggtagtcgcgcgagacgacctcctcgggagagtacggcgagagcgagtagatgccgggcaggtcgacgagggtgacgtccttgtccttcttccactcggcctgcttcttctcgacggtgacgcccggccagttgccgacgtatccgttcgagcccgtgagctcgttgaacagggtcgtcttgccgcaattggggttgccggcaagggcgatgtagaacgtgtctgccatgaagccttccttgcatgttgatgcttgtacaaaatgcctggtgcagcgtggtttgttagtatcgggtaactctccgcgcaaataaaaagggacgtcgtccccctggcctgctacgccttggcgatgtccttcacctcgacgcaacgggcctcgtccttacgcaggctgagctcgtagccgcggatggtgacctcgatggggtcgccaagcggagcgaccttgtgcaccaggacctcggtgttcttggtgacgcccatgtccatgatgcggcgcttgatggcaccctcgccggttagcttggacacgacgcacttctgaccaaccttgacgtccgaaagcgttggcatgcttcccctttcctaaagagccgcgcaacgcggcgcttgcaaaaccaaagtagtgggcctaagtccctagcaggtgacgatcttcatcgcgatgtcgcggttgagcgcgaacgtggcacccttgaccttcacgacgacgtcgccgctcacgcgcgagaccacctgcacgctcgcgccctgcacaaagcccatctccgcgaggtgctgcctcagctcctgcttgccgcgcacgcgcgcgacacaggcggtctcgccctcgctcaccatggacagcggcagctgtgcgccggaacgcacctcccgctgcgcggcgaccctacccgagccaatcgtgttgtccataacgctctccatgtactcctccgatgcatgagactccatgaagttagatggaactaactgcgtggaatagtagtacaccaaggctaactattgggcgacaattggcaattttctgacaaattgagaaggacgcgcatcccgagggcgcgcgtccttctccacttcataccctttgagctggtgatatgttgctctgtcgctacttcttgcggcgcaccgggatgggctttggcggcgtcttgggcttcttgttgcccgccatcacgacggcaccctccttgcaggcctccaggcagcggccgcactgggtgcacttgcgctggtccaccacgtgcacgaagccggggttgcccatgatggctgcgtcctcgcaggcttccaggcagtcgccgcagccggtgcagcgcgacacgaggatgtggtacgtcttatacgcgtcacagtcgccggctgggcaggccttgcgcgtgtagtgcgcggcgacctcgtcgccaaagagcgcgagcgcctggcgcacggtcttggccatggtgcggcccacctcgcagagcgactgcccctccatcatgggcgcgaggtcctgcaggagctccacgtcaccgggctggccatgcttggtgcatacgtcgtgcatgaccgcggccatctggaacgagccctcgtggccaaacacgcagtggccgcaggtctcgtggcgatactcctggcagatgcggtcgagcgccttggccacgcagtcctcggggccgagcacgcgcacaaggtcgcacgcgagcgtgacctccgtcgcgtccacgggcagcacgtcgccctggggatagcccaggtagacggccttggcaccctccacgccagcggccttggcaagctcggcggcagtggtgcgcgcgggcagctccacggggtcggcagcgtcgttcagccacacgagcttggtctgtgcgccgtcgccggcaagccaggcctcgccgcccacgagggcgtcctcgcaggagccggtcacggccgagggtatgggcttctcgcccaagaacagtcgctgcgccgcggtgtcgttgccgtagacgtagccaaacgacgcatccgcgcgggcgacggtcacgcccgcgtcctcgaaggccttgcagagcgcgtcctcccccgccgggaggaccacgcgcgcgccctcggacgcagccttggcgacggccgcgtccacgtcgcgcctgagcagcgtgagcgctgccggagcctgcgcgtaggcaggcatgaagttgacgatacgtgccatgcggatcccccctagtactcgttccaaagaagcggcttggtcagcgtgagcctcaggtcgcactgcaggcagcgcgaggcctcgcgctcggcctcgtccttcgagaacgggcactcgtagggctcgaagttgccctcgcgctcgctcgccgcggcgatcttgggcatgaccggcccgtcgtagaagccctcgggggccttgccgatgtgcggctggacggggtcctcgtcgagaaggacctcggagatgtcgccgtcgccgcccaggaagcggtcgatcgcctggctcgcctcgcgtccgccctcgatcgcggcgatgacggacttggtgccggtgacggcatcgccggccgcgaagacgccctcgacgctcgtgcggtggtcggagtcggccaccacatacgggccgtgcgtgagctcgaggcccatgtcacgggtgtcctcgggcttctgccccacggcaaagatcacgtggtccgcgggcagggtgagctcgccgccctccacgagctccgtcacggggcggtggtcctggtcgaagtagaacttcgcgatcttgtggatggtcatggagccgacgtgaccgggattgtccgggtcctcgttgatggacgtgaaggcgtaggcgtcgtgcagcgtgacgccctcctccgcggcctcctcgcgctcctccggcgtggaggtcatgacggcctcggcctcgaggcagcacacgtccacgctcgtggcgcccaggcgcacggcggtgcgggcgcagtcgtaggcgacgttgccgccgccgagcacgaccacgcggccgctcacgtccatgggctggcccttgcgggacgccttgaggaagtccgtgttgcggatgacgccctcaagctcgtggcccggggtgggcagcacggtgccgtcgaacgtgcccacggtcacgaggaccgcgtcgtagctggcacgcagctcgtccagcgagtgcacgcgctcgccgcacctgatctggacgcgcggctgggcgtcgtcgccctgcgtgaccttgaggatcgtgtcgatctcgccgtcgagcacctcgtcgggcaggcggtaggcggggatgccgtagcgcagctggccgccggccttggcctccgcctcgatcacggtgacggagtggcccttctcggcaaggtagtacgcggccgtgaggcctgcggggccggcgcccacgatggcgacgcgcttgcccgtgggggcgtcgtggcgcgtgcgggccatccactcgcccgtgtcgcgcacggcggcagcgcgcttgaggcggcagatggagagcgcgccgtgcaggtggttgcgcttgcactcgccctggcagttgtgcgtgcagatggagcccagggtctcggggaacggcacgcgctcgcgcacgacggccgtggccttctcccactcccccgccttgacgtggcgcaggtagcgcgggatgtcgatgtgcgcggggcagccggagcggcacggcaccacgttgtcctcgcgagagcgctcgggcttgttgaggccgagcacgtccacgatcgagcccgtggggcacacctcgacgcaggcgccgcagaagcggcagccggcctcctcgagcgagacgttgccgtcggtgccgatgcggatgccgtcctcggtgcgttggtagtcgagcacgcccacgccacgcagctcgcggcaggcgcgcacgcagcggccgcacctgatgcagcgcgtgaacatgtgcgtgatgagcgggttggagtcgtccgtcgggacggggcgggtgcggcagcgccaacgggcaggagacacgcccatgaactggtacatgctctgcagctcgcacacgccgaacttggggcagcccgtgcagtcggacgggtgcgtggccaggatcagctccatggccatgcggcgcacgtcctccgccgccttggcgtgggagtcgaccaccatgccctcgcgcacctcggtcttgcaggcggggacggccgggccctccccgtccacgaccacggagcagagccggcagccgccgaccgcctcgaggtccggatgcttgcagatgtgcgggatgaagatgccggcatcgagcgccgcgtccaggacggacgtgccctccggcgcctccacctccgtgccgtcgatagtaagcctcacgtgtacttcctctccaaagggcgcccccgcgcccgcatgccaagggggtgcggcccggggtcccgggaccgcaccccctcgttcagttacctaggaagctagtcccagtcctcgtcgccagccgcggactccgcgaccttctccgccgcgttctcgccggcgatgcggccggagttcaggcagaagcccatggtgttgcctgggatcgcgtagttgtaggagtcgccgtagatggtgcaggcgtcggtgcccacgcagtagaggccgtcaatgacctggtagtcgtcggtcatgacctccatgttgtggttgatgaggacgccgcccagggtgccgtacgcgcccacgtactggcggcacgcgtagaagggaccctcctccagcggcatcatgaagacgcgctccttctcgaagagctcgtcgtagcccttctcgcacatctcgttgtactccgccacgttcttggccaggccctcggggtcgatgccgatcttctcggccagctcctcgagcgtgtccgcctgggcgatcacgtggttgccgttgccgtcgaggtacgtgtcgaggtcgcgctcccactgggcgtcaaagccctggtacaggtccttggggtgcacgtggctcacgatgtcgggaccgtccttcttccagtggcgcagcatcttggagtcgaagatcgagaagcccaccttgccgggcaggtggttgatcgcgttgcccacgaacgtggtgttgaagatgtcgtcctcgggcatgaagcgctcgcccgtgcggtcgcaccagtagcacggctggcggaaggcgccctcgacgtagaagtggttcatgttgtcgggcagctggtacatcatctccatgctgaccggcgtgtggcccgcgccgacggcgtggcacatgttgaagccgtcgccgtccatgcccggcaccgcgaaggagtagaggttcttgccccagtcgaagccgatctggtcgtggatcatcttggcgttgttgccaaagccgcccgtcgcgacgatgacctcctggcaggagatcgtgacctcctcgccgtccttgttgacggccacgacgccgcacaccgcgccctcgtcgttggtgaggagcttcttgcccgggcactcgaacatgaactcgacgcccagcgcggtggcgcgctcggtcatgcgcttggtcatcgtggtggccgcgcggggacccggctcggagccgtcctcgggctgcacgacgtgccaggtgtactcgccgtcggcgtaggcgcgggtgcgctcgcgggcgcggaacgccgggcgcacggagttgaacacgacgcccatgtcctgcagccacttgatggtgtcgccgctcttgaagtagtacgcgcggacgaggcgcgggtccacctggtagtgggtgtagaacatgtggcgacggaacagctcgccgggcgtgacctcgatcatggaagcgcgctgcacgggcgagccggccgcgcacgggcccatgcccatgttggccgcgccgccggtgttggcggccttctcgagcgtgatgacccgggcgcctccctccgcggccgcgatggatgctgccaggccggaaaggccggccgccacgacgacgacgtctgtctcgagctcttgtgccatgggactcctcctaagacgaaaccctgttaccgcgcacgtgcgcggacgaattcttcctcacattcttgccaagcggcgccgccgagcctatgtgcagctgaccaacatttgcccgccgccgcggccgcgcactgtgcgcgcgtggagtcagatgcgccggggagaaggacgcgcccttctcgcccggcgcatcgccgtgggccgttctcgctagcgctcgggcatgctcggcgcgatgaactcgcgatagcgcctgacgcgctccttgtacgcgtcgcccttctgcagctgggcgagctcgccctccatgcggccgatgtcctcgccgtgaatctgcttgccctcggccgtgtcgtgcgcgcggaagagcccgcgctcgtcgtagcactcgtcgtggcggtactcgacctcgatcttgccgtccaccacgtgcacgtggccctcgaggccgcacacggagcagatggccttgtcggtcccggggaccagatagaagtcgttggcgttgcagtgggggcagacgcccttctctccctggtactgggcgtgctcggggtccttggccgcacgggccaggttcacgccgatctggtgggcacgcgcaacgaccttgtcgtccatgagggcgcgcttgctccagggcacccactcgttgtcgatgaccttccacgtgggcgtcatggactggatggcgtggtcggactgggcgtgcgtgccccagtctgagccgccgatggcgatgtagctcacgggcttgcccgggcagatcacgcgcgggtcgggggccttggcgggcttgccctcgccctggagcttgtgggcgatgttggtggcgatcacgttgttgccagtgtccatgcggggcccaaagcggtccatgatcgtgtggaacaggccggacgcgcccgtctcgaagatcgggtcgcacatcacgatgccgtcggcctcggccatcttgaagaacagccagtcgaagtcgtccttgtggatgcagcggttgccgcggccgctcatgagcgacttgacgcacgcgatgcagccggtgcagtggcggatgtcgaggtcctgagcgcggatgaactcgacctcacagccctcctccacggcgcccatgagcgcctccttgcagatgcagtcgttgttgccgttcttggtgccaaacgaaacgcccagtacctttgccatgaggcttcctctccacgccttgcggccacccccgtggtcgcttccaaatgcgagtagcgtaggttggagcccattgtgcgattgcaccaaatatgaaagtggaaactgcccgcctttgaggtcaggttacgttcgcgacgcgccgccagcatgcgaccatgtggcacctagcgcgagccggcgaggccctccatgatggcggccgagaagctcacggcgagccggtcgtccccgtccttcaggtccacgtggaagaggtcgcggatcttgttcacgcggtagaagtacgtgttgcggtggactgagagcgcctccgccgcgtccgccgggctgcccgggaagcgcacggacgcaacggcggtctccaggtacgacgtgccatgctcgcggtcgtaggcgtccatcgccacgacgcgcttgtccagcagcatgtcctgcgcgcccgcgagctcggagttgtgtgccacgacctcgaagcggtggcgccacaggtacacgaccctcgagcgcgcgtcggccggcggcacggcgtcgcacagctcgcggcactcgcccaggcgctggcgcagcgacgccaggtccgcaaacggctcgcacacgtaggcgcgcatgtcgttgttctcaagcagctgcgcaagggcccggtcacgcgcgagcctgcgctcgcagcgctcatacgagtcaaagcccacctcggcggaggggcccaggctgacgagaaggacgagcgcaccgtccgcgacgcaccatgccacgtccggcatcgtccgctgcacgatggcccccgcacgcgcgtagtagtcctcgttcgcgtcctgcgggccaagcacgcgcagcagcacgaaggcgtcgtccggcgagagccccagcagctcgaggtgcgcacgcagcgcctcctcgttcatgaacgtgccctcgagcgcgtcctgcaggattgaggatcccctgcccaggcggccacccgccgcgcccagcctgtcaatcatgatgcccgccaggtcgctcgcaaagtccacgagctcgaggtcgagccccgtcatgcggtgcgtcgcctcgaacacgtcgaagcggcccatctccagccggtggtgatagatgatcgaggtcacgcagcggtccttctcgcccgaacgctcgctcatgatggaatggcgcgcggccctcacggagctgatgatgccgtcctcgcgcatgtgccgctcgacctcgggcgtgatgtagcccgcctcgagcacggacctcacgtcgtccgtggtgggaagctcgcccgcgtgcgccaggaccttgtgctccgtgttcgatatgatgaccgggttgcccagcacggatgccgccttgcgcgcgaactgccgcatgtcataggagtccaggaagcactcaaagagctggttgcgccgcgcggccagctcgccgctcctgcgcaccaggcccaggaacgcgtcctggaagtcgctcgggcagagcctcccccagcagcgcaccacgctctcctcgcaggaggggtcgacccggccgtccgcgtccctctcgcccgcgtcgccctgcgcgtcacgctgctcgtacacaagcatgagcccctggtccgtggccggagcgccgtcctgcgcgaggtccgacacggaccccaggcggatcacgccctgcgtgccggcacccgtgccccacacgggcgagacgaccatgtcccagccgagctcggcctcgtcgtgcaccacgtagcccccgatgggaagctcgctcagtatcgtcctcagcttcatgcgacggcccctttgcccacgcccttctcgcccgttgtgcgcacgcacaagtctatcacgcgggaccgcaccgcattttggggccgctgccatgggcgccgcgcgcggcggcgcatacgcttcgatggagtttccaacgattggagaagaacgtggcaaagctgattgacgagctcatcgcaaaggcaaagcagtccccgcgcagggtggcccttcccgaggcgaccgacgcggacacgctccacgcggcgcgcgccgtgctggacgacggcatcgcgcagcccgtgctcgtgggccccgtggaagaggttcgtgccgccgcgtccgcggccggggtcgacgtgggcgacatggagctcgtggacacctcggacgccgcagcggcggacgcgctggcagagcgctacatgtccgccggacgcgagcggctcgtatccgcaaagggtgcgcgccgcaagatcaagaagccgctcaactacgccatggtgctcgaggacctgggcgacgtggactgcacgttctgcggccacgtcaacaccaccggcgacgtgctcatggcggcctcgatgatgatcgggctcgcggacggggtggacgtcccctccattctcgcgctcgcccaggtaccgggctttgccggccccgagggcgacgtgatcgcgctcacggactgcggcctcaaccccgagccctccgcggaggagctcgcctccatcgcgatcgcggcctgcgacaacgtgcgcgccatcatgggctgggagccgcgcgcggccttcgtctcgtattccacggacggctccggcgagagtccctccatcgagcgcgtgcgcgaggccctggcgatcgcccgcggccgcaggcccgacctcgccctcgacggcgagttccagctcgacgccgccatcgtgcccgccgtcgccgccaagaaggtcaagcgccagagcgccgtggccggccgcgccaacgtgctcgtcctgcccgacctcaactgcgccaacaccatgatcaagaccatccagctcttcgcgggcggcaagggctatggccacacgctgagcggcttccgccgtcccgtggcggacagctcccgcggcgcctccgtggaggagatggtgggcgacatcgcgatgctcgtcctctccgcggcggagtagccacgcccgcggccacgcgaccaccggcaatccatcatcaagcttcttaggagtacccatgacctacaggatcctcacgctctcccccggctcgacctccaccaaggtggccgtgttcgaggggcaggagtgcctcatgcgcgccaacgtcacccatccggcggaagagctcgcgcgcttcgaccgcgccgtcgaccagctcgactaccgcatcaagaccgtggaggccgagctcgaccgtgcggacatcgcgctcgacagcatggacgccttcagcggctactgcggcggcatgggccccacccgcggcggcatcttcgcgatcgaccagaccgtgtgcgaccacgtgctcaactgcggcatgaaccaccccgccatcctgggcgcacccatcctcttctcgttcgcgcagcgcacgggcaagccggccttcgccgtcaaccagccggacacggacgagctggacgacgtcgcccgcatcacgggctaccccggcgtctaccgcaagagccacgtgcactgcctcaaccagaaggagtgcgccatccgcttcgcccagtccatcggcacaacgtacgaccaggtcaacgtcatcgtcgcgcacgtgggcggcggcctttccgtcgcggcgcaccgccacggctggatggtcgacaccaacgacgtgctcgagggctccggccccttcgcgccaaaccgctccggcgacgtgcccctcaagcccgtcgtctcgctcctcgcgggcggcacccagaccaaggcccaggtcatgtcggtcatcggccgcacgggcgggctcaagggcctgctcggcacggacgacgcccgccagatcgaccagatgatagccgacggcgacccctgggccaccctcgtgtacgacgccatggcctaccagacggccaaggccatcggcgccctcgcggcggccctcgagggcgcggtcgacggcatcgtgctcacgggcggcgtctcgcatgacaagatcttcgtcaacgccgtgacccgccgcgtcggctggatcgcccccgtcacggtctacgccggcgacttcgagatggagggtgccgcgtccggcgccgtccgcgccctcgacggcacggagtccgtcatgacctacaccggcgacccctcgtgggacggcttcaggctcgccggcgcccccgcggacgtggaggcatagcgtgagcgagaagaacaccgccgcaccagccgcccccacgtccgcgcagcgctcgggcggcttccactacgcgtacctcatcgtgctctcgtgcatcgcgatcacctgcctgccctgtgccctcgtgctcagctgcgccggcatcttcttcacgccggtgagcgagtggctcggcgtcgcgcgcgcccagttcacgctgtacttctccatcctcaacgtcgccatgatgctcacgctccccgtcgcggggcgcctcatgggcaaggccgacctccgcgtcgtcctgtccgcctgcgtctgcctctgcggcgcggggctcctcggcatgggccgctcgagcgccctctggcagttctacgtctgcggcgccgtcatgggcgtgggcgtcgcccccctcatctacctggccgttcccacgctcgtcaatgcctggtgcgtcaagcgcgtcggcttcttcgtgggactctgcatggcgttcacgggcatcggaggcgtcatcttcaaccccatcggaacgtcgctcatccagtccggcgccgagggctggcgcacggcctacacggtcttcggcatcgtcacgctcgtcggcacgctgcccttcacgctcctggtcgtgcgctccaagcccgccgacaagggccttctcccctatggcgcaagcgccaacgccaacacgggcgagaagaacactgcctcggcaggctccgccacgcaggcgggcgccgccaagggcgtgagcgcggccgacgcgatgggcatgcccgcgttctgggcgctcgtcgcgttctgcggcgtcatcacgctcaaccagaccatctaccagttccttcccagctacgcgctgtcgtttgccaagtccgcgccgcagatcgcggcggcctcgggcgtcgtggcctccgcggccatggccggccaggccgtcggcaaggtcgtcctcggcgtcgtgaacgaccgctccgtgcgcgccggcgtcctcgtgggcatcggctgtggcgtcgcgggcgtgctcgtgatgtggttcctgcccacggcgctcgtccttctcctcgtgggcgccttcctctttggcgtggtgtacgcgcagaccacggtccagacgccgctgctggtgcgcgccgcctttggctcggccgactaccccgccatctactcgcgcgtctccatggc

SEQ ID NO: 168 - DNA, 35027 bp, Unknown
  Metagenome-assembled genome
aggccccggcgacatacccccgtcacgggcggccgccggccgcctggcccctcgtgccggaaaacaacgttccatatccggttgtcaaggtgctggaaaggccgaagttggcctggctaacctgttgacaaatccatagctggctcccccaatcggtctgcatgttacagattatatccgcggggagaagaactcagacgcgcgctagagggcccgtccgccaatgaagtcgcttccgtcgcgcacgatgccccacgactcgaggtccgaacgcgagaggctgagcttgtccgtggtcgcgagcgcgtcgagccagggcgccgcgtcgcgggcggcggcccagagctgggcgagccccacgggactcacggactggaacgagagcaggctgcgccagatgacgcgcgcgaggttgggcggcaccatgaggaggtagcaattctcgcccgcaagctccgtggcgatgcagacgcagctgatgcggccatcgagcatgaggctcgccacgctgccgggcgcggggagcgcgtcggcgccgcccacgtagtcgcccaggacggccggcgccgtgtggccccagagcacgagcggcacgaggcgcgtgctcacgtccgtcacgtcgaggccctggtacggcgcgaagccgtcctgctcgatggaggacacaaagctcagccacgccgccatgacggaggcgcgggggctcatgtcaaaggcaagcagctcgtcgtcgccggagcgcgcgagcagcgggatggaggcgaggctgccgtcgcccaggagcacggggccaaacgcggactcgcccacggagagcgactcgctcgcgaaggccgcctgctggaagccctcgagcggcgccccggaagagaggatcacgcgcatgcccgtggcgtcggccagcacgcagccctcgcgcacggcggaatcggccgcctgggcggaggcgtaggccaccgtcgtggggatgccgagctcgccctgcgcaaagcttgcgcccaggagcacgtgctcctcgtacagggcgccgcgcttctcacccgtcaggccctgcgtgtcgcgtgcgttgtccatcatgctcacctacaccagatcgcttgtgttgtagaacaggggcagcgcgaagacgtcccaggaggaggtgcgcaccagcttgctgccggcggtgtacacgtcgcgcgagaccacgcgcgagccctgcttccacacgctgctgccaaacgggtcccccgcgcccagcagcgtgccggactgctgcatggtcgtcgtgtacgtgacgtccctgccggcgtacacgcggcccacggcgtcccacgaggcgcttacggcgcgcttgccccagaggctcgtggggtcggtcaccatgcgcacgatgcgcgacgcgcgcgagaactcgatcttcttgaggtagctgtcgtacgcccagtccatgagcgccgccgtgtccgtgaagcgtccctcgtgcgtctggcagccgagcacggccgagaagagctggacgccccagcgcttggacgatcccaggaaggtggtgccggacgccacggctccggtcttgatgccgcagaggcccgcgtagctgcccatgaggtcgtccgtggaggagagcgtcttgctgatgccgcccaccgtaaccgtggtggagcgcgtggtgaccgccctcgcgatgaacgagtagtgctcgagcgcgtagcgacccatgagcacgaggtcgtgggcgcaggagtagtggccgtcctcctcgagcccgtgcgggttgacgaagtgcgtgttcgtcatcccgatctccttggccttcttgttcatgagctcgacgaacttgtccacgctgccggccacgttgatggcgatgttttctgccgcgtcgttggcggagtacacgagcatggccatcatgagctcgcggaacgtgggcgtgtcgctcgaggtgtagcctgcgagctgcgcgccgtcctggtacgtctcgtcggtgatggtgcacttcttgtccatgtcgatgccggcgtcgagcgccaccatggccgtcatgatcttggtgatggaggcgggcgccatatgctttgtggcgttcttcttggcgagcacgttgccgtcctggtccacgatctcgtagcactgcgcctcggtcacctgtggcttggactccgcggcgcgtgcgggcacggcagaaagccccagcgacgcgagcgcgatcgcgagggcgagaagaacggacccaacggcccgcgtcatcaaacggtgcatgagcgtcactcccctagtcggcctctggcgcacccggcacgccggcatcggccttggaacgcgcgtccttctcgcccgcgtgggctgcctcggccacggcgtccgcggcctccacggcggcggcgtcggccgcctcgtccgtgcggtggcccagcgcgagcgcgcggcgcttgatggcaaacccgcgcttggtgtacacgagcgcggccgcaagcgagcacaaaaggccggcgtacacgaagaagatacccagcggcgcgctctcgcggcccaggccaggcagccaggagacctccaccaggttgagcccgtgcacgcgcggcaggcccagcaacaggaagctgaagcccgtcatgaggaaggccgtcgcaaacttgcccacgtacaccacgtcgacgggcctgcgctggtacttctgcaggatcatgctgcctatgaagaggtagatgtcgcgcccgatcacgaagatggccgtccacacgggaagctcgcccgtgaggatgagccccagcacgcccgtgaagagcagcacgcggtccatcaccgggtccatgatcttgccgagccagctcacggtctgcgtgcggcgcgcgacctgtccgtccaggaagtccgtcacggcggcgatcacgtaaaaggtaagcgccaggtaacggttgatgtcgttcacgaacatatagaggaagatggccgtcaggacaaagcgacagagcgttatcacgttggcgatggtgaagatcttgtgcgaggggttgttcgatgttccgaccggggccgtggtgccgtgctcctgggcaagggcggcgtcgcgtccaacctggttctttatggaagtctcaaacttttcgcgcttggtgcccaaggggtcgtctcctaagtacggatttaacgttgctatggtaacccatcggatgcggcattcacaaacttgctcaagatttggcgccggcgcgacaatgcttgaaggacggtgcgtgcgcggaaggcgcccttaggaggtattgatgcgatacgaggttggcatcggcaaccgtacggagcggttcgagctcccgcaggaagacgtaatagaggtcatgcacgcgaaccccgcgagctttgcggccacgggcgagaaggtcgtgcgcgactcgatcgagcaccccatcgggacggcgcgcctgcgcgagctggtgcacgcgggccagagcgtctgcgtcatcacgagtgacgtgacacggccactccccacggcgacggtgctcccgcccgtgatggacgagctccacgcggctggcgtgcgcgatgaggacgtgcttctggccatcgcgctcggcagccaccgcccgcagacggatgacgagctcaggaccatcatgggcccctactacgggcgcctgcgcgtgctgaacggcgactccaagggcctcaagcactttggctacacctcgcacgggacgccggtcgacgtgctgcaggaggtcgcggcggcagacgtccgcgtgagcctgggcaacgttgagtaccactactttgcgggctactccggcggcgccaaggccatcatgcccggctgctccaccttccaagcgatccaggcaaaccactcgctcatggtcgaccccgcggcgcactccggcaacatggagagccccgtccgcctcgaccttgaggaggcctgcggcatggtgggcctcgacttcatagtgaacgtggtccttgatgaggagaagaacgtggtctacagtgccgcgggcgactttgtggctgctcagcgcgacgcctgccgcaggctggacgctctgtacggctgcgagctgcgcgagtatgcggacgtcgtcgtggtgagccagggcggcgcgcccaaggacctcaacctctaccagctgcagaaggcgctcgacaacgcgaagcaccccgtgcgcgagggtggcaccatcgtgctggtgggctcctgcgcagagggcctggggcaggagacgttcgcgagctggatgcacgaggcctcgtgtccgcaggacgttgtcgaccacctgcgccgcgacttcaggctcggcggccacaaggcggcggccatcgcgcagatcgagctgaggaacgacatctacctcgtgtccgacatacgtcccgaggtggtcctcgactgcttcatgacgcccttctcgtccgtgcaggatgccgtggacgcggccatggacgcgcagcgcaagagattggggcgcgagccgcgcatgctcatcatgccccacggcgggtcaacgctccccctcatgcgggtcgagggcgacgggcgctaacgtctgtcagggtcctgagctggccaaacggaccaatttcgaaattggtcaaaaatcttcttgcctcggttcgcggcaaatgatattgtattcaaccgcaggcgggcgagagtccgatgcaacgggtggtggcgcagcttggtagcgcacttgactgggggtcaaggggtcgctggttcgaatccagtccacccgaccagaaacttagaggccagacgggtttcccgcctggcctttttcgtgtgcagaggtgcctcgaccccacggtgctcccgcgttcatcactcccctacccactgtgccgcctgccgggcgcgccttgactctcgcgtcgcggaaccccctataaaggttgaatgggccgcgtgccgtgcggccataccggaggggatgccccatggcgctcacgaacgtgcaacctcagataccgctgtcgcttcccgcgcacatcggggcgcgcatggcgccaaaccgcttctgggcgcagccgatggagtgcaacgacgcggacgatgacggcgtctttaccgacgtgacgctcgagcgataccgccggctcctggagggcggctttggcgttgtcgaggtcgaggcggtgaccctccagcgccagagccgggcgcgcaggacgcagctcgcgctcgacgtggacgacccccgcagccgcagggcgtgggagcgcttcctcgcgtggaagcgggacaactatccccagcagctcctcgtggtccagctgcatcacagtggcgagctgagcgacccctcgttctcgcgtcgcgtgtgcgtgaagcagcgtccggggtatggcggagaccttatagacgagaagtacatagatgccgagatagaccgctgcgttcgcgcggcaaacttcctctggcgcgccggggccgacggcgtggacctcaagttctgccacggctacctgtggtcgcaggtgttccgtccctacaacgaccgagcctggcgctacggcggctcccttgcggcccgctcgcgcgcccttctggagctgtgcgagcgcgtgcgccacgcgacgccggacgacggcttcctcgttggcgccaagctgagcgtgtgggacgagtttcctggtggcgtgggccacgacgggccgaacagccccatcatcgacccgagggagaccatcaggctggctcagggcctggaggcgcgcggcgcgagctggttcctggagacccttggggactgcggttgcggatggggcctcatgtgccccgaccactacaccgccggcacggtgatgcagcacatcacggcggcgcgcacgcttcgcgacaggctcgccccgcagacgaccgtcatctgcggcgggctgagcgccctgagggacggccgcagcaacgggctctcgggcgtctcgcccgaagaggcgtcgctctttgccatgggcaacgcgcgcatatctgcgggcgacttcaacatggtcgccctgggccggcagtcgcttgcggacccggatacgccccgcaagtacctggagggcgaggtggagaagatcaggtggtgcacctgctgcaaccactgcggtgcgctcgagggcggccaggcgcacgtgggctgcgccacctacgacggcacctacgcaaaggcgtacgcgcagctctcgcaccgccacctgccctgcgacgcgtagcggactccaatcggggcagatgcctgctaggggctagaggttcttctcgccccagtccttgagctccatgagaatgggtacgagcgtgcgcgcgcggtccgtcaggctgtactccacgcggacgggcatctcggcgtactgggtgcgcatgacgaggccgtcggcctcgagctccttgagggaagacgcaagcatcgtgttggtgatgccgtagacgagcttgcgcagctcgccgtagcggagctcgtccgtctgcgacagcgcgacgatcagcagaatcttccacttgcctcccacggcgtcgagcaccctgcgcagcgcgcagcccgagcccgtgacagaggggtctgcgctcgacaggcagggcgacatagtttctccacgtgcgtttgtgctggtagacgccatggtcagattttccttaccacgtcaaacgaaactgcgtacttgctcagaaaaatgtaccacataagctagttcgtgaaccaagggagcgcgccaaggtgacgcgcggacgaaaggagaacgacatggagtacaagttcaccgctcagaacttcgaggacgaggtcgagaagagcgaccttcccgtcatgatcgacttctacgctgactggtgcggcccgtgccgcgcgatgggccccgtcgtggagaagcttgcggagaagtacgacggcaaggtgaaggtcggcaaggtcaactcggacgaggagcccgcgctcgcgcaggccttccaggtcatgagcatcccggcgttcttcttcatcaaggacggtaaggtcgtcgacaccgcgatcggcggcatgcccgcggccgccctcgaggcacacgtcaagaacctcctctaggcatgagggaacttcttgagggcgagggcgtcggcgaggctgtctcgtcggcgccccttgtcgttgtggagtacgggtcctccgcgtgcgcaccgtgcgcggccctgcacgggaggatcgagcggtgggagcgggagcatccgggcgtgctcgcgctctacgtcccgctggagcggcacatggaggaggcggcccaggccggcatcatgggcagcccaaccgtcgaggtgtgggcgcatggcaagctggcactgcgggagtccggctacttcagcctcgacctgcttcttgcgcgcgccgagcgctggcttggctgatgcggcggtcgcatgccgtgatgagcgccgtcatgagggcgagaagggccgcctccacgactggcatcagcagcggtgacacgcgctctatgatggcgcccatgaggggcggggcgaccatcgagcccacgtaggcacaggccatctggagccccatgagcgactgcgcgttccggctgccaaagcggcttggcgtgagctggatcatctggggatagatgggcgcacagcccaggcccagcagcgtgagccccgcgcccaggacgacggtcgagcgtcccaggagcagcacagcgatgccgagggccatggtcgcctcccctacgcgcaggagctgctggccgtcgagcctgagcgtgagcacgccggagagcagcctcccaaccgtgatgccgccatagaagagcgagaccagaagcgcggccgtctgggtggggacgccatgccccatcacgaggaacgtggacgaccagaggccgcacgtcgactcgatggagcagtagcacaaaaacccgagcatcgcctggatgacgcctgggcgccgcgcgagctgcagcttggagggacgttcttctcccccggcttccgcgtggctttcgtctgtgtgtgtgccgcggcgctcgtgccagaggggcaggctcacgaggatggccgccgtgagcgcgacctggatgagccccacgacgcggtagccgccctgccagccggcgggcgtcgccatctgccacgacatgaccatcggccccaccgcggcgccgatgccccagcaggagtgcagccagttcatgtggcgtggcgcaaagtgcgtggccacgtacgcgttgagggaggcgtccacggctcccgcgcccaggccgtacgggacggcccagaggacgagctgccaaaaggaccctgacgcggagaagccgaagagcgcgatggccgtgagccccacggagcacgcggtgaggccgccggcgcccaggcgcctgaccagccggtccgtcatgaggctcgacacgatggtccccaggcagatcacgagtgatatcgttcccgcagctgacaccgcggcgcccaggctcgcgtgcatggtgggccacgcggagcccagcaggccgtccagcaggccgaggctcacgaacgcgaggtagatgataacgaggagaagcgccgtcatgccctagattccctgttcctggcgctcgcggcggatcatcttgcggatctgcgcgaggctccactcgttcttttgctcgtcagtggcgagctcgaggccgtagcgaatcggcgtgggccgctcgtcggcgtccacatgcacctccgtgaggtaggccacgttgatctgcttgcgctcgccggtctggatgtcctccacgtaggagtccacgcgcacctcgagcgaggtcctgcccacgtacgtgacgtaggcgtccacgatcacgacctcgttgaggtaggccgggttctggaataccaggctgtcaacgcacgccgtcgtgacggagccgccgcagtgcctgcgcgacgcgatgcccgccgcctcgtctatccactccatcagcctgccgccaaacaggcggttctcgccgttcatgtccccgtggacgaccgtgtgcgtggtctccgtgcgggactggtccacggtcttgaggggcctcgtgtcgcttggcgtgccgatggacctcttgagctggtcaaggtccttgtctgtcatgtcaacccttccgcgggagaaggcctcccgtctgctagtgttagtgcaaacatagcagatgggaggccaggtgtggaagacgggttcttcttgcgtgcatatgacgtggtgaggcaggtgccggccgggcgcgtggcaacgtacggccaggtggccgccgccatgggcgagccccgcaaggcgcgctacgttggctttgccttgcactcgagcccgggggtggcaggcggcgtgccctgccaccgcatcgtcttcgcagatgggtcgcttgcgccaggcttcgcgtttggcggccccggcgagcagcgtcgcatgctcgaggccgagggggtcgggtttctccccaacggcaaggtcgacatgcggcgctacaagtgggaggcgctgtaggcggggcaggcgtccgcgcggctacacgttcttggtggccacgacgtccacgcccgtgccgcagacgtctgccaggaccacgtcgccaatgtggacgggtgccgtggtgcggacgcccgcgagtgcgcggacgacgtcgagcaccttggacttggggacgtccgcggcggtcttgacggacaccatgcgggcgacgggcgagccctccacgggcaccaccgtcgtgacggtgcgcgtggggttggtgacctccttgcgggcgtactcgtcgccgcggcggcagccgttgcccgtgacggagacgacctccgtcccctcgagctcgacggttatctggcagcccttggggcagcgtatgcaggtgaggtgttgcgtggacatggctactcctcctccagaagcaggcggatctcgtcggcaggggcgatgcccgcgagttcctcgcgcctgagcgtgagctcctgcatctcgccgggggccaggatttgcttgcgacggtgctgcacgcggcggtcgcccacgtagagcgaaacgtagcggttctggtagacggcccccaccctgaagcgcagggtgatcttctcgtccatgttggcgggcgagacaaacgcgggcacgctgtagcggatgcctccggcgaccctgaccggcacgaggtcggaggccccgcggccggcgccctcggccagctggcgcacgtagcgggcggccgaggccccggcgtgggcggactcctcgctcacgtagtcaaccaggtcgtgcacgtggagcacgttgccgcacgcgaagacgcccggcacgctcgtcatgagcgagtcgtccacaaaggcgccgcgcgtgatcgggttgatgcgcacgcccgcctggcggctgagctcgttttccggaagcaggcccacggagagcagcagcgtgtcgcaggggtagcggacctccgtcccggggatgggcttgaggtgctcgtccacctgggcgatggtgacggcctccacgcgcttggttccctccacgttcacgacggtgtgcgagagcagaagcggtatgccaaagtcatccaggcactgcacgatgttgcgcttgaggccaccggagtacggcatgagctccgccacgcaggccacgtgcgcgccctcgagcgtgaggcggcgcgccatgatgaggccgatgtcgccggagccgaggatgaccacctcgcggccgggcatgaggccgtcgatgttgacgaggcgctgcgcggtgccggccgtgtagacgccggcggggcgcgtgccgcagatgtcgagcgcgccgcgcgggcactcgcggcagcccatcgcgaggacgacggccttggcgcggatgcggaagacgccgcgctcggcgctcacggccgtgaccgtgaggtcgtccgctatgtcgagcaccgtggtgcggagcatgtgctcgatctggcgctcgcgcgcctggctgatgtagcgcgcggcgtactccggccccgtgagctcctccttgaaggcgtggaggccaaagccgttgtggatgcactggttgaggatgccgcccagctggggctcgcgctccagcacgaggacggactcgcagcccgcgtcgcgcgcggatatggcggccgcgagtcccgcggagccgccgcccacgaccacgatgtcgcgctcgagcgtctggatggttgctgtgctaggcattgcgctcacccccgcgggagtcgtccttctcgtccgaggcggtggcgaggccctgcttgtccggacccacgaccatgcgagagccgggcccgctcttggtcacgtgcgcgaggtcgatgctggcgacctcctcggatatgatctccatgatgcgcggcgtgcagaagcccgcctggcagcgccccatgcaggcgcccgtgcggtgcttgacgccgtcgagcgagcgggcgcccggcacgcggcggcaggcgtcgcggatctgcgcctcgctcacgcggcagcagcggcagacgatggtgccgtaggccgggtcctcctggatgagccgctgccagtcctcggggtcgatgtcgcgcaggttggggatgccgcggcgcgtggggacaaagccctcgttgggcgagaggcccaggatgccgttgacgatgcgcgcgaccatgcgcccgatggccgggctcgcgctgaggccggggctctcgatgccggcgcagtccacgaagccgggggcgtcctcgacctcgccgatgatgaactcctggccgggctggtgcgcgcgcaggccgctgaacgaggtgatggtctccctgaaggggatgtcgcgcaccgtgagggcggatttgcggcgcacctcggccaggccgtctggcgtggtctgggtgccggacttgtccgggatgtcctcggccgtggggccgaccagaaggttgccgtggatcgtgggcgtcacgagcacgcccttgcccatcttggtggggagcatgaacaccgtgtggcgtacgtggtcgccggccgtggtgtcaagcagctcgtactggccgcggcggggcgtgatggatatcctgcttgcgctcaccatgttgtggagctcgtcggcgtgcacgccggcggcgttcaccaccacgtgcgagaggaacgtgcccttgggggtcgtgacctcccacagggccggctccccatcgcgcttgcggcgcctggcgcccgtgaccggtgcgtcgaagcggaactcgacgccgtttgcggcggcgttctccgccagggcgtccgtcagctcgaacgggtcgcagatgcccgccgtgggcgcccagagcgccgccaccgcggcgtcggatatgttgggctccatgcggacgagctcttctcgcccaactatgcgcaggtcatgcacgccgttggcgtgcccgcgctcgagcagcgcctgcagcgcgggcaggtcggcctcgttggtgcacaccacgagcgagccgatctgcctgaagccaaactcgagctcgcgcgagagctctgggaagagcgacgtgccctccacgttgagcctcgccatgagcgtgcctgtctgggcgtcgaagcccgcgtgcacgatcgccgagttcgccttggaggtgccggagcacacgtcgtcctccgcctccagcacaaggaagcgcccgtcgagccgcgagaactcgcgggctatggagcacccgctcacgcccgcgcccacgacgagcgcgtcatacaccgtttctgccatgtccttccctccccgcaagggtccgtcgcacgtgcggccggaaccatcgtatgccctgcgggtatgaaaggcgcgccctctcgtctagtgggcgaactggctctggtagaggtcgctgtagaagccgccggctgccaggagctcgtcgtgcgtgcccgtctcgacgatgcggccgtcgcgcatgaccacgatgcagtccgcgttgcgcacggtcgagaggcggtgcgcaaccacgagcgaggtgcggccctccatgatgcggtcgaaggcgtcctgcacctggagctccgtgcgcgtgtcgatggagctcgtggcctcgtccagaaggagcaccaccgggtcgcacatcatgacgcgggcgatgcacaagagctgccgctggccctggctcagggcgccgccgccctcccccaccttggtctggtagccctgggggagctgcatgatgaacttgtgcgcgtgggcgcgcttggcggcgtcgattacctcgtcgtccgtggcgtcgggacggccgtaggcgatgttgtcacgcacggtgccctcgaagagccacgtctcctgcagcaccatgccaaaggcggagcgcaggctctggcgcgtgagggtgcgcgtgtcccgcccgtccaggcggatggtgcccgagtcaacgtcgtagaagcgaagcagcaggttgatgagggtggtcttgccgcagccggtgggccccacgagggcgtagcgcttgcccgcggggaccttgaggcagatgtcctgcagcagcgggtggtccttcgtgtacgagaagcacacgtggtccagctcgaggctgcccctggggttggcgagcgccttcgcatcggaggggtcgggcttctcgtcctgcgcatcgaggagcgcgaggaggcggcgggcggaggcgaaggcggtctgcacctgcgtgaccacggccgagacctcgttgaacggcttcatgtactggttggcgtacgagaggaagctctgcacctggcccacggtcatgggcgagggccagcccgtcacgacgcagcagcagcccgccacggcgacagccgcgtacgtgaggttgttgacgaggcgcgtggaggggttggagagcgagctcacgaactgcgcgtgctcgcccttgacgtagaggcgctggttgacctcgacaaaggcggcgacctcggagtccgcgtgcgcgaaggcgctcacgagcttctggttgccgatgacctcctcggccaggcctccgagctcgccctggatggactgctgcgcgcggaacgactccgcggagcgcctggtgatgaggctcgccgccacgatggagagcggcgtgagcacgatcaccacgagcgcgacggggacggagatcgagaacatgaagacgatggtccccacgatggtgacgatgccgttgaagagctgcgtgaggccctgcaacagaccatcgcccacctggtccacgtcgttgatgacgcgcgagagcaggtcgccgtgggggtgcgagtccaggaaggaaagcggcaggctcttgaacttggcgtacgcgtcggtcctgaggtcgcgcgtcgtctcgtacgtgaggcggttggtgcagtagccctgcgcccactgcgcgacgcccgtgagcaccacgacgaccgcgagcctctgcagcacgggcacgagcgcggcaaagtcgaccttgccggcgcgcaccatgaggtcgatggcgttgccgatgaggatgggcacgtagagcgagaggagcacggcgacggccgcgcaggcaaatgccaggacgagaagggcgaggtacggcctggcgtaggccatgagcctcctgaggaccgtgcggacgtcgtagccgcccacgtcgaggccctggttggggtcggttcccgatccgcggttgccgcggacgttggcgatggtagcggcggcggacccgccggctgcgtaggggttggccattacgcgagcacctccttctcggaaagctgcgagaggcagatctcgcggtagaggttgcagtccttgaggagctcgcggtgcgtgccgaggccagccacgcacccgtggtcgagcacgaggatcttgtccgcgcccatgacggcgctcacgcgctgcgacaccacgacgctggtcgtcctgtccgcaatgcccgcgagcgcatggcgcagccgcgcgtccgtcgcgaagtcgagcgcggaggcggagtcgtccagcacgatgatgcgcgggctcccgacgagcgcacgcgcgatggtgaggcgctgccgctgcccgccgctgaagttgcggccgtcggcctccacgggctcgtcgaggccctggggcttggcgcgcacgaagtcctccgcctgggcgagctcgagcgcgcgccagagctccgcgtccgtggcggaggcgtcgcgccaggcgaggttggagcggatggtgcccgtgaggagcgaggcgagctgcggcacgacggagacggtgttccgcagctggtcgagcgggtactcgcgcacgtcgcgcccgagcacccgcaccgtgccggacgtggggtcgtacagcctgtcgagcagctgcacgagcgtggacttgcccgagcccgtgccgccgatgatgccgagggtctgtccctcctcgagggtgagcgtcacgtccgtgagtgcgctcgactcgccgccggcgtagctgaaggtcacgccctcgagctggagggcaggctcttctcccctggcgggaagcgcgagttcggcgtcgctgccgtccgtgagggcgtcaggggtgttcagcacctccatgatgcgctggctcgatgcggcgccgcgcgtgaagaccaccacgaggttggccacgtagcccacggccaagagcgtctgcgtcatgtagttgacgaaggccatgacctcgccctgcgtgaggtcgcccacgttgatgcggatggcgccgctccacaggatcgcgacgacgccgaggttgagcacgaggaacgtcgcggggttgaggagcgacgtgagcttgccggcggagatcgccgtctgggcctgggcgcgagctgcctcgccaaagcgggtctgctcgtcgtcctcgtggcggaaggcgcggatcacgcgcatgccggagagcgtctcgcgcgcgaggagcgacacgcggtcgagcctgacctgcatctgcctgaagtacggcacggcgtggctcatcacgaaccagaacgccaggccgatgagcggcgtgcacagcaggaagatgcagccgaggcgcaggtcgatgaggcaggcggccaccatggagccaactgccaagaacggccaacggatgagctggcggatgcccagggcaacggcaagctgcacctggttgacgtcgttggtgaggcgcgtcgtgagcgagggcgtgccaaagcggtccacgtcggcggcggagaggcccatcaccttgcggaacagggcgtttcgcacgtccgtgcccatgccctgcgacacgagtgccgccatcttctggcacaccagcgtaaagcagtagcccacgcaggcgagaaggacgaggagtccgcccaggcgcacgaccaggcccgcgtcgtgcccggcgacgccgcggtcgatcatgcgcgccacgatgacgggggtcatcaggtcgaatatcacctcgaccaccttggccgacatgcccagcgccacgcgcccccggtacgggcgcatgaagcgagaaagaagctcgtgcaagaccgaaaacctcctgtggacgagtgcctagtctatccccagcttgtccgagagctcgatccactcggtctcgagctcgtcgagctccgcctccgctgcgtccacgtccttctgggcgtccatgagcccctggtagtccgatgcgtcgatctgggccatcttcgcgcggagccggtccggctcgccctgcttcttctggagcttgcgcgatacggcgtcgaagcgcttcttgagctcgcggcgctcggcgttggtgagcccgccgggctgggtggcctgcttggcagtgccgtcgcctacggtagcgccaccagtgccacctgtcgaattctggttttgtatgctggcattcaacaagcttaggtactcgtccacgccgcccggcacgtggcgcaggtgtccgccgatcagggcgtactggtcgtccgtcacgcgctccatgaggtagcggtcgtggctcaccaggatgagcgtgcctggccacgtgtcgagcaagtcctcgaggacggccagcatgtcggtgtccaggtcgtttccgggctcgtccaggatgaggacgttcggttcgcggagaaggacgcagagtatcgacaggcgccgcctctggccgccggacaggtccttgatgaacgtggggaactcgcggcgctcgaagccgagcctctcgagcagctgttccggtgtctggggcttgccgtccacctcgtagtacttcttgaacgtggagaggagctcctgcacgcgccagtcgtccttctcggccagctggtcgaggtgctgggacagtatgccaaagcgcacggacttgccgatcttcacgaagcctgagctgggcagcatgcgcccgctcatgaccttgagcagcgtcgacttgccggcgccgttctcgcccaggatgcccacgcggtcgcccggcccgatgagccagtcgatcccgtcgagcaccttgcgatcgccgtagccggcgctcacgttcttcatctcgatgacctgcttgcccaggcggctcacggcaaggcgcttgagctcggtcgtgttcctgaggggcgggtcgttggccaaaagggccatcgccgcgtcaatcctgaactttggcttgctcgtgcgcgccttggcgccgtgcgcgagccagttgagctccttgcgcagcgtgttctggcggcgctcctctgtgacggccgcctggcgctggcgctcgacgcgctgctggatgtaggcggagtagccgccctcgaatggctcgatcactccgtcgtggacctcccacatgtgctcgcacacctcgtccaagaaccagcggtcgtgcgtcacgacgagaagcgcgccctgcccgggctgccagcggtgcttgaggtggttggcgagccacgtgatggcgcccatgtccaggtggttggtgggctcgtccatcagaatcacgtcccacgtgcccacgagcacgcgtgcgaggtcgcagcgccggcgctgcccgccggagagctcccccaccttggcgtgccagtcgacgtcgcccagcagctcgtccaggatggagcggacgcgcggatcggacgcccacacgtactccggcacgtcgcccacgacggcgcgctccacggtgtcgtcgtcgttcagcgagtcctcctgcgcgagcatgcccacggcgatgccgttgcggtaggtaacggagccgtcgtccggctcgatgcgcctggcgatcagctcgagcagcgtcgacttgccgtcgccgttcttgcccacgatgccgatgcgctcgccctcgttgatgccgatggtctggtccttcagcacctgcttgccgggccactcctggctcaggtgctcgcatccgatgaggattcccaaagctatgcctccacgcttgccgcgatgccacgcagcaggctgatctccttcttgtatcccgccaggtcgttgggcgtctccaggatcatggggagcgtgcgcgtcctggggttggtcaccacggcgcgaaacgcgtccagtcccagcgtgccctcgccgatcttctcgtggcggtccttgtgcgacccgcaagggttcttcgagtcgtttacgtgcagcgccttgaggcggtcgagcccgatcacgcgatcgaactcgtccagcacgccgtcgaggtcgccggccacgtcgtagcccgcgtcgttcacgtggcaggtgtcgaggcagacgcccatgtacgagtcgagccgcacgccatcgaggatgcgtgccagctcctcgaagctccgtccgacctccgtgcccttgccggccatggtctcgagcagcaccgtcgtgtgctgcccctcgaagagcgcctggttgagcccctcgcagatgagctcgatcccgcggtcgaccccctgcttcacgtggctgcccgggtggaagttgtagtagttgcccggcagctcctccatgcgcctgaggtcgtccgccatggccgtgcgggcaaactcgacggttcgctccgtggaggagcagaggttcatggtgtagggggcgtgcgccacaagagggccaaagtccttctcgcccataatgcgcctgagctccgccacgtcgtccgggtcgagcggcttggcgttgccaccgcgcgggttgcgcgtgaagaacgcgaaggtgttcgcgccgatctccacggcacgccggcccatggcggcgtagccgtccgacgtggagaggtggcagccgatgcagatgtccgccatgctacgtccccgcttccaggagcgcgccgacgcggtccagcagctcggacgccacggacgcgagcggcagcgtgtccagctgctccacgtggtccgcgtacacgaaggcgacgcggtccgtgtcggagccaaacgtcgagtccgcccggctcacgtcgttggccacgatcatgtcgcagcccttgcgcgcgagcttggcctgggcgtttgccatgaggtcgtgcgtctcggcggcaaagcccaccaccttgcgcgcgcccttggcggccgagagctccgccaggatgtccgcggtctccacgagcctgatgctgtccaggtgctcgtgggccttcttgagcttgtggtcggcgggctcggcgggcgtgtagtcggccacggccgcggcgcatatggccacgtccgcatcgtagaaggacgagagcgccgcgtcgtgcatctgccatgcgctcacgacgtcgacgcggtcgacgcccgcgggcgtagggagctcgcagggtcccgcgacgagcgtcaccctggcgccgcggcgagccgcctcgcgggcgatcgcgaagcccatcttgcccgtggaggcgttcgcgatgtagcgcacggggtcgatcgcctcgtgcgtggggccggccgtcacgagcacgtgcttgccggtgagggggctcccctcagtggcgaggcccaggagcgcgagcgcgcgggacacgatgtcctccacgctcgcgagcttgccctcgcccacgtagccgcaggcgagctctccgctatcaggcatcacgaactcgacgccgcgcgacaggagcgtcctcacgttctgctgggtggccgggtttctccacatgttgacgttcatggcgggggccacgagcaccgtggagtgggccgccaggagcgtggtgctcgccgcgtcgtccgcgatgccgagcgccatcttcgcgacgaagttgcccgtcgcgggcaccacgagcacgaggtccgcaaagtccgcgagctcgatgtgggggatgtcggtcgaggcgttgccgtagagcgaggtcacgacctcgtggtgcgtgagcgcgcggaacgtcgcctcgcccacgaagcgcgtcgcgtcctccgtcatggtcacgcggacgtcgcagcccgccttctgcagcccgcgaaggacctcgcaggccttgtacgcagcgatgccgccgttcacgacaagggtgacgttgggcatcagtcggcaacctcctgcgtcacgagcaggcggtggcagtacgggcactccgtgatggcgtcggccttcttgaggtcgctaaagaggctcggctgcagcttgacgcggcagatcgagggcacgttgccctgcaggcgctccaccgcgaggccgccaaagcgcttgaacgcggcgtcgtagcgcctgatcgtgtcgtcgtccagcgcggcgagcatctgctttcgctcctcgttcaggctcctggcgcgcgccatgaggtcggccgtgtcgcgcttgaaggcctcctcctgggcggcgcgctcctcgtcgagcttggcctccaggccgcgggcgttggactcggccttgcccaggcgcttgagggcctcgaccttctggccgtgctcgaacccgatcttctccatcttcttggcaaggtgggtgagctgggcctcgatgttggaggcctggcggtagtcggcgtccggcgcctgcgccgtggccctgacctcgtccgtcttctgcatcaggtgctcgtgctcctgctcgcagtccgcaatctccatctcggtgtccttgcgctggcccacgatcttcgtgagctcgccggcgaccttgtgctttgccgcgtcgatggcggcgatcttcttctgctgcggcatggccttgagcgtcttgctcaggcgcatgagctcaaggtcgatgtcctgaaggcgaagcagtgcctcgtagtcgttcatgtctacctccggccgaattcccacggccaatattcctatgtgcgcccgtactgccgggcgccgccgtctagcgtccgccggacgccacgatttccagaagcgcgtcggcaaaggcgtcgaggtccttctcgcccacgcgctcgtcgaacgatatcctgagcgagcccagagcgtcccggcgcgcgatgcccatggccgagagcacgtggctggggtcgagcgagcccgaggagcatgccgagccggcggagacctcgaagccgcgcgcgtcgagcttgaggatgagcgtctcggagtcgagggtcggcaccatgaccgacaccatgcccggaagcctgtcctcccccacgctcgcgctcacggtcgggaggatccccgtgccctcggcgcagagcctggcgtacagcgcgttggccctgccctggacgagcgccctcagtcgcgggaggtcgtcgcagcagtggcgcaccgctgccgcgaaggcgagcgccgcgcggacgtcctgcgtgccggggcgcctgccctgctcctggccgccgccaaaggtctgcggcctgaagggcgtacgcccgcggatgagaagggcgccgatgccgaccgggccgccgatcttgtgcgcggcgacgctcacggcgtcgacgttgacgcagtcgagcgggatgcgcccgaaggcctgcacggcgtccgtgtgcatgagggcgccggcggcgtgcgccacggcaccgatcttccccacgggctggacgacgcccgtctcgttgttggcgctcatgacggacaccagcgcgacgtcgggacccatgagggactcgacggcctccgccgtgacgacgccgtcgcggttggggcgggcgaggtcgacgtcgaagccgcggttgcggagcgccggcaccacgtcgagctcggagtcgtgctcgatggcggacacgatgacgcgcgtcctggcgcggtcgcggtcgcgcgcgccctcggccagcccgtagagggcgaggttgttggactccgtgccgcccgacgtgtacgccacgtcagccggcctgaagccgccgccaacggcctttgcgatcacgcggcgggtggactcgagcttggcagaggccatgcgccccagcgtgtgcagcgagttggggttggcgccggcgatctgggacgcctcgtagtctcgctcggcggcgagcgcctcctcgcacatgggtgcggatgccgcgtagtccaggtacacgaacctatcgctcatattctcgcgcatccccctatgccctcttcgcggtgccgagcgtcgcgttggtgcgaagcgcctcgatcgcggcggagcggtcctccgccttgaacaccttgctgcccgcgacgaagacgttcgcgccggccgccgccacctcggccacgttgtcgggtccgatgccgccgtcgacctcgacgtcggggctcacgccgtgctcgtggcacagcttgcggagcgacctgagcttggcaagcgaggacgggatgaagctctgtccgccaaagcccgggttcaccgtcatgaccaggaccatgtccaggtcctcgatgatgctgtcgagaagggcgaccggtgtggccgggttgagcgccacgcatgccttggcgcctgcctcgtgaatctgcgagacgatgcggttggcgtgcgtctgagcctcgtagtggaacgtcacgatgtccgcgccggcgtccaggtaccagggcacctgctcctcggggttgctcaccatgaggtggacgtcgaggggaaggtccgtcgcccttctcacctggcgcaggatctccgtgccaaagctcaggttggggacgaagtgcccgtccatcacgtcgtagtggacgaggtccgcgctcttgatgctctgcagctcgtcgccgagccgcgtgaagtcggccgagaggaccgacggtgctatgaggatgctcttgtctggcatgatgcccttccctcgttactcgacgccgtcgagcccgtagaactcgacgtgggggtccctgtcgagcaggagcccgatgacgtcgtccagtttccttccttcgtacaggatcgcgtgaaccgcgtccgtgagcggggactcgatgccgcgctcgtgagcgagctcccacgtgctgagtgcggcgcgggcgccctccaccaccatgccggtggcggactcgtactcctcgagcgtcgtgccctttgcgtacgcctcgccaaacgtgcggttgcgcgagtggcgcgaggtgcacgttgccacgaggtcgcccatgccggccaggcccatgcaggtgaggggccgtccgcccatggcgttggcgatgcggctgatctcggccaggccgcgcgtcatgagcacggcgagggcgttgtcgcccaggccgagccccgcggagacgccacaggcgatggcgacgacgttcttgacggccgcgcacacctccacgcccacgaggtcgtccgagcggtacacgcggaacgcctgcgagacgaaggcctgctggaagtacgagacgacgtcctcgcggctgcccgcgaccacggcggcgctcagcatgccgcggctgatctcctccgcgtggttggggccggacagggccgccacgcgctcgggctctccgaggacgtctgccgcgacgtccgccatgaggaggtgcgtcttgggctcgatgcccttcgtgagcacgacgatcgggaggtccttcggcacgcttggcgccagctcctcgcagatgccgcggaggaagctcgagggggtggccaggaccatagactcggcgccatcgagcacctgcgcaaaatcgtggctcgcgctgacgttgccaggcaggacgtagtccttgagctgacgggggttgcgatggtcggagttgatggaatccgccacgcggggcgagtgcgcccagatgcgcacctcgtccgcgtggggcgagaggagcccgctggccgcggttccccacgagcccgagccgatgaccgcgatctttcctgccatgctacttgcggcccccttcgctcccctgcttgtgcaccgtgaacttgcgctccgtcccgttggcgagcttcacgatgttcttcctgtgcgcgaaggcgaccaccaccgtcacgacgaggattgggatgagcctgacgccacggattcccagcgcgaacgagatgattggcagcgcgatgtccgcggagaccgacccgagcgagacgtagtgcgagggaatcacgaggaccaggaacacgagcagcatgaggagtgcgacgggccagtacaggccgagcgcggcgccaaagcccacgctgatgcccttgccgccgtggaagcccaggtacggcgagtacacgtgcccgagcacgcagctcatgtacaggagcgtggccacccagccgtacgacccgagcgggctcgtggccccaaagtctccaccgaacgccacgttggcgacgaccagcctgcacagcagcatggccacgaggcccttgcccgcgtcgcacaggaacgtgagcgccgccgcgcccgcacccgcggatcgtgcgacgttcgtcatcccgatgttgccggacccgacggttcgcacgtccacgtgctccttggagtgcttggcgatgatgaggccggaggggatcccgcagacgagaaaagcggcaagcatgcacgcgatagttgaaatggcgatgaccgacattgcctagacgtccttcctcctgaacctgagcctcacgggggtgccctcgaggtcgaaggtctccctcaggcggttctcgaggaaccgctcgtagttgtcgtccacgaggtcgggggcgttgcagaagaaggtgaagacgggtggctccgagccggtctgcgtgccgtagtggaccttgagcctgcggttcttgtacgtgacggtgtggccgctctcgcggatggccgtcacgagcctgttcagctcggacgtcttgacctggcgacggtggttctgggccgccttgacggcggccgcgagcgccttgtccgtcgcgcggcccgtgagcgcggacacgttgacgctgggcgcccagcggcagaacgtcatgcgctggtccaggctctggaccacggcgtcgcgcttctcgtccgtgtcgatgaggtcccacttgttgaggacgatcacgagggcgcagccgcggtcgatggccatgcccgcgagcttctggtcctgctccgtcacgccgacgctcgcgtcgaccacgagcaggcagacgtcggccttgtccatggcctggaggcccctcacgaggctgtagtactccacgtcctcgtggacctgggtcttcttgcgcatgcctgccgtgtcgaccaggcggatgcggttgcccttccagtcgatgtggatgtcgacggcgtcgcgggtggtgccggcgatgtcgctcacgatggagcggttgcgcttggcgaggcggttcgtgagcgaggacttgcccacgttgggcctgccgatgatggccacgttcaggacgccctcgtccctctcctccggctcgtcgtcatcctcgggcgggagcgcggcgaccacgtcgtccaaaaggtctcccgtgccgtggccgtggccggcggatatgccgcgcggctcgccgacgccgagagagtagtagtcccaggcgttcaggtcctggttggggtcgtcgagcttgttgacgcagaggaacacgggcttgccggagcggcggaccacgcgcgcgacctcctcgtcctcgtccgtgacgcccacggtgccgtcgaccacgaacacgatgacgtcggcctcgtcgcacgcggcgagcgcctgctcgcggatgcggggcgcgaagacgtccttgctcttgatggactcgatgccgcccgtgtcgatgagcgtgaactcgcgaccgttccagtcgcagtcgtggtacgagcggtcgcgcgtgacgccgcgagactcgtgtacgatggcgtcacgattgacggccaggcggttgaccagcgtggacttgcccacgttgggcctgccgacaacggcgacgattggcttagacatatcactccttgctgttggtgcactgttatgcccagtctaccattcgcgcggcggggctattctgttgggaacgtcccacaccaactgtgcggaaccgtggcgcatggcgcaccgcgtacgggcgagaagggcgctacgccatggtcgcgccggaaagctcgcggatgcgggcgcacacctcgtctatctgctcctgcggggtcgaggcaccggccgtgacgccgatggtgtccgcgccgtcgaaccagcctgcctcgagctcgtcagcctgctccacgtggtgcgtctgcgagcaggatgccgagcagatcttggcgaggcgccttgtgttggcggacatgcgcccgccgatcacgaccatgacgtcggattttgccgcgagctccgccgcggcggcctggcgtgctgaggtggcctcgcagatggtgtcgattacgcggacctcatccgtcctgccgatgaggtttgatactagctccctcaggcgcgcgcgggactgcgtggtctgcaccacgacgcccaccttgtgcgcgagcctgaggccgagcacgtcctcgggcgcctgcacgacggtggcgccgggcgcgtggcccaaggtgcccgtgacctcgggatggccctcctcgccaaagacgaggacctggtagccctcgcgtgtgaggcgctccgcggcctggtgcgcgcggatgacgaaggggcaggtggcgtcgagcaccgtgtccgcgctggcgcgggcgcgctcctcctcctcgggggtgacgccgtgcgtgcgcaggacgagcgtgccgccctcgaactggtcgggctcctccgccacggtgacgccggacttggccagcgactccacgacggtcgggttgtggatgagcgggccgagcgtgtgaatgggtccgtctgccttggcggcggcctctcgcacgaggtcgagcgcacggttcacgccatagcaggcgcccgcctcgcgggccacgacgatggtcggcgtgttcttctcccccacggggtcctcctgactcttctgctcctacttcttgttgggatgctcctggcggagttcgtcgcgcagggcgtacacgcgctccatggcgacctcctccatgcgctgggcctgctgcttcctgcccttgacgccaaggtccgagaactcgatgcagtctccggccttgcagaacacgcggccgaagcgcttccagtgcgtgcccctgggcgtgatgtcgcgcgcgcccacgatggccatgggctgcacgggggccttggccatctgcgccatgagcgagaagccgccatgaatggtgaccggctggtcgtcactcttgatgcgggtgccctccgggaagatgagcacgacctcgccgcgtttgagcgcggcctgcgcgcgacggaccgccttgaggtcggccgtgccgcgcttgatggggatggttcccgcgcgcgagaagacccacgacacgaacgtgttggtgtagaactcgctcttggcgatggcgcggacgcgcttgccgtggtagtagagcgagcagatgacgatgacggggtcgagcatcgacgtgtggttcatgaccaccacgcggccgcggtcgtcatcccagagcttgcgggcatcctcgatcttccacggccacagcaccttggtgacgaaggtgacgatggccgcagcaaccgcgtagagggcgcgcgccggaagcgggaactcgcgcatgccgtggtcgtagtagtcgtcaaacgtgttgccggcaaacgcgcgcatcttgccgggcttgttcttctcgcccgttgcgcccttgggagcaggcttcttagctggggccgcctcctgcgccttggcggccgcgggagcctccggctctgccgggacgggcgcctgggactttgagcgggcctcgtccatgaggtccacgatcttctggaccacctcgtcgggcgcgaggccggagttatcgatcaggtgcgcgtccgcggcgggcttcagcggggactccttgcgcgaggagtcgagcttgtcgcggcgcaccaggtcgcgcaggatctgttgctcctcggccgcgtcagccttggcgctcgcgtcctggccggcgtccccgccctcgcgctgcaccgcgcggcggtgggcacgggcggcggcgtccgccgtcaggaagaccttcacctctgcgttggggaagacgacggtgccgatgtcgcgaccctctgccacgacgtcgcccgtgtagccgagctccctctggcgctcgaccatggcgtgcctcacgcgcgggtaggccgccacgacggagacgttcctgtccacctccggagttcggatctggtgcgtgacctcctggccgtcgatgagcacggtctggccctcggcggagcggccaaagtcgatgcgcgctgcctcggccaccttggagacggcctcctcgtcgttcacgtcgatcccgtccgcgaggcacttgtacgtgaccgagcggtacatcgcgcccgtgtccaggaacttgaggttgcacctcttggcaatggcgtgagcggtcgtggacttgccggacccggccggcccgtcgatggcgactatcatttgtcctcgcttcccgagatgttctgggtggtgtcgattcctatgagacttgggtccttggcgcggcgggcgacctcctccggcgcgagcgcgagcgccgcgagcgagaagtgcccgtccccgtacgtgaggacctgcgagctcacgttggggagcgtcacgtgccagaacgtgctgagtggcgtgccgaacacggcacccaggatggcgcgggacatgccgccgtggctgatgcaggccgtgcgcccctcgagcggagcgaggtcgtccagcacggtacgtgcgcgggcgagaaggtcctcgaagctttccgcacccggtgcggcgatggaatggccatcctggtccaggggccaggggaagtcgtatcccatgcggtgcacctcgtccatgtgcagtccctgcacgctgccgaagttgatctccgcgaggttctggtgcacctcgcacggcacgccgagcgcgaaggcggcctcctccgcgatggagcggcagcgcgagagcggcgagcaccagatgcggtccggcttccaggccacgacggccttgatggcgcggcgcatctgctcctctcccctgggcgtgaggtcgacgtcgatcctgccggaaaggacgccggccatgttctcgcgcgtctccggatggcgcatgagcaaaatcctgtggctgggcatcagcccacctcccgttttgtgttgttgcgcggcgcctgcgactccacggccgagcgctcctgggccgtgagcgggcgccactggcccggcatgaggccgctgagcctgagcgggccaaactcgtcccggtgcaggcgcacgacctcgtgaccgatggagcggagcatcttctttacctggtgcttcctaccctcgtggatgctgagcgagaccaccgcgtggttgtagggcacgccctccggcgccacgggcagcgctgccgggtcatccgccgcgagcagctgtgccttggcgggggccgccacgccgtcgggcatcctcacgccgtcgcgcagcatctgcagctggtggcggctcggcacgcccctcacgagcgccacgtagtgcttccacacgtggctcgaggggtggagcatggcgtttgccacgtcgccgttggtcgtgaagaggagaagaccggtcgtgtccgtgtcgaggcgtcccacggggaagagccccgggtatcggtcggtcggcacgagcgaggcgacgcacgggcggccctgcgggtcgctcatggtcgtgacgtagcccgcgggcttgtagagcatcacgtaggcgtgctcgtccgcgaggtggcactccacgccgtccacggtcacgacgtcgcggtccggcacgaccttgctgccaagctcggtcacgacctggccgtttacgcgcacgcgtccggccgtcatgaggttctcggacccgcggcggctcgcgacgccggcgcgtgccaggaagcgctgcaggcgcatggtgtactcgatgtcgcggtcgccatcggctggcgtctggcccatcagccgtccacctcctgcgagccgtcatcctgggcatcaggctgcggcgatgggggctcgtccttctcgcccatagcgttgacagcgggcgcgtcgaggtcctcgtccgcgtagtcgtcgcccatgagctcctgctcctcgtcgatgtcgtccgcggcctcctcgagcgtggaggatatggcgcggccggacaggcgctcgcggatgaagcgcttggactcctcgtcgggcgcgaagtcctcgagcggcgggagctccttgagcgacttgaggccgaaggtctccaggaagcgcggcgtggtgccaaagagcgtggccctgctgcggtcgcgctcgtggcccatctcgcgcacgaggcccttctccttgagggatgcgatcacgccgtcggagttgacgccgcgcacggccttgacgccctcgcgcgtgaccggctggtggtaggcaatcacggcaagggtctcgagcgcggcctgggagagcttgcgcgtgtcccacgagagcacgtagcgttcgacgacgtcgtggtaggcggggtgcgtgaagagccgccagccgccggcgacctcgcgcagctggaagccgcggttggcgtcggagtactccgccgagagctccgccagggcggacgcggcctcgctcggctccacgcccaggatgctggagaggtccgtcgctggcacggcgtcggtcgacacgagcagcagcgcctcgatcgctcccttgagcgagtcgtggtcaaggtgttcgagttcctgcatcagattccctcctcgatgctcgtgaggtccgattcgtccagctcgaagggcttggcgccctccacgcgcgcgacgtctatctcctcgaagttgcgctcctgcgacagcacgacggagccgcgcttctcgagctcgaggatcgccagaaacgtcgcgacgacgttctcgttcctcaggtcgccgtcgagcagctccgagaagctcacgagcggcttgttgcgcgtcacccggtcaacggcggcaaccgtgagcgcgatgggcatgcgcttgggcgccacgtgctccgcctcgaggaggaacccctggcggcggctgtcgaggtccgcacagatgacggccagcgagcgcagcgtgatgccctcgaggtagtcgggcatgaggcccatgaactcggggtcgggcccggcggtcctgggctccatgaggctctcggcctccatgcggctcgcgagcgcggccgcagcgttcctgaactgcttgtacgcgatgagccttgcgatgaggacctcgcgcgcctcgtcgggcgagaggttcgcgaggtcgtcctcgtcctcatcctcgggctgcgccttggggcgggccgcgtcttgcggcacgagcgaggcggccttcatgtcgaggagtgttgacgccaccagcacgaagtcgctcgccacgtcgaggtcgagctcgcccatggcctgcacctcgtgcaggtactggtccgccacttcggctatcgatatagacccgatggccagcttctgacggctcaccagctgcagaagcaggtcgaacggacccgagtacgcctgtgtcttaacgttgtacgacaactatgcccccaggagcgccgtcgtcaggttccccgccgtcgcgttgaggtagatgcccagcgggtcgaaccccaggacggagggaagcacgtacatgaccacaagaagtataggcatcgcatactgctggatcttgtagtagttcatcttcgcctggccgtgcaggagcggcatcacgatcttggagccgtcgagcggcggcagcgggatgaggttgaagaacatgagcgtcatgttcacgtacacgtagatgctcagcgcctggagcacccagtacatggcgtcggcctgccccgaccagaacccgtagcacgcccggaaggcgagcgcgcccacgcagccctgcaggaggttggacgcgggacccgccagtgccaccaacacctcgtccctgcgggggtgccgcaggttgtaggggttgtagggcacgggtttggcaaaggcgaacaccggaccgcccagccacgccatgagcagggggagcaggacggagcccaccgggtcgaggtgcgcgagcgggttgagggtgagcctccccgcctgcttggccgtggggtcgcccagcttgtaggcaacccagccgtgcgccacctcgtgcacgatggccgagaacatgacgagggcgacggagcccacgatcatgaagattcgctggttggagagcatgcacttctcctatcggtctcgaagctcccgcgccttgcgcgaaaggagccagtcgacaataaagaacgcgacggccaccgccacaaagtcgccgcgcaggacgccgccaaacggcgtctggtacacgagcgagccagaaagcccgtcggggatccacgatgcgaccgtgctcgtgatctccacaaggcgtatgcgcagcgggccgatgttgaacgcgttggccaccacgagggccgcaagcgcgatggcgcacaggcggagcaccaccgcgatgagcttgagcagccatgccgcccccgcgccgccgcgacgcaccggctcgcgctgcgccgcctgcgcgttgggcgagaagggctgctgcgccgggctctcgacgggtgccacgttggggcggtaggcctgctgctgcggtgcgcggcgcatggtctgcgtcacgggcacgtcggacgcggcctgggactgctggcgcgcggggggcacgggctggtactcggccgtgtcaccggacaccacgcgggtctcctgcgggctcacgaccctcgtcgcctcctcgtcggcggcattccagtccctgggggcgtgcttaggcattcaggctctcctcgatcttctccgtgagctcaagccactcctcctcgagttgcgggatcctcttggagagggcgttgtactccttcatgcacttgtcaaagcgctcggagtcgttgtagagctcctcgtcggccatctgcgccacgagctccttgtagcggtcctgcgcgtgcttgagctccgcctcgatctgcttcagacgcttcttctcggcgcggacggccttgttggcggcgtttctggcctcggcctcggcgcggcgctgctccttggtcttgacgttcctaccagtgccctgctgctgcttggcagcgggagtcgcggtcgcggggacgttcttctcgcccgcggcctccgttggtgacgcctcgccctcgagctccgcgcgcttgtagaggtagtagtcgtagtcgccgtcgtacagcgtgaccttgtggtcgcgcacgtcaaccaccttgttggccaccgcgcgcaccaggtgctcgtcgtggctgatcagcacgatcgtgcccgggaagttgacgagtgcctcctccagcacgtcgacggagtcgatgtccaggtggttggtcggctcgtccaggcacagcagcgggtcgggcgccacgagcatgcgggccagggcaaggcgcgcccgctcgccgccggaaaggacgccgaccttcttgtccacgtcgtcgccgtggaagaggaaggcgcccagcagcttgcgctcctgcgaggtggtccagcccggcgcggcctcgtccatctcctgcaggacggtataggactccttcagggtctccagctggtgctgcgcgtagtacgagacggtcacgttctggcccagcttgacgctgcccgccgtgggggcctcgtgcccgttgatgagcttcatgagcgtggacttgccggcgccgttggggccgaccagcgccacgtggtcgccgcggtagagcttgaggttgacgtcatcgtacacgtcattgtcctcgtagtgcttcgccacaccctccaggctcacgacctcgtcgccggtgcgcggcgggtccgggaacctgaagtgcaccttcttggaggactcgggcaggaccaccagctcctcgcgcaccttctcgagcttcttgatacgctcctgcacctgcttggccttggtcggcttgtagcggaacctctcgatgaagacctccatgtgctggatgtcccgctcctgcgccgcgcgcttggcgcgaagctgctcaaggttgtcctcgcgctgcttgaggtagctcgagtagttgcccgtgtaggtcatgagccgcttgttctcgagcgcggcaacgtggctcacgcacgcgtccatgaaggcgcggtcgtggctcaccagcagcacggcgccgtcgtaggcactaaggaagctctccagccacttgacgctctcgaggtccaggtggttggtcggctcgtccaggaggagaaggtcggggtgcctcagcaggagcttcgacagggctatgcgcatctgccagccgccgctgaactccttggccggcttgtcgaagtcctcaacggggaaccccaggccgcccaggatctgcctggcgcgcgcgtcgagctcgtagccgcccagccgctcgtagcggtcctgcgcggcgccgtacttctccagcagggcgtactgctcgtcgccctccggcatcacggagatctggtgctccatgtcctttatcttgcgctccagggtcttgatctccttggcggagtcaatcacctcttcaagcgcgctcttctcgcccgcgagcttcgtctcctgctcgaggtaacccacggtcgtgtccttggcaaagctcacggtgccctcgtcgggctcctcctgccccatcaggatcttgaggagcgtggtcttgcccgcgccgttgggccccacaaggccccagcgctcccccgcgttgagctgcaacgttgcggccgtgtacaggacacggccgccaaatgacttcgttatcttgtccgctagtgctatcaagtgctgtccgttcctacgtggccggggccgtcccgaccgggctttaccccactgagtatacgcggacgcgcccgtgcgcccgcatcggcgcgggtccgcacacaaaaaaggaccccgcgcgggggtcccggatgcttggtgggcccagagagattcgaactcccaacccagggattatgagtcccctgcgctaaccgttgcgccatgggcccctaacgagaagggcggcgacctaagccgccgccccctt

SEQ ID NO: 169 - DNA, 67695 bp, Unknown
  Metagenome-assembled genome
aaaggccgaacggaaaccgtccggcctgcaatctcttatggtgggcgatgctggatttgaaccagcgaccccttccgtgtgaaggaagtgctctacccctgagctaatcgcccctcagtgcggtagctatagtaacagaacattcgcccctgtaaagccgagaagttcgcccaatcgcaaaattgtttgtcgctcgtttccttacaagccatttacctgcgacgatgccattccctatggtggatattttttgagcgacaccccatgcggcgctacgcgagcatgtccgcgttgatgtccgccgtcgtctgggcgccgcacatctccatggtgtcggccaactcccggccgagctgcgcaaagtagtcgcgcacgccctctgctccggcgccataggtcgcgacggcaaacggcctgcaaatcaggcatgcgtctgcaccgagcgccagtgccctaaagacgtcgagccctgtgcggatgcctccgtccaccaggaccgtgaccttctcccccacctcgtttgctattgcgggcaggacgtccgccgtggcggggacgccatcctgtacccttccaccgtggttgctcaccacgatgccgtcggcgccggctgccacggccttgtgcgcgcctcgcaccgtcatgatgcccttcaggacaaagggcgtgtcggccgcgtggcaggcgtccgcgacgcgcgcgagctcctcgacggtcttgggtcctgcgggcggctcgaagcccctcaggaacggcaggccggccgcgtcgatgtccatggcgatggccgtggggtgcgcgtcgagcgcaagctcgagcttctccatgatggtctccatgttccagggcttgatggtcgtgacgccgcagccgccaagcttgcggatgtctttcaccgcggactcatggatggccgccaccatgccgtcgcccgtccacgcgagcgagcccgcctccgacgcggcttggaggatgcaggagttgtaggcctccatctcccacttgtcgccgtagtggagcttcacgtccccaagcggcccgatcatgacgggtacggatagcctgcgcccaaagaacccgacggaggtgtctgcctcgaagcgctcgtggatcgtgtccatctgcacgcacacgcgctgccacgcgtcgtagtttcgcgtagcgacggtgcccgtgcccttggagcccggccccggcatgtgcgagccgcacgcacgcccgttgcacacggggcacgccttgcaccaggggcccatgttgccgcgcgccgcagcggccatctggctgtagttcatgttcttctcccaaaagcggccgcctcccggaggatgcggccgcattcgattatccgtatgttccttgcgccaggcttaggccctctgggcctcgaccttctgggcgagaagggcggccacctcgtcgatggcgacctccgtgcgctcgccggtcgcacggttcttgagctccacgttgccgttcttgatggccttcttgccgcagaccacctggtagggcatgcccatgaggtcggcgtcgttgaacttgacgccggggcgctccttgcggtcgtccaccagcacgtcaacgccaagtcccaggagctggttggccaccttgtcggccacgggccacacgaggtcgtcgtggacgtcaagcgggatgacctcgacctcgtagggggcaacgctgacgggccagatgatgccgtgctcgtcgtggtgctgctcgacgatggcctgcagcgtgcggctgatgccgatgccgtagcagcccatgaggagcggcttctcgacgccgtcctcgtccatgaacgtggcgcccatggaggcggagtacttggtgccgagctggaagacctgggacacctcgatgccgcgcgcagccttgagcggggcgccgcacttggggcagacgtcgccctccctggccgtgatgatgtcgacccagtcggagtctgcgatctggaagtcgcggccgggcttggcgtgcacgtagtggtagccgggctcgtttgcgccgatggcccaccactgggactccttgagggagacgtcgtagcaggcgcgaacgccgtcaggcaggccgatgggacccatgaagcccttgacgaggccaaactccttgagctcctcctcggtcatcatgtggtaggagccaaaggcgtgctccgccttgacgtcgttaagctcgtggtcgccgggcacgaagcacacgacgggcttgccgtcgccatcgacgagcgcaagtgccttgcgcgtgcccgcctcggggacgttgaggaacttcgcgagcgcctcgatggtggaggcaccgggggtcgcgatcttctcgaggtcgccggcctcgccgtcgacgaggttgatggctgccgtggcggcctcggtgtccgccgcgaagccgcagtcgtcgcagtagacgagggcggcctcgcctgcgtccgcgatcgccatgaactcgacggaggtgtcgccgccgatctggccggagtcggccacgacggggagcgccctcaggccgacgcgcttgcagatcttggcgtaggcctccttctcctgctcgtagcactcctgcagggactcctgcgtcgcgctgaacgagtaggcgtccttcatgatgaactcgcggctgcgcatgaggccaaagcgggggcgacgctcgtcgcggaacttgtcctgcatctggtagagcgtcactggcagctgcttgtagctgcgaagctcgttgcggacgaggtccgtgaacgtctcctcgtgcgtggggccgagcgcgtactcgtggtcgtagcggtcgctcaggcgcatgagctcggggccgtagtcgttccagcggccgctctggtgccagaggtcgccgtccgtcaggatggggacctgcatctcctgtgcgtcgatggcctccatctcgtcgcggatgatgtcctcgatcttgttgatggagcgccacgcgagcggcaggtagctatagaggcccacggcgccacggcgcatcatgccggcacgcagcagcagcttgtggctggcgagctcggcctccctcgggtcctccttgagggtcggggcgtagagcctcgacatctgcatgtactttctcaacgtacttccttccaagttcacgaccagccggcgcgtgccggcacgaacactatcgcgacattctacgcgtccttctcgcccgcgtcgtcctgcgtgacgggattcgcgccgtcaccgtagcgacgctcgatctccgagaagagctcgtccacgatcctgtcctccgggacggtgcggatctgcttgccgttctcgaagaggacgcccttgcccaggccgcaggcgatgccgaggtcagcgtccctggactcgccggggccgttcacgacgcagcccatgaccgccacggagatgggagccttgaccttggcgagcctgcgcgagacctcgtccgccatgccgatgaggttgacctggcagcggccgcaggtggggcagctcacgagctcggggtgcaggcggcgcatccccagtgccgagagcaggtcccacgcgacgttgacctcctcgaccgggtcggccgtgagcgagaggcgcatcgtgtcgccgatgccctgttcgagcaggattccgacgccggcacagttcttaaccgtgccctggcggagcgtcccggcctcggtcacgcccacgtgcagcgggatactggggagctcgcgcgagagcatgcggtaggtctcgagcgtcacgggcactgagtgggcctttgcggagagcacgacgtccgtgaacccgcgcgaggcgaagtggtcgacgtagctcttggcggacgcgacgagcttctgcgggagcgagaggtcctggcgctcggcgtacgtggggtcgagcgatcccgcgttgactccgatgcgaatggggatgcccttctcgcccgccgcgtcgatcacctggtcgacgcgctcgaacgagccgatgtttcctgggtttatgcgaagcgcagcggcacccctgcgcgcggcctcgatggcgagcctgtggtcgaagtggatgtcggccaccacgggcagcgggctctgcgcgcagatcgcctcgaagccgtcgagcgcgccggcgttgggaatcgcgacgcggatgatctcgcagccggccttggcaagcccgtctatctgcgcgagcgtcgccttggggtcggtcgtcttggtcgtgcacattgactgcacggagacgggggcaccgcctcccacggcaacgtcgccaacgtgcacctggtgcgtcaggttcctggcggcaccgtcacgagcgtcagacatgtgtcatcacctatccaataaccttgcgtctctatccaagcacgaggcgcgtgatgtcattcttgagcgcgaacacgaatatgaacgcgaagaacgctagaccgacgtagctcacgatggtctgcgcgcggagcgagagcggcttgcgcacgatcagctggatgacctcgataaggatcttgcctccgtcgagcggcgggatgggcagcaggttcatgaagcccagggacatggacaccatcgcgacaaagaggagaaggtcgttcactccgcttgcagccgcctggctggcggcggccgagattcccacgacggacgaggcgctcgagagcgtcttcatggtctgctgcgggatgatgagctgcaccgcaaactttgcgaccgcctgcccgtattgcagcgccgcgagcgccgactgccaaacgggaagtcgtacctgcctggactgcgcatcgattccgaagaccttgaccttcttgccgttgacgcttacgttcgcggtatgggacctgccggaccgctcgtacgtgacggtaaagtccttgcgcgttccgagcacgccgtcgagcgccctgacgacgccgttccagtcgcttgtgctcgtcccgccgattgccgtgatgcggtcccccgcgcggaggcctgccttgtacgcgtacgagccggactcgacgccgcccagcttgttggagttgaccgcagccgtgacgccgacgatggagaggctcgcggtcacgatcgcgaaggcgaccacgacgttgacgagcgggcccgcaaagagggtgagcacgcgcctgaggaaacccttgccaaggtaggtgtggcccttctcgtccgcaagggcggcatctgggtctgtaacgggacgtggctccgcatacgttgtcgagccgtcctgcgagaagtcgtgtccggagtcgtactccgtgagcatgtgcgcatcgcgagcaagggtctcgaacgcctccgggaaggaaccctggttgggagactcgcccttgtctgggtcgtagtatggccggatgctcgcccagtcgcacagcgtagcgagaagatcgtacgcacggtccaggtccacgcccagctccgcggcaacgtccgaggcgaggacgtggccctcgcgctgcacgatggcgaagcactcggacaggagctcgtcctgggagccctccatgccgcagatgcgcgtgtagccgcccaggaggatgggcgtgacgccaaactccgtaccgtactttttggacttgcggcttgcacggatgcgacacggcatgccgaggaagaactccgtcacgcgcatgccacacgcgcgggccgcgaggaagtggccgccctcgtgaacgaagacgaggacggagaggaccacaacgccccagaacacggccgagatgacgcccatcaggaggcaatcccctcgagatatgcgcgtgccgcgtcgcgagccttggagtcgagctcctcgagctgcgcgagagactcgacgggcgcaacgtcatggacgcccatgaccgcctcgacggtagcctcgatgtcgaggaagccgcacctgccttgcctgaacgcgaggttggcgacctcgtttgccgcgttcatcacgcagggcatggtgccaccggtgcggcctgcctccttggcgagcctgaggcagccgaacgcctcctcgtcggcgtggccaaagctgaagtcgcagacgtcccggtagtcaacgcgttcgcagggggtctcccagcgttcggggaagctgagggcgtactggatgggaatgcgcatgtcggaggggccgagctgggccttcactacgccatccgagaactcgaccatggagtggaccatgctctggggatggacgagcacgttgacctggtccacgggcacctcgaacaggtggtgcgcctcgagcacctcgaggcccttgttcatgagcgtggcggagtcgatcgtgatcttgctgcccatgctccacgtggggtgcttgagcgccatggccgccgtgacgtgggaaagctcttctcgccccatgccgtagaacggtccgccggagcaggtgagccagatgcggtacaggtcgctcctgtgctcccccaccaggcactggtagatggcgctgtgctcggagtcgacggggatgagctggcccggcttgacgagcggcatgagcaggtcgccgcccacgacgagcgactccttgttggcgtacatgagcgccttgccggccttgagggctgcgtatccggcgcggatgcccgcaaagccaaccacggctgagacgacgctgtccacgtcgtcgctgcgaacgagctcctcgagggcctcggggccaaacgtgacctcggcctgctcgggcatgtccgcgagcgcggggtcgttccttcttgcctcgtttgcgatgaccacgtggcggcacccgaactcgcgagccgccttggccgcgaaggacacggagtcatacacggtgatcgcgacgacgtcgagcctgtcggcatgctgcctgcagacgtcaagcgtctggctgccgatggagccagacgcacccaggattgctacgcgctgcgggttgggccttttgtgggcctcgccctcattcacgaatatactcaaaggattcctccaagtctaagcagcaggaacgccgtcatgccgccaaagagcagcgagtccgagcgatcgagcatgccgccatgtcctggcatgaggttgccggagtccttcacgcccaccccacgcttcaggcgagactcgaagaggtcgccagcgacggcggcgatgttgacgagcacgccgcacacgatcgcgtacacgaggttgatgttccagacgcgcaggaagtacacgatgatccagacgaggacgctgccggcgaggccgccccagaagccctcgatcgtcttgttgggcgagattctgggcgcaagcttgtgcttgccgaacttcgatccgacgaagtacgcggtggagtcgctcagccagatggatcccataacggcgaaggtgagaagggcgcccctccacgacgggaagctgtctctgatgattacgatgctcgagaaagcgagcgacgtgtagatggggccgaacacggtgagcgcgacgtccccgaggttggcacggggcgtcgacacgtaccagcacgcgcagacgacgagcagcgcgaatatgacgaagaactccgcgtcagagatgttcgacagcggtgcgaaggggaacacgacggcgaacacgagcgcgatgacgtcgtttggcatcctgccgcttcgacgcgacatcttgaggaactccgagcagcagaggaacgccatgacggcgatgaggatcgccgtgggccacgtgcccagaaagagacacgccaccgtgccaagggcgtagatggccccggagaccacgcgcgcgtgcatggctgtaggcttgcccttgtgggcaacgtcactcttctcgtcctttgtggcggcttccgccgacggtgcctcgttcttctcgtccttggcttcgctctgcgaaggctttggctcctggccggaatcctgcgttgaactggccgcggcctgttcaacgccttccgtcgagacctcggggtccgactgcttctcttcgctcactttccagtaacacctccgaatcgcctgttcctaccctggaaggaacgaacggccctcaagaattcccatcggtcaaagtccggccagagggtgtctgtcacgtagaactccgtgtacgccagctgccagagcaggtagttggagaggcgcagctcgccggaggtcctgatgagaaggtcgggatccgggagtcccaccgtgtaaaggtgggacgagaagagctcctcgtcgatgtcggcggggtcgagctcacccctcttcacgagttcgctgatctccctgcaagcctttacgatctccttgcgtgcaccatagttgacggcaagcgcgaacgtcatgccgtcgtggtcagccgtctcgtcgaggccttcctggaagacggagcgcgtctcgtccggaagctggttcaggtcgccaaggaagcgcaggcgcacgttctcctggtggaagagcgggagctcctttagaagcgtcgtggcgaacaggtgcatgagcaggttgacctcatgctgtgggcgcttccagttctccgtcgagaacgcgtatacggacaggacgtccaagccaaggcgcacgcttgtggtcacggtctcgcgcagcgagtccacgccggcgacgtgcccctccgacctatcgagacccctcgcttgggcccagcgaccgtttccgtccatgattatggaaacgtggctcggtatacgatcgaggtcgacgtcagaaaggcatatgtcatcaggtgcctccgcatagaaggccctgagcttctccaggtccctttgcacgctagatctccatgacctcggcggtcttctccttcagaagggcgtcgatcttggccacgaactcgtccgtcaccttctggatgctcttcttctcgcggttgacgtcgtcctcggaaagctcctcgtccttctccgcgtcgtgaatcgcgtcgcgacgcgcgttgcggacggcaaccctggcctcctcggcgtacttgttgcagtccttcacgagctccttacggcgctcctcagtgggcttcgggaacggaaggcgaatggagacgccgtcgttcgagggagtgatgccgaggtcggaggactcgatggctttctcgatggcctttagcgcggtcttgtcccacggctcgatgacgagcatcgacgcctcgggcaccttcacgcccgcaagctgggtgatgggggtcggctggccatagtactcgacgctgatgccgtcgaggacatgtgcgtttgcacgtccagtgcggaccttgctgaagttgtacttcagggcttcgatggacttgttcatgctcttcctggcggagtctgtaaaggtgctcatgtctctctcctactcgtctacgacggtggttcctacgttctcgccgcgaagcgcgcggtcgaaaatgccgtccccatcaaggttgaagaccatgatgggcatgtggttgtcatggcagagcgccgttgccgtcgcgtccatgacgtggaggtccctgttgaggacgtccatgtacgtgatggtatcgaacttcttggcgttgggatttttcatggggtcgctgtcataaaccccgtcgaccttcgtggccttcatcagcacctcggcgccaatttcgcatgccctcagtgctgccgcggtgtcggtagtgaagtacggattgcccgtgcctgcggcgaagatggtgatgcggcccttctcgaggtgccttatcgccctcctcctgatgtacgtctcggagacctggtgcatctcgatggcactcatgaccctgcacaccatgccgttgtgctcgaacgtgtcctgaagcgcaagcgagttgatgaccgtcgccagcatgcccatgttgtctccctgggcgcgatccattccggccgcagcaccagagagtccgcggaatatgtttccgcctcccacgaccacggcgatttggagtccagcatcatacgctggcttcagctcctttgcgattctcttcgggacctctgggtcgattccgaaatccttggaccccatgagggcctcgccagaaagcttgaggagaacgcgcttgtacttgtaatcggacaatccaggcctccagtccttgttcgaggtgcgtcggtatactcgatgcctcgcgtgttagattttagcaaagcgtcaacagagacacgcatccaataggtaacctgtggtgacgcgacatatgaaaggagccggcgtttgtgcgccggctcccaagcaatacgatcttttgtgtctactcgccgaatgcgaagcggacgaacttaacgatctcgatgtcgtcgctgacggccttggagaccttcttggcgagctcgctgatggtgacgccagactccttgatcgactcctgctcggtcaggcagttctccttgtagaacttctcgagcttgccgagggcaatcttctcctggatgaactcgggcttgccggactcggcagcctgggccatgtagatgcccttctcgtgctcgagaacgtcagcggggacgtcctcgcggcgagcggcaacggggttggcggcagcgacctgcatcgcgacgtcatgcgcgaagctcttgaactcctcgttggagctggtctcggccttgccgaacgtgaaggcgacgatgtccgcaagcttgccgttgtggtggacgtacttcgcgagtgcgccgtcctcagcggtgatgcgctggaagcgagcgatcttcatgttctcgccaatgacgtgaatcatctcggtgagctcgtcggcaacggtgtcctcggccatcttgcaggccttgagggcctcgacgtcagcggggtcgttctccgcaacgaccttggcgaggtcgtttgcgaagccgacgaacttggggttggtgcccacgaagtcggtctcgcaggtgagctcgagaagagcaccggtcttgccgtcgtcggagacgtaagcggcgatggtgccctcgttagtctcgcggccagcgcgcttgacggccttggcaacgcccatcttgcggaggacgtcgacagccttatcgatgtcgccgtctgcctcgacgagggccttcttgcactccatcatcggggagtcggtcatctcacgaagctgcttgacgagagcggcagtaatcttagttgccatggtgaactcctttgtctctactgtaaagaagcctactcagctgcaggggtctcgaccgcgggagtggtctcgccagaggccatctcctcgacggagatctgctccttgccagagccagccaggatggcgtcagcgacaagctcgcacatcaggttgacggagcggatggcgtcatcgttcgcggggatgccatagtcgacgacgtccgggtcggagttggtgtcgagaagggcgacgacggggatgtggagacggttggcctcgcggatggcgatctcctcgcgcttgctgtcgaccacgaagatggcctgaggcagggcgtggaggtcacgggcgccaccgaggttgcgctggagcttgtcgagctccttcgtcaggactgcctgctccttcttggggagaagagccatgcggccgtcctcgaccatggcctcgagctcctccatgcgatcgatgcgggagcgcatggtgacgaagttggtgagcatgccgccgagccaacgctggttgatgtaaggcatgccgcagcgctcggcctgagtcgcgatgggctcctgggcctgcttcttggtgccgacgaagaggatgcgaccacccttggcagccgtctccttcaggaacgtatacgccttgtcggcgtcgaggaccgtctgcttgaggtcaaggatgtagatgccgttgcgctcgccgaagatgtagggcttcatcttcgggttccaacgacgcgtctggtggccgtagtggcagccagcctcgagcagggtacggatgttgatcttaacagccattcaaaaacctccattggttggtcctccgtgtgatatcaaccccgtgcgtaccacctgggatgcggctcacatcacaggcaccgtggtcgacgagtcgtcacacgtgtgaattaatgctgcacggtcgcacagcaagcaaaaattataacagtgtgtagcgtttaaaaccacgcaacggacaaataccctccactccacaaggtttgcaggattcttctcggatgtttcacaatcctctcgctcgcttgtccgttccagcgctcattcggaccttggatgagcctgcttggccgcagccttcattctgtctatggtcaggtgcgtgtatatctgcgtcgtagataggtcggagtggccaaggagcgtctggacgcttctgaggtcggcaccaccggcgagaagttccgttgcgaaggtgtggcgcattgcgtgcggcgtaacgtgcctcccgatgccggattggacgacacgctgctcgaacacctttctgagcgcgtcggcactcatgcggtttcccctcgtcgaaaggaagagggcgcgctcgcgtccgtcagaccttgtcgaaagcttcggccgtgcctcgcgctcgtatgcgtcgacccgttcgattgcgagcttgtagacgggaacgatgcggaccttactcccctttccgaagagcctcacctgcgcttgtgcgaggtctacgtcatccacgttgagtgacgagatttcggagattctcgcgcccgtcgcgtacagcagctccaagaacgctctgtctctcatttcccgagcgccgttgccatcgcagctgttcagaatggcctccgcctcggcctccgtaagcgtcttcgggagcgtcttccttctcttcgggctcgcgatcgccgcggcagaatcctgctccgtcacgccttcctcgagaagccacctgtagaggtcgcggaccgccgacagcctcctgtttatcgtggccgtggagtacttcgccctgttcatgtctgcaagatatccgcgcaactgcgggtggctcaccttgaacgggtcgactccgctcctctcgacccatcttacatacgattcaaggtcgcatgtgtacgcccggacggtattgtccgagaagagccgggcgcctttctcgcttctcagaaacgattggacgtactctcggaaccgcgcaatcgattcctcagagctcgactccgtctcactcaacggatgccgccggaaagaggtcgcgcctggaggccagatactcgtcgaggtctgtcgatgccctgtcagcatacgcctggtagcgctctcgcttcttgagtctcttgccctcaattggaggcacaaggccaaagttgacgtgcatcggctggtacgggctcgtgttcgggtttgttgcgtatgcgacgagcgacccgaacgcgctggttggcggcagactgaccatgggaagccctcggaggtccgcataggtgttcagggcggccagaaggccagaagctattgcctccgtatatccctccgtaccggtaatctgcccagccagtctcacgctcgtgtcaggtatcgcgaatgtcttgtccaggacgcgcggggcatccacaaacgagttcctgtgcatgacaccgtaacggaagaagtccgcgttctcgagacccgggatcattcggaaaacgcgcttctgctccccccatgtgaggttcgtctggaagccaacaaggttgtaagcggtgttcgcctcgttctccgaacgcagttgcaccgccgcccatggccttctcccggtcctcgggtcaacaaggcccacgggcttgagtgcgccgaacctaagcgagtcccttcctgtcctcgcaacctcttcgactggctggcacgcactgaacaagtcgctctgttcgaactccttcgagacgaccctcttggcctcgatgagagcatcatagaacgcgtcatactcttccttgtccatggggcagttcagatagtcgcccactcccttatcgtcgtatcgcgattgggagaagaccacgtccctgtcaagcgtctgcgcgtctacgatgggggcagctgcgtcatagaaggagagggaatccccgccgaccttctcggcgatagccgagaagagctcgtccccgcagagcggtccagccgcaatcaccgccggaccctctggaagtgtcgtctgtactcggcgctgaaccacgatgttctcggtattcgaaatcgcttcgccaacaaggtctgagaacctcttccggtcgacggccaatgccccacccgcgggtacggcagcctcccttgcataggagatgagcttcgaccccatctttgagagctcttccttcaaaagaccggcagcactgtcgtgcctagtggacttcagagagttcgagcagacgagctcggcaaagccgtcggtatgatgtgcggccgtgctggcaacgggacgctgctcaaccaatgtcacatctacgcccctgtcggcgagctgcagcgcgcactcgctccctgccaagccaccgccgatgacgataacgctctcagccaactgatccccctcttcgctaattcctacagtccattctatcggacgttctgaggaattcctccgagggagagtacctcccgtcgggcagcctcacgaccatgcccctcgcctcatagtcggacagcgtgccgagaatcgtgattacgctgtcgccaagcctgtttgcgagctcgtccgcacgcgtcggtgatgcgaccaaggccgacatgaccctgcccatctcgggattgccagtcgtctcagtcagcctaagcctgtcatagtccagggcaatgcacatttccaaatcccgttcagagcagatgatgctcgccccatccgatatcagctcgttcgtccccagggattggggcgagaagatcgatccgggtacggcatagagcaacctcccgagctgcgatgccatctcggcggtgctcatcgttccagacttcttgccagcctcgattacgagcgtcgcccgtgacagcgccgcaatgactccattcctcttcggaaaggcataccgtctcggtggcgcaccccacttctcgatggagatgacggcaccgtcgagctctatcgatttcaggaagacgtcgttcgatgcctgtgggtagatgacgtcggccccacagccggatacgataattgaccttcctccggcattcattgcggctctggacgccgccgagtcgcaaccgagcgctcctccggaaaccaccgcgagaccactttccgccgcgaccctacccgcaatctcggcgacggcaatcccgtaaggcgtcgcacgtctcgagccgacgatggcaatgctagggagggctagaacctccggatcaccaatcccatagacggtctttggcggattgggaagatcatccagtgtcttcgggtactgcgcttgcccgcgggagagctcaaatgatttgtcagtcatccttccctcctgtctctgtatgcgcaggcctcgagcacatcttccctagtgacgcgatctctcccttctaggtccgcgatggtcctggcgatgcctccgacgcgaactatcgctctcccaccgaacccaagcctgcgtgccaccctctcaatctcctcacgagcgcagtcatccagacacatgggctcgagaccctggttcggaagaccgacctctccggtccgtcgcgttctccaattccggaattcccttccttgtaggacctgactgcgcatttcctcggtgctcatcccctcttcgccggaaacaaccttcctggagtccgggcggttaacgaagacgtgtaggtcgatcctgtcattcagtggtccgcctatccgcgactggtactgcgcgatcttcgcaggcgtacatttgcactggtggcggtcatcaccaaggtatccgcagggacaggggttcgatgcggccaggaacatgaagttgcaggggaacctatagagtccgtcagcgcgtacgagcctgacctcatgctcctcgaagggttgccgcaaagactggagtacgttggaggagaattctgggagctcgtcgaggaagagaacgccctcgtgggacagagatacctcgccgggcctcacggggctgcctccccctatcatccccgccatcgagatcgagtgatgcggtgccctgaaaggcctcttccctgaagcaatgtccgagacgtccagccccgcaacggagcttacgagcatggcttcctccatctcccctctcgtcaatggagggagaatagtcggcatcctcttggcgagcatcgtctttccagaccccggcgggccaatcatgagcagaccatgaccgccagttgccgagatgaccatcgcgcgcttcgcagcctcctggtccatcacgtccgagaagtcaacgtctttggaactcgagccactggcaacttgcgacgaactgagaggcaacgtttgcaggtgctcgacacccgccagaatctccggaagggactccatgtccaaaaagtgcgtcgaccctataagctcgtttgtgcctgagctgacgagcttcatgccaagcctctgtgccagccgctcatatgcgaccattccacgcacggggttgaccgtgccgtcaaggtcaagctcgccgacaaagagacattcgtcaagaccgcgagggggaatctgcgaggtcgacgcaagtatggcgacagccagcggaaggtcgaagcccgttccggtcttcctgagctcgccaggcgaaaggtttaccgtgaacctgagtcttggcatcttgagtccggatgccctaatcgcacagcgtactctcgaacgcgcctccaacacattcgaatccggcattcccacgatgacgattccgggaattccgtttgacgtcgctatctcgaggtcgactgggagcgcctccatacccctcagggttgcgctgtgaatcacgagacaaggggagccagccatcgccgatcactggtcccactcgaatgcgccacagagatgacgcagccttgcgagatgcatgccaacgatattgacggcgatgacatcaaagcggatgttgaacacaccgggatggtcgtacagatacctcagggcaagtcgcctgtacttcgcctgcttcttctggtcgacggcaagctcggggatcagctccttgttcatgcccagggcgagcctcgtcttgacctccacgagaacgaatacgtcgtgtccgtcctcgtccagcgtcttggcgacaatgtcaatctcgccgtccaagcaggaccagtttcgttcgacgatctcgtagcctctgcgcatgaggtacgtggccgcgatcttctcgccctcctgtcccagctccttgggcgtgagctggtcaaccggtttgttgtcgacgggtggctgtgccgcatcctcgtccaagccgcttgatggcccgtattccgattggggctgcggagtgggagccgtttcgaggcccgtgcccgtcccctctgccgcaaagtattcggggtcgtcgtaccctgactgctgcgttccgtagacctcttcgtcgctcatgggaacctccaagcctcgcctatgggctttagagcttccctcacaggtctttaggtagcctttcgcatgtcttgcgtgaaactttgcaaacgagccagcttctcgagattgaacggggactcacacgtacaagccacgcctcaatatgctgtgattaagacatttatgagaagagccgaggcgtctccaagaaattcccacaaaacgagactctgtggattggcgtgaggccgagccgcttgatggcgtcaatgtgcgaggcggaaccatagcccttacactctgcgaggtggtactccggatactccgagtcgtacgcgaccatcagggcgtccctcgtgacctttgcgactatggatgccgcggcgatgcaggctatgcgcgcatcgcccttgaccaaggtcttctcccttgggtggacgtgcacgggattgccgtcgatgaggacgcagtcagggtcgacgccggcgtcctctatcgcacccgacatggccatgcgcagcgccgtcgccatgcccacggcgtctatggaggcgggttcgacgtgcgctatgccgatggccgtcgcgacttcggcaatcctcgcggcaagcacctctcggcgctcgggagtgagctgcttcgagtcgtttataccgtatattcgtggttcgtctggcagagcgaccgcgcagaccgtaagcggaccggcaagcgcgccgcgaccgacctcgtcaacgcccaggacgacgccgtcgccaccgagctcgcgctgtagctcgtacatcccgtcgacgcgctcgatctcggcctgttcgcgctgcttcctacgcagggccgcctgcaccgcatgctgcacctgcttgcgagggtcctccgcatagcgttctgcaagctcatcgatttcgtcaaggctcgcgtcatggagcctggccgccacttcccttgcgcttgcgggacgagaggcctgtgtcatgagtgatctccctacaaaaaaggcgacacccgcaagggtgccgccaaggtgtgcctatggaaaggcttagcgcttctcgcggatgcgagcagccttgccgacgcggtcgcgcaggtagtagagctttgcgcggttgacgtcgccgtgacgcacgacctcgagctttgcgatcttcgggctgtgcagggggaaggtgcgctcgacgccaacgccgaagctgatcttgcggacggtgaaggtctcgcgggagctggcaccgctcatgcggatgacgtcgccctggaagacctggatgcgctcgcggtcaccctccttgatgcggtagtgaaccttgacgttgtcgcccacgcggacctgagggatgtcctcacggatctgctgacgctcgatggcgcgaatgtagtccatagtttcctcgtctctagaggtgccgtcgccgtgtgcgcggcacataggtttacacacaagtgcgaagtataaacctcggaacgtgctccttcaagccttgcgaagccgtcaaaacttattcacacaagccggggcaggccaagacgccgctcgcacttctcgcctacctcaagccccaggcacgtggcacaaacaggtcctggtacctgcggatggcaaacctgtccgtcatggagctgatgtagtccgcaacgcgcacctcgtcggggtcgccgcgcaacgtgtactccgcgggaagctcgtcgaggtgccgcacgtaataatcgaagagcgcctcgacgacgtgctcggccttgggctcctcggactttgcgtcacctgtcttgtagaggttcgagaagagaaacgcgcgcatgcccatgagcgcgccccacaccgtgtcggacatctggacgtcgccggcggcagcgctcgtggacacaatgtcatgcaccatggccgcaatccgctcggacgagttgccgcccaggccgtcccggcagcgcgccggcagcatctcctccgtgagcaggcccgctcgctccgcgtcgtcaatgtcatgcgtgacgtacgcaatcctgtccgcacgcgcgacgaccctgccctcgagcgtgcgggccctcaggctccccgcatggcagcgcatcccgttgagcacctcggtgctgaggttaaggccgcgcccttctcgctcgtaaagctcgacgacacgcacgctctgctcgttgtggcggaagagcccccttgccgcatccgacctcgggtcaacgccaacgtgacgcgccatcgcacgctgcagcgcgcgctccccggcatgcccaaagggcgtgtgcccaaggtcgtggccaagcgctatcgcctcggtcaggtcctcgttgagcctcaggggccgggcgatgtcgcgcgcgatctgcgcaacctcgagcgtgtgcgtgagcctcgtgcgatagtggtcgccctcgggggccagaaacacctgcgtcttgtttgcgaggcgcctgaagctcttgctgtgcagaatccgatccctgtcgcgctggtaacaggtccttagggggtcctccggctcatgcctgccccgccccagagatgcatccgcaaacgcggccatcggcgagagcagctcgtgctcgcgtcgctccagatccaaacgagcgcagacttccatcgttcctcccgtttgccgctcgggaaccccttgcacccaaaaacaagaaggggagaaggacgcgagtccttctcccccactctaaaccaagcgattggccaatgcctgcctcaggctactccccgagcttcttggggccgccgttggagttgatcttcgcctgagcgccggcaagacgcgcgatgggcacgcggtacggcgagcaggagacgtagtcaaggccaaggtcgtagtacatctggatggagtcggggtcgccaccggtctcgccgcagacgccgcagacgatcttgtcgttggcctcgtggccaccctcgacacccatcttgacgagctttgcgatgccgtagtccagcgtctcgaacgggttggacttcaggatcttcttcttgaggtacaggggtacgaacgcgccctcgacgtcgtcgcgagagtagccgaagcccatctgcgtgaggtcgttggtgccaaagctgaagaagtcggcatacttgccgatctcgtcggcggtgacggcggcacgcggaatctcgatcatgcagccgacggggatgtcaagatcgacgccggtctgctcggcgacggaggcgatggtctcctcgatctggtcgcgctcgaccttgagctcctgccaggtgccaaccagcgggaccataatctcgggcctggggtctagaccgcgcttcttgaggtgcgctgcggcgccggcgatggcgcgaacctgcatctcggtgagctcggggtacacgatgcccagacggcagccacgcaggccgagcatcgggttggcctcctggaaggagtccagacgggcgagcatatcgcgacgggccttgagctgggtctcgttctcgccacggtcctcggcgtgagccagcgcgacggcgtagtcacgcgggttgtccaggaactcgtgcagaggcggatcgagcagacggacgatgacggtcttgccgtccatggcctcgaacattccgaggaagtcgtcggtctgggccttcaggagctggccgagagcggtctgcttgtcgccggtgcggtcggcgaggatgaaggtctggatgatctgcttacggtcgcccaggaacatgtgctcggtacggtcaaggccgatgccctcggcgccgaagtcacgggagagcttggcgtcagccgggttgtcggcgttagcgcggacaccgaacaggcggccacgggaggcgtcgtgacggacgtcgtcggcccactcgaggatggtctcgagatcgccggtgagctccgggcgaaccaggggcacctcgcccaggatgacgtcgccggtcgtaccgttgatggagatgacgtcaccctcgtgcaggacgatgtcggtgccggtgatgacgcactccttggccttggcgtcgatcttgagcgcctcagcgccgcagacgcacggggcacccatgccacgggcgatgacggccgcgtgagaggtcttgccgccgtgagacgtgaggatgccctcggccgcaaccatgcccttgaggtcgtcaggagtggtctcccagcgaacgaggatgcagggcttctcgatgttgtggtaatgaaccgcagcgtcggaggagaacacgacggcgccaactgcagcgccagggctggcgttcatgcccttggcgactacgtcgagcttcgccttcgggtcgaactgcgggtgcagcagctggtcgagctgagcgggagcgacgcgcatgatcgcctgctccttggaaatgcggccctcctcgaccatctgcatagcgaccttgagcgcggaaagcgcggtacgcttgccgacacgggtctgcagcatccagagcttgccctcctggatggtgaactcgaggtccatcatgtcagcgtagtgatcctcgaggatctcgaagacgtgatagaggtccttgcctgccttctcgagaccaggggtcttggggaggtcggcgatgggctcggtgttacggatgcccgcgacgacgtcctcgccctgagcgttgacgaggaagtcgccatagcgctcgttggtgccgtcggccgggttacgcgtgaaggcgacgccggtcgcggaggtgttgcccatgttgccgaagaccatgacctgcacgttgacggcggtgccgagcgtgtcgtcgatcttgttctgcttgcggtacaggatggcgcgcggagtgttccaggagccgaagacggcctgctctgcgagacggagctgcaggtaaggatcctgcgggaactcggccttgccgttcggggcgacctcggggtgagcctgggagtcgacgttcttcgcgaagatgtccttgaaggttgcggtgaggtccttgaggtcctcggcggtgagctcggtgtcgagctttacgcccttctcctccttcttctcgttgatggcgtcctcgaagagctgaccatcaacgcccatgacgacgtcggagaacatctggacgaagcgacggtaggagtcccagccgaagcgctcgttgttcgtcttcttgatgaggccctggacggagtcgtcgttgaggccgaggttgaggaccgtgtccatcatgccgggcatcgagaagggagcgccggagcggacggagacgagcagcgggtcgtccttgtcgccgagcttcttgcccatgcgattctcgaggtccttgcggtagacgtcgatctcgtcgagaacgccgtcaggccacacgttgccagcgctggaatatgcaacgcaggtctggcaggtgatggtgaatcccggaggaacaggaaggccaatgtttgccatctcggcaaggttcgcgcccttaccaccagtgatccacttggcctcgtcaacggtcttgccggcgacttcggtaacgttgttaccgttttcgtcaacgccgaatttgtacacgtgcttttcagccatttgacacccctgatcgttttcccgcggtgctgtagtgcacctagtcctttttggcaccactctgattgcgaatctcgcagcacctctaacgaaccctattgtatccacaagtattggtttatcgctcacgaatacacatttgggggtaaaaaaggtcgttagcatccactcagacgctaacgaccaccacacgcaaaatacttctttacagccactacaaattgaagtagctattaaatctcctggacgtcactgtccacgcggcgacccacgacgagcttcggctcctcgccggtgagcgacgatagcaccgtgattgccggcccaagcaggtcgatggaaggaacgccgcgcttgtcgagctcgcgacggatgtccctgcgaaggttgcggtcgacgatcgtgtggaacacggctacggggatgccctcctcgatgttctcgtccaggtacttgacgaccgtatcgaggttcctcacgttgccgatgctcttgatgatgacgctgtcctcgctgaactggtcggccgccgcctccacgacgccggttgcggtcttgccgcgagcgtcagagatgacgatcacgacgggagtctgtacgtcaaagatgtcctcgtccataccagcctcgtctcccatatcgatacctcctcgccggaggaaaatcccccgcatgatggataagcagcttttcctatcctacttcttcttcgagagcgcgccaatgttggcgacaccgctgaacaccgcagcgaacctgttgagaagcctcaggcggttctcccttaccacagtgtcctcgtccatgacgagtacgtcatcaaagaaacggtcgattggctcacgtagttcggcgagagccttgcaggcgccctcgtagtcatgcttcgagagcgcttcctccacgctttcgtcacccttcctacatgcggcgaggagtgccttctcggcgtcgcccatgatcgactcatcgacgtcggtgccgagcgacttgtcaccgaggtgcgcggcgcgcgcataggccgtggcgaggtcgtcgaagagctcgggctcgttcttgcgtgcgttctcgagggcgtgtgcgcgctcgaggaactcctcgggatcgatgacgccgacgctggagaccgcctcgatggtgtcgggagagatcttctcgtccttggcgatggtgttgagcctgccggcgaagaacttctggacctcggcctcgaccgcatccttgtcgaacataagcccctgctctgcataggcgtccagggagacggagatgagcgacttgagcgagacctcgggcatcgtcctgagcatggagatgatgccgatggcggagcgcctcaccgcgaacgggtcggaggagccggtcggcggctcgttgatcgcaaagaggccgcacaccgtgtcgagcttgtcggcgatggcgacgcacttgccgacgacgccggcgggcatgtcatcgcccgcgaagcggggacgatagtggtcgcggatggcctccgccacctcgtcgggctcgccggaggccttggcgtagtagccgcccatgacgccctgctggctcgtgaactcgacgacggcctgcgtaacgaggtccgccttcgcgaggtgagcggccctctctgccatgcgcacgacgtcctcgccctggccgtcctcgcgtgcgacctcgggggcgatcttctccatgcggagggtcttctggtacacggtgccgagcttctcctggaagacgacgtccttaagcttctcgacgtagtctgcgagcggcttcttgaggtcctcctcgtagaagaacttggcatcgtcgaggcgtgcgcgcactacgcgctcgttgccgtcgatcacgcgctcgtcgttgcggcgggcggtgttggagaccaccacgaactcgcgggtcaggttgccattggcatcgtagatcgggaagtagcgctggttggagagcatcgagtcgcagatgatctcgttggggaccttgaggaactcctcgtcgaacttgccgacgagcaccgaggggtactccgtgaggttgacgacctcgtcgaagatcctcttgggcgtgtccacgtgagctccgccacgctcctgctcgacctgcttgatgccgtcgaggatgaccttgcggcgctcgtcctcgaagagcacgccagcctcacggcaggtctcgacgtagcttgcggggtccttcaccaggtgctcgccggggccgaggacgcggtgcccgcgcgtgacgtggccgctcgtgacgtcggcgtacttgacggggacgacctcctcgccgagaagcgcacagatccagcggataggcctcacgaacgtctggtgctcggagccccagcgctgcgagcggtagttgggccactcgagggacgcgatggagtcctcggagagcttggtcaggatggggagcgccggctgggagggcacgttcttctccgcgaagacgtactcgcggccgtcggcgtcctcgcgcctcacgagctcgctcgcggcgaggccgaacttgcgggcgaagcctgccgctgccttggtggggttgccgtcggcgtcgaacgcgatgttggccgcggggccgcgcttgacctcgtggacctcctgcgtcgcggtcgcgacgtccttcacgatgaccgtgagcctgcgcggcgtgctcatggcgctcacggcgccgtggctgaggcccgcctcgtcaagccccttgccgacgagctggccgaactgctttattgcatggatgagaggagcggagggcatctcctcggtaccaacctccagcaggaagtccagagtctctgccatctaggccacctcccccttcgtgtgcttgtcgtcttgcttgcttgccacctcggcaaggtatgcctcgcagcaggcctttgcgatggtgcggacgcgcaggatgtagtttgcgcgctccgttgcggatatcgcgccgcgcgagtcgaggagattgaacgcgtgcgagcacttcatgacgcagtcgtaggcgggaagcggcagcttgcgctcgaggcaggcgttgcactcgcgctcgtagtcgtcaaacttgttgcgcatcatctcgacgttggcgacctcgaagttgtacgtggagaactcgaactcgttctcgtggaacacgtcgccgtacgtcatgggcgtgccgtcgggcaggtagctccagacgaggtcgtacacggagttgacgccctgggcgtacatggcgatgcgctcgaggccgtaggtgatctcgacggggacggggtccacctcgaggccgccgacctgctggaagtacgtgaactgcgtgacctccatgccgttgagccagacctcccagccgaggccccacgcgccgagcgtcggggactcccagtcgtcctcaacaaagcggacgtcgtggtcgttggggtcgaggccgatagcggcgagcgagccgaggtacaggtcctgggagtcaaccggggacggcttgagcagcacctggaactggtagtagtgctgcaggcggttggggttgtcaccgtagcggccgtcggccggacggcggcagggctgcgggtagcaggtcctccacgcctggggcccaagggagcgcaggagcgtcgcggtgtggaacgtgccggcgcctacctcgctgtcgtagggctgcatgaccgtgcacccctgttctgcccagtacttctcgagcgtcaggattatctcctgaaacgtaagcggcttgtcgctcatgtgcttgtctgctcccatcgtatgtgtgcccgcgcgctagagtccgcgcgcgtccttgaacggccagaaaatgaatacggcccttgatgataccgaatctacgctcacggcgccaaagtagcgggagtcaagggagttggtcctgttgtcccccatcacccagatatgacccgccgggaccttgtacggatagctgatggcctcgcccagcgtgctcgagtactgctcgagcgggtagctgggcttcccctccgtgtaggactcgctcagcttcttgccgttgacgtagacgaagccgttcctgaggtccacggtgtcgcccgcgacggcgatcacgcgcttgatgagcgtggtgccgggcttctcggggtcgtcgaacgtgacgatgtcaccccacttggggctcgaggtcttgtaggtgaccttctcgcccaacaggcggtcgccctcctggatcgtgtcgagcatggagcccgagggaacgatgtagacctcggccacaaaggccctcaccaggagcgcgagggtcacgcccacggcgatcgtgatgacccactcgagccatcccggaatccccttgccgcgctccttctgttcagatgacgccatcattcgtccttcccgtcgggctcgtcgaggataccggacacgaagtcgcgttcctcgtccgtaagttccgctgagtcaagcaggtcgggccgccacctggccgtgcgctcgagcgcgctcctgcggcgccacgcgtccacggcaccatggtcgcccgagagcagcacgtcgggaacgcgccttccctcgtagtcggcgggtcgcgtatactgcgcgtactccagcagcccatcgctgaacgactcgtcccgggcgctcatctcgtctccaagggccccgggcaggagcctcacgacggagtcgataaccacgagcgcggcaagctcgccgcccgtgagcacgtagtccccgagcgagaagacctcgtccgccagctcgtaggcgcgctcgtccatgccctcgtagcggccgcacaccaggagcactcggtccagatgcgacagccgctcggcgcaggcctcgtcgtagcgccttccgcagggcgagaagaacacgacgtgcggggcgcaatccccccgttgcgatatgtcacgaaccgcctcgaagatcggggcaggcttcatgagcatgccctgcccacccccgaagggggcgtcgtccacggtgttgtgccggtcgtgtgtccagtccctcaggttgtacgcctcgaagtcgagtatcccctttgcctgggcgcgacccatgatcgactcgtcgaggtagggcgcgaacacctgcgggaagacggatagggtctcgaacctcaacgcgcgtcactccccacggtcccgtcggggaccctcacgacgattgaaccttgcctgggaatctttaccaggaactcatccacgacgggcaccatgacctcgccatagggaccttcgacggtccagacgtcgtttgccggaccgaccatgacctcggtaaccttgccgaggtagccgaggcgctcgtccgtgacgtcacggcccatcagccagtcgacgtccgagcgctcgaacccgtcgggcaggtcctccacgcgtgcgaggagcgtcttccccacgagcttcgatgcggcctcgaggtcgtcgacaccctgcaggtgcacgagctggcccttctcgcccccatctgcggagagcaccttgcgccagcgcggtcccttaagcgcggggggaacgacgcagacctcgagacccttgctcacaatcgaaggaaggccgtgaacgggaaccgtcacgacctccccccttctgccgtgggccttgaccacacggcttatggctctgtattcgttatgcacgagacgtctagcccagaacctctacttccacggaggtgccgaccctcgagccgagcgcgcgagcgagcgtgcggatggccttgatggtgcgtcccctcctgccgattatccttccggcatcctcctcggcgcacgagacctcgatgagggcggaaccctcgctgtcggtcacgtcgagagatacggcgtcctcattcgtcacgagtccgcagacgatgtactcgacgaggtccgcgaccttgtcggaggcaagctcctcggagtcgtcagagagctggtccagggaatcgacgtcctcgatttcctcggacacgatgcctactccgcgttctcggcggcggcagcggccttggctgcggccttcttggagagcttctgcttcttctcgggagcgggagcgtcggagcgtgcgatgtcgatcaggtgagcgacggcgttggagggctgggcacccttggcgacccactcgtcgatcttctcgaggtcgaggtcgatggtcttggggctggtcagcgggttgtagcggccaacgagctcgatgtaacggccatcgcggggcatgcggccgtcagcgacgacgacgcggtagtacggacgcttctttgcaccgtgacgggcgagacgaatcttaactgccaaaacaaaactcctttacacgcgcggcgccggggttagttgagtttgtgcgccgcatagctgcaatcagcgactctatatgatacgacaccccacgggagtctcaaggtgtcgtttctgtgaaccttgtggagcatttttgcacgcaaaatggcgcgtgcgtactttaagacgcaattaagggcacgtgcctatattgctactagaaacacggaattcagctttccaaaggaggaagccacatgaacgttctggttgtcgaggatgagaggaacctggccgacgcaatcgtgaggatcgtctcggacgcgggattcaactgcgaggccgtgtatgacggcaacaccggactcaccgccgcggagagcggtctgtacgacgcggtgatcatggatgtcatgctgcccgggctcgacggcatccagatcacgaaggagctccgccacaagggcaactccatccccatcctcatgctcaccgccaggacgtcaaccacggacaaggtcgagggcctcgacgccggcgccgacgactacatgaccaagccgttcgaggcacccgagctgctcgcgaggcttcgcgccctcacgcgcaggcagggcgacgtcgtgatcgacaccgtgacgtttgcggacatcacgctcgacctcgagacgcacgacctctcctgcgggccccacacggtgcacctgtccggcaaggagttcgaggtcctcaagatgctgatgagctccaacgcccgcgtcgtgtcaaagcaggaccttctcacccgcgtgtggggcgccgacgccgaggcgtccgagaactccgtcgaggcgtacgtctcgttcctgcgcaagaagctcaaccacgtccactcgaaggtccagatcacgacgcttcgcatgctcggctacaggctcgaggtgttcgacgaggagtagcggcggtatccgcacatgataaagaagctcaagcgcaagttcattcttatcgtcatgacgctcgtggggctcgtcctcgcgggcgttctcggcatgtcgctgtattccacctacgtcaaccagcagaacctcatcaacgaggcgctcgaccgcaacctcgagggcagcatcgactccgtgcccgtcatcggcgcgcagcacgagcccggcgacggcaagcagcacggcaacatgctcgcgctcgggatcgagatctcctccgagggcgtcgtgctccagaccagcgacgcgcccgtcaacatcaacacgagcgtgctcaagcacgtcatcaagctcgtgctcaagtccaacgagtcccagggcaccattcgcaagaaccacgtctcgtggaagtccgccaccaccgcgacgggcagcatccgcatcgccctggtggacacgtccgccgtcgacgccacgttccagaacaccctcataagggacctcgagatcatagtcatcggtcttctcgtcctctccgtgatcacgtggttcctggcggattgggcactcaagcccgtcaagcgcgcctgggagcagcagcagcgctttgtggcggacgcgtcgcacgagctcaagacgccccttgcggtcatcatcgcgaacacccagatattggagaaggacacgtccatcccggcttcgagcaagcgctggatcgacagcacggaggaggagtcgcgccacatgaaggcgctcgtgaacgacctgctgcagctcgcccgcgctgacgagagctccgccggcatcacggacgcgctcaagcgcgaggacgtggacttttccgacctcgtgggcgaggcggcgctggagtttgacgccgttgccttcgagcgcggcatcactatagacgacgacgtgaccgagggcatccacgtgaacggcgactcggagtggctcgagcgcctggtcaagatcctgatcgacaacgccgtcaagtacgccgacgcgaactcgacggtgagcgtcacgctctcccgcaagggcggaaagggcggcaaggccaagggctgcgtgctcaaggtcaacaaccgcggaaacgtgatctcacccgaggacctcaagcacatattcgaccgcttctaccgctcggacaaggcgcgcagcaggaccgacggccagggcggctttggcctgggccttgccatcgcgaagggcataaccgaggcccatggcggctccatcgcgtgcacgagcaccgcggaggcgggcaccacgttcacggtcaccctctagcgcgtggcaacgcgggcgcgccgccctataatccttcccatggaacacgtttcggacatggcagaggcggagggcggcatggcgctcccctggtccggcaaggccataggcctgctggaccttgacgcgttcttcgcatccgtggagcagctggaccaccccgagtggcgaggcaagcccgtcatcgtgggcggctccgccgaccgtcgcggcgtggtgtcgacggcgtcctacgaggcgcgccgctttggcgtccactccgccatgccgtcatggcaggccgagcgcctctgccccaacgccatctggacccgcggccactacgaccgctaccgcgagatgtcgcgcgcggtcatgtcgctcatcctggacgagacgcccctggtggagcaggtctccatagacgaggcgttcttcgacgtcacacccggtcgctactcgcgcgagagccccatcgcgatctgccggcgcctgcagcggcgcgtggcggagctcggcatcacctgctccatcggcctcggcaccaacaagacgatcgcgaagatcgcctcggagcgccagaaaccccgcggcatgacggtcgtgcttcccggtacggaggcgcagttcctggcaccgcttcccgtgggagcgatgagcggcgtgggctccgcaacggaggcacacctgcgcgagatgggcatcaggacgctgggcgacctcgctcgacaggacgaggagcgcatgcaaaggtcgttcggcatacagggcccgcggctcgtggagcgcgcggcgggacgcgaggtgtcgaccgtacgcgcggaggccacgcccgcggaggtcaagttcgtctcgaacgagcgcaccttcgcccacgacctcacgagcgagcaggacgtcactgccgccatcaggatggtgagctcgctcgtgggcacccggctgcgccgcaagggcctcaggggccagcaggtcacgctcaagctgcgcttctcgctcaagaagacgaggaccgcccaacgccagttggacggtcccacagacgacgagcatgtgtttggtgcggccgccgtcgagctgctctccggcatctggcaacccggaacgccggtgcgcctggtcggcgtggcggtgagcggctttggccccgcaaggccccatcagcaaaggctggagctcttctcgcccaatgcgggcgagaaggacgaggcaccgcaggctgacgccaggcctcacagggacctcagggcgctctccgtggccgccgacgaggtgcgcgcccgctttggcagggacgccctcaacatggggcgtgacctcaggatcgggcgcgacgcctcggacacgtcgcccatgaacaagccggacgaaacctgacgtcccagccgcgcgacggcgcctgatggcaccccgctactgctcgagctcgagcggcacgcgcggggcgtcgccccagaggttctccaggcgatagaagtccctggtctcaggcttgaagacgtggcacacgagcgagccgtagtccatgaggagccaaccggagccgccgcggccctccgtcgagatcggcttggtgccgcactcctcgagcacgcgcttcttgatctcctcaaccacggcgtccatctgcgggttgttctgcgtggtgcagatgaggaagtagtcgcacacgtccgtgaggccgcgcaggtcgagcagcacgatgtcctgcgccttcttggcgtcggcggccgccgcggcgacctttgccatatcgagtgattctgccatgtgagttcccttccgccttcctagcgcgactgcgcgcgccgcaggacgagcttgttgtagatgtcgagcgttcccggatagaggtagcgcctggtgtcgatcacgtacgagagaccgccgcagaacgactcgtagtacacgtcgtcgagcggcgccttgcccaccatctcacgcacgcgctcgatgccgggcgacgacttgcggagcggctcgataccgtccgccacgaagacgacctcctgcagcggcgtcatgtccgccgcgcccgtggtgtgccgtgctatggcgagaaacacgtcccccgggagctccggatagagctcgggaagctcgcgcgccgcaacgaccccgtgcaggagcggcctcacgagagagaggtcaacgccgaagtcgatccccagggacatggcgcgcgcctcgagctcgtcgtcaggcacgaccttgtcccagtcgtgcaggatgcccgccgtcctggcgaggtacgggtcgacgccgtactcgagtgccatcgcctccgccgtcttagcgacggaaagcgagtgcgcgagccgccttggcttgacgtcccgcatgcgctccgtcacgtcatgctcgagcttctcgatctccgcccgttgcgcgggcgtgtacgctggctccgccatgcaatcactcacgaccttccgcgcccttggagccgtagcccagctggctcgccccatagagcttgtgcttgtgtatgtacccagtcacggcgtccggcgtgaggtagcgcaggctctggcccctgcgcacccgctcgcgcaggtagctggatgatatggcgagcgccggcacctcgaggtacgtgacgtcaaagggcaggcccgacttggcgatggcgctcttggcacgggcgaggtcgtagccagggcgcgtggcgcccacgaacctggcgagcgaggccatccgccccgcctcgcgccagctcacgatgtccgcgatcgcgtccgcgccggtgatgaagtagagctccacgttctcagggtagatggcccgcaggcgctccagcgtgtccgccgtgtacgtgatgccggggcggtccacctcgaagcggctcgccaggaagtgcgggttgtccgacgtggccagaagcgtcatcgcgtagcggtcctcgccggcgcttacctgcttgtcctgcttgaaggcggggcgaccggccggcatgaacaccacggtgtcgagccccaggtcgtcaaaggcctgctcggcggccacgaggtggccgttgtggatggggtcgaacgtcccgcccatgatgcccagcctataggtgcgcgatggctcctgcccaagcgtgggcagatcgccgcgctccaccacgtcggcggcaacctgttcaatctcgtcgaggctcagctccatcttccctcctagaaaaccagcagctcgtcgcggtgtatgacgggcaggcccgccttgtcgggcatgaacctggcgatgacgtccagcttgaggccgtgcacgcgcgatatgtcctcggacgagtagcgcgtcactcccctgccgatgagggtgtcgccgcaggtcacgttcaccacgtcaccactcctgaactcgcccacggcacccgccacgcccacggggaggatggaggcgccgccctcgcgcacggccctgctcgctccctcgtccacggtcacggtgccgcgcggcatctccgcgaggccgatccagagcttgcgggcgttctcgtgctgcgcgtcccgaggcgcctcgaagcgcgtgccgagtccttcccccccgacgacgcgctcgagcgaccgctcccctcgtccgcgacacaccaccatcgggatgcctgccgcgagcatcgcgcgcgcggcgcggatcttggaggccatgccgcccgtgcccacggaagagcccactccgcccgccatggcggatatctgcggcgttatctcgctcacgcggccgatcagccgggcctccgggtccgtcgacgggttcgcggtgtagaggccgtcgacgtccgagaggatcacgtactcgtctgcgttgagcatcgtcgcgacgatggcgccgagcatgtcgttgtcgccaaaggtgaactccgtggtggacacggtgtcgttctcgttcacgacgggcaccgcgccgagcgcaagcagcttgccgagcgtgttcctggcgttgaggtagccctcgcggtccgtcaggtccctacgggtgagaagaacctgcccacagggcacgccgcgccttgccagctgctcggcgtacacctccgtgagcgccgcctggcctgcggaggcgcaggcctggcgacccggcatgtcactggggcgactgtcgaggcccaggcgctccatgccggcggccacggctcccgaggagacgacgaccacgcggtagcccttagaggtgaggttggcggcctgctcgcagagcgagccgatgaacgccctgtcgggacgccccgagtcgtccacgagcgtggacgagccgaccttcacgacgatgacgtttggggtctcgaagatctcagacatgcaggacctctgtctccccgccgtcctcgtcgccatcgtcgagcacgaccaggtcctcgtcctcgttcagctccgcgaactcgtcgtcctggtccgccccctcgtacgtgaaggcgaagccgaggatcctgacctcgtccccgttcttgcagcccgcgtccgcgaggcggtcgtcgagaccgatgcggtcgaagcggtgctggaggtaggcgattgcctcgtcgttgtcccagtccgtctggatgaccatgcgctcgacggcgccgccgctgacacgccagatgccctgggactccatcctgatggaaatggcgttgtcgcgcctgcggcgctgcctctcggccctctcgttcagggcctgggaaagctcggtgtcctcgtcggacttggcggcgttcctcagcttgcgcacctcgacggacgtgttgatgacgagctcgtcgaggccctcgccggtgacagcggaaacctcgaagaacggacgcccgtccttctccgcggcttggcgaagcctctcgatggcgtcctcggtgcccggcatgtcgcacttgttcgcgacgacgatctggggacgctctgcgagctcggaggcgtatgcggcgagctcctcgttgatcgtcttgtagtcctcgacggcgtcccggccctcgtagccgcccgtgacgtccacgacgtggaggataagcgcggagcgctcgatgtggcggaggaactggtggccgaggcccttgccctcgctcgcgccctcgatgaggccggggacgtccgcgacgacgaacgacgagccgtccttggccctcaccatgcccaggttgggcacgagggtcgtgaaggggtagtcggcgatcttggggcgtgcggcggagatcctcgcgatgatggagctcttgcccacggagggcatgcccacgagcgctgcgtcggccatgagcttcatctcgagctcgatccagtgctcgacagcgggctctcccttctcggcgaacgccggggctcgcctgacggacgtgacgaagtggatgttgcccttgccgccgattccgccgggtgccacgatgacgcgctgcccgggatgtgtgaggtccgcgacgtcgaaggcgggctcgagcgtctccgggtcgagctcgtgcacgacggtacccacgggcaccttgaggacgaggtcctcgccgtccttgccgtgctttcgcgagccctttccgtgggtaccgcgctcggcacggaagtggtgcttgaacctgtagtcgatcaacgacgagagctgcgggtcggcctcgaggatgacgtttccgccatggccgccgtctcccccgtcgggacctcccttgggaacgtgcgcctcgcggcggaacgacatgcagcctgcgccgccgtctccgcccttcacgttgattcggcacacgtcagtgaatgtactcgatggcatgttggcctcctttgacgcttgcaatgttaagccatccgcgcgccatctcccaatggagggacggacggctcggccgatgcataagaaaacaccccaggccctctgttggacccagggtgcaagtcacgatgtaagggtgtgactaggcggtgcggacgtgcacgtagtgcttcttgcccttgacgaactcgacggtgccgtctgcgagcgcgaagagggtgtcgtccttgccgcgaccgacgttgtcgcccggcgtgatgtgcgtgccacgctgacggacgatgatctggccggtcttcacggcctggccaccaaagaccttggtgccgaggcgctgagcgttggagtcacgaccgttacgggaagtaccctggcctttcttgtgagccataatctacctgctctctttacgaagtaactataaaacgaactactcggcagcttcctcggtagaggcagacttggcagcggcagtcctggtggtcggcatcgaagtcacctggagcttggtgaggttctgacggtgacccttggtgcggtgatagcgcttgcgcttcttgaacttgacgacgaggcacttctcgcccttgtgctggtcgaggacctcgcaggtgaccttcttctttgcgagcgtggcagcgtcaacgacggtcttcttgccatcattaagcatgagaacgtcaagcttgaccttgtcgccaggctgcgcatcgagcttctcgacatcaaagatgtcgcccttggcaaccttatactgcttgccaccagtggtaacgattgcgtacatgtgttaacccttcattactggttctagtgcaacagcaaaacatattactagcgtccgaccgcacagtcaacggggaaacagcatcgacatgcagcgcacgcgcctagcaaaggatacctgcgttgaggctactcttcctgcgagggcatcggcttcacgagattgccattttcctcctcgtgccactggcccgttcggcagacccgcaggggcacgcgcgcgggtccggcgtcgccatccgcggggagaatcttggccagcgccgcgtcgatcaggatctgcggacgcagtgacccgttgtttgacgagcgggtgtcgagccggaggagaaggtcttctccctcagttgacacgtcccaaccaacgagggccgacgtgaggtcgatgcgcttctgccgctcgcccctcatgtagcggagctcgccggcgtcgcgcagctgcgagaacgtcgcgtcgaggtcgtgcggcgccacgaaccgtggcatgcggacctcccacgcggcgcggttgagccatgcctcgagggccggcagcttgcgagacacataggcggcggcgttgggcgcgaggccggtgggcgtggcgcccgcgagcatccgaagcgcctcggcgggttcgagcctctgcgttagcatgaggtcgtagtactcccccgcggacgaagcgccgacgggcagcgcctgcgagaactgcaggcggatgcgccgcgcgaagccgttgccgacggcaaacggcacgcacgagcgccggatcgagcggttgatggtgcccagcacctcgaggtgcccgaggtaggcgagcctgccgtccttcttgtagcggacgcggagacgcacctggttactggtgtccggcatgcctgtcacccacaatcgcaaggtcgacgccgagcttggggcagacgccgcagccgacgcagctcgtcatggtgcagtcgtccgtcgtgacgccctgggcggcgcgatgccactcgcgcttgaggaagcccttggagaccccgggcgaggtgtgctcccaggggagcctgcggtcgagcgggatgtccgtggacgcgatgtcctcgaggtcgaggcccagctccgcggcggcctcctgccagcgctcgaagctgaactcgtccgtccaggcgtcaaagcggcagccgtggcgccatgccgtgtagatcaggtcgaagcccgcgcgccccatcttggagaggacggcctccacgagcgagacctccgcgtcgtggtaggagatcttgatcgcgtggtcggggcaggtgtggagaaggagctgctgcctgcggcgcacctcctccaggcgtagctgcccgcaccactggaacggcgtgtgcgacttgggcacgaagaccgcgacggatatcgacacgctcacgccgctcttgggacccttgcccacgaccgtgcggccgatctcgagcaggtggtccgcgaccttgttgatcgcgacgatgtcgtcgtccgtctcggtcggcaggccaatcatgaagtacagcttcatgcggcgccacccgttgcgaaaggcgttttctgccgcgacgtctatgtccttctcgctcacgttcttgttgatcacgtcgcggaggcgctggctgcccgcctcgggcgcgaaggtgaggccgcccttcttggagccgccaacctcggccgccatgtcgacgccaaaggagtcgaggcgctgcgacgggatggacacgcgcacgccctggtcgcgcacgtcggcgttgagctggtgcaggatggcggcgcactgcgagtggtccgtggtggaaagcgacgtgagcgagacctcgtcgtgcccggtgatcctgaggccctccttggcggcctcgatcacctgctccgcggggcgctcgcgcacggggcggtacgtcatgcccgcctggcagaacctgcagccgcggcagcacccgcgcaggatctcgacggcgaggcggtcctgtaccacgtccatgtacggcacgatcctgtgcggcagcgggtccgttcccgcaaagtcctgcaggcagcgcttgagcacgacctcgggtgcgccggtgccgggccgcggaaccgcatagccccaccgggtcgagctgtcgtccaccaccacgtcgtacaggctcggcacgtagacgccctgtatgcgcgagaggtccagcaggatctgagccctaggcttgccggcggtgcggccgtcgctcacgcaggcgcacatctgaacgagcgcctcctcgccgtcgcccaggagcaccgcgtcgaacatgggcgccacgggctcgcagttccagaccgagggcccgccggcgatgacgatcgcgtcgtcctccgcgcggtcggcggcacgcaccggaatccgtgacaggtcgagcgcctccacgatgttggtgcaggccatctcgtgcgcgagcgtgaagccaaccacgtcaaaggatgctatgggagaagagctttccaacgcgagcaggggcacgtcgtgggcgcgcatcaggtccgccatgtcgacccacggcaggtagccgcgctcgcaggacatgccatcgaccttgttgaggatggagtacaagatggagagccccatgttgggcagaccgacctcgtacacgtccgggtacatgagcgccacgtggaagggaccgtcctgctcctcgatggcgccccactcgtggtcgaggtagcgggagggcttctctacctgcccgagcaggggctcgagccggtggtataggtcttctcgcctgagtcgcatgctaggcctcgcctatcacgatgtagccggagcccccggcactgcggtcgtcctcgtgcgaggtcgttgcctccagcagcgccctggggagctggcgcccctcgcgcggcacctcgtcctcgtggccaaaggccacctcgtcggcaccgcggtgggccgcggcgcgcacgcgatccatcacgcccgcgacgaggttgggctggttcctgacgccggcgacggctgccgtggccacggttcccgcatagcccacggccgagcggaccatccagtttggcagcggcaccgcggcctcgagcgccctcgcgacggcacggtacgccaggccggcccccgccacgcccgcgacgtccgccacgcaggagaggtccaccctcctgccgtgcgcggccgcgatgtcgagcgcgagcttggcctgcctcacggtcatgatggggaagtcggcaccgtggatgacgtcgacggcacccacggcggcgttctggagcgcagtgtccctcaccagcgagcgcaccacgggctcgcggcagaaggggaagttcgcggcaaaggctatggccttctcgcccgccgcgtccgcgacccactgcgagagatttgcctggagcgcgtcggcacttgacgcggcgaccggcgtgacgagcgccgccacggcatcgggaaggtcgcccgtcgcaaagtcgagcgcggactccaccacgacgcacgcggccacgccgcaacgcgcgtagccgatggccgtctgcgtggcatgcgccgcgtcgggtcccgccacgaccaccacgaggtcgcggctgccgtcaggcgcgccgcagttgtcgagcgtgccaacctcgacgctcgagctctcctgctccggcacgaaggcgtcgcggaccgcgagcaccacgtcgcgcggcgcgctcgggtccaccacgaccaggaggctgatcggcgtcgagcgacgcctctcgctgttgcgcccagcgctcaggacttccgctacgtcccgcaccgagaccctactctttcgcgccatgcgcaccaccttacctgggacggaccaccttacgccggactgacgccagtcgcgcctagccggccttcagcttatgatgccacacggactggaccatgcccaccgcggttatctgcaccagcatcgacgacgagccaaagcttacaaagggcagcgggatgcccgtgatgggcatgatgccgatgcacatgcccacgttctgcagcagctggaacgaccacatcgtggcgcatcccacgagcacgagcttgccaaacggcgactcgatcttgttcgccaggatgatggtcgagaagatcagccctccaaagagcgcgagcagcagcacggatcccacgaagccaaactcctcggcgagaagcgcaaagacgaagtccgtgtgcgcctcggggaggaagccgctgccggcctgcgtggcgtggccgatgcccttgccgagcaggccgcccgagccgacggcgatcttggcctgctggaggttgtagccgtcgcccgcggggtccacggaggggtccgcgaacacgatgagcctgttgagctggtactgcttgagcgggtgcggcatgccgggcgtcatggacatgacgaccacgagcgcgccgagcgccacgatgccgccgatggtcacgagcacccaggagcgcttcgcccccgcgcagatgatgatggcggcgccggtcacgaggatgatgaggccggtgcccaggtcgggctgcgtgaggatgagcaggaacggcacacagaggaagccgcagagcttgaggtaatcgcgcagcgtgtcaatcttgccgttgtactgcgcgcccagccccgccatgaggtatatcgtgacgagcttggcgagctccgagggctggaacgtcatcccgatgatcggaatcttgatccagccggtcatgcccagggccgtgtagctgagccccggcaccttgggcaggaacatgaggatgacgtcggtcaccagcagcgccgtcgtcatgttctgcagcgtgcggtagtcgtagcgccagatgagaaacgcgcccaccaggcccatggcgatgcccaggaggtgcctggggaaggacgcctccgcgatggagagcgacgccgagtagatgacgacggcgccgtacgccaccagcagcacggccgggatgagctgcgggatgtagacggagctgcgggcgatgtgcttgcccgtggagggacgggccgccatgccgcggcggttcatgatgtgggaatagaatgccgagaaggaccccaggcccttctcgttcaccttggccccctgggccgagttctgccgtgtctgccgtgccatcgtccctcccctactggacgccggagttgtccacggacgttgccgtgtcgggctggttgtagatctggccgaggatgtccctcaccacgtacatggctccctcgctgccgtagccgccgtactcgatcacggatgcgaccacgtactttggcttgtcgtagggagcgtacgcgatgaaccagcccgtgggctgggacttcgaggtctgggcggagcccgtcttgccggcgacggtgaccgagaggttcgtgaagtgctcggtctgcgcctcggactcctcgtagatcacgcccttgaggccggcgtggaccacgtcgaggtaggcctgcttctccgtcaccttgcgcatgacctgcggctcgtacgtgaccacggagccgtcgcccaggggcgacttgacgctcttgagcacgtgcggccggtacatggtcccgtcgcacgcgatgccctcgtagacgcagagcatctgcaggggcgtcacgagcaggtcgccctggccgatgacgaggttcgtcgtgtcgcctccctgccaggtcctcgagtcgctgtctgaggaggcgtagtacttgtacttccactcgggcgtcggcacgcggccctccgactcgctcggcaggtcgatgcccgtctttgagcccaggccccacttcttgtacgtgtcctgtagcccctcggggtgcttggagtagaagaaccccttgccgatctcgtagaagacgacgtcgcaggagaccgtgatgcccctctggatgttgaccgtcccgtgtccggcgtggtcccagcagtactgtccgaagcccttgccgaagcccgtccagtatccggagcagtagtaggtcgagctcgtggtcgcgatgccgtagttgagggcggcaaacgacgagagcggcttgatggtcgaggccgacgggtactggccggctatgcagcggttcatgagcgggtagtggctcgagtcgtccgagaggctcttccagtcgtcgctcgagatgccacccacgaagacgctcggtgagtacgtaggggccgacgccatggcgaggatctcgccgttcgtcacgtccatcgctatcgcgcatcccgcgtggcagtccgtcctgccctgcttccttagtgccgcgatcctcttggccagcgagtcctccgccgccttctgcagtgccgagtcgatggtgagcacaacgtcggacccgctttgcggctcgactgagctcgagtagctcaagacgtttccggatgcgtctacgtacaccttctgttcgcccttgacgccctggagcacgttctcgtactcgtactccacgccggcctggcccacgacgtccccggactcgtaggcgatgctcgacttgctgtcagacgaggacgacttcttcagctggtcggagctcacggttccggtgtagcccaacacctgcgccgccagggtcccctgcgggtaatgccgctgggtcctctcctccacgctcacgcccgtgaagacgctctggtgcgcgtcgataaaagccacgacgcgcctcgaaacgtccaccgcgaccggcctcaggctctgcgcgccgcccgtcgagtcctcgatgttgcgcttgacggccatctcgggcatgccgatcaggttcgccagaaggcgcatctcgatctcgtcgtccaccacgtccgacttcgcgacgacggtcagactcgcgcggttgttcacgagctccttgccgttgcggtccagaatcctgcctcgcgcggccgccgtcgagatggtcctcgacctgttcgactccgcctgctcgctgtacgagctcgaggacacgagctgcatggtccaaaggcgggcgagaagaacgccgatgatcgagccagagaatatccccagcccgaacagcctcgacttgaagccgccctcgctcgacatgtccgatccgccggacgcgcgaggcgccccgcctccgatgtcgaaggtgaagcgcgactcgcccctcccaaagaggaagaacgcgataagcagcccgatgagtacgagcgccagtacgatgattattacgacgatgggactcaagatctcaccttagatgttgccaatgttgtatctcgaacccttcttgggacgaccgccccgctggcgtccgctgaggcccgtaccgtcgccacgcgagtagaagatcgcgaacgggatgaacgcaatcacgctcaggaggaacgtcggcagcgtcctctgaacgatcacgtcgaagatggagctcgcctgacccacgatgagcatggccaggtggtagaagaggctcaccagcagcgcatgtatcgcgtacaggatcatcgagggacctatctcccccgccagacggttcctgcactccatgcccatctggaacgaggatatggtgagcagcagcgccatgagtccgatggggcccgttgtggacaggtcgaagaccagccccgcaagaaacccgcagaagactcccgtcctcccgccgatggtcagcgccaccacggcggagaagatcagcgcaaagttgatgcggccgtttccaagggcgaggttcggtgccacggcgagctgcagcaccagacaggccagcgcgagccagccgatgctcctcttgttcttgttggtgtccttgacctgcacgcttactcacccacttccgatttgtcgaaagtccctccgatgctccctaagggatggttcctaggaggagctggagctgctgtcgctgctgtcagaactcttggaggagctcttgctcgagctcgaggagtcctgcgagtcggcggacgtgatgtcctccgacgtggcctgctggtcctccgtgagcgacgtgatcacgaggacctcctcgaagttctccgtggtcgacagcggcttcacgtcgatgtcatagtagagcgcgccggcggacttgtttacgctcattacggtgccgatcggcaggccctttgggaacacgccacccaggccactcgtgaccacgttgtctcccaccttgaccgacgtgtcggtgctgatgagcgtgagcttgagcgttccatctgagctgccctcgagtatgccctgtgccctgctcgactggatcatcgcggagaccctggagttctcgtccgtcagaagcctgaccgtcgcggaggtgccgccacagctgatgatctgcccaatggcgccattcgagtccgttacgggcatgccgacggcgagccccgaggtcgatcccttgtcgatggtcacgtcgtcgctccaggaggacgttgccccagagatcaccctcgcggccgtggacttcagcttgtaggtactctggagcgcaagcagcttctcgagccgctcggaggtcttctcagcctccttgagcttcacgttgctcgccttgagcttcgcgttctccgacttgagctccgacagcgacttctggttcgccgtcaggttcgagaatatgttcccgagtccctggaacggagccgtcacgacgacccccacatagcgtacgggcgtggtgatcgtggagtacacgctcctgacgcccgtgaagaacccgccattggactcgcgcgcgctcatggtgaacatgacgagggagagaacgacgagaaccaccgcaaggcggctcccgtttccctgcgtatccttatgcagacccgaggaggacaggcctcccccgttcatagtcggcaatcgccccacctgctagcttgcgctctggacaaagccgccggagagcgcgttggcctcgagcacctttgcacagccgttcaccacgttctcgagcgccgtggggctcacgttcacggggactccggtctcctcgcggagcctctggtcgaggccgcggagcatgccgccgccacccgtcaggagcacaccatagtacatgaggtccgatgcaagatcgggaggcgtcacgtcgagtgcgtccttaacggccttcgtgacctcgtcgaggggcttgtccagggcacgcctgatctcctccgactcgatcctgacgctcttgggcagaccactcatcacgtcgcggccgttgacctcgacgtcgagctcctccgcaagcggcgcggcggatccgaccttgatcttgatgtcctcagcggtcctctcgccgatcgagaggttgtacgcgtcgcggacgtgctcgaggatcgtctggtcgaactcgtcgccagcgacgcgaatcgactgcgacacgacgataccgcccattgcgatgacggcgacctcggtcgtaccgccaccgatgtcgacgaccatggaacccgtcgggtcctcgatgggcaggtcggcgccgatggccgcggccatgggctcctcgatgaggtatgcctgcctcgcgccggccgagatcgtggcctcgaagaccgcgcgcttctcgacggacgtgacgccggacggaacgcagatgacgaccctcggcctcggggaccagggatagcgccgcgtcccgcgggctttctctatgaagtagcggagcatgacctccgtgacgtcaaagtcggcgatgacgccgtccttgagcgggcgctccgcgatgatcgagccaggagtcctgccgatcatgcgctttgcatcggcaccgacggcaaggaccctgtcctcgctcttgtcgatggcaacgacggagggctcgttgagcacgatgccacggccgcgaacggccacgagcgtgttggcggtgcccaggtcgatggcgaggtctccgtcattttcgccgaagagtgagtcgatgatcgacattgcttcctatcctattcccatacgggcagccctgcccgaggccaatcgtgaatcctttgggctactcgcccgtagagatggtacccgtggtggagccactctgagacgtcgaggagctactggacacgtcagttccactattcgagctcgtggaagagtccgcactcgacgtggacgagtcgctcacggacgcgtcggaaccgttgctcgaggcgtacaggggcgtcacggccgagaccttccagccgatgccatccctcacgagcgtgatcttgtagctctgggttccgccagcggagagcgtcgcggtcgcggtgacggtggacgtgcgcatcgacttatccaggccgtcgatcgtgaccttcgaggtgctcgtgggaaggagactcttgatctgcgagcgctccgagctggagaggctggagctcaggtagctcgagacgtccttgctcgaggagccagccgtgaagaggtcctcgacgacggactgctgcgtgggccagccatagcccttgtagtacgcaaacccagcgactccggccgcgatgatcaggatgatgaggatggtcaggaacgccttcaggccacggtggctcttcttgcgcctcaccttacgctccttgcgggccttcttgtcctgcgcgacgaggtcctcctccttgacggagaagaagccggtgtcctcgggagagggcatgaactcgcccgtctgtcccgtggggtcgagcgggtcgatcgcggcgccggtgccatagccggcggcggcgagaaacgcgtcggtctcggagggagagccgtcagtaatggcggcaacggccttcttggccgcctcgaacgctgcctgcgcctcgggcttgagcttgtaggagccgtccttcgtcgcacgggagaaggcgtccactgcctcggtcatgcggttcgcggcgacgtaggcgaggccgaggtcaccgtagatctcgttctggctctctgcgggagtcgtgaagtcgagcgcggtgcggtacgcctcgacggcgtcgacagcacgtcccatctgcatgaagcatccgccgaggttcttgagcgcggagctgggatcggggttcttctcgtcgattgcggcgttcctgtatgcgacgcccgcatcacgaacgttgccgacgcgcatataggcgttgccaagcgccgtgtaggccttgtagggagtcgggtagtcctcgtccttgatggcgagcgacagggacgcgattgcctcctggggcttgttcgcggcgagaagggcgcggccgcggttgcacgcgagtgcgccggagtggccgtagtttgcgtccccgagggcgttgccgtaagaatttgctgcctcggcgtagcggccgagcttcatgaggcagttgccgagcaggtgatcgacagcgccagacacctctcccggggcctttgcggccgagagctgagccacggcgccagcgaagtccccacgcttgtacgcgtttttgccggcttcgaatgcttgctgattcatagtgcccctttaccgagtgtttatagaagtttctggctactcagcgtgctcgatcctgatcgactcgatcacgtcgccggcccgaaggctcttgacgacgtcaagcccctcgatggtgttgccgaacaccgtgtagttgggatcgaggaagtgctgggcgcccaggcagaagtagaactgcgaccctgccgagtctggattctgcgagcgcgccatcgcgagcgcgccgtccacgtggctgttgcggggattggtgtcgtactcgtgcttgatgcgatacccggggccgcccgtgccgggcattccgtcgggaccggcgacgcccgccgcgacctgctccggtgtcatgtccctggtgttggggcatccgccctggatcacgaagtccgggacgtagcgatggaacttcagtccgtcgtagaagccggagctggcaagctcgcagaagtttgccacgtgaatcggtgcgccgtcgccatcgagacgcgccttgatggtgcccttgctcgtctcgaacacggccacctcgtcacccgcgacctcgtactcgggcgtgtagacgggctccaagaagaatcccatgtcagtccctccagaatgcaggccatatccctggctcgccatcgttcatccaaccaattctagcagcagggatattgtttcacatattcggcagaacgctaccgtgcctagctcgatttcttctggggcttccaatccttgtagttatcctcaaagagcttcttgtaccggtcggttattgagcttccgtcggtgtccgtgagcggctccgcgatgatcttctggtccgcctgcgggtcggacgacttggcggagcgcttccacgcgtcgtagagcgcatccatcctgttgcgcatgtagttgccgagcgacgtgaggttgtttgcgtcgtcggtgtaggtgcccgacgtgacgtctatctgcttgatgtcgctgatgaggttgctgatctcgtacacgagcgcctgcgcgttgtcgcagcccgcctgacgctccgtctgcgtaccggaataggcgatcttgtcgaagttcttctcgctcgcgtcgacctttgcctccagcttcacgagcttcttgtacgcgctcgagagcttcttgtacgtggcgtcgtcgcccgaagtcaccttctgggaatcggagctcgacgaggagtcctggcccttgagctcggtgatcttgcccgggtagccggccatggaggtgttcgcgtccgtcttggcacgagtgtcgaacgcctgggggttccagggatgggtgacgagaaggacgaatccgcacacggccgccacggctatggccatggtgatcaccatcacgcgggcgcgcggcatgcggtcgtgctccgcgacggggctgtcgccgtcgtcctccggcgggatggcgctctcgatgcgcggcatcacgttggtgcgctcgcggtcggagttgaggtcgcccgtcgcctcgcccgcctcgatcgcactctggcgagggtcggcatcgtccgtctggcccacgggcatcccgcagtgcgggcacaccgtcgcgccatcgggaacaagcgaaccgcagctctcgcaccacacgccctcggccttatggggctttgcggggtgctcgaggtcgacgtgacacgccgggcactttgccaggccgtcaggtatgttcgagccgcagttgggacaaatcacgattgatgacctccaggtcacgagcactggaagggtcgccccgtcgccttgtggacggcggggcgaccgacgttactccgaaagctcctcgagaacgtacggcaggatgccgcccgcagaaagataaccgccctccatgggcgtgtccaccctcaccacgcagtcgaacacaatcttctccccgttcggcttcgtagccgtcacggtcgccttgcggtcgcggggcaggccctcagacacgtcgacgggcgtgacatcgaaggtctccgtgccgtcgagaccaaggctctcggcggagtcgccgtcctggaactggaggggcagcacgcccatctgcacgaggttcgaacggtggatcctctcgaagctctgcgcgatgacggccctgacgcccaggagcgccggacccttgcccgcccagtcgcggctcgagccggagccgtagagcttgccggccacgacgaccaggggcactccgtgctcgcggtagtcgacggacgcgtcgtatatgctcttgacttcgccgtccaggaagtccctggtccaaccgcccttgcggccgtccgcgagcgcgttggagagcttgacgttggcaaaggtgccgcgcgccatgacctcgtggttgccgcggcggctgccgtacgtgttgaagtccctgggctcgataccgtgctcgcgcaggtagcgcgccgcgggcgagtcgggcgcgatggcgccggcgggcgagatgtggtccgttgtgacgaagtcgcccagcagcgcgagcgcgcgggcgcccctcacctcgatcacgtcggtcggacgagcgatgtcgaagtacggcgcacgcctcacgtacgtggacttggggtcccagtcgaaggtgctgctcttgcccgcgtcgatctgcctccacacgcgcgagccctcgaacaggctcttctcgccctcgctgaagagctcgggtgtgagctgcgcgtccaggaccgccttgacctcggcgtccgtgggcatgacgtccgaaagcatgacgggcttgccgtcgccgtcgaggccgaggggctcgtttgcgaggtcgacgtccacggtgcccacgagcgcgtaggcgaccacgagcgctggctgcatgagatagttctggctcacgtagggcgagatgcggccctcgaagttcctgttgccggaaagcacgctcgtgagctcaatcctggaggagagctccttgagtgcgggaaggatgtcgccggagttgccgatgcagctcatgcagccaaatccgcaggtgtagaacccaagcttgcgcagcggctccgcgaggccggagcgcgcgagcagaagcgacgtcaccctggagccgggcgcgaggatgcgcttgacccacggcttggtggcaagcccgcgctcgcaggccttccgcgcgagcaggccggccgcgaccatcatggcggggtcggtcgccgtggtgcagctggtgatggccgcgatcgcgatggtgccgtggccgaggctcacgtccttctcgcccaccttgacgtcgaagcgctcggcggggtccttgacgccgtgggcggcgagggaggacgagaagcgctccctcagggtcgcgggcgtcacgcggtcgtgcggcttggacgggccggcgaggctcgtctggacggtcgcgaggtcgagctcgaccgtgcgcgagtacgtgcggccgctggtggcgccaaagacgccctgcatgccgaggtaggacctgatgagcccgacgcgggcctcgctcctgcccgtgagggtgaggtagtcgacggactgctcgtccaccgggaagagcgtggtcgtggcgccgtactccggcgtcatgttggcgacgcaggcgcgctgcgtcgcggtgagcgttgccgcgccgtcgcccgtgacctccacgagcgtgccgacgacgccctccgcgcgcaggcgctgcgccaccgtgagcgcgaggtccatgccgctcacgccgtcgcgcagcctgcccgtgaggcgcagctccacgacgggcggcacgagcatcgtgatgggctggccgagcgccgcggcctcggcctcgatgccgcccacgccccagccgagcacgccgaggccgtttgccgtggtggtgtgcgagtcggtgccgaccagcgtgtcgaagcacgcgaccggcagctcctcgctggagagcgtgtccctgctcacgacctcgctgaagcgctccatgttgagctggtggcagataccctccccgggcggcacgatgcgcacgttgtcgaaggagttggcggcccacttgaggaacgcgaagcgctcgtggttgcgctctgcctcgcgccgctggttcttctcgaccgcgtcgtcctcgcccgtgacgtccgcgatgacggagtggtccaccaccagcgtgcacgggatgcgcgggctcacctttgcggggtcgccgccgcgggcgaccatggcgtcgcgcatggccgcgaagtccacgaagaccggcacgcccgtgaagtcctggaagagcacgcgtgacggcatgaaggggatctcctcgccctgcttgccggcaaggcccgcctcgaccacgcgccgtgcgagctccgtcgcctcctcgtcagtggacgccctgcgcacgcagttctcgagcagcgtcacgagtgccctgggcagcctcgacgcgccggggatggcggacacgtcgtaggcgaggaagctcttctcccccacctccaggcgcttgggcctgcgtgcggcgctaaccgcgtctgcgaactctttgctcacgctcattcagcttctccaacctcttgataaggaacccgacgaggcccttggcccctccctcgcgaacggattcgtcgtacagcctgttgaacaagactatcgccaaaacggcgaccacggtcgatgctaccgcagaattaaccgtcggggtggctatggagaagaacgaggcgcccagggtcgtgcccacgcctatggtcgcgagcacgatcgcgagcacagcgaccctcagcgggttgagtggacgcgatatgcggtagatgagcgcgacacccacgacgagcatctgcatcatgcacatggtggacatcgtcgcgtccgaccagcccagcgccctgcagcagcagatggtcgcgaccagcgccgccacgatggagagcgaggccggcagcgagctggtgaggacgtttgatatgaagcgcccacgcacgcgttcgtggttgggctcgagcgccagcaggaaggacgggatgccgatgacggccgcggacacgagcgacatctgcaccggcacgaagggatagggcggcatcaggatgcagaacgcggcaagcaccgcgctgaagaacgtcttggtgaggaagagcgccgcggagcgctgcaggttgttgatggagcgtcgcccctccgccacgacctcgggcaggtgcgcgaagtcgttgtccacgagcacgatctctgccacgttcctcgcggcggccgacccggaggccatggccacggagcagtcggcgtccttgagcgcgagcacgtcgttcacgccgtcgcccgtcatggcgaccacgtgcccctcctcgcgcagcttccgcacgatctggcgcttgacctggggcgtgacgcggccgaacacgcggcagtccctcaccgcgcggtccacgtccttctcgcccgaaagggtcgacgcgtccacgtagcggtcggcgtccggcacgcccaccacgcccgcgatgcccgacacggtgcgcgggtcgtcgccggaaatcacgcggatctggacgccctggcgcttgaagaactccatggtctgcgccgcggtgtcgcggatctggtcgcggatgcccaagaaacccagcacctcaggcttgccctctatcgagccgtcgggcgcaaagccgtccacgcgcgccaccacgagcacacgcatgagctggtcaaagccgtcaagctctgccctgacctccgcagcgcgctcgcccagcacgaactgcgccgcacccatcgcgaggcaggtgccgtccgccgtgacgcagccagagtacttggtcctggacgagaagggcacggcccgcgtgacggcaagcggctccacggcgtgcgcccttccgtactcgatgacggcgcgggccgtctcgttcgcgtcgtccgcgctcgcgtgcgcgatggtcacggccgcctgcgcggcgtccccgcgcacctccgcgacctccatggcacccgtcgtgatggtccccgtcttgtcgaggcagagcacgtccacgcgcgcgagcgtctccacgcagtacgcctgctgcacgaggacgttgcgcatggccaggcgcgtcgtcgcgatggcgaggacgctcgaggtgaggagcacgagcccctgcgggatcatgcccaccacggccgcgaccgtctgcagcacagccgcgttgtagtcgtactttcccgtcaggatgatccgcacaaagagcaccggacccagcacgagcaggcacgtggtccccaggcggatgatctcctccagggcggagagcatctcggagttgacgcgcttgacgtacttggcctccgcgttgatgcgcgcggcaaagccctcgcgtcccacgcgcgtcacgcggtacacaaaggcgccgctgtccacgaaggagccggacaggacctcgctgcccacgttcttctctattgcgtcgctctcgcccgtgagcaggctctcgtccatgcggggcgagccctccaccaccacgccgtcggcgggcacctggtcgccgtgtgcgagagccaccaggtcgtccagcaccacctcgtgcacgggcacctgtctgcgctcgcccccgcggatgaccgtcacgtcctttgccgcgacgatcgtgagccggtcgaccttgcgcttggcccgtacctcctggacgatgccgatggccaggttcgcgatgaccacgatcatgaacgcgcagttcttgtaggagccggtggagatgacgagggccgccatgaagacgttgatcgcgttgaagagcgtgagcgtgtgttcggccacgatctgccggaccgacttggtcttgacgtccgtgtcggcgttgaccttgccctcgcgcacgcgctcgcggacctcgtcgtcgctcaggccgcggagcggttcttcctcccgcgtccgggccgactgctccgtcgtctcaggtgccacctgtcctccttgtcagacccgccagatcgctaccacgccatgagtcggttcgagggtccattctatcagttggagaagaacgacggcgaaggtcgaagccccgcacctgccgccacgtcaaatcctgcccactcccgtggcacattttgcgcgggatgtcgtatactgttcacccgcgtggccccatagctcagtggattagagcgttcgcctccggagcgaaaggtcgtgagttcgagcctcactggggtcaccaaccggcagttcaagggcatccttcgggatgcccttttttgttcttctcgccctcttcctccaccggggccgtcgcgccgtcggcccgccttcatcaaacgtgcacggacgggctcaccaaaatccacgtttcgtaacgctttgagtacgcgaagccgcatatccaatatcttgcgttagcatcgtccccgtataggacgactaggtgcgcaggcacccgaaaggttagttagaaatgattgcaatcgttaaagactccgcaaccccggagcagctcgaccacttcgtgcgatggatcgaggaccgcggcttcaagacaaacgtgtccaagggcgagaacgagacgatcgtcggcatcatcggcgacaccacgcgcatcgacccgttcctgctcgagtcgatggacatcatcgaccaggtgaggcgcgtctccgagcccttcaagaaggccaaccgcaagttccaccccgaggacacggtcgtcgactgcggccacggcgtcaagatcggcggcggcaacttccaggtcatcgccggcccctgctcagtcgagggcgagggcctgctccccatcgcgcgcgccgtcaagaaggccggcgccaccatgctgcgcggcggcgcctacaagccccgcaccagcccctactcgtaccagggcatgggcgagaagggcctcgacatcctgctggaggcctctgccgagctcgacatgcccatcgtcacggaggtcatggacccgcgcgacgtgggcctcttcctcgacaagggtatcgacgtcatgcagatcggcgcgcgcaacgcgcagaacttcccgctcctcaaggaggtcggcaagaccaacgtccccgttctcctcaagcgcggcatgtccgagaccatcgacgagttcctcatgggcgccgagtacatcatgagcgagggcaaccccaacgtcatcctctgcgagcgcggcatccgcacgttcgagacgcgcacccgcaacacgttcgacgtcaacgccatccccgttgtgcaccacctctcgcacctgcccatcatcggcgacccgagccacgccacgggctacacccgctacgtgcgccccgccgcctacgcggcgacggccgccggcgcggacggcctcgagatcgaggtgcacgacaacccgtccaaggcatggtccgacggcgcgcaggcgctcacaccccagcagttcgaggacgcaatgaggcgcatccacgtcatccgcgaggccgtcacgatggacctcgacgagggcggcgagctctgatggcgcagcagaccttcactcccgaccgcgtcggcgtggtcgggctcggcctcatgggaggctccttcgccaaggcggagcacgcgggcggtcgcgaggtgtacgcctggaaccgcacgcactccaccgtcgagctcgcggagatcgagaccatcgacggcgagctgacggacgacgtcatcccgacctgcgagctcatcatcctggccggctacccccaggtgagcatcgactggctcgagcagatggctggcctcatctcgcccaacgcgatcgtgatcgacaccgtgggcgtcaagcgcgtcatctgcagccactgcttcaagatagcggagaagtacgagtggaccttcgtcggctgccaccccatggccggcacccagtactcgggcttcgcgcactcccgcgccaacatgttccacggcgcccccatggtcgtcgtgccgcccaagatggacgacttcgagcgcctcgacgtgctcgagcgcctcaagcacctgctcgagccctgcggcttcggctcgttcacgctggccacggccgcgttccacgacgagcagatcgcctacacgtcccagctcgcgcacgtcgtctccaacgcgtacgtcaagagccccgcggcccagagccacaagggcttctccgccggctcctacaaggacctcacgcgcgtcgcgcgactcaacgcccccatgtggaccgagctcttcctcgacaacgccgacaacctctcgcacgagatcggcatcctcatcgacaacctgcaggcatacaaggacgcgatagacgagaaggacgccaagcgcctcgaggagctcctcgcggagggcgaccgcctcaagaaggaggccgagcgcagatgagcacggacgtcatcaaggtcaacacgccgtcgcgctcctacgacgtcgtcgtgggccagggcgtgatcgacgaggtgggcgacctcacgcgcaaggcgtgcggcggctccgtcgcctgcgtcatatccgactccaacgtcgcgccgctctacgccaacgcggtcgcggagtcgctcgaggccgcgggctaccgcacgaccctgcaggtcttccccgcgggcgagcagcacaagcgcctctcgaccctgtcggacctgctcgagggcctcgcggagtccgagctctcgcgcgacgacgtggtcgtcgccgtgggcggcggcgtcacgggcgacatgggcggcctcgcgggcgcgctttacctccgtggctgcaaggtcgtccaggtccccacgtcgctcctcgcgatggtcgactcatccgtcggcggcaagaccgccgtcgacctcgaggccggcaagaacctcgccggcgcgttcttccagccctcgctcgtggtcgcagacgtcgactgcctcgacaccctcacgccggccctgttcacggactcgtgcggcgaggtcatcaagcacggcgtcatccgcgacgcggagctcttcaggaggctcgttagcaagcccatcaacgcgccggacttcgacccagcagagctccagtccgtcatcgtccgcaacatagagatcaagcgcgacgttgttgaccaggacgagcgcgagcgcggcctcaggcagatcctcaacttcggccacaccatcggccacgcgatcgaggccgcgagcgacttcaagctcggccacggatcgagcgtcgccgctggcatgtgctgcatcgcccgcgcgtccgcgcgcatgggctggtgccccgacgaggtcgcgacggacatcgtgtccgcggtcgaggcgtacggccttcccactgacacctccgaggaccacgacacgctcttctcctatgccgtgcacgacaagaagcgccatggcaccaccgtcaacgtcgtggtgcccctcgccatcggctccgtcgaggtgagaaagctgtcgctggaggagttcaggcacctcatcgaccttggctgcggcacgcaggcgtagggggagaagatcatggacgtaaccatcgagccccacgcgctcgcgggcacgctgcccgccgtcgcctccaagtcgatggcgcaccggctgctcatcctcgcggcgctctgccccggcaccacggacatcgactgcaacacgacctcgctcgacatcgacgcgacggtctcgtgcctcgaggccctcggcgcgcgcatcacgcgcacgcgccgcggcttcagggtgaggcccgtaccgcacgacgccgagcaaggtgcgcctgcggcggacgaccacgtgcccacgctcgactgcggggagtccggctccacgctgcgcttcctgctgcccgttgcaagcgcccttggcatgccggtccggatcgtcggtcacggccgcctagcgtcgcgcccgctctcgcccctgcgcgaggagctcatcgcccacggcgcgcgcatctcgcgggaggggtcgttcccgcttaccgtcgaggggccaatctccggcggcgcctaccgcatccccggcaacgtctcctcgcagtacgtgagcggcctcctcatggcggcgccgctcctcggcgagcccgtgcgcgtcgcggtgagcgagcccgtcgagtcccgctcatacatcacgctcacgcgtgcggccctccgggccttcggcgtcacggtccgcgtctcgcacgaggacgtggctggcacgccgtgcgaggtctactccgtcaattccgccaagctcgcctcccccggcacctgctccgtcgagggcgactggtccaactccgccttctggctcgccgccggcgccatcggcggccccgtcacggtcaccggcctcgatcctaagagctcccagggcgaccgcgcggccctcgccgccacggcactcttcggcgggcggacgtccgcctcgcaggagggcgtcaccgcgggtcacgcaccgctccacgcccaggtctcgagcgtggccaacatccccgacctcgtgccgcccctcgcggccatggccgcgtacgccacgggcacgacgcgcctcaccgacgcgggccggctgcgcctcaaggagtccgaccgcctcgcaacggtgagcgccgcaatcaacgcgctgggcggaacggcccgcgtcgagggcgacgacctcgtggtcgagggttcgggccgcctttccggcggcaccgtcgacgccgcaaacgaccaccgcatcgccatgatggccgcggtctgcggcgcctacgccgacggccccaccacgatccgcggcgccgagtgcgtccgcaagtcctatccggatttcttccgcgacttccgctcgctcggcggcgtcgcgcgcgaaagcgagtagccatgccttcaaccttcggcaacacactcaaggtcaccgtcttcgggcagtcgcactccacggccgtcggttgcgtcgtcgaggggcttccctccggccacgtggtcgacctcgacgcccttaacgcgttcatggcgagaagggcgcccggccagggcagctggacaacgccgcgcaaagaggccgaccttcctcgcatcgtgagcggtctcaaccccaagggcgcgacctgcggggccccgcttgccgtcgtgatagagaacaccaacacccgctccggcgactacgacaacatcctcgccgtcccgcgccccggccacgcggacttcacggcatgggccaagtggcacggcaaccaggacgtccccggcggcggccacttctccggcaggctcaccgcgccgctctgcgcggcgggaggcatcgcgctccaaatcctcgcaaagcagggcgtccgcgtggccgcgcacctcgcaagcgtcgcgaacgtggatgacgaacccttctccgcgctcgacaactcgccggaggcacagcagcgcctggccgcgcagatggacgcgcttgcagacggccgcaccttccccacgatcgacgagtcggccggcacgtccatgctcgccgcgatcgacgaggcgcgccgctcgctcgactccgtgggcggcattgtggagtgcgtcgcgaccggcatgcccgccggcgtcggctcgcccatgttcgacggcatagagaacctcatcgcgcgcgcggcctttggcatccccgcggtcaaggggctcgagttcggccgtggcttcgaggcggcgcgcctgcgcgggagcgaggacaacgacccctaccgcatgcgcgacggcaggcccacccccaccaccaacaacgcgggcggcgccctgggtggcatcaccacgggcgcgcccgtcctcttcaggatcgcgctcaagcccacgtcgagcatctcgcgcccccagcagagcgtcgacctcaccacgatggccgacgccgagctcgaggtccacggccgccacgacccctgcgtcgccacgcgcgccgtccccgtgacggaggcggtctgcgcgctcgtccttctcgacgcgctcgagtcgttcccggcagagtagccaagcacacaagcagaacccgggtgccgcgccgagcggccggacccgtcaggaggaaccttggaagacctttcccagatccgcagcgacatcgactcgatagactcgcagatcgtcgacctgttcaagcgccgcatggactgcgcggacagggtcgccgcgtacaagcgacagaagcacctccccgtgctggacaagtcgagggagcgcgctcttctcgcccgccgcgcctccgaggtgcccgaggacatgcgcgtctacacggaggtgctgttccagctcctcatggaggcctcgcgcaaccgccagaccgagcgccttcagacgcccagcgccacggccgaggccatccaggccgcgctcgcgcagagcccggcgtgcttcccgcgcgacgccttcgtggcgtgccagggcgtcgagggcgcctaccagcagatcgcgtgcgaccgcatcttccggcacgcaaacatcagctacttcgacacgtttgacgcggtcttccgcgccgtggaggagaagtacgtggaccttggagtgctgcccatcgagaacagcaccgccggctccgtcaaccaggtgttcgacctcatgatgcgccacaacttccacatcgtgcgcacgtgccgcctcaaggtcgaccacaacctgctggcaaagcccggcaccgggatcgaggacatccgccacatctacagccacgagcaggccatcaaccaatgcggcgacttcctgggccagctcaagggcgtcaaggtccacgcgtgcgagaacacggccgtcgcctccaagatggtggccgagagcccccgcacggacgtcgccgcgctcgcgtcgcgctcgtgcgcccagatctacgggctcgacgtgctcgcgtccagcgtgcaggaccagggcaacaactacacgcgcttcgcctgcatctcgcgcgacctcacgatcttcccgggcgccgaccgcagcacgttcatgctcgtcgtcaaccacgagcccggagccctctacaaggtgctggccaagttctacgcactcgacatcaacatcatcaagctcgagagccgccccatcccggaccgcgacttcaagttcatgttctacttcgacatcgactgccccgcggcctccccggagttcctcacgctcgtgcgctccctcgaggcgaactgcgaggagttccgctacctcggcagctacagcgaggtgatctaggtggcgcgctttggcctgctgggcaggaagctcggccacagctggtccccgctcatccacaagtgcctgggctccacgccgtacgacctgatcgagctcgagccgggcgaggtcgagcccttcgtgcgcgaggacaagacctggcagggcctcaacgtgacgatcccctacaaggccgacgccgcccgcctcgcggacgaggcatccacgcgcgtgcgcgagctcggcgtggccaacaccctcgtccgccgcgaggacggaagcatctacgccgagaacaccgacgtcctcggcttcggcttcatgctggaccagttcctgcgcgggcccctggcactcgacggccccgagccgctccgcggacgcgaggtcctcgtcctgggcgacggcggcgcgagccaggccgtacaggccgctctcgcccggaccggcgcggacgtccgcgtgatatcgcgccacaccgaggacgactactcaaacatccccgggcgccaccccaacgccttcctcgtcgtcaacaccacgcccgtgggtatgtaccccaagtgccccgcgacgcccctcacgctggatgacatgcgcgcgctccacggcctcgcgggcgtgctggacgtcgtctacaaccccgcgctcacgggcatctgccttaacgcccgccggctcggcataccctaccagagcggcctcgccatgctcgtctcgcaggcgctgtattccagcgagctcttccagggccgcacgctcgaccgctcgctcgtggcaagcatcgagtcgcagatccgccgccagacccagaacgtcatcctcatcggcatgccgggcgtcggcaagacgaccacgggacgcgcgctcgcgcacctgctcgggcgcccgttcgtggacctggacgacgccttcaggctcgagtacggcacgggcgccggcgactacatccgcttgcacggcgaggatgccttccgcgagctcgagacgcgcgtcgccgcggactacggctcgcgctcgagccttgtgatcgcatgcggaggcggcatcgtcacgcgcagtcgcaacgaggacctcctccgccagaacggcacgatcgtgctcctggagcgcccgctcgagagcctccccaagggcggccgccccatctcgcaggcaaaggggctcgagcagctcgcgcgcgagcgcatgccgctctaccgcgcctgggccgacgtcgaccttcgctgtacgggcacggcatcgggcgacgcgcgtgccatcgtcaagatgattggttgttaaggcctcatttcttgcgattcgtaccaacatccgttcatggagaatttcgcaacgcccaccagacagtccttctcccccgctggaaacgcttccgcgcttccctatacttctacgtttgtatgcaagtgtctaaagagggatgaggtcccaatggagacgggcgaggccgcaagggccgtactcaagaacataggcggcaaggcaaacgtggcgtccaacgggctctgcatgaccaggctcaggatcacggtcaagaaccccacgctcatcaaccggacggccctcaagggcgtccccggcgtcctgggcgtcgcgtccttcggcacgaacggcatcgaggtcgtctttgggccacgcgtcgtccagcgcgtgttcgacagcttcgcgtcgctcacgggcctcgagccggacatcgagctccctcccctggccaggggcgagggcagcggcatacacgtccagatcacgccaccggacaaggcgcccgcagccaccccgctggccgccgacgcatcccaggagcccgacgagttcatgctcaagacgctcctctcgctcgacgacgacgatgacgacgaggaggacgactccttcatggacgacgacacccttgacgatgatgacgagctcgaggagcccgacgcgggcgagaaggacgaggccccgtccccgtccgacggtcccaggctgctcgtcatcaacggccccaacatcaacatgcttggcatccgcgagccggacctctacggacgccaggactacgccgagctcatccgcgtgtgccgcgaggcggcggacgccgcgggcttctcgtcctgcgagtgctaccagtccaaccacgagggcgacatcgtggaccgcatccaggccgcgtaccagaagatcgacggcatcgtgatcaaccccggcgcctacacgcacacgtccgtcgcgatactcgacgcgctcaaagccgtgtccatccccgcggtggaggtccacatctccaaggtggacgagcgcgaggacttccgtcaggtctccttcgtgcgcctcgcctgcttcgagacgatcatcggcgagggcatccagggctacgtgcacgccatcagggacctcgcggagcacctgggggcgtagtcgggaagacccgaacccttcggcaagccatcgcagttcgcaattcggcgtaccgcgcgcagtctatcgctagtccgcaacgcgcctcgcacgccacacggcgccgtcgctcacgatcacgtccacgggaacgtcgtggtcgtcgtggggcagcgggttgccgcttatctgcatcgttcgggcaagccccaccttgaggccggggtatcccgccaggaagtcgtcgtagtagccggcaccgtagccaatgcggtagccctcggcgtcaaacacgaggcccggcacgaggcagatcgaacggccaagctcgtccggtcccaggggaagctccccctccgccggcacgggctcgagcacgccgcgcgtacccgcaaccagcccctcgagcgagtccacgccatagaagctgagccgggagccacgcaccccctgctcgcagcgcggcagcgccacctgcttgccatcggccagtgcacgggtcacgatgtcgcgcgtgggaaactcgtcctcaaaggggacgtaggccagcagccagtcggcacggaggtattccggcagcgtgcgaaggtgcaggcggacctccctgtcaacacgcttgcgatagcgcggcgtaaggcccttggatgccctgaggtagctctcgcggagtgcggacttgctcgcatcttccccataagaactggccatcggcaccctccccatatacaatcgcaagtctagaccatggccgccgcatgccgcggggcaatattgcatacggaaaaattgtaacagggaggaagccccagcgtaatgaggactgccaagagcatcgcggtcgacggcgtggaggtgtccgtcgtacgcaagcgcgtgcggcgcgtcaacctacgcgtccgccaggacggctccgtcgttgtgagcgcgcccgcccgcgtgcccctcgcacagatagaggagttcgtcctttcgcaccgccagtggatcgccaaggcccgctcgcgagccctcgcacgcgaggaagcaaggcgagaaggactgcgcgacggcggtcgcaccaggctcctggggcaggagctccccattcgcgtcgtggcggacctcccccgccgcaggagcccgcgggccgaggttgagggggacgcccttctcgtccacgtggcacaggacgccgtttccacggacaccgaccccgccggcacgcccgcaccggacccgcagcaggcgattgcgcagctcatcggcaccgctgttgaggagctgcgccgccgggagctggaggcgctgctccccgcgatgttcgagcgctacgagcccctcatgggcgtccacgcgagcgagtggcgcctgcgccgcatgacatcgcgctggggctcgtgcaacgtgcggacggggcgcatcacgctcaacacggagctcgccgcgcaccccgtcgcgagcatccagagcgtcgtcgtgcacgagctctgccacctgctcgagccaagccacaacgtgcgcttccacgcgctcatggaccgctactaccccgcatggcgcgaggccaagcgcgagctcgacgcagcgccccaggcccggccacggccctaggcggccgaacttctcgcccggtgccgcccgcggcgttacgccacggtgccccacgcgggggccaggcgggacgtgacgccccttttgccgtaggatagaggggttacgcgagaaacgattccgcaaggagaagaacatgcccaacgagggaagctacgaggcggcgctcaggcgcagccaggaagtcgaggcggacatcgcctccggcaaggtcgagaagtacaccatgctcaccggcgacaggcccaccggccgcctgcacctgggccactactttggcaccatcaaggagcgcgtgcgcctgcagaacctgggcgtgagcaccaacatcatcatcgcggactaccaggtcatcacggaccgcgacaccacagagcacatccgcgacaacgtgtacaacatggtgatggactacctcgcctgcggtatagacccggacaagacgatgatcttcacgcactccgccgtccccgcggagaaccagctcatgctgccgttcctctcgctcgtgacggaggcggagctccagcgcaaccccaccgtcaaggccgagatggaggcctctggccactcgctcacgggactcctgctcacctacccggtgcaccaggcctgcgacatcctcttctgcaagggcaacatcgtgcccgtcggccgcgaccagctgccgcacatcgaggtcacaagcaagatcgcccgccgcttcaacgagcgctacggcaaggtcttcccggacgtgacgggactcctcacctccacgccgctcatcccgggcctcgacggccgcaagatgagcaagtcctacggcaacgcgatctccatcagcatgaccgcggaggagaccgccaagctcatcaagaagtccaagaccgactccgagcgcttcatcacgtacgaccc

SEQ ID NO: 170 - DNA, 1768 bp, Unknown
  Metagenome-assembled genome
ctttctttagggaccgatctacggatgccgtacgcattgcaaggccatccgcattcaagcgagtcgcatgcgcgtaagggcaactggcgggacttcggctatcctcttccaaggaagagaccgggaggaatcatggctaacgacaagagcaggcagcacaagaagacggctaagcagggcggcaccggcgcgtccgacgcaaagccgaccatggacaaggcgcagcgcgaggccctgatcgacgaggcagacaagcagacgcgcgccatcatgcgccttgaggtctacaagcgcctgagctactccgtcgtcgcggttggcgcgcttctgatctactcgtacgtcttccagcacgccgcgttctggacctacgcgctgggtatcgtctgcatcgtgttcggcgcggctgcggcgatcgtcctctacatcggcgtccgcaacgccaagaagaacgtcaagcgcatccttgaggccgttggcgtcgatcccgatgccgtacggactaagaaggacgtcagggcagaggcgggggagaagagcaagcctgccgctagcaaccgcgccaagggcaagggtggaaagccgaagtcgaagtaacggcgactcgttcttctcgtctgcctgcgcttctattggtcgccactcaaagcctctcaagcgtccgcgtgtgccgcgggcgtttggattgcgcggtggtttgacggctggcctgcgagattcgcgcgaatatcgtatggtagaggggcgtgtgcaagacgaaaggactttgtgatggctcgaaagctgacgggacaggaacgcgacgacgcggaggcgctgcgcgacgcgatggtgcaggcgcttggtcccgcggacaggggctatgcgcctgggatttcgagcgcgctcgttcgcgtgaagggcggcaggatatcctcggacgacctggaccggattttgggcaagtacgacgtgagcgatgcggccctcaatcggatggtcaaggcggggctgctggttccggctgacggtaacgacggcgcctatgacctgcgcattcccgcgacggacgacgctgacgaggctgcgcgggacgatgatgccgcgggtgagggcgatgccgatcctgaggcgacggatgccgatcccgaggcggacgagcctgcgtccaccgatgacgacgatgactcgcagacggaggacgacgccgcggatgctttcgattctgatgcagatgacgctgcttacgatgcggatgtgcagacggaagcgcctgaggctgtgagcgattccgacgctgccgaggacgacgtcgacctcgaagccaccgatgcgggcgagaaggacgccgccgcgcccgaggccgactcggcagacggggacgccacgtcgcagcaagagcccgcagccagcggcaagaagccccgcaatgcccgccgcaaggagcagccgcgtcgcgacctcaagagcgtgccgtacgtgcgccgcggcagcgaggccgatgcggaggcgcgccagaagatcgtccagcttgaccagcgcttctggatgaacggctggctgctttcgcacccgggcgcattcaccatgtacgagcgcgagataaccgcaataaacgacgtgctgacggacggcatgctccccggcgacatcacgcggcggcagcttgcctaccagatgggcggggacgagaagttcttcgagtacgggagcgacgggttccgcctactgcgcgccatgggcatggaggacatcgtgcgccgccgtcccatgcccaagagcgacctgg

SEQ ID NO: 171 - DNA, 1869 bp, Unknown
  Metagenome-assembled genome
cgagaagatctccgaggcgaggcagcacccgctcaccatgcgtcgctacatgtggaagcttcagtattaggcgatgctgcatgtcgcaggccgtccttgcgcgggcggcctgcttttttgtaggcgaatccaccgagagggaacgctcttctcgcccgcgtggaacggctcgtttgggggtgtcgcatggcgcgtgccgtgctgtttgacatggacggggtgctcgcgttcacggagcagttctacaacaggcgtcgcgtggactatctggtggagaagggcttccgctttgactcggttcccgacttcagcggcagcaacgaccctgccatctgggaggcgctcgtgccaggcgacgcggagttgcgcaggcggctgcacgacggctatctcgagtacatggacgcgcaccccacgccctggcgggaggtcatgaatcccgacgcgctgcccgtgatgcacgacctgcactcgcgcggcgtgcgatgcgcgatctgctcgtcgtcgggaccggagctcataggggagttcatgcgggcggcgggggtcgaaccctacgtggacctttctataagcggggaggactgccgcgagttcaagccctcgcccgagatctacctcaccgcgatgggccagcttggcgtccgcgcgcgggactgcgtcgtggtggaggattcgcccatcggcattcgtgcgggcaaggcgtcgggcgcgctcgtttgcgcactgcgaccccggcccggcgtgagcctcgaccagaggggggcggacgtggtggtcggctcgctcagggaggtcctgccgcttgcgttgggaccgcatgccgtgacccacggcgattgatgccgggacggaggcgtgtgcgcgtatagactgtgatggcaggtatcatacgtttcgaacgtgagagatggcacggttgcgccacggggcgcgcgtttggaaggcacaggatgagaagcacggcaacgccgctctatcagcggatctacgacgacctcaagggcgccataaaggcaggcacctacaagaacggcgacaggatcccctccgaggcggagctcagccagaaatacgaggtgagccgcatcacggtgcgccgtgcgatcgaggacctctgctccgacggctacttggtcaagatgcagggacgcggcacgttcgtgggcgcgcggcacatcagcaggcacctctcccgcacgcgcgagatcagcacgttcaccaagatgtgtcaggagattggcgcacgccccggcgcgcgcgtgatagacaggcagatcactcccgggaggaacgacgagctcgagttctttggggtgccggaggggacgctcatgctcctggtgcgtcgcgtgaggaccgccgacgacctgccggtgtgcgacgagcgcgtgattctgccctacgactgggcccacgacctgctcacggtgccgctcgaggacgtgtccatgttcgatgcgatcgagcgcgcgctgggacgtcggccggaccacaaccccgtctggaccatcaacgcggtgaaggccacgaccgagcaggcgcagctgctcgacgtctccgccggcgacccgctcatcttcagcagtacgggctacgtcgacgcggacgagaggcccgtctacatcggccgcgactacttcgtgggcggaaggtacgagatcgatctctagcgggagggcgcgtccttctcgcccgagaacccccgacgaccttgtggccggcgggggctctcgtgtctattcatggctttagcctgtgccgcgcgtagcgcggcacaaagaaccacccgctatgcgggtggacggcactgatgctatgcaacaaaactccctcccctctaggatggcggttgttcaggtcgccggc

SEQ ID NO: 172 - DNA, 10969 bp, Unknown
  Metagenome-assembled genome
ccaggtggacgtgtacgagacgcccatgaactgcgcaacctacctcgtacctgccgcgatcgaggaggcggcgcgatgacgaacgcaacgcaagacaagcgcacggtgggcgagaagaacgagccaacgccctcgtggccgcttgcggtgctcgagctcgtgctcgggcttgcctgcccggccctgggctgggcgtacctgcgtgtggtgggcagcgccggcggctcgttcttctccaccgagggtcccgtgtacgagctgctgctggtggcgtggctcgcgtgcgccgcggtcggctccatcctggggatcgtcaagcgcaaccagatgcgcggcaacgtggtgtggcgcatcggacgcgtcgtgtgcgtggcgttcctcgcgctgttcgtggcgatgctcgcggtgattgccgtgttcatggtggccttcaccaagactaagtagcggcattgttatgattaagcgtgggggaattattattaaacccacacttcatggttttgagcctatacgagtgtgcccgtgaggaaattttcctaacgggcacaccaatctctccttgaattattaattttcattattgattttatatcgagtgcttcgtccatttccctctttgaaaagcctattttcatctacgagatccgagagatacctgtaagcctgtttgtgatggatgtggagcagggccgcaacttcacgggtagcaaccgaacctccttgctgatgagctagtttcatgatgagctcgggatatcttactttgtcaatatcagattgtctgacgaagtcggcattcctgccgctatttgagtagactcttgcgctaagcatgaatgatcgagatggtccgtttccgattgcgtctacaagtcccctttcaacgagtgcttctagcgttgctctaatggttgtttcggttgcatgtagctgcttcgaaagatcttgtacagtgagccttcgttgatgttttagtgtgtcaaggactaagagagatctaatagaaaacggtttcccaaccttctcttgttcgtctctgagcatcttcatgaacaattcgtcgggtgcgcttcgtgctatgaatactctgaccattgccgacgtgctgcctgtgtaatcgggcagtggccttccgtaaatcaatgacccctcgtatatacgatcaacaccgcgcccagttttttctgcgagtccaatcctcttaagagcattcatcaggcattcatttctaccatgtggttctactgttagcagattttctattgtgacgccttcgataaaaccacctggattagctatagagaggccctcatcatcgacgagtactcgcacgcgacctaaggctgcatagtccctatgtccaaaggcattgaccagtgcctctctatatgctctgttatcaaactcgggcacagggactctgaacagaccatcttcgaactccctttcgggattccaaggcgtcagcatctctctcatcttttcaatggtatagagaagtggctgccggaagtccttgtttactcgtacctcagtgccttgaaggacctggaaagttgcgccagcggttggaagggtacgctcaatcacttccgtctttccggcaagtagaattcccgtaaccgtgggcgatgcttttccatcgacgactgttgtcattcgcagagcgcttagcagctctgaatccgaaagctctatcagagcccgatcgccgccctgtccttttgaaagtatctctcttagtctcgatagttcatttggatcgaaatcttccgaggttgtgtctggtactggaaatgcggaatagtcaagttgccccaacgtcgtaagtctggtgataatttcaaaggggtatagcgggacactttctggactaccatcggctttgagtctccgtctcattattctgccgtctgtggatgatacaattgcgagagactttggaacttcgattgaaactacgacggcgccgtcatcatctgcagttccgtcgcgtgcgagtaaaagcgtggagacacgtgccggtacgggtggtacagttttattcgcaatcattgccgcaagctgcgtagcatccttatgtgcctgatggacacctgtgggagttccatcgtcttcgacaccgagatagattgttcctccgtcagaattgctgagcgcaactacagtgtctatcagctcgccgtcaggcaatctcttccgatcgctcttgaactcacaattgagtgcttcgctatatggaatttctcgcatcgcaggcatgtgccccctccaatccatgtctatatttagatgatagtcctgattaatcaggacacgggatgattaatcgggacatgtcctgattgtgtcccgtttaggaaggctatctgtccacttttccacacgctcgctagaacgcggacaggtagatcgccttggcgtcgtccatggtcagaggcctcagctcgccaaagcgctcgcccttgttctggcgcagcgtctgcagccagccgtcaacctcgtccttgctcaggcccaggtcacccagggtgcgcggcatgcccaggctcaccaggaagcgctgcagctcgtcgatcgcaaacgtgatcgcgtcctccgtggcctcgtccgtctggtccacgggctccacgtcaaacacgccggacgcaaacgcgaggaaccgctccgtgttggcgggccacacgtagcgcatccacgcgggcaggagcacggccagccccgcgccgtgggcaacctcgggacggtgcgcggagatctcgtgctccaggccgtggctctcccagccgcccgcgcgcttctccggtgcggaggagcggccgcagccgcacaggtcgttgtgcgcgagcgtgcccgaccacatgatggtcgcgcgggcgtcgtagttgtcgggttcctgcaccacggtggtggccgcgtccatcaccgcgcggatgatcccacagcagatgttgtccgtcacgggcacgggacccgcggagctgaagaaccgctcgcagatgtggcagatgatgtccgtcacgcctgccgcggtctggtactgcggcagtgtgaacgtcacctcggggtcgagcacggccacgcgcgggcggaacacgtcgccgttgacgcccttcttgaggctgagctcgtcgttgctgatgacgcacgaaccgctcgcctcggacccagccgccgggatcgtgagcaccacggcgatgggcaggcacgcgtcgatggttgccttatgcataaagaagtcccaaacgtccccctggtagggcgtgccaaacgcgatggccttggacgtatcgatcacggagccgccacccacggcgagcaccaggtcaacgtcctccctgcgggcaagctcgatgcccttgcgcacgagcgagacctccgggttgggcctcacgccgcccatctccacgtagctcacgcccgccgcgtcgagcgacgccgtcacgcgcgcgagcagcccggtccgcaccacggatccgccgccgtacaccagaagcgcgcgcttggcgcccagcgcggcgacctccccgccaatccggtcggcgtacccgcgcccaaacacgaagcgcgtgggggactggaacacgaagtcgttcatgacacccatcctttcctggggcgccgcggccccgtctacgttgctggcaccattctagcggccgccgccctccgcacatgccgcgccccactcgccgttccactcctgccgccaccgagtgcaaactcacaaaacgtgatttgtgagtcacccctacaagcgaagtacctgcagaaactcaaaattggccccactcacaaagtacgctttgtgagtggggccattggcagtagaaatgatgcgcgacggccgacgtcaggttcgatgctctttcggtttctctaatgctgacgaactcgaataatcgttggcgtgtctcgtaggtagtgtgtgaacgcaacgacttggatgagactctccttctcgtccacaagatagtagattccgtagtgctttacctggcattttctaacctgtttgcctactgcctcgctgacatcaatgtcaacaccaaacagcaacggattgtcggaaataagtcggagtttgtcctcgtaggcatcgagtagtgacttcgcagcacctggcgcacagagctctcgtgtgaggtaagagatggcctcatcaaggtctctgcttgcaggattcgacacctgcacgttataggccatacttgctcctaagcgcggcaactgccccaaatgcatcttggcactctccgtgctcgacagcgtctattccctcctgtacgagcgagacgatctttcccgtctcggctgcttcggcaaggctctcatacgtctccgtgctcatgatgaccatgtctgggcatccgttcttcgtgacatgaacgggctcgcctgtttcgtggcagagcttcgaaacccttgcggtgtcctttagctctttgacaggaatcatttgcatctcttacctccaatcacattattatgggacaataataccatcatgaatcaatacttcacctcaggaattagtgttgtaatactaaccacgcgctggaggaggggccaccatggcacaaccagctgcaaccgttgcggactacatcgcgcaggcgccgggcgagaagcgcgagcgcctcgagctggtgcgtgccatcatcctgagcgcggcgcccggggcggaggagctcatctcctggggcatgcccaccttccgcgtgggcaagaaccagctgcacgtcggctgtgccaagcaccacgtgggactctatcccggcgcggcggccgtgcggcactttgccggccagacggccgagcttggccttgcctgcaccaagggaagcatccacctgccggactcgcgtcccatccccgcggacttcgtggcggacgtcgcctcgtggtgcctgtccccaatccgcgtgcgagagcttcgcgccgcacctcaggttcgcgagcgccaccagatgccggattgggtccgcgtcgccctgcacgaggccggccttgcagatgcatttgcggcacgcccgccctaccagcgcaacgactacgtcggctggatcgtgcgccccaagcgcgaggcaacgcgccaggcgcacctcgcccagatgctcgacgagctccgtcgcggcgacgtctacatgaagatgccctggcacccgaggcgctagccatctcgccgcgtgcaggctgcgtggcgtttcctcccatgtgcttgcagcagcaccctctcggtaacaatatgaacatcgttcacatagagaagaacggcgcatcctcccgatgcgcccatcccaggaggcaccgcaatgcaacccacaaccaccaccgcgcccgccgcgccgcacgacgccaccacctcgcgccccgatgccatgcccaagcccatgcgcatcgccgagagcgttttcgacatctgctacctgctgttcgacctggtggcggccatcgtcttcctcgcgtccgcgcacggccgcgccatcttccagctgtatgggcttctcgccctcgtgctcggcgggggagacgcgttccacctcgtgccgcgcgtgcagatgcacctgcgcggcgtgcgtgaggacaccacagccaagctgggtctcggcacgcaggtcgcgtccatcaccatgaccgtgttctacgtgatcctttaccttatctggcgccggctcttcccggcggcggccgcaaccctgcccgcggccatccccgcgctcatcctcgcgatggcggccctccgcatcgtgctctgcctcctcccgcagaacgactggcgctccggccgcgagaacctgcgctgggagctctaccgcaacctcccgttcgcggtacttggcgtgctggtcatcgccttgttcgcgatctccggcaacgcgggcggcctcggcatgtggcgcatgtgcgtcgccatcgcgctcagctttggcttctaccttccggtttgcttcctcgccaagcgcaagcccgcaatcggcgcgctcatgctgcccaagacgctcacctacatgtggatgatcgccatgggcctgcagctgctggcccgtctgtaggcgcgccatgaagccgcaggcaacctcaagggaggccatccttgcggagtgtcgcgccatcgtgcggcaccagggcctctccggcattagcgtacgcaccgtggctgcggctgcgggcgtggccacgggcacgctgtaccactactttccggacaagcgcgcactccttttggccgtcgtcgcagatgtctggcgtgacgtgttcgccctggacggcgccccgcgcgaccgcacggacttctgccagtacgtggacgacctctatcgaggcgcgcgcgatcgccttgccgcctaccctggcttcgcgcagggtcacggcttggagctcgtggccctaaccggtcaggaggacgagggccgcgcccgaatgcaggcgttcctcgacggcgtgggcagcaagctgcaagaggcgctccgccgcgacccccgcgtacggccggacgcgctcgcgggcgacctcacgtcccagtcgctcgcgcgtttcgtcacgcgtaacgtgctggccggcctcgtgcttggccaacccacctgcagcgacctgcttgccgtgctgcgcgccgccctgtactgacgcctgggcgactgccggccaaaacgcaccagttgcactccaaatcgctctcacatatcttgcacttgctacgtcaggcgtagtatcctagccccagacgaatactacgtctgacgtagcatgtcacacacgaggagccagggggtcggcccatgccaacggacaacctggacataagcagcgacgtgatcaggggctacatcgaccccatgatcctgcgcatcctgctggacggcccctcgtacggctaccagatctccaagcgagtcttgcagatgtctggcggcctgtacgccgtaaagcagaccacgctgtactccgcgttcgcgcgcatggaaagaaacggcctggtccaatcgtttccgcaggtcgcgcaaaacggtaagcgccgcacctactatcgcataaccgccgcgggcatgacccactaccggcaaaagtgccgcgagtggcaacttaccaaggacgtcgtcggcagatttctggaaggcagtgtcgagtgatggaagacatcagcaagtacctggacaacctgtttgcgcagctgcccaacacgccggaggcccgccacgcgcgcgaggagctgggtcagatgatggaggaccgctacgccgagctctgcgcaaagggcatgggcgagaaggacgcggcctccgcggcgatagcagagttcgggagcctggaggaggtccgcgagtcgctgggcctaggcgcacggcccgccgcatcgcaacccgctgatgcgcagccctctgatgcgcagcccgcagctgcgcagcccgcgtgccagcgtcctgccgcggcgagcgccccgggggcagaggccgtgccgccccgtccgcagggcacgtcgggcccggttccgccccacgtggagcagccgccgcagccaggcgccgccagcccagaaaagcatcacaaccgcggacgccgcgctcttctcgttacgtgcatcgttgtcgtggcagtcgttgtcgcggccgtcgcgtggaacggagtctccgccagcatccgcggcgcgtttggggatggcgcacccatcggccagagcgcgtcgtcgggcgcgtcgggcaaggtagagaaggacgtggacgcaagcttcgactccgtggacgtggacgtagacatggccgacgtcgtggtacgtgcgggggattctgcgcacgtgagctgcacgggtacgaaggagttctcgtatgcctgcgacgtgaagggcggcgtcctgaccgtgacccaggaggcaaggcacgagcacgttcgcggctcgggcggcaaggttgtcgtgaccgtgccgcgcggaacgtccctcaggcgcgtgacggtggagtccgagatgggcgacgtgaccataagcggcgtccgcgctaccacgacggacctcgaggcagagatgggcgacatcacggtggccaattgcgaccttgcggacgcgagccttgaccttagctgcgagatgggcgacgtgacgcttaacggcaagagcatggggtcaagctatgccacccatggcagtggcaactccggcagccggaccctcaaggccacgtcggagatgggggatatcaccgtcagcgactaggcatcaaggacctgcgggcgactccgacggtgcctgaacgcgccaggttgcgcctccccccccgtgcgaatgattcgtgtaatgccagcttgcgtcggcgtgcggcgatgccaaagcaatagactgaagcattgtggacgttaagcctgcgttcagtgcaatgtgtgtacgtgggccgcctattgtcagtggctgcagtcgccaagactacgtctcgcctgcaaacccaagctcattgcgagtccgcttgaagggaagcacaacggtgaccgatttcggtaacggtccggaaggtactgccaaccatccaaagcatgcacgccatgcaaggcagccgcaagatgccccggcagcaacgccaacaagcgacctcgcgcagggcgttcccacgccgcgcaacggtctgtcccgcgccgctgcctctccgctcccggcggattcgcctaccgcacaccaccccagccaggaggaggtccgcaacctcacgcatcgcgagcaccacaagcgtcgcctgcccatcgtggctcgcatccttctggttgtcgtggcaatcgtcgcagtcgcgggcatcgcggcggcggcatgggtgggtcacctcaactcgtccatgtccgtgggcggaagcgagggcaagaagctctccaatgcgctcaagaagccggcctccggcaagaaggacgccccgttctacatggtcatcatcgggtcggacaaccgcgccggcgtcgcgggctcgcgctcggacgtcacgatgctcgcacgcgtggacctcgcgcacaacacggtcgccctcatctccatcccgcgcgataccatggtgcgtgccgccaacggctctacggaaaagatcaatgcagagtataacaacgggcccgccgcgaccgtcgaggcggtctcaaagttcgccggcgtacccatcacgcactacatggcaatgtcgtttgacgacctgtctggcgtgatcgaccgcctcggtggcattacggtcaatgtcccggaggctttcacctctcgcgatggctatcacttcaccaagggcgaccagaacatcagtggcgcggaggccttcagctacgtgcgcgaccgctacaacgaggccggtggcgacttcggccgcgcacaggcccagcgccaggtggtcgaggccatcgcgcgtaagacgctcgaaagcccggtgacggagctccccagcgtggtcgagtccctcgctggctccgtaagcacggacctctccgtcacggacctcgtgtcgtgggccaccacggtcaagggctccggcatccgcctcaaggtgtattccgctgtcgtgcccagctactcgctcagtcaggatggcgtctcctacgtcggcaccatgtacaatgagtggcgcgccatgatgcagcgcgtggacgccggcatggatcccaacgatgccaacgcccaggtgccaaaggcgcaggcaagcgacaccgccctcggagccgcggaaaacgccacgtctcccaaggactaccagcaactagcggcaaacgctggactcaccaccaacgacgtcgcccaataggctgaagcacattcgcccatcagagcgccaagtgaggcgccgccagtaacgtacggccagaagggaagcacgcatgaccctgctcgaactcctacagctcctcaggaagcacctcaggttggtggtgcttcttcccatcctgtgcgcggttgtcgtgggtgcctactccgtgctgttcatgcgcaacacgtataccgcgagcacgagcatgtacgtcctcgcgcagagcgacgagtcctccaacgcgtccaacctctcgcaggacctcaccgcctcgcagatgatcacggcagacgtggccaagctcctccagagcgaccgcatcaccaaccagacgggaaggcaggtgggcgtcccgcagctcaagggctacaaggtggacgtctcgtcggaaacaacctcccgcgtcatcacgctctccgtcacgggcagggactcgcagacggccgccaagatcgcaaacggcatggtcaagaacgtgtcgaacctcgcccagaaggtcatgaaggtcgaggccgtcaactccatcgaccaggccacggcgccaacgcaccccagcggccccaagcgcgccctctacgtcgcggtcgcggcgctggccggcctcttcgcggcgatcatcatcgtcgtcgtgggcgacatgctcaacaccagggtccgcagccagcaggacctcgagtccatcgtgcccgtgcccgtcatcggtcgcattccgtacgccagggaaggaaggtagccatgcctcgcaagagaacggcagacaggcaggcgctccagaacgccgtcaagacgctcgccgcaaacatccgcttcgcgtccgtggacgaccccgtgtgcacgatctgcgtcacctcggccgtcccgtccgagggcaagaccaccgtctctgtcgcgctcgcccgcgcgttcgccgagggcggctcgcgcgtgctcctggtcgagggcgacatgcgccgccgctccctcgccacggcgctcggccgccacggtaggcacggcctctacgctgtgctctcgggcaagcacgcgctcgcggaggccgccgtccgcgcggacgcctcgggtcgcctcctcttcctggacgccgagcccggcatccccaaccccgcggacgtcctgcagtccaagcgcttccactcgttcctcacgcagcttagggcccagttcgacttcgtcatcatcgacacgccgccagtgaccgccttcgtggacgc

SEQ ID NO: 173 - DNA, 18421 bp, Unknown
  Metagenome-assembled genome
cgtacaagaaagcccgacagcggggctgccgggcgcatgcgcaatggcggagggagagggattcgaaccctcggtacgggaacccgcacggcggttttcaagaccgctgcattcaaccactctgccatccctccgtggtcaagtggatatatcctagcgcataagggttgaaaacggtagcggggaccggcaggggaggcggcatttggcggagcaggcaggccaggcaaatccgatcgcgcaggcgcgggacgcaatgctggacgagaagtacatggccatcgcgctcgaggaggcgtcgctggccgcggcggaggacgaggttcccataggcgccgtggtcgtgtgcgacggcgaggtggtggcccgcgcgcacaaccgccgcgagctggacgaggatccctccgcgcatgcggagttcaaggccatggtggacgcgtcgcgccggcttggccgctggcgcctgacgggctgcaccgtgtacgtgacgctggagccctgcctcatgtgcgcggggctcatggtgaacgcgcgtgtggaccgctgcgtctacggcgctccggaccccaagggcggcgcgctgggcacgctgtacgacgtgagccacgaccccaggctcaaccacgagttcgaggtgacctccggcgtgctgcaggacgagtgcgcggccgtgctgcggtcgttcttccgggcaaagcgtgccgcaaggaagcgccctggggctgccagcacgtcaaaggccgaacgatgaggcctttttacggcatgggaggtttcgtttttctccccagtcggttatctttcatatggcttacatttgcatagtctggaaggcgcgccgtcttggggctggcccggcggcacggcggcgggggagcacgtatgagagagtggtttgacgcggacgacgttcgcgaggcgcgcgagagaatcaggccgtgggcgcgcgagacgccgctcgagcagtcgatttaccttgactacgcggaccgcaactaccagttcaagctcgagagccagcaggtgggcaagagcttcaagttccgcggcgcgctcaacaccatctcgcagctgtctgagtacgagcgccgccgtggcgttggcaccgtgtcgaccggaaaccacggcgtggccgtggccatcgcggcgcagctgctgggcatccgggactgctccgtggtggtgccgctgggcacgccgcacgccaagaccgaccgcatccgcttctacggcgcccgctccatgatgctgggctctgactacgacgaggccctcacgctgggcctcaactacatcgaccgctccgagatgttctacgttgacccctacgagcacgacccgcgcatctatgcgggccagggtaccatcgggctcgagatcatggagcagaaccccgacgtggacaccatcgtggtgcccatcggcggcggcgggctgtgcacgggcatcgccgtggcggccaagtccatcaagcccgacgtgcgcatcatcggcgtgcagacggccgcgtgccccgcgatggtcgcctcgatcgaggacggcacctgctacaaccgcttccccacggagggcgatacggtgtgcgaggccatcgtgggtggcgtgggcgagatcgccttcgagatgctgcccaacctgattgacgacatcgtggtggtgagcgagaagagcatccgctccgcgttcaagttcatgatcgagcgcgagcagctttccgtcgaggcgggcagcgccatggtcgtggcggccgtgcgcgagttcccggagcgcgtgggcggcaagaacgtggccctggtcatcagcggcggcaacctggacatcaacatcctgacgtccgtgctgcaggaggactttgacgactagccgccggtcggctacaccacgcggaagatgaagaagtcgaggtagtgggtctccggcacgccccacaggatggggtggtccggcgcctgctggcgctcctcgacctgcatgagctgcacgtttgccttgtgcgcggcctccgcgatggccttggccaaaaggtcccgcgtcatgaagtggctgcagctgcacgtggccaggtagccgccgcggggcagcaggcgcatggcctcgtagttgatctcgcggtagccgtgggcggcgttgcgcacggtgccgcggctcttggtgaaggccggcgggtcgagcacgatgaggtcaaacgggccgccctcgctctgcatgagctggcggtcctcgcgcaggcgtggcaggtactcgagcacgtttgcgcaggtaaagtccatgcgctgcgtgccgtctggcgccacgtcgagcccgttgaggcgcgcgttttcccgcgcgaggtcaatcgccgtctggctcacgtccacgcagcgcacaaactgcgccccggcgcgtgcggcgcccaggccaaacggccccacgtggcagaagcagtcgagcacgcggcggccgcgtgcgatgtgctgcacggcgcgacggttgtacttctgatccaaaaagaagccggtcttctggctgttttccaggtcgaggtcaaaggcgatgccgttctcgtgcgcgagcacgcgcgcgctgtcaggcgtggccaggctgcagatggccgggctcacgagcggcctgacctcgggtgccacggcgccgggcgcggcaaagtcgtagtagcccttctgcagcgggaggccctccttggcgcgggcgggggagtcgtttcgctggtagatgccgcggatggactggccgtccgcggcgagcgcgtccaccagcagcgggaagatcacgggccgcaggcgctgcatgcccacggtgcccacctgcgccaccaagacgtcctcgtagcggtccaccacaaggcccgggaagccgtcagcctcgctaaagattacgcggcagcagttggtgtcgggctcgcaccccggcagcgcgagcgagcccatggtgaccttgcggtgctcccacgcccactgcaccttgcgctgccagaaggcggcgtcaaagcggtcgttcgcattcttgctcaccacgcgcacgcggatcttgctcctgagcgagatgagccccgtgccgtggtaggtgcccttctcgtccttcacgtccaccacgtcgccgtttgcgacctcgcgtccgtccgcgggggcgggctccacgcgcagcacctcgccctcgaacacccacgggtggccgccactgagggaacgtgccgccttcttggtgacgatgacctgcggaaacgggcgaagctgcctcatgcgatgctcctgtgacggtgtgatgtttgatgatgtggcgcgcgcgttgcgcggccggcgcgcatgtgcgggcgagaaggacgcggcgtccgcctcgggcgccgcgcctgggatgctgcctagtagtggcgaccgtagcgcccgccggagatgccgcggcctcgtgcgcgcgagccgttgaacaggctgcgcgtgggcttggtggtgctgcgcccggggttggggatgatgcgcgtggaatcgtagtcgaagccgtcgaggtcccacgtgggcacgagcttgtgcgtgaagtactcgatctcgcgcagggggctgatctcgtccggtgcaacaaaggtaaacgcaaggccgctgtggcccgcgcgtcccgtgcggccgatgcggtgcacgtagtcctccgggtccatggggacgtcgaagttgacgacggcgtcgatgccggatacgtcgatcccgcggctcatgacgtcggtcgcgacgaggacctgcacctccgccgcgcggaagcgctcgagcgcccggtcgcgctcgcgctggttgcggccggagtgcatgaagtccgacttgaagccggcgcgcctgagcatctgcgcgacctcgtccacgcgggtcttggtgcggcagaacacgagcacgcgctccgggtcgtagcggcgcagcagcgcctcgagcagctgcagcttctggccctgcgtgacgggacagaggtgctcctccaccgtgtccgccgtctggcccacgcgcgcgatctcgaccgtggcggggtccttgagcatggcgtccaccgtgcccttgatggagggcgggatggtggccgagaagagcagggtctggcgctcgcggggcagtgccgcgacgatgcggcgcacgctgggccagaagcccatgtcgagcatgcggtcggcctcgtcgagcacgaagaccttgacgtccttgaggctcaggtggccgtgctccatgaggtcgagcaggcggcccggcgttgccacgagcaggtcgcagccatcctcaagcctacggatctggcggtcgagcttggtgccgcccatcacgacgacggccgtctggcccgtcttctggcacacgacggagacgacgtcctcgatctgctgcgcgagctcgcgggtgggggtcacgacgagcgcgaacggcccaaagggatgcgcgttggggttgggcgcgaggtccacgtcgctcttgcggccgcgcctgcgggaacggcggcgcttggaggcgggcttggtgccggccttggggctgtctgcggctgcgccgcgctcggacttggctcccgtcgcgggcttggcgcctgcctttggcttggatgcgcgctggccctcggcgtcggcggaccttgcgcctgcctttgccgttcccgtgcccgaggcggccttcttgtggtggcggcgcctcgtgcggtggagcccctggatgttgccctgggcgtcgaccccggcagaggtggacgcgctgccgtcgtcggcggcatccgcgaggacgtctgggccgtcggtctgcgggccatcaggcgcgggggagtttgggccagccgactgcgcgggggacgagggctcgtccttctcgcccgcggacttgtcctgggcggcaaggcgtgcctgctcctcccgcgccgcacgggagtacggctcgatgagctgcaggatcggcagcgcgaaggcagccgtcttgcccgtgcccgtctgcgcggacgcgatgacgtcgcgcccggcgagcaccagcgggatggcctgctcctggacgggggttggtgtggtgaagcccagggcctcgacgccctggaggatgtgctcgtctagcccgagctcggcaaatgtcttgttcatgcctcccagtatccaccatctgcggcgctcgtgcacgccaactgcggcgatgcggcctgccgcacacaatatgcgcaggtagagcggccatggcggcgaggcgggaaccaagcgcgggtttgctccgcgaatcacgctcccgtggttgggtaaagttggtaaggtagagaggttgaaagcgagtttgatgccgccgcccgcgcgctggcgcggggcggcaggcaggcggaaggcagcgtcccacatgagcgctagagcaatctggatgaagagcggcatggtgcttcgaatgcgctagcgtcacgcaaggtaggcccgttgcgtgacggtctatgcgagggccatcgggacgggtgcaggcaggcgcaaggcgcgccgcacccagaccgcagagacgcgacgccaacgctagggagaagagcatgccaatcaacattccggacgggcttcccgccaagaagatcctgcaccaggagcgcatcttcgcgctcgaggaggaagccgcgaccgagcagcagatccgcccgctcgaggttgcgatcctgaacctcatgcccaccaagatcgagaccgagacccagatactgaggctcatctccaagtccccgctgcaggtcaactgcgacttcatgagggtctcgagccacgagtccaagaacacgcctgaggaccacctggtcaagttctaccagacgtttgacgagctcaagggcaacaactacgacggcctcatcatcaccggcgcgcccgtggagcagatgccgtttgaggaggtcgactactgggacgagctctgccgcatcatcgactggagccaggagcacgtgctttctaccatgtacctgtgctggggcgcgctcgcggggctgtggcacctgtacggcatccccaagcgccagctgggcagtaagctgtttggcgtcttccagcagcgcctgtgcgacgagtacagcttcctcaccaacgggtttgacgaggtccacaacatgccgcactcgcgccacgccgcgatcgacacgaacgagctcgccaagcacccggagctgcacgtgctttcggaaagcttcaagacgggcccggcgcttctggccacgcgcgacttccacgagatctatgtgaccggacactttgagtacggccgcgacacgctggcaaacgagttctggcgcgacttcaagaagggcctgcccatcaacgtgcccgagaactacttcccgcacgacgaccccgagcagcagccgctctttacctggcgcgcccacgccaacctgctgtaccgcaactggctcaactgggtgtaccagatgacgccgtacgagctggagaagatcccccagacgatcgcgagcctcaaggcctccaacgacggcatggtggacaagttcgaggcatagcacttctcgcccatagcacttctcgtccgcaaggaggacagcgtgaccatcgtcgacatgctgcgcaacaacgcggccacgtacccgaccgagacggcgctcgtcgaggtcaaccccgaggttcgcgagaaccgccacgtgacgtggcgcgagtacgagctggtggagaacacggaggacgagccgttccgccgcgagatgacctggcaggtgtttgacgagcaggccaaccgcttcgccaacctgctgctctcgcgcggggtgcacaagggcgacaaggtcgcgctcctgctctacaactgcatcgagtggctgccgctctactttggcatcctcaagagcggcgccaccgtggtgcccctcaacttccgctacgcgccggacgagatcgagtactgcataaagaaggccgacgccgacatcctggtcttcggcccggagttcatcggccgcgtggagcagatcgcgcccaggatccagcgcgggcgcctgctgttctacgtgggcgacgactgccccacctgggcggagagctaccgcgagctggcgcagctctgctccagcgcggacccgatgatcccgctttccgaggacgaggacgcggccatctactacagctccggcaccacgggcttccccaaggcgatcctgcatcaccaccgcagcctcacgcaggcagcggagatggaggccgtgcaccacaagaccacgcacgacgacgcgttcctctgcatcccgccgctgtatcacaccggcgccatgatgcactggctgggctcgctcagcgtgggcgggcgcggcgtgctgctgcgcggcgtgagccccaagaccatcctgggcaccgtctccaaggagcgctgcaccatcgtctggctgctcgttccctgggcgcaggacatcctgctcgccatcgaggagggcaccgtcaccctgagcgactaccacctcgaccagtggcggctcatgcacattggcgcgcagcccgtgcccaagagcctcatccgccgctggaagcaggtcttccccaaccaccagtacgacaccaactacgggctttcggaatccacggggcccggctgcgtgcacctggggctggacaacatcgaccacgtgggcgccatcggcgtgcccggctaccgctggcagtgcaagatcgtggacgagaagaacgagcccgtggagcagggggccgtgggcgagctgtgcgtcaagggcccgggcctgatggagtgctactacaaggaccccgccgccacggcggaggcgctgcagggcggctggctgcacaccggcgacatggcgcgccaggacgaggacggcttctactggctggtcgaccgcaagaaggacgtcatcatcaccggcggcgagaacctgtaccccgtgcagatagaggacttcatgagcggctgcgaggccatccaggacgtggccgtgatcggcctgcccgacgagcgcctgggcgagatcgcggcggccgtggtgcagctcaagcccgagtacgtgggcaaggtgcaggaatccgacatagacgagttctgcctgggcctgccgcgctacaagcgcccgcgccgcatcatctttgcggacgtcccgcgcaaccccacgggcaagatcgagaagccgctgctgcgcaagcgctacggggcaacggagctcgtcgcgagggagaaccaggcgtaacgggccgcggggctgctccaacttggcggaatgattagcgtttgctggccaacatggtccgaatcgtgtgttccgaaaacgtttccaggacgttcacacaaaatatcgccgcattctataaaatgagcacagtcgtaatgcgacgtaggcccggggccgttgcgcccccggccagacaagacgaaggagagaacatgtccgaagcccccgagacaaaagctccacaggtcgacgcgcccgtgtacgatgacggacccgcaatcgtcgttcacagcgacgacgagatcgacgcgaagctcgcacagatgcgcgaggcccagaagaagtacgcgacctacacccaggagcaggtcgacaagatcttcaaggccgctgcccttgccgcgaacaaggcccgtatccccctggcgcagcttgcctacgacgagaccggctacggcgtcgtcgaggacaaggtcatcaagaaccactttgcggccgagttcgtctacaacaagtaccgtgacaccaagacctgcggcgtgatcgaggaggacaaggcctacggcatgaccaagatcgccgagcccctcggcgtcgtggccgcggtcatccccaccaccaacccgacgtccaccgcgatcttcaagtcgctgctctgcctcaagacgcgcaacgccatcatgatcagcccgcacccccgcgccaagaagtgcaccaccgaggccgcgcgcgtcgtgctcgaggctgccgtcgaggcaggcgcacccgagggcatcatcggctggatcgagaacccgtccctggtcgccaccaacacgctgatgtccgacgccgacatcatcctcgcgaccggcggcccgggaatggtcaacgccgcgtacagctccggcaccccggcgctcggcgtcggcccgggcaacaaccccgcgattatcgacgactccgctgacgtcgtgaactccgtcaactcgatcatgcactccaagacgttcgacaacggcatgatctgcgcgaccgagcagaacgtgatcgtcctcgacggcgtctacgacgcggtcaaggccgagttccagaagcgtggcgcctacttcctccagggcgaggacatcgacaaggtcggcaataccgtcatcgtcaacggcgccgtgaacgccaagatggtcggccagcccgccaccaagatcgccgctgccgccggcgtcgaggtccctgcctggaccaaggtcctcatcggcgagaccgagtccgtcgacccctccaacccctgggcgcacgagaagctcacgaccatcctcggcatgtatcgcgccaaggacttcgacgacgcgatcgccaaggcgtcccgcctcatcgcggacggcggctacggccacacgtcctcgctcttcatcgacacgcgcgagaccgagaagctgcagaagcacgcgaacgccatgaagacctgccgcatcctcatcaacaccccggctgcgcagggcggcatcggcgacatctacaacttccagctcacgccctccctcacgctgggctgcggttcctggggcggcaactccttctccggcaacgtcgaggttcaccagctgctcaacatcaagtcggtcgcagagaggcgtgagaacatgctctggttccgtacccccgagaaggtctacttcaagaagggctgcatgcccgtcgccctccgcgagctcaaggaggtctacggctgcaagcgcgccttcatcgtcacggactccttcctgtacaagtccggcttcaccaagaagatcgaggagccgctcgacaagatgggcatcgtgcactccagcttctggagcatctcgcccgaccccaagctccaggacgcccagaagggcgaggagctgctccgcgccttcgagcctgacgtgatcatcgccatcggcggcggctccgcaatggacgccggcaagatcatgtggaccatgtacgagcacccggaggagaaattcgacgacatggccgtcgacttcatggacatccgcaagcgcgtctaccgcttcaagaagatgggcgagaaggccaagttcgtcgcgatcccgacctcctcgggcaccggctccgaggtcacgccgttcgccatcatcacggacgccgagaccggcatcaagtggcccatcacggactacgagctcatgccgaccatgtccatcgtcgacaccgacaacatgatgacgcagcccaagggcctgacctccgcgtccggcatcgacgtcctcacgcacgccatggaggccttcgtctccatcatggcgtccgactacaccgacgccatcgcgctcaaggccgccaagctcgtgttcgactggctgcccaaggcctacgcagagcccacgaacgtcgaggcccgcgaccacatggccaacgcctcctgcctcgccggcatggcattcgccaacgccttcctcggcctcaaccactccatggcccacaagctcggcgcctaccaccacatcccgcacggctgggccaacgcggtcatcctcacccgcgtcgcccgctacaacgcggccgagcgtccgacccgcatgggcacgttctcgcagtaccagtacccgcacgccaaggcgcgctacgccgagatgggccgttactgcggcttcaccggcaaggatgacgacgaggtgttcgagaacttcatgaagggcatcgaggacctcaaggacttcatcggcgtcaagaagaccatcgccgactacggcgtggacgagaagtacttcctcgacacgctcgacgagatgtccgagaacgccttcaacgaccagtgcaccggcgcgaacccccgctacccgctcattgccgagatcaagcagctctacctggacgcctactacggacgccccgcaacctcctacgaggacaagggcctcacgatccgcgactccgagtagcctagaggtcgcttagcgaaccaagatgaggagatgactgcaccatggaactacccaaggacaagaaggtcatcaagacccgtcacaacaaggtcgtctatgactgcggcgacacggtcgtaaaggtcttcaatgccaccaagccgcacgcggacgtcttcaacgaggcgctcaacctcgcccgcgcggaccaggccggcatcgacgtgccccagctcgtcgaggtcagcaaggtcgacggctcctgggccctctcgaccaagaaggtcgagggcaagaccatgcgcgagctcgtggacgaggacccctccaagctcgacgacgtcatgaaggacttcgtcaacctgcagcttgacatccacaagcaccgcaacgaccttctgaaccgccagaaggacaagtacacccgcatgatcaactccgtgagcgaggtcctggacgagtccacccgctacgacctgctgatgcgcctggacggcatgcccaaccaccagaagatctgccacggcgacttcgttccctccaacgtgatcgtccgcccggatggcacctactgcgtctgcgactgggcgcacgccagccagggcgacggctccgcggactgcgcggtgtcctacctgcacttcaagctcaacggccaggacgacttcgccaagtcctacctcaacacctactgcgagctgcagggcaccacggtcgagtacgtgagccagtggttcccgatcgtcgcggcggccgagctcgcgcgcggtcgcgtggtcgagaaggacttcctcctgagctggatctccgtcggcgactacgagtagtccgcactccggacgcctgcgcgcgtccgcgcgccgcgaggcgcaccacagagcgtgaccccaggggcggggcggctgcgagccgctccgccccgttcttctcgcccgcggtatgcggccgcttgccagcggggtgccgcccattttcaaaacagaaacaagtatgcttgaaaatgatgcgtgctagtgtgcgtgcggcaccgcggcgtgcgggctaggggcccggccgccgcgtgggcgagaggagaaccaatggcaaggcagctgctttcgggcaacgaggccatagcgcagggcgcttgggaggcgggcgtgagggtcggcacggggtaccccggcacgccctcgaccgagacgctcgagaacctggtcaggcacaaggacgtctactgcgagtggtcgcccaacgagaaggtggcgctagaggtgggcatcggctccgccatgggcggggcgcgcacgctcgtgaccatgaagcacgtgggcgtgaacgtcgcggccgaccccttcatgtccgtggcgaacacgggcgtcaacgcgggcctggtgctgctggcggcggacgacccctcgtgctacagctcgcagaacgagcaggactcccgcacgtacgcggcctttgcgcggatcccgtgcctggacccctcggactcccaggaggcctacgagttcgctcgccaggcgtttgcgctgtccgagcgttttgacacgcccgtcatgctgcacgagaccatgcgcatcgcgcacacgcgcaccatggtggagccggcgggcacgcgcgaggacgcgccgctgcgcgactacgcctcccagccgcagaagtacgtgatgatgccggcgtttgccgtgggacgcatccgctccacgaacgcgcgcgaggacgcgctgctcgactacgcggagaagagcgagctcaaccgcgtcgagatgcgcgaccccaaggtgggcgtcatcgtggccggcgcgctgtacaaccacgtgcgcgaggcgctgcccaacgcgtccacgctcaagctcggcctcacctggccgctgccgcccaagctgatccgcgacttcgcggcgtccgtcgagcgcgtgtacgtggtggaggagacctgccgctacttccgcaccgccatcgcggccatgggcgtggagctttccgagccgcccgccaagccgctgccgcgctccggcgagatcttcccctccgacatccaggcgagctttggcgaggcgctgcccggccacgccgcaccggcgaaagacctgccgccgcgtccgcccgcgttctgcgccgggtgcccgcaccgcctggtctactgcgagctgcgacgcatccacgccatcgtgaccggcgacatcggctgctacacgctcggcgccgtcgcgccgtacaagtccgtcgactccgtgatcgacatgggcgcctcgctctccatggcgcacggcatggagctcgcgggcgcgcccgagcgcacgggcaggccggtcgtgggcgtgatcggcgactccacctttgcgcactccggcatcacgagcctgctcggcaccgtctacaacggcggcaagggcacgctctgcatactcgacaaccgcaccacggccatgaccggcacccagggcaaccccgtcaacgggctgacgctcacggagcaggcggcacgggtttctcccctgatcgacgcggcggagaagcccagcatgctcgaccggccggcgggaaagccactcgacctggtggcgctgtgcaaggccatcggcgtggacgaggtcgaggtcgtggacgcgcaggacctcaaggcgatccgccgcgcgctcaaggcggccacgtcgcacacggacatgctgagcgtcatcatcttcaagagcccgtgccgcctggtcgaccgctccacgcgcccggcgcccaagatcacggactgccgcaagtgcggctcgtgcatccagattggctgcccggccctgggcaaggccgaggacggcaccgcccagatagaccccacgcagtgcatcggctgcaaccagtgcgtgcagagctgcccgtttggctgcatcgcgttcgaggaggagtagcaatgccacacgcaaccgcatccgcagaggcctcgaccatcgagctcggggagcgcgtgacgctcgagaagaccatgaccgtcctgctcgtgggcgtgggcgggcagggcacgattcttgccggcaacatcctggccatgtgcgcgagcgaagccggcctggacgtgaaggtgtccgagatccacggcatgagccagcgcggtggctccgtcagcaccatcatccgcatgggccagcacgtggacagcatgatctgcgatcccggcacggccgacgtgctggtggccttcgaggcgatagaggccctgcgcaaccagcagttcctgcgcgagggcgggcgcctcttcgttaacgacgaggtcgtgacccccgtgcccgtcaacataggaaacgcaaccatgcccgaaggcgtggacgggcgcctagacgcgctgggggccgtccgcatgaacgcgggcgccatcgcgcgcgaggccggcagcccccgctccaccaacgtggtgctggtgggcgcgctctccacggcgctgccgtttgcggtggacgaatgggaggacgccatcaggcgccgcgtcccgcccaagaccgtggacgcaaacctcaaggcgttcgcgctcggccgcgaggccgcgcttgcctagcatgagcgcgggtgcggcgtcaggcgcgggcgtgggctcgggcgcgacgttgggctcggccgaccgcgagcccctcacggaggagctgctggcccgcctgctcgcgagcgccacgccgcaggagtaccttgaacagacgcaggtgggcgagcgcgaccttgccgcctacctgcgcaccctgctgggtcagaagggcctcacgcgtgcggacgtcctgcgcgccagcggcgtcaacccgtcgtttggctaccaggtgttccagggcgtgcgcggccccagccgcgacacggccatcgcccttgcgcttggctttggttgcgacctgcgcgagacccagcgcctgctgcgccgcgccggccactcagagctgtactgcaaggtgcgccgcgacgccgtgatcatcttctgcctggagcacggctacacgcgcttcgagtgcgacgacgagctcttccgcttgggggagaagaccaccggctccggctccgcgggggccgccgagtgatgtcaggtgccgaccctacgggcgaggcgctgctcgaggcgctcgacctggacgactcgttctcgccggtgcgcacgcttgcggagggcaaggcgggcacgacggagctcgtggtccgcagcgacccccgtgccggcgagcccacgcttctcgtgcgcaagcgcatgccggcgcagctcgccaacgagcaggcgtggcgtgcgctcagggacgttgccgcgagcggggcggagggctcttctcgcctgccgcgcgtgcgcgaaatctaccgtttgcctgacgagctcgtggtcgtgtacgactttgtggacggcccgacgctcgcggaccttgtgcgcgacggtggcccgctcgaggtgccgcgcgcggtgctgctggtgcggcagctctgccaggcgctggcgccgcttcacgccgcgggcgtggtgcaccgcgacgtggcgcccggcaacgtggtcgtggccgcggacggggcgcacctcatagacctgggcatcgcgcgcgtgcgcgtggagggcgccacgcacgacacgactcgccttggtacctggggctttgccgcgccagagcagtacggctttgcccagacggacgcgcggtccgacgtgttctcgctcgggcggctgcttgcgtacgcgctcacggcgcaggacccgtccgaggagtcgttcgagtccgccgcggactcgccgtgcgtgccggcgtccgtgcgcgccgtgatcaagaaggcaaccgccttcgagccgtcgtcgcgctaccagagcgtgggcgagctcgcgtccgcgctcgaggcggcatgcccgccggagcccgttgcggcacgacctgcggcgccggagccggcgcagtcgagctatggcgcgcgggcctggctccgcagggcgaccgcgcccgccgcgagccctgcggacctttgggatgccttccgctccgccgatgcgggtgccaaggcgggatgtgtccttctcgccctgtttggcgtgctcggtgcgttgatgatgctgtactccgcgagcttcgtcgttgcaaagtctctggtcgacacgttcacggctgtcctgtgcgtggccgtgggggcgtggtttgcgcttgcctttggatgggagcccgtctgctgcgtgctttcggccggccgctacggcgtgcggaccgggcgcctgcgcaccctgctgcgccgcgagggcgtgcttctgctgtggctgttcgcggcgttcgcgatcatcgtcctcgcggtggcgttcgtgctgccaaactgctgacgcacggccaacggtcgcgggagacgggggccgctgatcccgtgacgcccgtccggcatgtccaccgtgcgcgccaacctcccgccccccagtcaatttgcccgactctgctgccagcagaggacttatcgaatcctgaaacctaacatcgttcgtgcgcccagacgcggtgtcgcgtcgtgcggacctggcctcggcccggctcgcgggcatgcatccctgtcggttccacggatgatcggagcagatatgtccaagcagagcagtccggatggcgtttccaggcgtaaggggcgcaggctcctggtcgtggcgtttgccgccgcggtcatcgcgtgcggcggcctcgccgcatgcggcggctcgagcgactcgggcagcaagagcgagtcgaccacgtcgagcagctccagctccaagtcatctgacagcaagacgtcgtccagctcgacggacagcaccaagatcgacgcggacaagttcaagcagatccagaacggcatgacgtacgaccaggtcaagcagatcatcgggtccgatggcacggaggagtccaccagcgaggtaagcggcatcaccaccaagatatatgagtgggagtccgacggctttggcgtcgcgaccgtcacgttcgagaacgacaaggtcgtcaacaaggcccaggccggcgtgagcggcagctcgtccgtccagatcacgatggaccagtacaaccaggtccagaccggcatgacgtacgaccaggtcaagcaggtcatgggtggcgacggcgagctcacgagcgacaccaagatcgcggaccacacctcgcagatatatatgtggtcgggcaagtccgtcggcgccaacgcgaccatcacgttcatggatggcgcggtcgagtccaaggcgcagtacggcctcgacagctaaccgcaagatacgagcgcaaggctcatgcacggtcgtcgggcgtgggtgctcaggcactcgcgcccgacgtgtggatagcaagacaaacgaaaggcaggctccaacatgaaacgcaacaagctccttctggtcgcactgatcctgggcgcggcctatctggtctacagcctctggtactggttcggcggaggcgcggcgggcgccgtgggctccgacagcgcctcgcaggccggcgcgggcatcgccgcgatgctcgtgatgccgcacctcctgctcacggtggtggctgtcatcttcaacgcgttggcgttcttcatgagcaagcgcgcgtttgcgctggtcgcaggcatcctgtatgcggtggcgatggcgctcttcatcgcgtacgcgctcttcctgctgatccagatgatcctctgcttcgtggcgtacgcaaagatgcccaagcccaaggaggcctagcgaatccgaaaggcaccaggcgccacggcgccaaagacaaatgcgggcgagaagaactgacggccatggccgctggtccttctcgcccgtttgcgtatgcggagtgtgcggtggcgctggggctacccgagctacccgaggatgcggtgctcgaaggtgccgtccaggtagatgccgtagctgtgcgagccatccttggggatgcccacgctgccggggttgaagcaccagatgccggggttggcctcgctggggaggttcaccttcttatgagtgtggccatagacgatagcggcgcccgcgggcagcgtcggcatgtggtcgacggagttgtggatgccgggtccccagacgtgaccgtgcgtgaggaagagctcgcggccggtgccggcggcctgcgggttgggggccgtcgggtcccagagcgcgtcgtaatcggccatgcaggggaagttgaggaccatctggtcgacctcggcctcgcagttgccgcgcacggcgatcacacggtccgcgatgccgttgagcatcgcgatgacctccttgggggcgtagtcctccggaaggtcgttgcgggggccatggtacagaaggtcgcccagcagcacgacgcggtccggctgctcggcgtcgatggcgtccatgaggcgcgagcaccaggaggccgcgccgtggatgtcggatgcgatgaggagcttcatgatcttcttgccctccaaaagttttt

SEQ ID NO: 174 - DNA, 4758 bp, Unknown
  Metagenome-assembled genome
agggagctcgagcggctggtctcggagttcgtgggctactacaacaaccgccgcatccaccagtcgctgggatacgagaccccggcgagctggtacttctcgggaatcaaccagagggcggcatagggaagggcaagaacagctaagctgggaacaccatcaggcaagggctttcggtagaaaacgctaattcgtgtcgaacagactcagccagttcagttcgcctgaccgctgcatcgacatcttgcatgagtggcaggctaagtatcctgacaagcttatgattatcgataagaagaacgagggcgtctggcgaggtcgctgggacggcattgcgaaggcccgtggcgagtacattggcttcctcgacagcgatgactattgtgagcctgactttgcagagctgctatataacgcggcaaagaaggaagacgcagacattgcagtatgcggcttctcgcgcatagaccttgagagtgggaaagccctttctcatgagatgtgtacaccgcgtcccgactttgtcatagaccaagatcctggcagactggtcgagttgaacggtgctccttggaataaggtgtttcgctcttccgtgctcaagaacatgcgggacctgcctacgccccctcctgtactggacgacctgatgttccattggctggcctatttggacatgcatggtaaggtgacgtttgtccctaaatcgcttgttaactatatggtgcgtgcaggctccatcatcaattcggtacggatggaacaggtggagaagacctacgcggcattcaaacaggtcaagacctactacaccgaggctggtgcttcgaaggcgttgcaggaagcgttggatgctgctgctttcttacatctcggtatctcgctgaactatcgtctggcggctgatcctaagtgcgatttgaagaaggcaattgccaactgtacaaagttcctgaaccagaacttcccaacttggcacgattctccctatatcaggggctcttacgctcgcactcgcggtggggcgttcaagaggctgctaacggtgtccaggctgtataagcttggcatgttgcccgcgttcctgcatgtgtacagcttcgtgattaatacgttcgacgtggacatcaaatggtagggatggaaatgacccataaggcacgcgaacagtagggagagcattactaggtatgaactttaaatccttactctccaacctatcggtcgccatcgttgcccaaggtgtcagcgttgtcctcagtataatctcctcgcttttagttccaaagctattgggcgtggaggaatatggatattggcagctcttcctctactacattagttacgtcggattcttccatttggggctgaatgatggcgtgtaccttatctttgggggtattccgcgcgatcgaattgacaagaggaatctaaactctcagttttggttcggtgcagccttccaagccgtgtttgctgccatcattatcgctattgcggtcatgggcggttttggagctgaccgagagttcgtgttgttctggaccgcaatctttatcgtgattcagaatcttatgaactatctgggctatgtttttcaagctatgaacgagacgaagctcttctcgtacacgactattgtcgagagacttagtttcctagttcccctagtgctgctgctattgacccgacaggcctcatacaagccctatgtgtatgcctactttttctcatgcagtattggtctgttgtattgcgtctaccacgcaagagattttttttcggctgggctactgccagtaggccagactgtccgtgaaggtctcggcagtattcgagtgggcatcaaacttacattggcgaatattgcaagtacgctcattttgggagtcacgcgctctatcgtcgatatggtctggggaatctctgcctttggtcagctgtctttttcaatttcaatggtgtattttatcctgaactttattattcaggtcagcatggtgctatttccagctctgcggcaaggtacggataaggaacttagaagctttttcgttaactcacgtgatgccactgatctcttgctcccggcgttttatatcctctattttcctgttgtctggattttgagcctgtggctgccgcagtacctagagagctttaagttctttgcttacctgataccggtctgcgtttttgatggcaagatgaacgctatctccacgactattttcaaggtcaaacgtaaggagacgctgctacttgcgattaattttgcagcggtgggtattagtgccataggctcctttatcggagcctgtctgatgcgctctgtaattgtcgcaatcatttccgcagtcatagcgattgttggccgtagcactttctcggaactctatatcgctcgttcgatgggcgtcgaatatggcagggcattgccgtatgagatttgcttaacggctgcgtttgtggctctgtgcactcagttgagcgctttgtatgctgcggctatttacatagccctgtatgcgctatatgctttcgcattccgcaggcagtttagcgagctcttgggaaagatacacgggctatttcggtcttaggtgtgggaatgttcttgaaaggtaccgggctaatggaagcggaatctacagctaaagttgcaatagtcatggccgtgtataacggtgaacaatatctggatgatcagattcaatctatcctgggacagacttacgagaactggcaactgttcatttctgatgactgttcgaatgacaacagtctccaggttgtgaagaaatacgtccgatcagaaccgcgaattcacctcgtgttggagggcaagcacttcggtaatgcgcaagaccatttcatggcactcctacgagaagtagctggaaaattcgattactacatgttttgtgaccaggatgatgtatgggattcgaacaaggttcaactagaggtagaagccgcggctaagtggccgatggacaaacccgtactggttgcgacggacctacgagttgtgagcgaagatctttcggtcatttccaattcctttgcgaaatacagcgactttagccctacaaccgcacagtttggaaatctgctgattgagaactttgtcacaggttgtaccgtactaatcaataattgtttggcagaacttgcggctgatactcctgcaggcacgtatatggttatgcatgattggtggttcgcactaatagcaaaagggctaggtcagcttgtatacttgccgactgctaccatctcttacaggcagcatggcgacaactcgcttggtgctgcgcaatatggtattcattcgattctcgcgagctgggactgggcagagcaatgcaggaagatgtgcaactcaattcgacaagcggattcatttatgggtcagtacggtagccaactagataatgaaaagcgttctgagactattaactttatagggctcacggctcatcccagaattttacgcattgcaaaacttgcgaatgctcatgcctggaaaactggcgtaccacgttgtttcggcgagatcatcggaatattgttctcacggcacatcaataaggattggtagcggcaagcagtggtgacacatacggcttcaccactgcttcaaacgatgcttcccgtaactatataccgtacgggtgtccatgctgatgaaggtactctaaacggtgatgcacctctgctgcttttggtagcattgacttgtcctcgacatcgtttcggtcgtgctcatcgaaagtcgattggtctcgaatgccaagctgatcagccatccccctgctccgcttcaaggcgaattcttctaccgatttacaaaaataatgattgatgtagggcggaatatcagattgcgagtccggcgagaaaggcccagtgatgtgctcgcccaaagcgtttatcgaatggtagcctaataggggcactgcaaagtgtggattcggataacccagtactcttctcggatttacgatggctttagtgtgtttgttgttcctgaagctcgcttctgatcgttgagtgtagctttcaattaccaatccttctggtctcgctttccttcccgctgaaccaaatatcagccaatttagacctacgccagagatgccatcggtgatgtgttgatctagccactgggagacgctggtacttccaaagtttatgaattcatccaaatcaataactgccagatacttgcagtctctgacatgtttgtttagcgcgtcgttgtatgcatccatctgtcgagcttttccaggccaaggtgttaattcgacaatacctgcctttacatatggagctagtatcttgcgggggttatcagtactttcgttgtcatatagatagaacttctggaatccaatactacggtgatattcaatccactctagtagataagggccctcgttctttatgattgcggctatggctagggtagtcttgccgttccattgctgacgattgagatttaggtatatggaatggaataaactaggtaacaccaacagggcatctgtcacttttctgctggagacacttcgggagcgttcatgttgtcgaatttcgtagggcatgcgaaaggtgctcgataagagtgatgtggctggccaatcctagacacgcttgagccggagctaccgaaagcccgacaatgtgccgagaggcacgaagggagctttcggaccatgagcaggacgacgaggagaaggtacgacccgcagt

SEQ ID NO: 175 - DNA, 43316 bp, Unknown
  Metagenome-assembled genome
ctggcggttctcgatcaggtagtactcggtgtcgctcaccttgatgatgtagctcttgtagcctgcggagtccgtctcggaggtcgcggtgtaggtgccgtccttcgtgatctcctcgggcgtgatgtagccaagcgggtagcggtcatacgggtcgaagaacgtcgggcggtactcgccgctcgtggtcttgccgtaggagccgtagtccatgatggagaggtacatggtggagtagttgtcccacgcgccgctgtcggacgtcgtggagtacaggtcgggcatgccgaggaagtgccccagctcgtggccgagtgcgccgatgccgctctggtgctgctcgccctcggacatggactcgttctcggactggacgatgtagcggacgatgcccaccttgccgccgctcggggtgctcacctcgtaggggctgccgacctcctcggtaaaggagtactggtgcgaccagatgccgtggtggcccgtcgggatgacgccggtcgcggcctcgtagccggcaaacacgacgcccaggccaagctcgttggcctcgaccttgccgtcgccgtcggtgtcatattgcgagaagtccacgtactgggccgcggcctgaatcgcgtcctccatgtccttcacgtagtcgggatcctggttgccaaacgggtcggggttgccgtaggtgtggtccaccgtcacgtgcacgacgccgtcgttagccttgtcggccgtgttggtgttgccgcccacgccgtacgcgctgctctcggtcgcgggggtccaggtgaacttcccctcagaggatatgcgatacagggagctcacgctgtagtcgcctgtgaagaacgtcttgttccagtcgtagctggtgctgtacggctcgtcgctgaagcccacgacgatggtgagcagcgggatgctggtcgtggtgctcgtcgtggactgcgcagcggtcctcatcagcaccgacttcttggtcgtcttggccgtcgtggcggcagtggcctgcgtcttctgcagcgagctcaccgtgatgggtgcggaggtcgtcgcgtcgctcgcggtcttgcccgtgtaggtctgacccgcaagcgcgtagtacgccacgcgggcggaactttcggaaaggtcgtccgcgctgatggcacccgcgtcggtcgcgtcctccgcggcgctcccaagctggagcgaggatccggacccaaccacctgacgccatgacccgtcggacgggtcgcgctgcaccaccacgccgtccgcgttggtcgcgtagtggaaccactcgtcaccgtgcgtggtgatcttcgccgtcgagccatcgggctgctcgaccgataccgcgcggttgtacgccggcattgccgatgcgacgcccgccgaacccagtgccagggcaaaccccagcgccgcggcagccgccgccttcgcgacgcggccccgcgcggcgaacctgcccttcgtcctacctgccatcatgcctcctccgtaaagcaaccagacatcaacctgcattcaagttgaggctaacgaacctgattttccgttttattggatatcagttacgagtgtgcttcctataagcgcgccaactaaacggtaaacggcagttcagataccttgagtcgaaccatccatcaatcttacgcatggttgacatgcatatcaggcatgcgcattttcagattcggccactccgcaaacccacatgccgtacagctacaattgcagagaagaacgcgggcacctgcccggaggcatcacgatctttcgaggttacatgggcttcaagacctacacctgtcccatcgcacggcaatgcggcggctgcgagtggctcgccgtcccctaccctatccagctgcgccgcaagcagcagcaggtcgaggagctgctggggaccatggcccgcgaggacggcgcggaggtgctgcccatcgccggcatggcggagcccaagggcttccgtcacaaggccgccacgcccttctcgcccgcaaggggcggatgcatccgctccggcttctatagcgcgggcacgcaccgcatcgtgcgctgcgacagctgcctggtggaagccccgggcgcccgtgcggtgctgacggacgtcgcgcgcgtgggcgaggagctgggcatgagcgcctaccaggaggaccgcgggcgcggcctcctgcgccatgccgtggtgcgctgcggctacgccacggacgaggtgctcctgaccgtggtcgccaacggcaaccgcctgccgcgcgaggacgagttcgtgcaccgcatgctggggctccaccccgagctcacgtccatcgtgctcaacgtcaaccagcggcgcaccaatgccatcctgggacgcgacagccgcacgctctgcggtcccggcagcatgcgcgatgccctgctgggctgcacgttcaagatcggccccaccagcttctatcagaccaaccccgcccagaccgaggtcctctatcgcatcgccctggagggggccgggcttcgcgacggctcccggctgctcgacgcgtactgcggctgcggcaccatcggcatctgcgccgccgcgcacgcgcgctccgcaggggcggacgtgagcgtcacgggcgtggaccaggtgggcggtgccgtgatatccgcccgctgggccgcgcagcacaacgggctcgacgacaactgcaccttcgtgcatgaggacgccacggcctacatggagtcggtcgtgcgcgagggcggccgcggcttcgacgtcgtggtgctcgacccgccgcgcgcggggtccacaccacgcttcctcacggacgtggcgcgcctcgcccccaagcgcgtcgtgtacgtcagctgcaatgtaaagacgcaggcacgcgacctcgcccttttgcgtcagcacggctaccgcatcatgcaggtggcaccggttgacatgttcccgcacaccaagcacgtagagagcgtggtctctctggtgcgcggctagggtcgccccctccgcctgcgggactgtgtcgattccatcaatatcgcgacgatgtgcccatgcgcgttgccaccgcgcatgcaaggcgtcagtctgtcttcagccccgcttcggggccggagtttggcgattcgtacgtaaagaggcattttcatgacaaccaatagcgaggcgacggtcagtcgcaacccctttggctaccacagccgccgctggtgggtggggctgaccgcgtttctgttcctgttcctcgtggggccgtttgcggagtttggcaacatggaccgcggcaccatccaccacgcgccgcagctggcggcgcactaccagaccatgctgctgtgcttctctctcctgctcatatacctggtgccgttcttcctgttcgtgcgctacacgcgcatgcgcgcgggcgtgccgcgctggcttgtggtgctggcgttcgcgagcggcctctttgttcccggctggatcgccggagagctcaacgccggcgcagacgacctgctgcacctgctcgcgtccaagtcctttgtcagcacgtggggcgatgccctcgaggcgccgctggtggaagagaccctcaagctcctcaccgtggtggcggtgctgaggctggccggccggcgtgacgggcgcgactggctcgtgggcggcatgtgcgtgggcatgggcttccagctgtccgaggaccttggctacatagaggaccagatcgcctccgggcatcacgggttcgagaccgcggtgccggtcacgctcaacgaccgcatctccggcgcaatcgtgtcgcactggacatacacggcgctcgtggccgtggcgatctggctgctcttctgtcagcgccgacgcgtgcgcggactcctgctcctgcttgtgcccctgctgggccacgccgcatgggacacgccgctcagcgacgcaggcgcgctgttcgaggcattcttctgcctgatcgtggccgtcccgttcctgtatgcctggggcgacatcgcgtttgacggcgggcgccgcctttccgcggcacgtcccaagcggcataagcggcacaaggcgcaaggtgcgcacgtgacgcacaccgcgccgggcgagaaggactcgagccccgcgccgcagcccccacagggtctgtaaccagcgcaaaggtcgggaggttgtgccatgcacggtggtaacgcacggaaagacgcgcgcaaggcagcagcaagttgcgcacgcgaaaccgcaagtccctacgaccttggcactcccctcccgcgcgactatccgtacgatccccgcggccgcaggcttgcggacggcgccctcgccacggtcatcctcctgcgcgtcgcggcggcagcgctcgcgtttgccggtctcgcatggtgcgcaatctggtgggcggccacctcgcttggcgccgcaatcacggccatcctttgcatcacgctttccgcactcgtcctcgggcgcggcctcgagtatgcggccggcgcggcgttcggtcgcgcgtcgctccgcctggagccaaacgttcgccacgactacgtgctgcgcgcgttccgcaagggacgccgctccgcaggcaccacgccacgcttcctgctcgctcttgcgcggctagacatcctcagagggcagccccgcctagccggcgacgccctcgcgcgcgtagacacgtccaacctgaaccccaaccgcctaaagctcctgtacctgctacagaccgtcacggcaatccagctgcaagaagacgcccacaacgcggcaatccgctacgcgggcatcacgggcgagaaaagcgcaggcttcccgcccgatagcgtggtcattggctgggcgcaagacgccgcagacggccgcgcgcctgaggacgcaaccatgcgcgacgtctgcgcaagcgcgctgcaaccgcgccgacgcagaccgtttttggcagtctcgctctccgtcatgctggcgcactgccttctcttcgcaggcgtcgccaccggggtcgacgccacggacagttggcgcctgcacctggggtatcagaccgtagcaggactcttgacctcgatgttcatggtggcgctcgcaatcgcgggcgtcgttcttctcgcccggtggcgcatgcgccaggatgcgccgcaaacgcgcgggcgcaaggtcgcacaagtcgtgggctcgtgtcttgtggtcatggccgtcacttgccttgcgcttgttgtcgcaatcgggacgatcttcgcaacggatggaacagagcgcaccatcgcacgcggcgtacggagcgattcagccgacggacgcccatacaactacgtcgcgctcgacatggaaaacggctacggcgcagcacgcaccaccacgtattggcgcacgcgcgatttcatcgtgatgcaagagtggtcgccagcgcaggactatgacaccaaggcagaacgcaagacgactgcagacagcagcgaggctggcactggtacgaccgatgtctcgacgtccgcaacggagtcggcaggtacctcttcgagtccaaccagctccaacgcgtccgattcgggcacgcccgacgccgacagtgcgtccgcactcgcagaccagatgcgcgcagtcgcaaggtatctgcaagaacagggcatcgtgcccggcgcaagcgagcccgcgctcgactacgatgccaagggccatgcatatgcaagtctgggcacgcaaagtcaaaccgtgaacggcaaggccgtcgaagtcgggtacgagctgagagacaacggcgagtcacagcagccttccggcacggcacaggagctcgtgctggaacgcacgtatcccaacggcgggggcgatgcggagctcgtgggcttctacctggtggaccaccagacgcttgccgttacggacgaaaacaggacgtcctggtagggacgtcctgctcttctcacgccagtctttcagttgtctgcccgcaacgtcgcgccgctatgcgcccgccggcgggtcgaccacgaccttgttgccctccacgtgcacgcgaccctccgccagcagctggatggtgtcggggtacagctcgtgctcgatctcgtggatgtgcgcctcgagcgtgtccacgtcccagccctcctgcacgggcagcgcgcgctgcgcgatgatcgggccgcagtcgtagtggtcgtccgcaaagtgcacggtcacgcccgtgaccttcacgccgtagtcaaacgcgtcctggatggcgtgcgcgcccttgaagctgggcagcagtgccgggtgcaggttcacgacgcggttctggaacgtgcgcaggatcggcgcgtgcaccatgcgcatgtagcccgccatgatcacgtagtcgaccttctcgcgcaccagcgtggaggcaatcacctcgtctgccgtgatggggtcggcgtagatctccttgctcagggtcatggtctggatgcccgcagcctccgcgcgcttgagcccgtacgcgctgggacgggacgagataacgatcgcgacctccgcgtccagcgtgcctgcggcgatgcggtcgataatggcctgcaggttggtgccgctgccgctgatgaggacgccaagcctgatgggactgcggtcgctcatcggtaggtcaccttgccctcgcccttgacgcactcgcccatcacgaagggctcgaagccctgcgccacgagcgcctcgcacacgtcgtccacgtcgtcgcggccgcagatgatgctcatgcccacgcccatgttgaaggtcttgtacgcctcgtcgggggtgaggcccgccgccttgacgcaatagttgatgatgggcggcacgtcccatgcggggccgtcctcgccgccgcggtcgaccacggcatccacgtccgccggcagcgcgcggttgaggttctccgtgatgccgccgcccgtgatgtgcgccatcgcgtggatgggggcgccggccttgagcgcgaccaccaggccgccggcgtagatcgtggtcgggcgcatcacggcgtcggccaggctctcgccacccagctcctcgagcggggtctcgagctcctccacggtcttgccctcgatcgcgaccttgcgcaccaggctgtagccgttggagtggatgccggagctgggcaggcccaggatcacgtcaccctcgtgcaccaggtgcggtccgatcatcttgggacggtccacgacgcccaccacaaagccggccaggtcgtagtcctcgggcttcatgacgccggggtgctcggccatctcaccgcccaccagggcgcagccggacttcttgcagccgttggcgatgcccttcacgatcttggccacgtgctcggccttgagcttgccgatcgccacatagtccaggaagaacagcggctccgcgccgatgggcaccacgtcgtccacgcacatggccacgaggtcctcgccaaccgtgtcgtgacggtcgagcagctgggcgatggcgagcttggtgcccacgccgtccgtgccgctcacgagcacggggtcctccatgtccttgaaccccttcatgctgaagcacgagccaaagccgcccaggccgccaatgacctcggggcggttcgtctccttcacggccgccttgatggcgtctaccgcgcgggcgccctcgtctacgtccacgccggcatcggcgtaggtgatgtgcctgggctgggtctccatgtccttctcctccatatgcggcgctggttgggcgcctgtttcagacgacgttttcagtctaacaagttcgcgcacgtgggagcgctttcgtacccccacgcgcgcattttgtttacgaacgcgggcgagaagaacgtgccccctcgcccgcagcgcttccgctcttatgagctcgagccggagctctgtcccgtggccgcggcggcctcgctcttgggcacgcacagcagcacggcgcggccgtgcccaaagtcgtagttgcacgtgacgagcgtcatcacgtggctcgtgccctggatgatctgcgcggcgtcggagcgcttggcggacgccttcgcgagcatcttgttgaggtacgtgtggaactcgtccgtggacgcgaagttgaaggtgcgcaggtcgtcgtcgtagtcgctcttgatgatgtagagcagcagcggctccatctcgtacgccttgttgttgcggtccacgtaccacacagtcgtgatcttgtcgaagttggcctgcttcttgaggtcgtccagcggcgcgaacatctgcccgtcgttgaggtggtggccgtagatgagcgtctgggcgtccaccatgccgggcttggtgttctggcagtccatgaagacccgcccgccgatgctgtactcgcccgtggcggagtgacgcaggtactgcgtgttgttcttgccctggtacacggggaagttgatcgtcgtgccctcgacgtcgatccaacccacgatgtcgttgttgacggcctcgagcgcggcaaagtcgatcgtgggcgcgcccgtggacttgtcggtctttacgttggcgatcttctcgagcttctggttgttctggcgctggtggctgtactcgctctgcgcgtggaagtacaggtaccctgccacggcgagaagggcgatgcccaccaccaggaagatggtgctgagcacgcgcctgccgcggccgcggcgcctgggcttctcgcccctatcgtcccgacgcgaccttccgccgccaccgttgccgccggccgcgctgcggtccgcctgcacggaagacgcgtacgcgaccgcggacgttgccggcacgtagccggcggcacgtggcgcggcagccgtggagtcggcgtcgacgttcgacctggaatgcttacccatcggcctgtcctacgcctcggccatctgcctcttgagctccacgatcttctcgcggtactcgggcatggtcgcgcccagaatctgggtcgcgtagatggcggcgttcttggcaccgccgatggccacgcaggccacgggcacgccggacggcatctgcaccatggacaggagcgagtccatgccgccgaggtcggaggtcttcatggggacgcccacgatcggcagcggcgtgtaggcggccacgacgccgcccaggtgcgcggccttgcctgcggccgcgatgatcaccttgagcccgcggtcagccgcggtcgaggcccactcgtgcaccttggcgggcgcgcggtgcgcggacgcgatcacgagctcgtagggaacgcccagctcctcgagctccttggtgcacgcctccatcgccggcatgtccgacttggatcccatgatgattcccacgactggcttgtctgccatgattgcctccaaagcaaggtggttgttcttctccacccgtggggcgtcgcgctcccacaggctgcttacagtatagggatggcgcggcggcgccgcgagcgggcctaggagctggtgcccttggagctgctggagctcgtggtgccggtgctggtggagccggacgacgtggtcgagctggttgtgctcgtgcctcccgtcatgcttgtcttgttgtttgtcgtgttgccgagcgtggtggtgaccgtggtcgtggtgccggagtctgacttgtcatccgcactcgggccaaacacctggtcaagcacgccgttggtgatcgatccgcgcagctgcttttccgtcgcggcgtccacgcccgtgatggagcagttaaagcgcacgccctgcgccgtggacgtcttggtccagacgaaggtcatcaggctcttgatctcgcccgtcggcttgaggtagcccagcagctgcgtcttctggatcttgccgttcttgtccacgtggacgttcacgttgtatatgacggtgttgatgtcggggttcatgagcgcgttggtcgcgagcgcggccgcctggatctgcgaggacgagaagacccccagcacgtcgctggacgtgtcgtccgtgacggtcacctcgatgcggtgcgtgttctcgtccgcctcctggacggagaagtcctccgggaactgcgtgtagccgttgccccactccacgccgttgttcatggcggacaccacggtcgatatgctcacctggttgcccagggactccgtgctcacgcggcgcgccacgccgcaggacacctgcagcgccatgatgccgaggaagaatatcaacaggatgattgtggccgtcctggtcatgacctcactcaggttggagcccgaggggtccttgtcggaaagcgggtcgacctccacgccgtggcggccctggctgcgcctgctgcgctggcgcttggcggtctcctcgttggtgtggccggtctcgtccacggtcgagaagagctcctccgcctccttggcgttgagggtgcgccgcctgtgcgacctgttcttctcccttggcatgaactcccccggatcgctgccgactaacccgtttatgatatccgttttctctgttagaccacgattgacccgagagggcacaaataatgtctggggctccgtctacgatgcatgtcaccagacaagtatcaacgagggacggggccagacgggttccatgatactgcggcgtggtcgggatgatgggcattgccgagaagcgcgaactcctcgaggtgctgaaggcgcctatagtcgaggaggaagcggggggcggcgagttgagactgagatgcgaatcgctgatgcgtcacgctcttcgttgaatctatcctcgtctgctcccccacgtcttgactgcctcgacttttaggaacgtgagagtaggaactagatttttatccgtatcccacgcctcaatagcaccgtaataggacatgcggtcgtcctcgaacacaatgattggcggattgtttaggcaaacgagcaggtagttcatgagcgcgcgcccacacctgccgtttccatcggcaaagggatggatgttctcgagtacgtcatggaagtaggcggcaagcaccagcggctttgtcggttccgcttggctgacctcgtcgatgagggcagacatctcctgcggcacctcgtcgggcgttgcgcccacatctcccgagccaacgacatagtcaccgcgcttgtacgaaccgggtctctcaccggctcgccagcgacgctcgtcataagtgccttgggtaagcgtcctgtgacattcaagtacgaaatcctcgtccaacttgcggtgtacggcgaaggcatccagcagcacctcatggcactccttgaggttctggatctcaaagagcgttcgtgggtctccggtaaatccgactaccctcccgtcctcgaacaccgctcgcgtgtcgtggtagctgatctggggattctcgatatggccagagttataggcaaagcgaatgcggtagtcatcaagcgcggcagcaaggtcctcgcggcttgagatgttcctagcctgccagtcagaaacaacctgccggtacgccttatcaagaaaatcggaggccattagtcacctcacaggtaatccgaaagacgagtgcgcttgcgctctctcttgtccattttgcgggccatatcatcaaccagctgttgcaccgctgcctctccgtgactgctcgagggaggctgccccgtagcaaggacgagaccgacctgcctggcaacagcaaatgccttgccaatctctgcggtaggcttccctcgctcgagttccgatacaaaacgttgagagcaaccgctgagctcggcgaccttcacctgcgaaagcccacgctcatgtcgtgccctgcgaatagctgtgccgaaatccttcgcgtcgttgatgattgtggccattgtgtcagccaatctaataccgttctgtgtgttcctattacagttcaatcatagtctattagtaattagtaacgtacgtgattaactcgatagaggtgtagcgctgacgtctcgaagcagtacggcgccaatgcgaatcgagcttcggctccaccattgctcgaagagccttgcatgtggccggacgtcgacttcctgcagcagcgtcgcagggttcttccagagccatgcggctggttgggagttgcagtggatgcggtgcagccgagcgccacgacgagggctccccgccgtggcgagggcgatggcccagatagtcaggcagatgtcaggttgtgggcggagggacccggctggcggcgcgctagcccaggcggcgcgccacggcgtcgcacaccagggcgcccaccacggtcttggcgtcctcgatgcggccgtcgagcacggcgtcgatcagctcggggagctcgaccaggtcgacgttgatgaactcgtccgcgtccgggctcgactctgcgagcgagaggccagtggccatgtagatgtggatgagctcgtccgcaaagccggccgaggtggcgatcgtggtcaggaaggccatcttttgcgccttcatgccggtctcctcctgcagctcgcggcgggcgcagtcgagcgggtcctcccccggctgcagcttgccggcaggaatctcaaccgtcacgcggccgagcggcgcacggtactggcgcaccaggcagatgcgaccgtcctccgtgagcgccacgatggcgacggcgccggggtggcgcaccacgtcgcgctccgcctccgcgccgtccggcaggcgcacgcgcagccggtcgacgttgaacacgtggcccctgaagatcacgtcctcgtccagcacgtgctccgtcaggtccttgtcgcgcgggtcgtcgtcgcccagcaccaggtggcggctctgcggcgcgcctgacttgtggtcgtggcgcgagcggtctccgtcaaacgtgaacgcgcccgtggacgccttcatccccgcgattgcgtggtcgagaagttcggacccatccgggtcgacgccctctgccaagtcgtccatgaactcgtcctcgtcggccgtgctgtagcggggctcctcctcgggcggctccgcgccaaggcctgcatgcccctgcgtggccgcgtccttctcgcccgcgtcgtccttgggcgtggcctgccttgcggctgcctttgcctgcgttgcgtcgtcctggctctggtcccgtttgctgtccttcgacaccatgtcccccttgcttgcgtatacgcgtcgcggcgccacagggcgccgcgactgatggctagctaggttgtacccactcgggcgctacaggttcgcgcggcccttgatcgccttgatgccgatgtcgtggcgataggtcttgccctcgaaccagatcttgtcgcaggcctcgtaggcgaggttgcgagcgtcctcgaacgtgggggccacggccgtcacgtcaagcacgcggccgccgttggtgtagacgttgccgtcctcgtccagcttggtgcccgcgtggtagacggtcacgccgtccatcgcgttggcgtcgtcgatgccgtggatgagcttgcccttctcgtagtggccggggtagcccgcgctcgtgagcaccacggacacggcccagtcgtcgtcccagctcaccatgtccgggctcagcgtgccgttgtcgcaggcgaggaagcactccaccagatcgcccttcatgcggggcagcacgacctgcgtctccgggtcgccaaagcgcgcgttgaactcgagcaccttggggccgtccttggtgagcatgaagccgccgtacaggcagccgctgtagggattgccctcggccgcgagctcggccacgaccttacgctcgatctcgaccatcttgtcgagctcgcccggcagcaggatgggcacgggcgagtagacgcccatgccgcccgtgttgaggccgcggtcgccgtcgagcgcgcgcttgtggtcctgcgaggtcgcgagcggcaccagggtcttgccgtcggtcagcgcgaggagcgagcactccggcccctcgagcatctcctcgaccacgacgacgttgcccgcgtcgccaaacgcgttgaagcactcgtgcacgccgtcgagggcctcctcggtagtctgggccacgatcacgcccttgcccgcggcaaggccgtcggccttgatcacgatggggccgcccaccttgcggacgtagtccgcgcaggcctgctcgtccgtgaaggactcgtagcgggccgtggggacgcctgcgcgcgccatgacctccttggcgaacttcttggagccctccatctgcgccgccttgccgctggggccaaagacgggaatgccctccgcacgcacggcgtctgccacgcccgcgaccagcggtgcctcggggcctatcaccacgaggccgacgttcttctcccttgcgaaggccgcgacggcctccggggagtcctggtccacgtccaccttctgggccagctggtacatgccgccgttgcccggcgccacgtagagcttgcccgcgcggggcgactccgccagcttggccaggatggcgtgctcgcggccgccagagcccagtagcaggatgtcgatcttgttgtcagtaccagccatgatgccctccttgggctcgacgccgcccgctactgggcggcctttggtttgaggaccgaggcggcttcctcggcggtgatgagcgagctcggcgcgtaggctatgcccacggcgccgatgccgagctgcgcgcaggtgctggggttcgccctgagcacggcggcgcaggccgactcgaactcgttggtgtccagcggcttctccaccttctgcagggtcctggggtcgccggagtacatctcggcgtacgtgatggcgcccaccttggcggagtatcggctgagcgtgcgcgcgaggacgcccgcgatgcgtgccatgtccgaggacgagaagatctcctccgcctggccgtcgggcgtcaccttgacgaggccgcgcacgttgagggcgcgcctctggagcatgctcatgtggcccaggatgccgctgcgcttgtggccgatgcccgcggcgaggtccgcgtcgggcgtggggatcatgagcatgcgcgacgaggcggaaagcgcctgggcgcgctccacggcctcgtagaggtccatgcccgcgtcgcggtcgcgcacgaggcgcgccagtacgagggcgtactccgcggacaccgcgtgcgtgtcgatgacggtgacctttgcgccctgcaccttggacacggcggagcgcgccacctcgccggcgtcgcgcatctgcgacgacacgtggagcgatacgatgcgctcccagccctgctcggccagtgcctgatagacggtcaggaagtccacctcggacggcgagtaggtgttaatctgccccttgtgcttgggcgactcgcgatagaacgtgggcgtgtcgatgtcgaggcactccctgaactgctcgtgccccatgcgaacgacgagcggcacaagggcgacccccgccctctccagcgtggagaggggaaggtcgcaggagctgtcgcatacgatggcgaacttctttttggaggcggcgctcacgtgtgcctacttccagtaacggtcgatcgtctgctcgcggtcggggccgacggtgatgatggacacgcgcacgcccgccagctgctcgaggaagtcgatgtagtccttggcctcgcgcgggagctggtagaagttgcggacgccggagatgtcgcacttccagccggggagcgtctcgtacacgggcttggcgtgatagaagacgctctggtgctcggggacggtggtgtagcgcttgccgtcgcactcgtaggcgacgcagaccttgatctcgtccaggcagcccaggacgtcgagcttggtgatggccaggtcagtcaggccgttcacgcgggcggcgtagttgacgacgacgccgtcgtaccagccgcagcggcgcttgcggccggtggtcacgccgtactcgtggccgacctcgcccagcttgtcgccaatctcgtcatacagctccgtggggaagggaccggagcccacgcgggtgaggtacgccttcgcaacgcccagcacgcgcttgatgtgggtggggccgacgcccgagcccgtgaccgcgccgccggcggtgcagttggaggaggtgacgaagggatacgtgccgtggtcgatgtcgagcatcgtggcctgcgcgccctcgaagaggatgttcttgccggcctcgagctgctcgttcaggaagagcgagctctccacgatgtagggacggattcgctcggcgtacggcaggtacgtctcgcagatctggtcgacggtgtaggtcgggagctcgtagaccttctcgaggatggggttggtgtagctgagagccgcgtccagcttctcgcggaagatcttctcgtccagcatgtcctggatgcgcaggcccgtgcggttcatcttgtccatgtagcaggggccgacgccgcgcttggtcgtgccgatcaggttcttgccaagcttcttctcgtgcgcgccgtcgaggtccttgtggtacggcatgacgatgtgcgcgttgccggagatcttgaggtcgtcgcacgagatgccttgctcctcgagggtgtcgatctcgcccagcaggacctcggggtcgacgatgcagccgttgccgatcacggggtaggtccccttgtacatgacgccggagggcacctggtgcagtgccagcttgtgaccattggcgaccaccgtgtggccggcgttggcgccaccggcgtagcggcacacgacgtcgaagtcacccgagatgaggtcggtcaccttgcccttgccttcgtctccccattgcgtaccaacgagcactgttgcaggcattgcatcctcctgttgggtcaaaaactgccttcggcgcacctgcgccggcacgtcacagtatagggcacgagaagagccgccgaccttctcgcgcccccaaactgacgccgtatgcaattcttccgcgctactccatgtgcctggtgtcgacctccacgaacttggtggagccgggcaggaacatgagcggcacgatgttgagcgggccggaacggttcttcgcgatgatgaactccgtcacgttcatgtccgggcggtcgtcgcgcgcggcctcctcctcggtcatggagcggtccagcaggatgacgatgtcggcgtcctgctcgatggagccggactcgcgcaggtcggaaagctgcggacgctggccctttctgtccgttacctgacggttgagctgcgacagcgcgaccacgggcacctcgaggtcctttgccatgatcttgataccacgcgacatctccgagacctccgtggcacggctgtccgcgcggtgcccgcccgccgggggcgagagcagctgcaggtagtcgaccatgaccatgcccttgggcttgtccttgagcatgcggcgcgccttggccctgatctccgtcaccgtcgtgcccggcgtgtcgtcgatcatgatgtcgagctgcgacaggtcgcgcgtggcatccaggatcgtgggccactggtcgtccttgatgttgccgccgcggatggcggaaagcgggatcttggcctgcgcggaaagcaggcgctgcgcgatttccgccttgctcatctcgagcgagaagaacgcgacgctcgcgcccgcggccgcagcgttgaccgcgaggttgagcgcgaaggacgtcttgccgacgccgggtcgcgcgccgacgacgaccatctggccgggacggagtccctgcaggctcgcgtcaatcccggggtagccggtcgagacgccgatcatcccctgcgggttctggctcatctcgctcagctcgttgtagaggtcgcccatgacgtcggtcagggtggagtagctgtcgcctatctcgcggttcgtcacacccagaaggaggttctccgcggagtccacgacctccttcgtgtcctccggtgcgtcgaaggcgagcgccgtgatcttggacgccgcctcgatgatcgcgcgaagcgtcgcgtccctgtggaggatctcaacgtggtgctgccagctcgcgagcgaaaacgagttggtgttgaggtcgaggatgtaggccatgccgcccacgcggtcgaggttgcccgtgctgcgcaggtggtctgcgagcgagacggggtcgacgacctgccccctgtcgaacagctcgttcatcgcgcggaagatcgccttgtgggagtacaggtagaagtcgtcctcgttcagggcgaccaggcactcctgcaggacctcctgcgaaagcagcatggccgagagtatgctcttctccgccgcgatgtcctgcggcatcacgtgctcctgccggccgtccccacttggcgcggcgtagctgtcatacgtactctcggccatgcttcttccgtttctctcgcgcccacggcaccttcgtgcctaagcgcgtcgtcatgtctttgtcaaccccgcgtaagagcggtcacgcactatgaacgccgttttgttgataccgggacgccttaagcgggcgtttcttggcttttctcacttttcaacaattttggaaaattgtttgtgagcgagttttcaacatcgcagctccacgattccgctggaggggtcgacttaagccgcgtttcaaaattagcccatctaacagcggaaacatcacgttttcgcaggtagattgagtgtccttcccaaacgcgaagcacgggccacccgaacgaaagtctgttcgagtgacccgtgctctttgcacaagttgccaatccattggcagacagtggcccctacctgcaattcctgttgaaaatcccagctcagggccacgcctttcgcaagggtctcgcgctactcggcagactcctcagcggcgggctgctcgccctcggcctctgcggtctcctcggcaggctcctcctccgcctcggcctcggcggtcacgccaacgaggacggtgaccttggagccgatctcacggtagaagttgacgtcgaccacgtgcgcgccggcggtcttgatggcgccaccggtggagatgcgcttgcgatcgacctcgacgccgagctggtccttgatcgcgtccgcgatctgagcggcggtaacggcaccgaagagctggtcgttctcgcccaccttggcgtcgatggtgacggactggccgtcgagcttggccttcgtcgcgttggcatcggcgatgcgcttctcctcgcgcttctcgatgttgtggcggcgctcctcaagctgcttgatgttgcccggggtggcaggctgagcgatcctctgggggaacagatagttctccgcatagccctgagcgacctctacgatgtcgccctcgccgcccttgcccctgagctcacccagaaggatgactttcatgggaactccttttgttggtcggcttacgccgactccttactctctctcgggtcctgctgggacttcgccttcccgcgaggaagctcgcggaagttcgcgacgaagatgtccacaagacccagaacgctcactatcaagaaggacgcctcgaggtagaacgcgaaaacgaccaggagcacacgagtgagggggccgaggcccgccttcctcgcgtaccacatggcaaccgccaagccctggagccccagggcgatcctggcggtgttgagcacgttctcgcccaccatcttcacctgagaggaccaggttggcacgtacggccccgcaagactcaggaccacacccaccacgaagacgatggcaacccacaccggcgcgtcgaattcggaaaacgtccgggtggtccgggcgttcctctttcgtgccgcaagcacgccgcccacatgggcgcagagtgcctgcacgatggcgttgctcacgaacgccatcggccagtagaccttggccagcgcacggacggtcgcgatctggtcgctcatgtcggcgctggtggactggcttgcaaccttggcgtacgtcctcacggcctgatcgatcagggcaggcaggttcgtgccgttgagataggcgtacgtcgcgtctatccccgcgcccaaggccgctaggaccaggacggcaaggcacttagtacccgtcgagacctctgcctccgaaccgtcgccggagaaggcgaaggccgccagacaccccacaagcgcgtagggaatctgctcgggaccggccagcacgcatatgagcacggaggccaggcagctcaccacgaacgacgagcgcctggatcccctcccgccctgaagcgaaaggccaagcccgtaggcgacgatcacgcacgcgagctcgacgcccgcgtacatgcaggctccacccagcagcgtccagaagagggccccctggacggtctttgggcttctcgtcacttccctcacgccctcgtcggtcccgatgttgccgggaacgggcgggcgattgttgtcagaagtgtcagccaaggatgctacgtccttctctctggctcaactagccgcgattacggccgccgcggctggaaaccacggtgacggtgtacggcaggagagccatctcgcgggcgcgcttgatggcgaccgcgatgtcgtgctgatgctgcgtgcaggcgccagtgacacgacgcggcttgatcttgccgcggtcagtcatgtacttgcgaaggagctgggtgtccttgtagtcgatgaactcgacaccctccttgcagaactggcaatacttgcgacgcggctggcgctgttcaacttgcctttgcttagccatgtctatttgcctttcgttcgacggccgcccgaaggtgaccgccatcaaaaaatctagaacgggatgtcctcgtcgtagacgtcagccgagggcggcgtctgcacgggaggacgcgagggctgtggagcgcgcgcgggcgcgggtgcggaatagctctggtagccaccattgccctgctggccaccaccctgctgtccctggttcctgggtgagaagaactcgacctcgtccacgatgacctcgatcttgctgcgcttctgaccgtcgcgctcccaggagctccagcgaagcttgccctcgatggcaaccttcgaacccttggagaggaaacggctgagcggctcggcacggttgccgaacacgacgcaatcgatgtagttggggacgtcctcccactcgccgctctgcgggttgcgacgacggtcgttcacggcgacgccaaaggtaaggacctgggtgccgccggaggtcgaacgcagctccgggtcacgagtgaggtttccggaaatgttcaccctgttgatgctcatgcttgctcacgcctctcatccgcggacgcatgcgtccgcacttccaaactagtccctgtcggtgcgacggacgatcatgtgacgcttcaccgtatcgttgatgcggagaacgcgatcgagctcggcgatctgagcggggtctgcgtggaagtcgacgaggatgtagtcaccctcggtgagcttgtcgatctcaaaggcgagcttgcgcttgccccagtcctcgacgttgtcgatggtgccgccgttctcggtgacagcgacgtcaatacgcttggagacgccggcgcgagcctcctcagtggccgcgggatcgacaaaatacagcagttcataagccttcatgtggtcacctcctctgggctaacggctccggtttgtgaaggtatcatccggagcaggaaaggtcgatttgcaatcgtaacacacgaacttctcccccattcccaaacgccagctttcccagactcaccacacgttccccacacgtgccgacggaggatgcgttcctccaccgtgacgctagcaaagccaccttgcatatagatgtccccaggctgcagatagcttgcctggggacacatcgtcgcacgtagatgggttgttcttctcgccctcaggcgcctgggcacacggggcgtccacggactctacagaatcacggggccgtccgagttgtcgtcgttggcatccggctcgctctggggcgtggggttggctgcgccaggcgtggcgtcggtcggggtgtccgccggagcctggtccgccggagcctgcgtggggtcctgcggcttggagggctcggccagtgccatcgcggtggcgggaagcgggtccttgctggcaccccagtgcggcacgtcgaagttgcgcacccacaggcccacggccgtggtgacgatgagctcctcgaacgtcctggcgaggtttgcgacgtagcacaggagcgcgagagccgggaacacgccgctcagcgcggagaggatcgagggcatccggacgaggaggtcggagcgcgtcgagatgctcccgatgccaaagaagaggttgacgaggacgggcatgacgatcgcgaggccgagcacgaagaggatcacgccagagatgagcccgatgagaaacccaatccccacgatcttggcaaagccgccaaagtcggccttgaccatgtcccagattcggttgacctggtacgccgccttgaagtcctggtagatcgtcgcacggagcgccacgacgaggtagagcacgcccaagaagagcgtggccacgtccagcagcaggttcatcacgtcgttgttgtcagttagcttcttgagggcgccgcagatgatgccccagacaacggcccaacccaggaagcctacaaagccgcgccagccgctcttgatgcactcgcccacgcggacgttcttctgcttggggtatgagtcaacgccccacgccgtgagccgcgcccactccaggcggtacccataggtgcccagcgcgccagcaacgggcacgaagtccgcgatgcccataacgaggaggaccttccaccagcctttgtcatgcgagagaagtgcccacgacctcgagtagtaggcgtcctttttgtcgctcatgcgtacgctccttctggatgccttgcggcgcttgtccggccagctggcccgcgccttgcgtttgttgggaaagtatctggcatgtccactctaaagtaaagcctgccgcaaggtacggcgcggcgtagattgatagggctccgtaagccctcgcgctataaaaaagcggacaggacctgcgtcctgcccgcgctagctcaaatggcggaggaggagggattcgaaccctcgtacccgcaaggcgggtaaacggttttcgagaccgccgcattcaaccactctgccacccctccgtggagtactggctatttaaaagtggcgcccgaaggcgccacgcaagtattctggcggagagtctgggatttgaacccaggatacgctttaggcgtatacacgatttccaatcgtgctccttcggccactcggacaactctcctcaaaaccgcggacgtaagtatacattactttgcggcccgtggctactgacattatttcttcaaaaggcggaatgtcagccaagtgttagcggttgaggacatctgccgcctgggcgccggtcatgtccgccgtgacgcccagctccgcagcctggggcgtcatgccggttaccttgttggccagcacgtcctcaaagctgccgcctgccacgcgcacggccgcatcgcccagcgcctcggccttctcaaggctcaggtatccgcacatgaggtagccgcgtgcacacttgatcgcgatgagggaggcatgcccttctcccccaagctcagagaagatcatgccctctgccttgccggaacctatcgtcagcatctgggtggtaaccatggcaactccaatcgtctgggatttcgccccattcttcgcttcgcgggctggcatgtcaatccgcaacgccctatattcgaagttcgacctcacataccgttgtctggaggagaagaacgtgctcccttccctcatatccgccaccggccccgacgtgaccgctgtcgcgatccccgcatggctcgacgcctccgccgtggccgtgggttccgtttcgggcatcctcgtcgcgcgcgagcgcaagctcgacctggtgggctacatcgtcctcgccatggtcggtgggcttggcggcggtctcatccgcgacatcatcatccagcacaacgacgtctacatggcaaagtcctcctacgccatcccgatgaccgtcctcgtcggattccttgggtttctcttccccaacgccctcaagcgcttcccgcaccttctggagtgggtcgacatcgtctccgtcgggctctttgttgcggcaggtaccgacaaggcgatcgtctacggcttcaacgcttgggcggtggtgctccttggcacggtaacgggcgttggcggcggcatgctccgcgacatctttctgggagacacgccccgcatcttccaacgcagcaacttctatgcgctgtgcgcggtggccggcgccctgagctaccacatactggtcttccacctcaacgtgacgagccagtgggccgcagccatctgcgtggcagtggtggtcctcaccaggcgcgtgtcgctcaggttcaacatcctctcccccgccaacgtcaacctcgcgcccgccgtcacgcggcgcgtcaaggtcatctaccacatggcgaaggaggacggggtcgaaagctccaagcgcatcctccagaggctcagcaagacaggcaactaccaggtaacgttcgagaagagcgcgggcccccaggacggcaccgcctcgggaaaggcagccgccagcgattccgacgaccaggacggcagtcccgtgatagacaggatcatcgttgaggacgacgtggacctgaactcgcacgacggcgccacaggatcggactcagacctaagctagccgcaagaacaatagctaaccgcaaggcaaagccggggagaagaacatgacgtccttctccccggctcctttgtatctgcagcttatctgccgtcgcagcctacttgttgacgaggccgttcctcacgcgccacttgcggcgctcggtctcggacaggatgcgcttgcgcatacggatgctcttgggcgtgacatcgaccagctcgtcgtccatgatgtactcgagcgcctcctcgagggtgaagtgcctcggcggggtcagctgcacggcgatgtctgccgtggagctgcgctggttgcccagctgcttggtgcgcgccacgttgacgaccatgtcgccgggcttggagcgctcgcccacgatcatgccctcgtagcactcgtcgccggggccaacaaagagctggccgcggtcctgcagggtgcccagcgcgtaggcaacggccttctcggtcgacatggagatcatggcgccgttctggcggccgccgatctcgccggcaaacgggccgtactccaggaagttgtgatagaacacggcctcgccgtgggtcacgttcatgatgcgggtcttgaggcccatgatgccgcgcgtggggatgcggaactcgaggtgagtctgctggatgcctgcgctcatgttgctcatggtgccgccggcgttgccaaatacctcaattaccttgccggagtagtcgttggggcactcgaccacggcctcctcaatcggctcgagcttgttgccgttctcgtccttcttgaaaagcaccttggggcggccgacctggaactcgaagccctcgcgacgcatctgctccatcaggacggagaggtgcaggatgcctcggccggcaacctccacgccggtcttgtccggcgtctcctcgatgcgcatggtcacgttgttctcgcgctcctgctccaggcgctccttgagctgacggccaccgacgatgtcgccctcgcggcccacgagcgggctcgtgctcggctcgaagatgatggagagggtcggcgggtcgatctcgatcgggtccagttcgacggggttgtccgggtcggtgtacacgtcgccgatgtcggtggagtcaaggcccaccacggccgcgatgtcaccggcctcggcctcgctgcactccttgcggcccaggtagtcaaacgtgaagagctgcttgacctggctcatcgtacgggagccgtcgttcttcacgacgaggatcttgtcgccgtcgtggatggtgccgctgtagatgcggccaatgccgatgcggcccacgtagtcggagtggtcaacggtcacgcactgcatggcgagcgggccgtccacgtccacgtcgggggcgggcagcgcgtccacgatcatctcgagcagcgggtacatgtccatgttgccgtcgttggggtccaggcgcgcgtagccgttcacggcggaggcgtacaccacgtgctccatcgcaaactcgagctggtcgtcgtcggcgcccaggtccatcatcaggtcgaggcagtcgttcagggccttctcggggttggcgccctcgcggtcaatcttgttgatgcagatcatgatctgcaggttggctgcgatggcgtgcgagagcacaaagcgggtctgcggcatggggccctctgcggcgtcaaccagcaggacggcgccgtcggccatcttcaggacgcgctcgacctcgccgccaaagtcggcgtggcccggggtgtcgatgacgttgatcttcacgccgcggtactcgatcgagatgttcttcgcaaggatcgtgatgccgcgctcgcgctcctggtcgttggagtcgagcacgcgctcctgcacctgctggttctccctaaaggcgtgcgtcgccttgagcatctggtcgaccagcgtcgtcttgccgtggtcgacgtgcgcgatgattgcaatgttcctgatgtgctcctggagcatgtctacctcttctgtctttcgcctagtacccgcatgactctataacagcgccgctaggcgcatcgtctgcgttttggctttccatctaaactgctaccgcatcgcccacaactggggtgcgtcgttcttctcgcccaacttcgcctatctgcggcgggcgagaagaacgtgccgcctaaagcagcggctccacctcgccggcaggtgctggctccgtccacgcgaagccgtcgccctctcctctgcccttcacgtaggagtatgcggagtaggccttgtagcccttctcgccaaactccaagaggaccgcgtcctggtaggcgccggactcgtccgccacggcgccctcataggttattgcatagcgcacgggttccccaaggccgacctcggggtcgccgccatcgcgcctgagctcgcgtacctttgcgtgcgcgccggcgaggcactcctccatgccgtcgtcggaaaacgcatacgaggccacgttgctggcggcgtcgcccaccaccagcagcacgtccacgtccttgcccgcggcaagcaggtcaaacgcgtcgcccataagggtgctggaaagctcgtcgagctcgggggtgaccccgtccgcgcgatgttcgtcctcagccttgcgtgccatggcctgcccttctctacgcttgcgtttgtcttcccgctgatgacccaaggttcacgcacctaagagcgacggatgagctccgcgaccaggtcggtcacgtcgaccacctgagcggggttcacgttctggggcacgtcctcggatgtggcggaaagcgccggaacaccgccggggcccacacccatgagcgtggtcgcgcggacggagttctgcatcgcgagcgtcgcgtccgtatcgtcccagtcgtgctttgcgcggccgagtgggatgtggaggtccttggcgatgttgaggagcatcctgcccatgcgcctgtctgccctgcgcgtgttggtcctgccctcgtgcgtgaggaacacgaggtcgccggcgcccacggagtccaggttcaccaggaaggcgcccctgatgtcgctgcggtggtctgccaggaagtgcttcatgcccgcgtggtccttggcggaggcacccagcgccacaaagtagatgtcgtgtgccaggagctcgtcgtcgctcatgccgagtaccgcctggcgcaggtcctcctgcgtgggttcctgcggcatctggccctgttgctggtaggcggggtcgttccaaccctggtccgtaggctggggctggtcggccggcatgtcgtacaggtcgtagccctgagcctcggcgggcgcgacagggtcctgctgctgcggctggccgtacgggtcgtccgcatactgggcatccgcgtactggttgtccgcgtactgaccgtccatgggcacgtcgtcctggccgagattcgcgccgtcgggcgcgtcgccgtccacgaccctgaagccggaccgcgtggtggcaccacccttccagcttcccttgcgctggttcttctcgcccttgtcgtcctcgggctcgttgaagtgatcccagtcgcctatcttgcggccgtccttcttggcgtcgtagtcctcctcgacgccaagccactcgctcatggattcctgaccctcgctcgggtcgagcttcttgggacgtccgccaaacaggttggggagcttcaccttgtgatgggtgggcgccttcttcctgttgcggtcgacgctaaagcgcatggcctcgttctgcatgggctgggccccctttaccaggccaatcggctcgcgcgtgccaaccggaccggactcagcgcgctccgcgccggcgccgacgggcgtacggccggcgtttgcggccttcttggctccatcgagcggaccggaggcaaacgggtcgctcgaagactcgctcgggtcgggcagatcaaacaggaccgcacgacgtgccacggagtttacctggggacggtactcgctgcggccccagttggggtcgtcaacggggcgcggctcgggaatcttctcccgcgctgcgctgtcttcgtcctcaatcggggcgtcgaggccggatgcgtccttggattccagctcgctttccggaacctcctcgttcgggatgaagctcagatgctgcatggactctgccgtcgcagcggttgcgtcatgatcctgtgctgcctcgggctccgccggcgcatcgggctcggtctggtcgggctcgtccgttacctgctcgaccgaaccgtcggtcggcacgtcgtcggaagccacgttctgcggctctgccatgtcgccctctggcgcctcggccggttcgggctcggactcgacatcagactcaatctcgctgttagcttcgggctcgggctgctcgcttggcgcggcatcctctgcgtcatcgtacagcggctcgatgggtgacgcctcctcgcccgcgcgaggcatcggctcaaccctatccgggtactcatccctcagcgtcgccgtgggcttgagcggacgcatgtgcgccgtactctcgagctcgtcgtagctggctgccgcataggcatcaagcttggtcgtggaatccagcgactcgtcggccgcggcaccatagttcgcgtcactatatccgttgtcttcctgcgaaggcgccgcgctcttctcgtccgaatcgccaatgacctcgtagtcctccacaatgggggcgtcatccacaaagtagttgtacttgggcacgggggcaggctcgggcgcgacgggctccgcagcctcctgcaagggagcgggctcctcgtcgcgcaacgactcgacatcggtatcggcggccggctcgggctccacctctgcagccggctcggactcaggttcgggcatcatctcggactcaagcgttacctcggactcaggctcaggttcagccacgtcctcgctttccggcgactccgcctcgggctgctcttccgtcacctgatcctcagacgcatcgtagtattccgcgtccgcggtatctatatactgcggctcgtccgcaggcgccggctcctcaggctctgcctcgggcccgacttcaggctccgcgacctgctcgacaggctgttctgcctcgtacgtctctttctcggcggcatcctccgcaggctgtgcggctgcatcgtcttcgcccatggcaggcgcggactcggtcggctccgcgtcccattcgctcgtgggctcgtactcgctcatgtccaggacgggcatgtccatggtcgagtcaaggttctcgttggcgttcgaccctgcgggcgagaaggacgagccctcctgcttgcgacccttcccaaaggcagacgcaaacttcgccttgaggctgctaaagaagccctgcttcttctcgccctcaggcgcgacggcaccagtatcctcaggagccggctcgcttgtgatcgtctcccatgcttcctcgctcgcgacggttgcctcatcctccggaagggagtcctctggcgcatacgtcacatccgaagtctgctcgacgtcgccctcgtcctcggcggaaacgtcctcggactcgggctgcaccggctcctgcagagcgggagcagtcgactcgtcgtcgtagtacggcgcgacgggctcctcgcccaccggaatgtaatagtcttcctcggagctgccagcaccttcgtcatggggagtcgcctcggtctcaaaatcagcggtggcgtcctgcggtgcctccgcagtcggtgcaacctccggaaggtcaatcagcttggacttgcgctcagccgcgtccatcctcgcggtgtcctcgggagcggccgcaaacgcatccgtctgctggctgggccgcgcggtcggctggggctctggcgccgcaacaggctcgggctcggtctcgacctcaccctccggctggacggtcggctccgtcgcatccgcaaagtgagcgggctccgcgggagcctcctccacaggcgcgtctgcattctggttggcagttgtctgcccacccttcggacccgcgggcggctcgggctcctccaggacctcgtactcctccacgatcgggtactgctcgtcgtacgtcacataatgtatgtagtcgacggtcgggtgctcctgaaccatgtacgggttcacgtgagtctcgtccatggacgtcgcggggttgtacggctcgtacacaacgtcttccggctgcctgccgtcggctgcctcgggctcggccggctcgtatccctgctccgcctcggactcctcggcctccgccgctgcggactgctcgtacaggcgctcgtacttctcctcgtactccttctcgaagtcgggaatctcgggcacctgcggaagcttcgtcaggtcgggcttcggccgcggcggattgtcatacacgatctcgcagtcggtcggcaggatgttcaggctacccacaaagtccgggccgcggcggacgttcccatcaaacgggttgtccccaacctcgggaacgatgtcctccagcctctggccagagcgcgtcctcacgtcgtgggcgccagtcacgtcaccgcggttggtgccagcctcgcggttgtctgccacctgctcgggtacgcttgtcgcaaactcgtcctcggctacgccgctctctggagtcacggcaggcgtcggctcgccagcgccctcggggtacccggcattgccgcgcgaggcgttgcccttgcggaagccctgcacgcgctccgtcacgctgtcggcagccttcctaaagaaaccggcaagccccgcggccttcgaggccggcttggtctcggtctgctcgccctgcgtctctgccgcggcatccacacgctcggcgggcacggccggctggcggacgaccgtcgcgtcaacgggtgcggcctgaggctgctccgcgtacgacgcctcgttcttctcgtcatactgagcgtactgcgcgtactgcgcgggcgtctcggcgtagccctcgtccgctggcgccgcctcggtctggctctcataagtctggccctcggggttggcctctgcgtactgaccctgctcgggcgcgtactgctgtgcctcatactgctgctccggcgcgtactgctcgggagcagcctgctcgccatacggcatgtctgccggcgcggcaccctctggcgccccctcgggcgagaagtactgaccctcctcgtagccggcgggagcctcctgcggcatcgcgccctcgggctgctggccctcagccgcagccgcaccatagtattggtccgtgccctcctccggggcggtctggtcgtacgcgggctgctcctgcctgcgcgggtggagagcaacgtagcgcttggctgcgtcatcgtgcggcgcgaccatgtccatcacgcccagcatcgccgcaagcgaggacttgttgtcgctcgcgcccgtggtgcagggcgcaaacctctggtagattgcggacacgcccaccgccagaagcgggagggacgcaagtatgcccacgatccaaaagatgtgcctaaagccagccggcaggaacaccagaagctggaacaccgcgcacaacggcacgatcacgctgcacacaaacgtggagcgcttgatcatgggctggtacgcggagattcccgggtggctcagcaggtcctcgttggggctgtcgtagtgcgccacgatcacgatggggcggttgcccttcatcacgaggggaccggaggcgcggtgcacgccgatgacgttctggctcctgccacgcgggccaaggtttgccagcacgtcatgccccgcgtattccagggccagaaagacaaacgaaaccgcaacaagaacgagccccaggactcccacccgagaggagaggaagcctgccagcaggatgccaacaaacataacaatgtaaagcacatagtgtgcaaggttcccctgcgatggagcgtcaaactcctgcatctggacgtcgagtccgtgctcttccataagggagccaatcagctccgctgcgtcaagctcctcctggctattagcgggcgagatgtcgatcttctcgtcaagataatcaagataggtgcgcgttgtcgccatgctattgtcctttgccaagacaaccaaatccgctactactccatcgtcaaagtatacgtcttatgtgcctgcgtttcccaaacgcgcataacctaccttatattggtgcgcggcagggcaacgcaggtggcaacgcaggtcgtagggagtcgcactcatggctgcagacaactggggagacgaatcgtttgcgtatgaggaccgcaacagcgacgacctccaggcgctgcgcctcacctccctcatgatcggcctctccaacagcaagaagccgctctccaccgcggagctgcgcgacctctactacgcggacatgtccgaggacgccttcgcaaagaagttccagcgcgaccgcaagagcctcgcaacctgcggaatcgttgtccgcgaggtcgaccgcaccggcgagggcgcgctctgggccctcgacgcggacgccacgttcgccgcggacgcaagcctctcgatagaggacgcgaccctcatcgacgtcgtctgcatgcccctggcaaacgacccctcgtttccctaccgagacgagctcaccctcgcgctcgcaaaggtaaatcgcagctacaccacggtcgtcgcaacccgcgacgcaagcgaggccggcgcgtttgacgtgcgcctggcagagctcgttggcgcgctccagaacaggcatccaataaccgccacctaccaggcaaagtccgcgggcgagaagaactacaccctcgcgctgctgggctccttcggcatgcgcgacaacacgtacttcgtggcgtgcgactacgaccgcaggtcgcggcagctatccggcagcccgcgcaccttccggctcgaccgctttggcaaggtcaagccccttgtctctcaaacctaccagatacctgcggacttctccgtaagcgactacgtcaggctgccgttccagctcggacccaccgtctgcacggcaagcttcctcgtgccacagccgcccaacagcccagacctcacgccagaggcacgccgcgcaatcgcgtcgtacggaagcctctccaaagacaagcgcacctggagcgcggacgtgtccaacctggatgccgcggcgacatgggccatcgacgtcgagctcgtcccccagtcaccgtcccagcttgcggacagctacaagaaacggctctccgctgcggcaacgctgcagccaacgagccaggaagaggcacccgctaaggcggactcgcggtcgagaaggacggggcgccgcggccgcaagggcggcctgctcgaggcccgtcagctctcggcactcgtcggcgcgctcgaccgcgagggttcgaccctcagcgcggacgttgtcgcgcgccgcctcggctgcagccaggaccacgcaaagcacctgctcagcatgcttgtcgatgcctcagacgacaagagcctctacaggctcccgctcttgcccgcggacgacatgagcaagaccatcctcatgttccgcacgctcgcgggcaggccgctccgcctcaccaggacggagtcggcggcgctcatatccgccctgggtcacgctggcgtcacgccagatgatcccctgtttgccaagcttgcgcggggtctcgtcgcaaggccactgcaagacgacctgccaaacgacgcctctcccaaggcggatgcctccactcccgaggctgacgtcctgcgcgtctgctcgcaggcaatcgcaaggggatgtgcgctcgccttcgactacgtctcttcactctcgggccagcacacgcacaggatggtcctgcccaagggtgtcgaccacagcaacggctcctggtatctcgacgccttcgatctctcgcgcggcggcgcgaggacgttcaggctcgaccatatgacaaacctgcagctcgcacagggcgccacgcgcacccaaccgccaaagctcgccccagaggcagacgcccccaagcaggtgtcgttcgtccttctcgacccaagccttgtggatgccttccactggaaccagaccagcttcacgccgctgccgtccggccacgtgcttgcccactgcacctactttggtggcaactggcttccccgcaggcttgctgcctgcggaaatgccattgccacctcggacgccgccctctgcgaggcgattcgcagctacgccagccggctactcgtgtgactttcgccacatctctatgtacctgctcacgttctcgcactcgagcatggtgccagatggcttcggtagcgacgtcaggaactgcctgccgtagcgcttcgtcacgagcctcgagtccgcaagcaccaggatgccgctgtcggatgcagtcctgatcagccttccggcggcctgcttcacctcgatgaccgcctcgggaagcgagtagcgccaccacgcgcgctgctcgcgtctgtcgcgctcgcgcacgagtgggtcgcgcgggctcgcaaacggcagctttgggatcacgacgcagcgaagcgtctcacccgtcgcgtcgaatccctcccagaacgacttgagcgccagcagggacgagctcctgtctcgcaggaagctttccctgatgcgccggggagaagaacccctctcctggcagataagcgaaagcccggccgcgtccagcctcggcttcaggatctcgtacacgccctccatgtccctgcggttcgtgaacagcgtgagcacggagccgtccatcgcggtgtgcacgtcgtacaggaggtcggccaggcgctcgatgtacctggggtcattcggctgaggcatgtccttcgccacgatgacggacatgttcctgtcgtagtcaaagctcgaggccaggcgcacgtccttgtgcatggacgcgtcaagcctgtccaggccaacggcgtggtcaaagtgctcgaagctctttcccaccgcaatcgtcgcggaggtaaagaccacgctcatcatctcgggaagccacttctcgcccaggtcggcgccaatgtcgagcttctcggcatgcagcaggtcggagcccatgtccttcttcctgcgcgatatctgcgcggagtagacgtaggcctcgttcctaccatccatgatgagcttgagggaatcaagcagctctgtcaggaaccttcccgattcggatatctcagcagcaagctgcggcgcgttcttcgccagctccacgcgcgcagactcgatgtccttggtcgtctcctcaagacggtcgatggccacctgcgcggtctcggtcagggccgcccattccggcgtctcccgcacctcgtcgtcaatccagagcttcgtgttgtcgtaggcaccgttcgggccggataccctgcccaagtcgtacagcgccacaaacacgtcgcccatgctgacggaagacctcgcggcagcggcagcagccttggtaagaagccgtattatcagcgtcgagccctcaagccccgccgcgtgcgtcatcacgttatgcagggcaccgctcttcgtgccgccaagcagctcaaaggccgcgcgggtcttctcgcccgacacctccactgcccactgtctgcgtgcctcggactcaaagccgtgcgcctcgtcaataacccaatgccgtatgggtggcagaatcctgccctccatctcgatgtcgcgcagcaaaagcgagtggttcgtgaccaccacgtcgctcgacgcggctctgcgcctcgcgccatgcaccaggcactcgttggggaagtatgggcacttggtgcgcaggcactcggcgggcgtggtcgtcagcaaggcacgcggcacatagcgccacctgatgcccagggcgtccaaatcgccctccggggactggcagcaatacgcatacgtgaccgcaatcgcggtcataacgtccgattccacggcagaaagcgacttcgtcgcgtcagaaagcagctccgtcggcagctcgttacgggccgcaaggtccagcctgtgcaggcaggggtagtggtcgtaccccttcaggctcgtaaaggagatccccccaagcgccttcgaaaccgcaggtagctcgtgcgagaccagctggtcggtcagagtgttactcttcgtggcaacgcccacggtcacgccgttgcgcttggcaaacgccgcctcgggaagcaaatacgccatggacttcccaacgccagtccccgcttcgatggcacgatgcgtcgagctcgccagcgcgtcccgcacctcaagcgccatctcgacctgctcaggccgcggctcatatctgtcatatagctgcgacaccacaccgccgggcgcaaacgcggcctccacctcgtcacggctcatcgccacaaggtcgtcggccttctccgccgcgtcctgacgcggctgcgcaacaacctcacgcagcagctcatgtctcaacgccttgagcgagaaggtcgtgtcctcgtcctcgcgctcaagtgccaaatgcctgatgatcggcctgaactcccagtccacgtcgtcatgcatctgcgccaggagcaacagcagtcccgcgggcaggtcgctcagccccagcaggatgatgcgccacataccgcacagtgcctctacgtcggcgttagcacggtgcgtgaccgagtcgcagtcaaacgcctgggccatgtcggacaacctgtgcgagctcagccgcggcagcgcaatcctggaaagcgccagagtgtcgatccagttgtctgtcacatccctgccaccgggcgtccgctcaataaacgtcctgtcaaacgtcgcgttgtgcgccaggatcggcgcaccgccaacaaactccgccagcatggctaccgcctcaggcgcctcgggggcgtccgcaacgtccacgtcgcgtatgtgcgtaagcgcggtaatctccttggggatcgggccgcccggatgcacatacgtctggaacctttcggatacctttccctcggatatcctcgcggcggcaatctcgatgaggtcgcagtccttaaaggaaaggcccgtggtctcggtgtccaagaccacgatgtcatcctcaaggggaccaaagtcggccgtcttcgctcgttcctggagcgagaagtactgatcccttatcgattttggtgtaccagggaggaggagcgactccagggtcgcccctcccttagccgtatcggcagacgccatgcagtgtccttacttcttacttttccttcgcagcatgtgcctcgagcgcatactccacaaacttgcggcagagctcggggaactcgatgccgtcgtgacgcgcggagtccggcatcaggctcgactcggtcatgccagggatggtgttcgtctccagaatcaccggcgtgccatcagactttacaataaagtcgcttcttgatgcaccgaggcagccaagcgccttatgtgcccgcacggcaagctcctgcgccttcgcgtaagcctcctcgggcagacgcgcggggatgacatggtgaagggcggacggctcgtacttcaccttactgtcgtagaagtcggagccggtcacgatctcgatgatggggagcgcgtgaggctcgtcgttgccgatgacgggtacggagatctccataccctcgatgcaggactcgaccagcacacggtcaccctcggagccggccttcgcaactgcagccgccagctcatcagcagaagtgacgcgggacacgccatagcttgagccattagctgcaggcttcacaaagatgggcagaccgagcttcttcacaagctcttccgccatcgcatcgtctacctgcgtgtcaccctttaggtcaacaccctcgggcactgggatgccggcggacctatatatcgactttgcaacttccttctcggtgccggtggcagacgcaagcacgccagagaacgtgtaggggatatgcataatctcaagcagaccctgtatacaaccgtcttcgccgtagcgaccgtgcattgccacgaaggccacgtcgtagttgccgtcggcaagcgtcttcacaaagtcaggcgccgcgacgtccaaaaagtcgaccttctcgaatccagcctgaccaagtgccttctggcacgccttgcccgactgaagcgagatttccctctcgtccgaccatccaccggcaagcacaaccacgctgcattgtgtaacgtcggtcttctccatcttaagctccttcatcctgcacttcgtgcggtagtatcaactcgaaaggcgaggtaactcaaacgaggatactccacaacaccacgaagacccaggcgaggtcccaaatcatgcaagatgccaatactcagcagccgtcttctaagccacaccagaagaaggacattcacagctattcgcacaaggagcttgtcgcgctcttcaaggagcttaaccagcccgcgttccgtgccaagcaggtggaagaatgggtttgggagaagaacgcgacgtccttctcccagatgacgaacctaccgaagtcccttcgttccgttctggaggagaaccttactctcggcgggactgaggagctcgtcaagcaggtctctcaggacggaagcaggaagtacctgctgaggtatcctgacggagtttccgtcgagtgtgttggtatgcccaatcgcggcaagcttgcggtttgcgcatcctcgcaggcaggttgcccgatgggttgcgcattctgcgccaccggtgcctccggctttacgaggaatcttaccgctggggagatctacgagcaggtaatgcatgtgcgcgacgacttcgacacgcgtgtaacgagcgttgtcctcatgggtcagggcgagcctttcatgaactacgatgctgtgctttccgcgttgcgcaagctcaactcgcctgacggagcgggtattggcgcaaggcacttgactgtttcgacttgcggcgtcatccccatgatcaagcgcttcgcgaatgagcctgagcagttcacgcttgccgtctctcttcactccgcggttcagcgcactcgtgacatgctgatgcctggcgtcaaaaagtactctctactccatctttacgatgtcatgggtgagtatgttgacaagaccgggcgtcgaccgacatacgagtacgcactgatcaagggagttaacgataccgaggaggagcttgcctcgctttgtgacttctgccgcgacaatcttgcacacgttaaccttatccagcttaacgacgtcaagggttctaagttccagccgtcatcagaggcacgcgcccaggagtttgtcaggcgacttgctaacgtaggcgttgaggctacgatcagaaactcgcgtggctccgatatcgatgccgcttgtggtcagctcaagcagaatgtcgagcgtatgagtcgctaaccattctccttagataccttgtggaaaaggccggcctggaagttccagaccggccttttcttagtacccgatagccttccattcgttgagagttctctcgctgttcttagttgaagaactctcttgctctcttttagcctttgaagccttcactgcctcgcttcccttgtctcttagaaaccggatgagtgactgcaatgattgcttggcttcatcgtttagcagaagatagcttattgtcagaagcatactcacagataagattccgcatccaaacgccgccgttgacttcttcattcgtcatctcctgaagcttcttcattcgagagcatgtccactattctcgccaaatcttcgtcagtcgagaattcgatctctatcttgttcttgttccggagacgcttaaccttgacgtttgtattcagtgccgtacgaagctgtctcgctgccctcttatatgcgagcggtgtaggctccctatgctttctctcttcagtctcgccagtgccagaaaataggggagcaagcttttctgtctgtcttaccgttagattctcgtcgatgaccttatgtgcaagcttgatttttccctcagatccggagacagccagaatcgcccttgcatgccctgctgtaagtttcccatccaacatcatctgctggacctcttctggcaaatcaagcagtctgagggtatttgctattgccgagcgcgatttcgagagcgctttcccaagttgctcttgagtaaagccattatccttaatgagcttctcgtaaccttttgcctcttcaattgggttaaggtccgaacgctgcaggttttcgattagggcaagcttgaatacctctttctcatcaatatccttgatgttcacaggtatttccttgagaccggcaagctttgcagcctggtatcttctctcaccagctacgatttcgtaattcgaacctttcttcctgacaagaattggctgtagtactccgttttgcttgatggagtccgcaagttcctcaagtgcttgttcgtcgaaattctttctcggctggtctttgttcaccttgatcttcgacaatgggagtgttgaatcactcgaaatggcggaaatctctgcatcggccgttcccattagggattcgagtccctttccgagtccaccctttctagccacggcgagtcacttcctttgccaacttcatatatgccaacgaacccttactgacatgagcatacagcgtaatcgggagcccgtggcttggtgcttcagacagtttcacgtttctcggaatgattgtcttgaacacttttcgaccaaaatactttgttacttcctcgacgacctgcttcgaaagcgtcgttcttgcatcatacatggtcattactacgccaaacacgtcgagtccagggtttagacgggtcttgaccatcttcatagactcaagaagtttagttacaccttcgagcgcgtagaactcacattgaatcggaattaggagagaatcagcggcaaccaaagcatttaccgtcaagaggccgagtgatggggggcaatcaataaagatgtagtcaaattcgtttctaatcggctcaagtatgctttttagaatgctttcccttgccatggctgagacaagctcgatttccgcaccagcaagttgaatcgttgctgggattacaaacacatttggctcgacagtctctgtaatgagctcctttattgggaagtcattgagaagagcatcgtaaacgtcgtgttccagttcctctttttcaattccatacccgcttgtcgtgtttccctggggatctaggtcaatcacaagcactttcttcttattctctccgagcgctgcagacagattgacggcggtggtcgacttgcctactccacctttttggttaatgatggcgagcaccttcgagtctctgtcaggaaacgctcgttttacttcctcatacttcatgtttctccccacattgtttcacgtgaaacattagacaatatacttttagaacagagggcttgcttttgcctcgccagttcttctaggtagtcttacactcgatctcttgatcttctctactttaagaatctcacgatgaccagactcgttcggaagttcgaatgtttcacgtgaaacaatcttcattccacaaatctttgcagtcttaatagcatcgtccaattcttcgtcagttagattacctttcgatgcaatcaagaagccaccgattgctagaagaggagctgcgtactcaattagcaccctcaacttagcaactgcccttgcagtcacatattcatactttgaatcattggaacgagctaagtcttctactcgaacatgaaaggcatggcagcggtcggccaattcgagatcttcaataaacgaattgacgcagtcaaccttcttgccaacagagtcaaccatatcgatagagaaattcgtcatgatggcgataggaattccaggaaaaccagcaccggtaccaatgtcacataaatgagagtcgtcctcaagtgagctcatttgcttcaaatataggagtgagtcaacaatatgacgatctatcgcatcgtcaacagatgtgatcctggttagattgattgtcctgttcttctcatttacaagagagatatgcttgaggagcagttcagcctgatgtacagaaacagggatatcgaaatccctagccatcaagatgactctatcaatgttggtactcatgtgggcctttcagtttgacagaagttcccgagtcgagaattttcgtcctagacaagatccaaatcacgctactagtgaagtcaactatgacagtatgatatgccatgcctaagaggaaacgctcgacaccctagacagcaagattcaaacgtatgactaagtgggtcgcaaatcccccgtacttctcagcagcctcttatgattcgcttgtagaccagaatgatgacagacagcgtccactagtagcagatgagaattctcagacactcttatactttctactaacaggcgaatgtggcttcgtgtgactcatgaggaacaggaagtctcactaagagtttctgttcctcatgagccagtatttaaagatgatctaggggcacaactcgcaattaacacccaaaaagctgatcgacccatagaagtattgaagcgtcctcacgctgcacctcttgcaggcatcataaagatcaagagacaaccaggtaccgaacgctacttcttgacccgatgtgcgtctcattgtcatgtacgtgtcctgacatgggatattaagcactcaccagcagtacctcagctagacattgctccaatcctctttgtatatatgacagtaggcagtcacaccgaaatcagaaggagacatcagacgcaccgtctataacagatggcagggtcataccccacagaccctagacgcatcatcgataccaatcgagacaataccttgccagctatcaaagcattagcaatccgagagtagcgaatcgtgcgggtcgcggtaacctccccgcacccgcctgacaccactcggggtaccatggggatgccaaacatagatttgcccaagcggccacccggtcctatgtttggcgaca

SEQ ID NO: 176 - DNA, 1848 bp, Unknown
  Metagenome-assembled genome
cttgatatttatacagttcaataatgagattcgtcatgagctggcgtaaattaggatccgcaatccctgtcatggacggcaagtttaacacatctagggtggcccccttattttgaatggtgttcataatcttagttaagtcctggttgtttcggcccaagcggtctaattcagtaaccaagacaatatcaccttcacggatataggccagcatcttttgcagttctggccgattagtgttagccccacttaatttatccgtaaataatttatcaacgcctcttaaagcagctaactgtcgatctaaatgttgctccttggaactcacgcgagcataaccaattttagccattgtcagcacttccttttggacagttctaatgaacatttataattcctagtatagcacaggaccaaaaatgaccattagggtatgccctaatggacattgaactaacttagcgaaaaagaaaaaattcaccttcctttagctgatctgtatttaatcttgaatctataacgttctgatctccatttgccattttcaatagatcttctttggatataaactttgaatgaaaagaagcttcttgataggcaatttcccaatctctcaaaatattataatcttctgaaaactctatgttcttttttacaccctcaaaatctggaaataatttggtgctgatggctccgttttcttttaaacatttttgtaaataatttcgatccctttgcggtagtttgtggaccattaaatctggtttgtaggaaacaaaaacacgacactcatttgaatgtcgtgtatacataataatattcataactatgtaaaaattcccgacaacataaaaacaacacacttccaatttatacttattatagaaacaaagcaaaaggaagtgaaactatgtcacaatggattctgatagccctttttcttctagcacacccactcatgatgctatttatgcacaagggtatgcacggtggctctggtagtatgggcggctgtggaaacaacactcaacaaaattccaataatactgaaaagccacgtaaaaaagtcaattaacttgggggtatatattatatgaaaatattaactggtagtcgcggtgatgaggtccatgaacacctttacgaaaatggtcaaagacgggttggtcatcgtatactaaagaaaaatacagtgacaaacaacggagaatttcaccctgtacctggaaatatagttctcattcccttaaaagggacggtgaaactgaccacaccagatcaagaatgtacaatcaaaaatggtcaacttgcaatacttggaccaactgatagtttttacttaactgcaattgatgatgttgaatttgtcggtgttgttgatattaaatagctcaaaaagagtgtcacatggcactcttttttatatatgctggcttctccatatttacgacacatatgactgttttaataaagtgtatttcaaaaaaatggaggagacaaagttgaaattaacgcagagaaatatgcctactttagttaccgcactaacattaacagatgttacactctccactggaaaaaaactgcttgaggcagcaacaacttggactacagttttttataaagttgatgcaactactgttaatcaagaggattttagcactaagattggtctaaatagcctacagtctgatggatctgtcgactcgatcggtaattactcttatactttgcctgcagttcgcgtcttttaactaggttgttcactgaagatgtttaaaaatctaaaacagcaaatacgcccttgggactacataatcatttttatactacttgtcgtttctttta

SEQ ID NO: 177 - DNA, 66846 bp, Unknown
  Metagenome-assembled genome
cggctgaactcgggcgacatggtgaacttctcgtcgtcgaagtcgatggagcagcccatgcgcttgatctggctgacgatggtgccgccgtactgctcgcgccacttccagcactcctcgatgaacttctcgcggccgatcttgaggcgcgatatgccctcgctcttgagcttcttgtccaccttggtctgggtggcgatgcccgcgtggtccgttcccaggatccagcgcgtggagcggccgcgcatgcggttgtagcggatgtaggtgtcctggatcgtgtcgtccatggcgtggcccatgtgcagaatgcccgtcacgtttggcggcgggatgacgacggtgcagtcgcccacccccttgctgcgctggtagcagccggcgtccatccagctcttgatgagctcgggctccgcggtctgggggtcgtagttctttggcatttcttccacggttgataccgccttcttacgcgccccgtcagacggtgtgggcactcgtgtaatgggcgcgcgcctccgccggggctggcttacgttgcgacccggccggcggcgccggtcaagtcagcccaacagcataccacgcgcgccacgcgccgcccgcacgaccgcgtgctacagtcgttaccacacacgcgcccacgcggcgctcgagccttggaggtaccgatggacgagaagaacgccaccgcggaggaggacgctccgcaggtggaggcggagaccgcgaccgaccggctgcgcatcatcctggggcaggagcggctcgacgctctggcgcgctcccgcgtgctggtgctgggcctgggcggcgtgggctccaactgcgtggaggccctcgcgcgcggcggcgtgggcgagctcgtgctggtggaccgcgacatcgtgcagccctccaacatcaaccggcaggccgtggcctaccactccaccatcggccagcccaagaccgacgtgatggaacgcatcgtccacgacatcaaccccgactgcagggtcaccacggtgcaccagttcctctccaaggagaacctcgtccccacgctcgaggcgctcccccgccccgactacgtggtcgacgccatcgacaccatctcgcagaagctcatcgtcgccaagtggtgccaggacacggggctgcggctcatatccagcatgggcggggcaaacaagctcaacccggagcgcctgcgcttctccaccatcgagaagaccaagtccgaccccatctgcaaggtcatgcgtaaggaatgccgcaagcgcggcatccgcggactgcaggtgctctactcctccgaggtgcccatgcccgtgacgccgcgcggcgccgacctgccagacggaaagcgccccgagaagggcgtgaccctgggcacgatgagctacatgccgcccatcatggggcagatgatcgcgggccgcgtgatctgcgacctggcggatctccacaacgacctggacgtgcaggcgcccatcgtggcggagcgccgccgcgggagcaggtgaaccgcatgggcgcgggcgccgcggaggacatggccggcatgaggctgcttgacgcgcactgccacctggactttatgtccaacatgcgcgaggtcgccgcggacgcgcgcgaggacgggctctgggtcctcgcgaacacggtcacgcccgcgggctacacagccgcgcgagacgcgctggccgaccagcccaacgtgcgcgtggcgctgggcatgcacccctggtgggtggccgacagtcgcgtgggcgagaaggacgtgcacgacttcgagcggctcgctgccaaggcgcggtacgtgggcgaggtcggcatggacttctcgcccaagcacgtgcccgaggggtccttcgaccgtcagcgcgaggcgttccggcgcgcgtgcgtcgccgccgcggcggatggcgggacggggccgcgcgtgatgtccatccactccgtgaggtccgccggcgaggtgctcgacgtgctgggccagaccggctgccttgacaggtgccgctgcgtcttccactggttcacgggcacgtcggacgagctgcaccgcgccgtcatggccggctgctggttttccgtcaacgagatgatgctgcgcacgcggcgcgggcgcgaatacgcgcggcaggtgccgcttgcgcagctgctgacggagacggacttccctcccggggaggatgtgcccttctcggccggggaaatcgaacgctcgctcgagggatgcatccggacgatcgccgagtcgcgcgtcatggagccgaacgccctcgcgacaatcgttcgcgacaacgcggtgcggctgctggggtgacttcgaattgccctcctcttgcaagttgattccgcgcgcttgcacgaagtcggggattttgtgcgtttgaggtcgcaatcgcatggtcccaaaggccatcttcaagctgaggcatgcagtcgaatcacacaaaactccccgattgaggtcccagaagtgtgactctgtgtgtttctagactgtcgggcccgcttccccctccgtcgaaacgctcaaaatcccgcatctcgtgcgcttgcgataaatcatctccaccttcacacgccgacacgatggtcccgacatggcataaggggagcccgccaccatcgtgacggactcccccactcagaacgatatctgtagctaaacctgccagctaggcgctgtgcttgccaaagctcgagctcttgcgcacgatgcgcggaggctccttgccgcccacggactcgggcgtcacgatcacgtccgtgatctcgaggtcactcgggatgtcgaacatggtctcctcgagcgtcgcctcgcagatggcacgcaggccacgggcgccggtgttgcgggcaatcgcctcgcgggcgatctcgcgcagcgcgtcctcctcgaactcgaggttcacgccctcgatctcgaacatgcgcttgtactgcttgacgatggcgttcctcggctgggtgaggatggtcaccaggtcgtcctccgtcagctccttggtggaggtgatgacggggatgcggccgatgaactcggggatcatgccgaacttgtgcaggtcctggggcatgacctgggccatgagctcgtcggtgttctcctcgaccttcttgttgagctcggcgttgaagccgatgcccttcttgccgatgcggtctgcgacgatcttgtcgagcccgacgaaggcgccgccgcagatgaagaggatgttgcgggtgttgatgtggatgagctcctgctgcgggtgcttgcggcctccctggggcgggacgctcgcgtccgtcccctcgatgatcttgaggagcgcctgctggacgccctcgccggagacgtcgcgcgtgatggagaggttctccgccttgcgcgcgatcttgtcgatctcgtcgatgtagacgatgccgacctcggcgcgctccacgtcgccgttggccgccgtgatgagcttgagcaggatgttctccacatcctcgcccacgtagccggcctcggtcagggtcgtagcgtccgcgatggcgaacggcacctccaggaagcgcgcgagcgtctgcgcgagcagcgtcttgcccgtgccggtcgggccgagcagcaggatgttgctcttggcaagctcgaccttctcgccctcggtgttgacctcctcgtcgcccatctggacgcggcggtagtggttgtagacggccacgctcatggcgcgcttggcggcctcctggcccatcacgtactgcgagagctcctcgtagatctcgtggggcgtggggaggttctcgatgagcgccgactcgtcgccgggctcctcggcctcggccgcgtcgtcgtcactgatgatgtccgcgcactccttgacgcactcgtcgcagatgaagacgccgttgggtccctggatgagcttgcggacctggctcctgctcttgccgcagaacgagcagtgcatctctggcatgttcatgtcgttgttcggcatctgccttctcttccttgtgaaactaagaacttacgcctgctccgtgcgagaggcgatcaccttgtcgaccaggccgtagtccttggcctcctgggcgcgcatgtagttgtcgcgctcggtgtcggcgttgatcttctcgacggtctgaccagtatactgcgagagcagctcgttcatgtggttgcggatccacttggtctcgtccgcgacgatctggatgtcggtctgctggccctgggcgcccgagctcggctggtggatgaggatcatcgagttgggaagcgcgagacgcttgcccggggttcccgcggcgagaaggacggacgccatggaggcggccattcccacgcagatggtggagacgtccggcttgatgaagttcatcgtgtcgaggatgccgagtcccgcgtagacctcgccgccgggcgagtcgatgtagagcgagatgtccttgtcgggatcctggctctcgaggtgcagcagctgcgcgatcacgaggttcgcggagtcgcgcgtgatctcctcgccgaggaagacgatcctgtcgttgagcagcctcgagtagatgtcgtagctgcgctcgccgcggggcgtctgctcgatcacgtacgggatgagcggcgtgttcatgggattgtgcattgggtctccttccggtcgttcgacccttcggtcccccggccgcggccggggtattgttaccaaaaaggaagcaaaaagcgctccgaggtctgtgtacccccggagcgcttctctagtcctctgaagggagagggttactcggcgtcctcagaatccgcatcggaggcgtcgtccttcttggcgcgagcctcggcgacctcgtcgacgacggtcacgggcgcgttctcgaccatccagtcgaccgccttggagcgacggatggactcgcggatggcgggaagctggccgcccttcctgaagtcctcgatgcgggagtcgacgtcgtcgacaccggccttctcgaactccttgcggacgtcgtcctcggtggcctcgagctcgagcttgtcggccagggcgtcgagcgccagggactggcgggcgcgctcctcggcctgctcgtggaggtcgttgatgaagtcctggctcttgatgttgcgggcctggaggtacatgtcaaggctgatgccctggcgctgcagctggccgaggacctcctgcgcgagctcgttgaagacctggttctggtaggcctcggggacctcgtcgagcgtgaggtgcttgccgatctcctcgacgacgcggtcctccttgagggagggaaggctggacttcttgtcgttctcgatgtcctccttcagggcgtcgcggagctctgccacggtgtcgaagccgaagttcttcttcgcgaactcgtcgtcgagctcgggggtgacggacttcttgatgcccttgagcgtgacggagacctcgtagttgcgctggtcgtcaccctcgccctcggtccaggcgatgtccttctgctcgcccttcttcatgccggcgacgccagccttgaagtcctcgggcaggtagttgctcgcgaggttgagctggcggtcggtgccggcgaggccggacttctgctcggccttgtcctcgacgtcgagcacgacgacgtcgtccttctcggccggacggtcctcctcgacgtcctcgagggtgttgcggtagctcatgagctgctcgagctgctggtcgatctcggcctcggtggcctcctcgggcggcatgttgatggcgggggcatcatagctgtcgagctcgcaggtgggcgggacggtgacggtggccgtcacgacgaagtcctggtgctcaacgacggacagggggtcgtcgccgtagttggggttctcgacggggacgatgtcgagctcctcgagcatggcgggctgcgcgtcgttcatgaggtcctcggtggcctggcccaggacggagtcacggccgacgatgccgtcgatgacgggacgcggggtgtggcccttgcggaatccctggaactggtacttgtgggagatgtccttgtacgtcttgttgacgtacttgtcgacctcggcggcagggacggtaatcgtggcgactaccttgccattctcaggcttctcagcggtgacggtaatgttcaacgttcctccagtgcttctcgtgccgggtgacggggcccacgtcccgacgcctggcgcagttactttgctttgttgatggtgcgggcgaaaggatttgaaccttcacgagatctctcccactggaacctaaatccagcgcgtctaccagttccgccacgcccgcgaatcaacgcacagcctatgcatgatagcaaacaaggggcagtttacccaacacccagcaaatctttccatgcgagttgcgcaattttggccgctagcgacggcattgccatcagggcgagaaggacgtgcgctcccgggcgcacgtccttctccaccgttgttacttctccccggccgctatgcgagcgccgctaagcgaggtcctgcagcgcgtacacgtcgagcgagctctgccgcaccgccgcgagcgcctgcacgagcgccgtcgtggcggaaagcgccgtgacgcacgtgatgccgcggctgaccgcctcgccgcggatccgggcgccgtcgcctcgcgagtcgtgcccgtgcggcgtgttgatgatgaacgacacgcggccggagcgcatctcgtcaagcgcgttggggtgcccctcgctcaggtgccggcagacctcgcactcgatgcccgcggcgcgcagggtcttggccgtgccgcgcgtggccaggatgtcgtagcccagccccctgagcgcgagcgccacgggcgcgatggcgcgcttgtcgcggtcgcacacgctcacgaagacgcagccttgctcgggcatggcgtagtcgatggcctgccgcgtcttggcgtaggccttggggaagctgtccgccacgcccatgacctcgccggtcgacttcatctcgggcccgagggtcacgtcagcccccgggaagcgcgcccagggcatgacggcctccttgaccgcgaagtagcccacctcgcggtcctccggcggcaggccgaggtcggcgatcttctgccccgccatgaccttggcggcggcgcgggccaggctcacgccggacgccttggacgagaagggcaccgtgcggctggcgcgcgggttgagctcgatcacgaagagctgctcgtccttgacggcatactggatgttgagcggtcccacgatgcccacggccagcgcgagctcgcgcgtggtcctgcgcacgcggtccacgatcgcgtcagacagcgagaaggccgggtagcagcaggccgagtcgcccgagtggatgccgcactcctcgatgtgctcgaggacggagcccacgtagcacgtggtgccgtcgcagatcgcgtccacgtcgagctcgatggcgtcctccaggaaggagtcaaggtacacggggtgcgccggggagacgtgcgcggcctcggccatgtaggtcgcgagctcgccgtcgttgtagacgatggccataccgcggccgcccagcacatagctgggacgcacgagcagcgggtagcccacccgtcgcgccacctggcgcgcctcgtccacggtctgggccgtggagctgggcgggtaggccacgtccagcctgtcaagcagctcactgaagcgctcgcggtcctcggccaggtcgatggcgtcgggctgcgtgcccatgatcgggacgcccgcggccttgagcctgcttgcgaggttgatgggcgtctggccgcccagtgtcaccacaacgcccgcgggcttctccacctcgcacacgttgagcacgtcctcgaaggtgagcggctcgaagtacaggcggtcggacgtgtcgtagtccgtggagaccgtctcggggttgcagttgaccatcacggtctcgtagcccatcctgcgcagcgccgcgctcgcgtgaacgcagcagtagtcgaactcgatgccctggccgatcctgttgggaccggcggaaaggatcatcgcgcgcggccgctcggagggggcgtgctcgctctgggccgtgccgcccacgggcgcggcctcgtaggtgaggtagtggtagtccgtgtgcgccgcgaactcgccggcgcaggtgtcgaccgtcttcacgacgggccgcactccctctatctcgcgcagtgcgcgcacgacctccgcgctcgtgcctgtgagccaggcgatctgcacgtccgagaagcccatctgctttgccgcgagcatggtcttggcgtcgagccccgccgtgcccagctcgtgcaggcgcctgcccgcgcgcacgatgttgtcgatcccgtgcaggaaccacgggtcgatccccgtggcctcgtgcacgcgcgcaacgccccagccgcggcggagcgcctccgccacgaagaatatgcgctccggcgtgggctcggccacgcgggacgcgaactcatcctcggaaaggccggcaaagtcgtccgtgccgtccatccccaggccggcgtgcccctgctccagcgagcgcagcgccttctgcagcgactcctcgaacgtgcggccgatggccatggcctcgcccacgctcttcatgcgcgtggtgagccgctcgctcgtgcccttgaacttctcgaaggcgaagcgcggcaccttgaccacgcagtagtcgatcgagggctcgaagcaggcgggcgtggcctgcgtgatgtcgttcgttatctcgtccagcgtgtagccgacggagagaagcgcggcggccttggctatggggaaccccgtggccttggaggccagcgcggagctgcggctcacgcgcgggttcatctcgatcacgacgacctcgccatcggccgggttcacggcaaactgcacgttggagccgccgcaggcaacgccgaccttctccaggatcgccagggagtagtcgcgcaggcgctgcagctccgggtcggagagcgtctggcacggcgccacggttatggagtcgcccgtgtgcacgcccatcgggtccaggttctcgatggagcacacaacgatgccgttgccggcggagtcgcgcatgacctccatctcgatctccttccagccctcgatggagcgctccaccagcacctcgtgctcggggctgagcgagagcccctgcgacgcaatggcctccagctccgcgccgtcgtgcgcgatgccgccgcccgcgccgcccagcgtgaagctcggacgcaccaccacgggaaatcccagccgcgccgcgatctgcttcgcgtcgtccaggctgtgggcaaagccggagtcggccaccttgaggccgatctcctccatcgcgtgggcgaagagctcgcggtcctcacccacgcggatggagtcgaggtcgcagccgatgacctccacgtcgtacttctcgagcgtgccgcgctcgcccagcgccacggcacagttgagcgcagtctggccgcccatgttggggagaagggcgtccggccgctcccgggcgatgaccttctccaccgcctccgccgtgatcggctccacgtaggtgcggtccgcggtctccgggtccgtcatgatggtcgccgggttggagttgacgagcacgacctcgtagcccgccttgcgcagcgcacggcacgcctgtgtgccggagtagtcaaactcgcaggcctggccgatcacgatggggccggagcctattatcaggatcttgtgtatgtcatcgcgcctcggcatcagaagcgcctcccctcgcgcacgtcgatgtcgaggtagtcggcatcgccctccatcagcctcgcgaacgacctgaataggtaggccgagtcgtgtggccccggacacgcctccgggtggtactgcacgctgagcgcgggcacgtccagaaactgcacgccctcgggcgtcccgtcgttcaggttcacgtgcgtcaggcgcacgcgccccatctccgcggtccgcaccacgggcgccacgccgcgacggcaccacgcgcgcaggtcgcgctcgtgctcggcgtagccgcccgactcctcgggcacgatcggacctagcgagtcgaacaccaggccaaagttgtggttctgcgccgtcacctccaccttgctggtcaggaggttcatcacgggctcgttgccgccgtggtggccaaacggcagcttctctatccgcgcgccggccgccatgctcacgagctggttgcccaggcagatgccaaacacgggaaccttgcccaagagctcgcgcgccgcatgcgcggtcgccgtcacctggccggggtctcccggtccgttggagaagaacacgccgtccggcctcgcgccgtcaatcccaagcgcgagcgtccgctcggccggggtgtcccacggcacgacgaccgtctcgcagcccacggaggcgaggccgtccgctatgccgcgcttctcgccgcagtcgtacgcgaccacgcggaagcggcgctcgcccttggcgggcaccacgtgctcctgcctgggcgagacgtccgccacgaggttccggctcgatatcccgggcgcctggcacacgcgcgccaccaggctctgcgggtccaggtcctccgtcgaaatcgcggcgcgcatggcccccgcggagcgtatccgcagcgtgagggcacgcgtgtccacgccctcgatcgcgacgacgccctcgcgctcgagcagctcggggaggctcccctcgctctgccagttgctgggctcgtagcacatgtcgcgcacgacgaggcccgccagcgcgggcgcgcccgactgcatcgcggccgcgctcacgccgtagtttcccacctgcgggtacgtgagcgtcacgatctgccccgcgtagctggggtccgtcacgatctcctggtagcccaccatggaggtgttgaacacgatctcgccaaaggcctcgcccgtcgcaccggcgcatcggccgcggagcaccgttccgtcctcaagggcgagaagagcctcgcgtggtggccgcatgcaaacaagtggattcatgcccatacctccttcgtgcgcgtgcaaaaaacggaaccccacctgcggcggagctccggcacatacgtaacgtcacgcgctttgtctgccttgacggtatctccgtaccatccttaaaggttgttttgcattctagatttttacttatgcggttatgcgcaatactgcattctgttaccacgcagaaacaaagggcaggaccaggtctccccggtcccgccccaagcgtgactctattccaggcacctgcctggaactatgcgaaagcgtgcactacacgatgccctgggccatcatggcgtcggcaaccttcaggaagccggcgatgttggcgccaaacaccaggtcgccctcgtggccgtactccttggccgcgctcgaggccgcagcgtagatggaatccatgatggagtggagcttctcgtccacctcgtcaaacgtccaggagaggtgctcgtggttctggctcatctcgaggccggaggtcgcgacgccaccggcgttggcagccttgccgggcgcgaagaacacgccgttggccatcacgtactcggtcgcctcggtcgtggtcggcatgttggcgccctcgaccacgtacttgcagccgttggcgacgagcttcttcgcatcctcgaggtcgagctcgttctgcgtggcgcacggcatggcgatgtcgcacttctcgccccacggacgctcgccctcgtggtagacggcgccgtccctgcgctccgcgtacttcttgacgcggccgcgctcgacctgcttgatctgcaccaggaggtcaaagtcgatgccggcgggatcgtacacgtagccgttggagtcggagcaggtcacgaccttgccgccaagctgctcggccttctggattgcgtactgggcaacgttgccggagccggagaccaggatcgtcttgccctcgatggagtcgcccttgtcgcgcagcatgttgagcaggaagtacacggcgccgtagcccgtggcctcggggcgcgcgagcgagccgccgtaggagaggcccttgcccgtgaggacggactgccaggagttggtcaggcgcttgtactggccaaacatgtagccgatctcgcggccgccggtgccgatgtcacccgcggggacgtccgtgtcgggaccgatgtgcttgacaagctcggtcatgaacgactggcagaagcgcatgacctcggcgtcggacttgcccttggggtcaaagtcggagccgcccttggcgccgcccatcggcagcgtggtgagggagttcttgaagacctgctcgaagcccaggaacttgaggatcgagaggttcacgctcgggtgcaggcggatgccgcccttgtagggcccgatcgcggagttgaactggatgcggtagccgcggttgacccggaccttgccctcgtcgtcaacccagggcacgcggaagatcacgatgcgctcgggctcgaccaggcgctcgagcaggccggccttctcgaactcgggatgcctgtcgagcgccggctgaagcgtcgtcaggacctcccttgccgcctggataaactcgggctggtcggagtagcgctcctccagctccgcgatgacgcgctcggaatagttcatgtaagctcctctcacacaaaacacacgccaacaatccacacacaaaacaattttaaataatatgttcgctacgggcgagaaacacaaatgcgaaagttcctgtaacaaactttaaacggcggccccagacgcgggcccgcttcgtgcgattgcagataaccccttgcccaaagccgcccgctcccctatactttcaacgcggctccggggtgtggcgcagcttggtagcgcatctgctttgggagcagagggtcgctggttcgaatccagtcaccccgaccacgtgcggcggtagttcaattggtagagcagtagccttccaagctacctgttgcgggttcgagtcccgtccgccgctccattcgcgctcaagaggctaatcggcatgtccggttggcctctctttgtgtagattggtcacatggccatctagagggagtgacgcaatgcccatacgcaacctcggcaggatgcttctgatcgccaacccaacggcccacagcggcagaggtgccgaagccgcagcatacgtgacgcggcttctctctaacttccccgccgcaacaacgtccttctcgtcccgcctcacgacggctcccggcgacggcacgcggctcgcctcccagtctgcgggattcgacaccgtcatcgcgcttggcggggacggcatcatccacgaggtcgcaaacggcctcatgtcagtcgagaaggacgcgcgtcccacgctcgcggtcgtgcccgtgggctccggcaacgactttgcccggacgctcggcatggccatgaacgacccggcgcgcgccatggcgcagctgcttgccggcaaccctcgatcgctcgacctcggtcacgtgtcgagcgactccggcgcctcctgccactacgtgcagacgctatcctttggcctggacgccgccatcgcgcttgacacgaccgaccgccgcgcggacggcacgcgccagagcggggccgggctctttgcgacctcgggcgtcaagctcttctccaaggtgcggggagagtcgtcgggctggccgtccaccgtctccatcgacggaggcgagccgttccggctcaacacgatcatcttcgcggtgcagaacggccccacgtacggcggcggctttcgcatctgccccgacgcgagcccgttcgacggccgcctcgacgtctgctacaacgtgggcgtccccgcgctcccccgcctgcttgcgcttttcgcgctcgcacgcacgggaaggcacgtccgctcaagcgtcgtgcgcgtctccacgctcgagcgcctcacggtcgacttcggcacggcgacgcctccctgccaggtggatggcgagcggctcgtcggcagcaggttcgaggtgagcgtcgtgccagaggcactcaccgtcatcgttccgggcaagagccactagccacccgcgacctccttctggcacctcgcgtctacagaggaggcgcgttcttctcccccagctcatacatgaaaggggacgcccattctgaactgcctcccatttcctggacacgggaaatgggaggcatattcatgcgtaccgatctgagggtaaagcacgacgtcgggaccaggatgaaggcggcagggctcttcgccgcgggtcatggctacaagggcgtggcgaaggagctccgcttcccccgaaacaccgtgagaaaatggtggcagatatggagggcgttcggaagcgaggcgctgctgtcgatgggcgggaagcaggcaaggtacacatacggccagaaggtcgcgtccgcgagggccgtcgtggagggcggcatgtcgaaggccgacgcgatggcagagtacggcatcatgtccgagtccccgctcgagagatggtgcagggcataccgcgagggcggcgcagaggcgctgaggccgaggcccaaggggcgcccgaggggatccggcgccgccgcgaggccgctcgcgcgcgagcagcagctcgagcgcagggtgcagcagctcgaggccgaggtggcgtacctaaaaaactgcggtccctggccaggagggaagggcgctgaccagggccaaggcggaggcggtgcgcgacctagcgcgggaggggcacaggctcgacgacctcctcgcgtgctcggggctcccgaggtcgacctactactacgcgctctcgcaccccaggcggcccaccaggcccgagctctgggggcgcgtggcggaggtgttctcgcgctgccccaacgggtgcggccacagggagatagccatgtgcctgcgcaacgagggcggcgtgcgcatagccgacaagaccgcgctcaagatcatgcacgagatggggatatcctgcggcatcaggcgcgagcgcgactaccacaggtacaactcctacaggggcgtggtgggcagcaccttcgagaacatgctgggacgggacttcgcggcggacgggccgtgggagaagctggggacggacgtgacggagttcaggtgctcgttcggcaaggcgtacctcgcgccggtctacgacttctcgagcagggagatcgtcgcatggtccatctcggagcatcccgacatggcgcagcagatggagatgctccgcatgctcatagggaagctccccgcatggaagcacccgctgctccacagcgacatgggatggcagtaccagcacgcggcatactgcgagaagcccggggaggcggggatcgtgcagagcatgtccaggaagggcaactgcctcgacaacgcctgcgccgaggggctcttcggccatatgaaggacgagttcttccgcggccgcgactgggacacgttcgaggcgttcggggcagacctcgaggcatatataatcttctggaacacccgcaggcgccagaaggcgctaggcggcctgaccccggaggagttccggaaccaggccgcctaggctcagtctctattagggcgtccaggatttggggcgcagttcattcggacgtccccctcacagtcagcgttgtgaccggacttacttctgggcggcctgcagcatgaccttgacctcggtggcggtcttgcacttcatgaccttctcggtcagggcgtccgcctcctccttggtccactcggagatgatcttgcgggtgcgcaggatcgacggagcggagacggagaactcgttcaggccgaaggagagcagcacggggatgagcagcgggtcggctgcggcctcgccgcacatgccgaccatgatgcccttggagcggccggtctcgatgatgttcttgagcgagcgcagcactgccggctgatagacggagtacaggtaggcgacgcggtcgttgccgcggtcggcgcacatcgtgtagccgatgaggtcgttggtgccgatggagaagaagtcacactcctcggcgaggttgtcggcgatgagggaggcggcaggggtctcgaccatggtaccgacctcgatgtccttgttgtacgcgacgccgcgctcgtcaagctccttcatgcactccttgacgagctccttggcctggcgcacctcgtcgatggtcgtcacgagcggcagcatgatcttcacgtcgccaaacgcggacgcgcgcaggagcgcggtcagctggaccttgtactgctcggggttgttcaggcagtagcggacggcacggaagcccatgaacgggttgtcttccttctggaggttcaggtacgggatctccttgtcgccgcccacgtcgagcgtgcggatgatgaccggctggtccttcatgcgcagggcgaccttctggtacgccgcgaactgctcgtcctcgatcgggagctccttggcgtccatgaacaggaactcggagcggaagaggccgacgccctcggcgtcatgctctgccgcgacgttggcgtcgtcggggttgccgatgttcgcgacgagaaggaccttctcgccgtcgccggtcacggtctccttgccgcggtaggcctcgagcgcggccttctcctcggcatagctcttcgccttggcgcggtagttctcgagtacgacgtcgtccgggttgttgatgaccttgccgagcgtgccgtcgacgatgaccatctcgccggacttgatgttcttcgtcgcgtcggcaacggagaggaccgcgggaatctcaagggcgcgcgcgatgatggcggagtgcgaggtgcggccaccggtctcggtaacgatgccggcgacgttctccttgtcaatgtcggccgtcatggagggcgtgagctcctcgacgacgatcacggagttctcggggagcgaggagaggtcgacgacctgcttgcccagcaggtctgcgagcaggccggtcttgacgtcggcgacgtcggcggcgcgctcgcggaagagctcgtcctccatgttggagaacatgttgtagtacgtgtcgtaggcctcgctcacggcctgctcagcgcacatgccggagtcgatggagccgttgaccatgtccttaatgccttcgtcctccgcgaactcgatgtgggcgcccatgatggccgccgcctcctcgccaacggactgcttcatgcgctcgatctgagcgttggtctgggccacgaacttctcgagcgcggcggcgtagcgcgccttctccgcctcgggatcctcgggcttcgtcggggtaaaggacaggtcgggcgctacggcaacctgcgccacaccgatgccgtacccgtcagaagcgttaacgccttcgtacatgtagacctcccatagtagaaaacacccacacttgcccatggcgctatcacaaatcggggattccccccttgaaatccccgacctattccatggcgagaatcacggcagctacttgccctgctcctcgatgatcttgatgaggttcgcgtacacgcggtcgatggtcgcacgcttggcgatgcccttgctcgcggccgtcgcggtgccgcaggcggaggcgaagcgcagcgccgtctcgtagtcggcaccctcctgcaccttcgcgacgaagcccgcgaccatggagtcgccggcgcccgtcgcgttcacgagcttgatcttcgcggtcgggaccgtgtggatctcgcccttctcgtcgtacaggagcgagccatgcccgccgcaggagacgatgacgttctgcgcgcccttctcgtgtagctccttggcataggggatgcactcctcgggcgtctcggggcgggcgttgaagatgcggccgacctcgtggttgttgggcttgatgaggaagggcttggactcaagcgactcgagcaggagcttgcccggcgcgtcgaccacgaagcggatgccgcggccctcgagcctcttcatgatgatgttgtacatgtcctcgggcagcgacttggggatggagcccgtgagcacgagcgtgtcgccctcgccgatgtagtcgatgcgctcgaggagctcgtcgaccttcttctcgctaatcttggggcccatgccgttgaccatcgtcatgacgatgccgttgagcttcacgttgatgcgcgtgaagcccttgtccaggcggacgaagttgcaagagatcccgttcttctggagcgtctcgatcaggtagtcacccgtaaagccggcggcgatgccgaaggccacgttgatcaccttgagctcgttcagaagagtagagacgttgatgccattgccgccacagtagatctcctcgctcgaagacctgttggtgaagcccatgtcaagcgtcaggggatgcatgacatagtcaatagccgggttcaaagttacggtgtaaatcaacgtaggctccttccagcacacaatttgactacattatgactcaaacaaacttcggtatacgcgtgaaaagaacaaacctttggcgcaatccaagaatacgtctgttacgtcggcatttcccaggattcccgtaagcagtcgacaaattcgggaaggggtatgaccacgttttggtagacaagtcaagacgcaactggcaggcggcgcttctctaccatctgccacccagcacttgacattatcgaatgacggcccttcagcaccctccccacgtcgacacgggccagattgagcgagaagggcgcgcccacttcgtggtaacatcttgcacgcacgctcccttagctcagctggatagagcatcggtcttctaaaccgcaggtcaggcgttcgaatcgcctagggagcaccagacttgccgcggcccggggacattgcgtcctcgggccgctcttcgtaacaagcccaagccggctacgcgagcccccgctcgacggccgcgagcgcgccgatgatggtcttgccgtcctggatgagccccgcgcgcaccgcctcgagcacgtcgcgcaccggtagccagaccacgtccacgaactcgtcctcgtcgggactggcctccccctgccgcaggcagtgcgccaggtagatgctcgtggtctcgttggtgaagccgatggatccggccgcgcggccaacgaactcgagccgccccgccacgaggcccgtctcctcccgcagctcgcgcgcggcgcagcgctctgggtcctcgcccacctccagcttgccggcgggaatctccaggctcatgcggcccatggcaacgcggtactgcctcaccaggcagatgcgcccgtcgcgcacggccgcgacgccggccccgccgtggtgcagcacgagctcgcggacgccatggctgccgtcgggcagctccacctcgagcttccgcacgccaaagatgcggccgtcccacaccttggtctcgctgacgacgtgctcgaccagccgcgggtcgtcctcgaggagcgcccggatgcggccgaggccgccctcctgccaaacgcccgtgtccttctcgcccaccttgcgcactccctccgtttgaggcgcctgcccggcgccgcccgtcatgcatacacggcccatggtagcgccagagcgacggtgcgggcatcggcgcacgtgagtgggtttatttggtagatgggtcgcgcggcgcgcgggcggctgatttttggatacgattccctagcaccgtaagcgacatgattggaagtgcatattggctgaccgccaacacaataagaaacgcaacaagggcgacgcgggcgagaaggtcgtgtcctttgggcagctggggctctcccccgccgtgatagacgccctcgcccagatggggcacacgacgccgacgcccgtgcaggcacaggccatcccgcccgtgctcgcgggcagggacgtgctcgccgcggcccagacgggcaccggcaagacggaggcgttcctgctccccacgctcagtaacctggggcacgccgcggccggcgagggaccgctcatgctggtcatcacgcccacgcgcgagctcgcgcagcagatcgacgacgtggcgagtaccatctgctcccacaccggccaccgcacggtgacgctggttggcggcgtcgcgtacgagccgcagtaccaggcgctcgagcgcggctgcgacgtgctcgtggcgaccccaggccgtctgcaggacctgatcgactccggccacgcgagcctctcgcaggtcgaggtgctggtgctggacgaggccgaccgcatgctcgacatgggctttttgccggccgtgcgcaagatcgtggccaagacgcccgcctcgcgccagacgctgctcttctcggccacgctggacgacgacgccctggcgagcacgcgctcgctggtgagggaccccgtccgcatcgagatcgcccgcaaggggacgcccgcggagaccgtggaccagtacgtgctggcagtctcccccgaggcgaagaacgccgtgctcgcggaggtgctgcgccgtgaggggccgcgccacgtgatcgtgttcacgcgcggcaagcaccgcgccgacgccatctgccgcaagctccgcaaggcgggcatcgcgtgcgcgcccatccacggcaaccgctcgcagcgtcagcgcgagaacgccctgcgcaacttccgcgagggcgaggtcgacgtgctcgtggcgacggacgtgctcgcgcgcggcatcgacatcccggacgtgcgctacgtgatcaactttgacgtgccgggcgacgccgaggactacatccaccgcatcggccgcacgggccgcgccggcgagactggctgggccctgacctttgtgaccgaggacgactacctggagcttcgcgacgccgaggcgctcatgggcaaggtcgtgccggcctacccgcgcgccgagggcctcgacctgggcgagaagcccgtccgccttgaccctgaccgcgacccgcacgagaagcttccgggcaagaaggcccgcaagaagatggccgacgagcgcaaggcccgccgcgagcgcgagcgagccgagcgcgaggacgagcagaccgggagtggggcgcgtcccaaggccaaggcgcctgccaggcgcaaggcgaaggctcgccgcgaggacgaccccagccgcaaggcaaagcgtcccgccaggaagcgcgcccatggcgagggcaagccaaaggccgccgagaaggcctcgggccactcgaccgccggcaaggcggcatcccgcaggcgcagcaaggccatgccgtacggtccggcgggcaagcccaagcgcgagaccgccaagaggctgagccgccacccgggagaccgcggcggcaggcgctaggctgggccgcagacagcccgcaaaagcactgcttgcaaaacaagcacgctggctgccacggttacgcccactattgtgggtccaaccatggcgaccagcgtgctttttgcgtgccgctacctgcccaggaggcgcagcgcctcttcgcgcgtgcggctgtcgctcttgaagacgccgcgcacggcgctcgtgacggtggaggacccggcggcgcgcgccccgcgcatggtcatgcacgtgtgctcagcctccatcaccaccatgacgccaagcgggtcgagctcgcgcatgagggcgtccgccacctgcgaggtcaggcgctcctgcacctgcagccggtgcgcgtagcccgtgacgcagcgagcgatcttggagagccccgtgatgcgtcccttgcgtggtatgtagcagacgctcgccctgccctcgaacggcaggatgtgatgctcgcacatggaggagaacgggatgtcgcgcacgacgaccatctcctggttctggtcctcctggaactgcctgcgcaggtgcgcgtccgggtcctcctgcatgccgccaaagagctcctgcgcggcgcgcgccacgcgctccggcgtgccgcgcagcccctcgcggtccgggtcctcgcctatggcgagcaggaactcgcgtaccgcggcctcggcccgcggcttgtccatcatggcgaagccctggtcgttcagcgggcggccaaagtggtccttctcgcccgtgggctgtgccgcacggtacgagctcgtctccggaatcatcagtcaagcgtcctttccgcggcctcgatcacgtgcttggcgaggcaggccgtcgtgacggagcccacgccgccgggcacgggcgtcacggcgcgcacgatgggctcgaccgcgtcgaagtccacgtcgcccacgagccttcccgcggcctcgtcccagttgatgcccacgtccaccacgacctggccggcagcggcgcagtccgccccaaacgtgccagggtgacccgccgccacgaccaccacgtcggccgcgcggcacttggccgcaaggtcgcgggtcctcgtgtggcacatcgtgacggtggcgttggccgcctgcagcatgagggagaccggcctgccgatcacgagcgagcggccgatcacgactacgtccgcgccctcgagcgcgacgccgtagtgacgcagcagctcgagcaccgcctcggccgtgcagggcggaaagccgcggcgctcgttgcagaagacgcccgcgagcgagccctccgtcacgccatccatgtcctttgcggggtcgagcctggcgcaggcggcgcgctcgtccagctgcctcggcagcgggcggaacatgaggcagccgtggacggacgcgtccgcgttcacgcggtcaatcgcggcctcgagctccgcctggccgcagtcggccggcagcgcgatcctctgcaccgcgatgcccaccttgtcgcagcgcttgacggccgcgcgctcgtacgcgaggtcgtccgcgcgctcgcccacgcgcagcagcgcaagtttgggcgtgacgccgcgggccgtcagctcggccgcgcgcgcggcgagcctctccgtgagcgcctttgcgaccggcgcgcccttaagaacctcagccaatctggtccctccccctcacgcgtgccatcacgcgcctcgaaacttccctcgccttgggcgagaaggtctggagcatccgctcgctgcgcccctcggcatcgtccgcgaactcgcggtcgcgcaggttgtgcgtgttgacgtacacgctgatgcccgcaccctcgagggcggcctcggcaagggccgcgccgcatcccacgtccgcgacgagcatggcggagcacttctcctccatctcctcaaggaggtcgatggcgcggcaggtctcctccatcacctgaaggggcaccttcgtggcgcccttggtagcgagctcgatcgcgtccgcgcgcgtggggtcgtccttgggcagcgcgtaggccgcagcaagcggggcaaaggcccgcgcgtcgccgtccaccaggccaagcagacgctcgcgcacgtccgcaagctccccgagcatgcgctcgaggtcgtcctggtaccgcgcgtagcgggcctttccaatggtgaactcgcccgccatcgagcccagcgcggctgcgagcgcgcccgcgtaggctatcgccccgcccccgccgggcacggacgtgcgagcggcgagccgccccgcgaacgcggcgcagctgccgtcaaccagagtatccgacatgtgttcgagcctttccaggggcgccccacaggggacgccccgcataaccatgatctgagttcggcgttgcgggcggtattagaacaggcccacgatcttgccgtcgggcgtgacgtcgatcttctccgccgcgggaaccttgggcaggcccggcatggtcatgatgtcgcccgtgagcgccaccacaaagcccgcgcccgcggagacgcgcaggttgcgcaccgtgatcctgaagccctcgggcgcacccagcttgtgctggtcgtccgtaaagctgtactgggtcttggcgacgcagatcgggagcttgccaaagccctgctcctcgagctgcctcatctgcttggcggccttcgtcgtgaagtccacgccgtccgcgtggtagatgcgcttggcgatcgcgttgatcttgttctcgatcgtgtcgtccgcgtcgtaggcaaagcggaagtcgctgggctcgtcgcacaggcggatgacctcctcggccagcgcgcggccgccctcgccgccctttgcccagacctcggacagcgccacgttcacgccgatcttgttgcactcctcctcgacgagcctgagctcggcctcggtgtccgtggggaacgcgttaatcgcgacgacaacgggaagcccgaagacgtccttgatgtttgagacgtggcgcagcaggttgggcatgccggccttgagcgcgtcgaggttctcggtcgtgagctccgccttgggcacgccgccgttgtacttgagcgcgcgcaccgtcgccacgagcacgacggccgatggcttgaggcccgtcgcgcggcacttgatgtccaggaacttctccgcgccaaggtccgcgccgaagccggcctcggtcacgacgtagtccgcgagcctcatggcggtcatggttgcctcgacggagttgcagccgtgcgcgatgttcgcgaacgggccgccgtgcacgaaggcggggttgccctcgagcgtctggaccaggttgggtttgatcgcgtccttgaggagcgcggtcatggcgccctcggcgtggatgtcgtgcacggtcacgggcttgcggtcgtaggtgtacgccacgaccatgcggcccaggcgtgccttgaggtccatcaggtccgtggccaggcagaagcaggccatgacctcggaggccacggtgatgtcgaagccgtcctcgcgcggcatgccgttggcgacgccgcccaggccgtccacgatgctgcgcagctggcggtcgttcatgtccacgcagcgcttccacacgatgcggcgcgggtcgatgcccagggcgttgccctgcttgatgtggttgtcgagcatggcggcgcacaggttgttggccgccccgatggcatggaagtcgcccgtgaagtgcaggttgatgtcctccatggggaccacctgcgcgtagccgccgccggctgcgccgcccttgatgccaaacacggggcccagggagggctcgcgcagacagagcatcgagttcttgcccaaggcgcgcagggcgtcctgcaggcccacggaggtcgtggtcttgccctcgcccgcgggcgtggggttgatggcggtcacgagcacgagcttgcccttgacgggcgtgtccttgagggagtggatgtccaccttggccttgtagttgccatagagctcgagctgttcgggcttaaggccggccctcttggccacctcggtgatgggaagcatcttcgcttcctgagcgatctcgatgtctgacttcgccatttgcaggttcctttcgcttctcggagcggtcgagctccaacggttaccgagtcacacgggacgaactgaccgtgagcccattatgtacccccgctgccacgggcgcgcgctcttctcgcccaatcggcgagcttcgcgcaagctccatgcgtagcggcgtccgtggagggcgagaagaacttgggccgcggccgcgcgaacctgtcatcatgggggcgaaccatcgattggaccaggaggccggcatggcgacggcaacgctcgtgatcatgcgccacggcgagagcgcatggactgacaagagggtcaacaagttcgcggggtgggtggacgtgccgctcacggaccgcgggcgcgcccaggcggcggaggccggcaggctcatgcgcgaggcgcacatcctgcccgacgccgtgttcacgtcgcttctggggcgctccatcgtgagcgcggacatcgccctgggcgaggtgggccgcctctgggtccccgtgatccgcagctggcgcctcaacgagcgccactacggcgcgttccagggccagacgcgccccgccatgcgcgagcgctacggcgacgagctcttcaacacgtaccgccgcagctttggcgtgcgcccgcccgcgatcgcgctcgactccccctacttccagggggacgacccgcgctacggcacgccctcgcaggacgggctcgacgggaccgacccacgcgccatccgctccgagtgccttagagacgtcatcgcgcgcctggagccgttctggggcgcctacgtcacgccgccgctcctgcttggccagacggtgctcgtggtcacgcacggctccgtggtgcgctcgctcatgaaggtgatcgaggggctgacggcagaccagatccgcaacgtcaacgttcccaccggccagccgcgcgtgtacgagttcgaggcgggcggcctgggcgggctcagcctcaaggcgccgggtaggtggctcgacccggacgcagcgagccgcggcgcgcgggagacgctcgcactgggcgaaagcaaccccgcgtagcgacgtggcgcgggcggggcggctcaacgggagcgtcgccccacccgcctggctccatcccgcctcagcaacatctacgctatagcaaaaagcctgccaccaggtgccaggcttcgctttaaatggtgggtcgtgagggggtcgaaccctcgaccttgggattaagagtcccctgctctaccaactgagctaacgacccatatgtagtggcgcgtgggcgctggaggaatcaatggtgggtcgtgagggggtcgaaccctcgaccttgggattaagagtcccctgctctaccaactgagctaacgacccattgatgcctgcaatgcggttggaatggggtgggtagaggggctcgaaccctcgacctacggagccacggtccgtcgctctgccaactgagctacacccaccatttggttccgctcgcatcgcggtatgtaataatgcccgaacccggcccgcttggcaagggtaaatttgaaaaaacttttcccgatgcaaatctccgccacaaggccccgtccttctcccccgccagaccctgcccaacgcagcgcctacgtcgccgtttgcagcacacgggcgagaagcccgcgccgccttggccgcggccccgccatgaaacacactcttaactgcaagcagcttgaaggcccccgcgccgtgccctatgcttactccagcgcgctaaagtgcccacgggccaggcgcacacggcaagcaagcaactccagggggtatcaccatggatcgtcgtcagttcctcaagctgtccgccgcggccctcgccgcgcccgtcatgctcgacctcgccgcctgcggcagcggcagcgccagctccggctccaccaagaagatgcagttcatcgtcggcttcgaccaggagttccctccctacggctatgtgggcaaggacggcaagtacaccggcttcgacctcgacctcgccaaggccgtctgcaagatggagggctggacgtacaagcccaagcccatcagctgggacgccaaggacagcctgctcaacagcggccagatcacctgcatctggaacggcttcaccatcgagggccgcgagaaggactacgccttcaccaagccctacatggagaaccgccaggtcatcgtcgtccccaagagctcgagcatcacgagcctcgcggacctcgcgggcaagaacgtcatcacgcagacggactccgcggccctgagcctgctctccaccggcggctcgcaggagaagctcggcaagacgttcaagaagctccagacgatcgacaactacaacacggccttcatgatgctgcagaacggcacggtcgacgccatcgccatcgactaccccgtcgccgtgtacaacatcggcaaggacacggacaagtacacgattctgagtgaggcgctcaactccgagcacttcggcgtcggcttcgccaagaccacggagggcaagaagctcgccgagaccgtccaggcggacctcaagaagctcgacaagaagggcaccgtaaagaagctgtgcgagaagtacgcagaccagggagtctcgtacgacctctgggtgctgtaggctagcctagtcactgcaccccacagttccaagcgcctttggtctggcggccaccccggccgccattccgcttttctggcgccatccattcaagacgaacgactaaggcggtaatcacttggatatctccacgatgacgggcatgctgctcaacgggtacgtggtgtccctccagatattcgccctcacgctcatcggggccatccccctcggggtcctcgtcgcgctcggcaggctctccaggttcaagcccctctcctggctcgtgggcctctacatctcgctcatgcgcggcacgccgctcatgctgcagatgttcgcggtcttcttcatcccctactacctctttggccagcagacgggccccgactacatgttcgtcgcggtcatgatcgccttcatcgtcaactacgcggcctacttcgcggagatctaccgctccggcatccagagcatgccacgcggccagtacgaggcggcgcaggtccttggctactccaggacccagcgcttcttccgcatcatcctgccccaggtcttcaagcgcatcctgcccgccatgggcaacgagatcgtcacgctcgtgaaggacacctcgctcgcgttctcgatcggcatcgccgagatgttcaccaccagccgcgccctcgtggcgtcgcagcgcagcatggtccccttcgcgatcgccgcgctcatctactggatcacctgcctcgtcatcgagttcgtgcttcgcaggatcgagaagagaatggactactaccatgactaagcccaagacgcgcgagatgccgcgccccgacatcagcctcacctccgcgctgggactccccgccgtctacgtaaaggacgcgcgcaagtcctttggcgacaaggaggtcctgcgcgacgtcagcctctccatcaagcagggcgaggtcgtctcgctcatcggcccgtccggcgccggcaagtccacgctgctgcgctgcctcacgctgctcgacacgttcgacagcggcgagctcgcctacggcaacgtgcgcgtctgcgccaacgtgcccggcgagtcgcgcaccacgtacgacaaggaggccgagcgccaggcgcgcatgcgctttggcatcgtcttccagaactacaacctcttcccgcactacacggtgctcaagaacgtgatggacgccccgatcgtggtacagaagcgcgaccccaaggaggtggaggagcaggcccgcaagctcctggagcgcctcgacatcgcggaccacgcggacaaggtgcccgaccagctctccggcggccagcagcagcgcgtcgccatcgcgcgcgccctctgcatgaacccgcaggtcatctacttcgacgaggccacctcggcactcgaccccaagctcacgcaggacatgcaccggctcatccgcgagctcgcgcacgacggcatggccgtgggcatcgtcacacacgagatgggcttcgcccgcgacgtgtccgacaggatcgccttcctgttcgacggccagatcgtggaggagggcacccctgacgaggtcatcggcaacccgagcgaccccaggaccaaggccttcctcgccaacgctgaggactaaccggattagctgggcgagaagggcgccagcaggccacaggcaacgccacgaacggcggcaacgcattccaatcagccagccaaccaagacagcaaagagggacggaccagatggcccgtccctcttccgttacgcatatgcggttctgctacgcatgcgcgaccgcgacggacgcacgtccttctcccctgggcatgccttgcgcgcccgggacgtgaggcttgctagagcagcatctccgcgatctggacggcgttggtcgccgcgcccttgcggatctggtcgccgcagcagaagaacgtgagcgcgttgacgccctcgggggccgagaggtccctgcggatgcggccgacgtagacgaggtcctggtcggacgtgtcgagcggcatggggtagcgcaggtttgcggggtcgtccacgaccttgacgcccggcgccttggacagcacctcgcgcgcctcgtccggcgtgatggggttgtcgaactcgaccgtgatggactcggagtgcgagcgcatgacgggcacgcgcacgcaggtgcagttgacgcgcagctcgggcatgtgcatgatcttgcggccctcgttctgcatcttgagctcctcggaggtgtagtcctcctccttgaagccgccgatctgcgggatgaggttaaacgcgagctggtacgcgaagggcgaggtgtcgccaacctctccgccctcggcgatgaccttgctctcgcgctcgagctccctgaggcccggcatgccggcaccggaagcggcctggtaggtgctcacgatgagcctgttgaggccggcggccttggcgagcggccacgtgggcacgaggccgatgatcgtggcgcagttggggttcgagatgatgttcctggggtggttcgcgacgtcctcggggttgatctcagggatgaccaggggcacgtccaggtcgagcctgaaggcgtgggagttgtccacgcacacggcgccgcgcttggcggcctcgggcaggagctccttggcctgcgcgtcgccggcggcgcccagcacgatgtcgacgccctcgaacgcctcgggcgtcgcctcctgcacggtcacctcctcgccgcggaacttgagcttcttgccggccgagcgagcgctcgcaagaggcacgagcctctccaccgggaagtccctctcctccaggcactgcatcatctgcgtgcccacgacgcccgtcgcgccgagaattgctacaaccttgcctgccatgtacttctcctctgcgtgtgttgtgtgggccgcatcgggcgggcccggggccctactgcttggcgtcctccgccgtgacgtactcgttctcgacgaagttgtcgtagatcaccttgatggcgcgggcgaagtccgagttgttgacgcccatgatgatcgagatctcctgcgagctctgggtgatcatgcggatgttgatgccggcctcgcccagcacgccgaagatgcggccggaggtgccggcgcggcggctcatgttgcggccgacgacggagatgagtgccaggctgtcgatcacgttgatgctgtccggcttgagctcctggcgcaggtcgttcacgatcgagtagatcgtgtccttgacgtccgcgccgttgacgacgatgccgaaggagtcgacgcccgtggggatgtgctcgactgacacgccgtagtgctcgaacacggagagcgcgcggcggacgaagcccacggtgttggacatgtgggccttctggatgtggatcgccatgaagtccttcttgccggcgatgccggtgatgaggtgctcgcgctcgtgctcgacggcggtctcgcggatgacggtgcccggggcgtcggggtcgttcgtgttcttgatctggatggggatgcccacctcgcgcacggggaagatggcctcctcctgcaggaccgaggcgcccatgtagctgagctcgcgcatctcgtcgaacgtgatgcggtggatggagcgcgggttgtccacgatgcgcgggtcggccgcgaggaagccggacacgtcggtccagttctcgtacacgccggcgtcgagacagcgcgcgaggatggcgcccgtgatgtcgccgccgccacgctggaagagcttgatggtgccgtcgaccgtcgagccgtagaagcccgggagcaggaagccgcccaggcgctgcgccgcgtccttcacgcgcgttgccgtgcgctccatgtcgacggagccgtcgtggtggaacacgacgacgtccgcggcgtccacgaacgggatgcccaggtactcggccatgagctggccggtaaaccactcgcccctcgaaacgatgtactcgggcgacaggctcgtgatgaccgaggagaactcctcgaacttctcctcaatggggtacttgaggttcagcgcgtcacggatctcgacgaagcgctgctcgatgtccttgaggagcgacgtgcagtcgacgtggtactcgatgtgggcgttgacgaggaggagaaggtcggtcagcttgttgtcgccgctgaagcgcttgcccgcggcggacacgacgacgaacttgcggtcggggtccgccttgacgatccccttgaccttcttgaactgctcggcgctcgcgacgctggagccgccgaacttcgaaaccttgatcatgtatctagtcctcctgggaaagtgctgccatgaacgtgctggggtcgacctcctgggcgcgctcaaaggtctggcgcgcctggacggcggtcagcccgcggagcacgaccataccctcggcaaagggctccgcgccctcgacctcggccgtggtcctgtagacgtagtccgaggtcaaaagctccgggcgccactcgaggccgcgcgagaagtcgtagtggggacggcgcccggcggcaaagtcgagcacgtcctgcaccatggcgttgcccgtggggagcatgccggcaccctggccgtagaacttgagcgggcccaccgtcgtgccgtcgagcgagatgaggttgaagtttgagggcacgttcgcctcgagcgagcgcacgggcagcgccacgggctcgaccgcggccgcatagccgccgtccgcctgcacgccgcggcccagcagcttcacgctcaggcccttctcgcccagcacgtcgaggtcgcgcttggtgagcgtgcggatgccggtcgtggggatgtccttctcgcacgcggtgttgaacgccacgccgacagagatgatggtcttgttgcggacgtcgatgccgtcgatgtcggcggaggggtcgcgctcggcgtagccaagctcctgggcctcgcgcagcacgtcgtcgaagtccgcgccctgcttcaccatggcgtccacgatgtagttggtggtgccgttcatgatgccgtagaaggacttgacctcgtcgatgcggcggaccttctcgaccgaggcgatccaggggatgccgccgccgacggaggcctccacgagcaggcacgcgcccgtggtgttggcctggcgcacgaactcgtcgatgtaggcggccacgaccgccttgttggaggtcacgacgctcttgccggccgcgagcgcatccatgatgaacgtgtgcgcgggctcgaggccgcccatgcactccacgacgacctcgatggagtcgtcgcccagaatctccttgaagttagaggtcatgcgctcgtcggtcaggcggtcgggcagctcgaggatgcgcgcaacctccacgccgctcacgcgctcgcggatgattctatcgacacccttgccgaccgtaccgtatcccaggacagcaatcttcatctctatccaatctttctgttgtgtgacgttgcagaggccacttgccctctgcggctatgatacaaggtgtttagccgccattacgaggcaaggagcgccacggtgaaccttttctatcacagcacgcgcagcgatgaccaaactgtaacaagcaagcaagcaattctcagaggaatcgcacctgacggcgggctctacgtgtccgacgggcttggcaagacgcagcttgacctcgccgaggtctgcgcggagggctatcaccccatcgcgcgccgcgtgctgtcgaccctcctgccggactacacgcccgaggagatctcctcctgcgtgagccaggcctatgccgacaacttcgacacgcccctcgtcaccccggtctccccgctcggcgacgactggctgctcgagctctaccacggccccacctgcgccttcaaggacgtcgcgctccagatgctgccgcgcctcatgtccgtcgcgcgcaagggagaaggacgcgacgtcatgatcgtgaccgccacgtcgggcgacaccggcaaggcggccctggcagggttcgccaacgtgcccggcacgggcgtcacggtcttctaccccgagggcaaggtgtccgacatccagcacctgcagatggtcacccaggccggcgacaacgtcgcggtctgcgccatcaggggcacgttcgatgacgcccagaccaacgtcaagcgcatcttcgcggaccgcgagctcgccgcccgcctcgacgcggaaaacgtcatgctctcgagcgccaactccattaacgtaggccgcctcgtgccgcaggtcacgtactacttctcggcctacgcgcagctcgtgcagcacggtgccatccacgtgggcgacgccgtggacttttgcgtgcccaccggcaactttggcgacgtgctcgcgggctacttcgccaagcgcctcggcctgcccgtcggcaagctcgtcgtcgcgtccaacagcaacaaggtcctgacggacttcctcaccaccggcacctacgaccgccgtcgcgacttcgtcaagaccatctcgccctccatggacatcctcgtgtcgtccaacctcgagcgcatgctctactacctcacggacggcgactgcgagcgcgtcgcgtccctcatgggcgacctcgcgaccaagggctgctacagcatcggggcggacctcctcgccaagctgcgcgagaccttcgactgcggctacgccacggacgaccagacccgcgccaccatccgcgacacgtgggagaaggaccacgtcctcatcgacacgcacacggccgtcgccaagaccgtgctcgacaccctgccgcgcgagggcaggcagcgcgtctgcctctccaccgcgaacccgtacaagttctcggccgacgtgctggccgcgctcggcacggacgtgagcggcaagagcggcttcgactgcatggacgagctccaggcgctcacgggcgtccaggccccagcccagctctccaacctccgctccgcggcgctcctgcaccaggacgtctgcgacatggacggcatggcgggcttcgtggaggactcctgccacaggatctttgggcagggacggtagcgcatggcacaagagaccacgtaccagcctccccgcaagttccgggtgaccgtgcccgcgacctcggcaaacgtcggggtcggctacgactgcctgggcctggcgctcgaccttctcgcccacttcaccttcgaggtggcggacgacctcagaatcgacggctgccccgagtgcttccgcggcgaggacaaccttgtctggacgagctacctcgacacctgcagggagatgtacacccctcccgtcaggctgcacatcaccatcgactcgcccgtgccgctctccggcgggctgggctccagctccacctgcgtcgtcgcgggcgtcgtcgcggcgcaggtcctgcacgccggagggttcgaccccgaggccgcgctcgacatggccaccaagatcgagggccatcccgacaacgtggcgccggcgctcatgggcgggctcgtgagctcgtttgtggacacggggcgcacgcggtcgctgcgcttcgacatcgcggacaacctgacctttgtcgcgatcgccccgccttacgaggtccgcaccgcggacgcgcgcaaggtcatgcccaagaccgtcaccatcgagacggccgtctggcagatcggccactgcgtcgcggtggtggaggcgctccagcgcggcgacgcggagctcctgcacgcggccgcgcaggacaagctgcacgagccgtaccgctcccagctcataccggactacgagccgctgcgccgcaccgcgctcgccgcgggcgccgcgacgtacctcatatccggctccggctccacgatgctcgccatcgcggacggccgcgaggccgccgagcacgtggcctccgccgtcacgaacatggtggagaacagggtcgaggggctgtgggtgcgcgtgctgggcgccaactgcgtgggcacgacggtcgaggcgctctagcgccaccgcggcggttcgcccgcactccagcaccagtctacgggggagaaggtccgtccttctcccccgcctttttgtgccagccccaagctccaccaaggttggcaccctatggacgaggggacgtcccgattggccgggacgtcccctctcttgttgcgatgttgatgcaccagcgtgcgacgcgcggttgatggcctgctagccgcccaggtaggccttcctcacgtcgtcgtcgtgcagcaggtcctggccggtgccggtcttgctgatgtggccgacctcgagtacgtagccgcggttcgcgatggagagcgccatggaggcgttctgctccacgagcaggatcgtggtgccctgcttgttgagctcctctatgatgtcgaagatctcctggaccaggatgggcgcgagtcccatggacggctcgtcgagcatgagcagctcgggcttgctcatgagggcgcggcccatggcgagcatctgctgctcgccgccggacagcgtgccggccgtctggttcatgcgctccttcaggcgcgggaagcgctcgtacacgacctgcagggtctccgcgttctcggagtcggtgcgggtgtagccgcccatctgcaggttctccgcgacggtcatctggctgaacacgcgcctgccctcggggcagagggccaggcccttctccacgatcttgtgggccttcacgcccacgaggctctcgcccttgaactcgatcgagccggagtcgggcttgacgatgccggcgatggtgttgagcgtcgtcgacttgccggcgccgttcgcgccgatgagcgtcacgatctcgccctgctcgatgtcgaacgagatgccctgcacggccttgatggcaccataggagacgtgcaggtccttgacggaaagaagcgccattacttcaccccctgcttgccgaggtaggcctcgatcaccttcgggtcccgctggatttcctccggcgtgcccttcgcgatgatcttgccgtagttgaggacgccgacgacctcgcagacgcccatgacgagggacatgtcgtgctcgatgaggaggattgcgatctggaactcgtcgcgaatcttcaggatgttatccatcagctcctcggtctcgttcgggttcatgcccgcggcgggctcgtcgaggagcagcaccttgggatgcgtcgcgagcgcacgcagaatctcgagcctgcgctgggcgccgtacgggaggttgcccgccttcgtgtccgcgaagcgctgcatgtcgaagatgccgagaaggtccatcgccttgtctcggtactccctctcctgcttccagtgcttggggaagcgcagcatgtccgtaacgaggtgcgtgctcatggagttgccgaagcccacgaggatgttctgcgcgaccgtcatctggctgaagaggcggatgttctggaacgtgcgggcgatgccgagcttgttgacctgcgtgatgctcatgcccgccgtgtcgtagccgtcgacgaggatggtgccgcgcgtgggcttgtacacgttggtgagcaggttgaagatcgtggtcttgccggcgccgttggggccgatgaggccggagatctccgtgcggcccatggcgatgttgaagtcgtccactgccgtgaggccgccgaagtcgatgccgatgtgctttgcctcgagcacggggatctggccgaggtcgcgctcggggatgaggttggggctctccatctgcacgatgacgggacggcgcttctgcttggtctcgctactcatcggcctcgacctcctccgcctgcttcttcttccacgggaactcgccgttgatgatcttctccaggaagttgcccatcgagaagtcgtagtcgcccagcaggccctgcggacggaagatcatcacgaggatcaggacgatcgcgtagacgaccatgcggtagtcggcgaaggcacggagcgcctcgggcaggatcgtgaggaacgtggccgagatgacggagccgagcatggagcccatgccgccgaggacgaccatgaccaggatctcgatcgacttcatgaagccgaacttggcgggcgccatgacgccgatgcagccggcgtacaggccaccgccgacgcccgcgaagaacgcggacacgacgaaggcgagcgtcttgtagtatgtggtgttgacgccggtggcctcggcagcgatctcgttgtcgcggatggcgaggatcgcgcggccgtgacgggacttcatcatggtgtggatcaggaagagcgagatcgcgaccacgacgaaggtgttggtgaagttggtgtaggacgggatgcccgtgaggccctttgcgccgcccgtgagctggaagcccacgacgctgtcgatgttgagcatgacgacgcggatgatctcggcgaagccgagggtgatgatggcgaggtagtcgcccttgaggcgcagcgccgggatgccgatgatgaggccgcagatcgccgcgcagacgccgccgaagatgaggccgcacacgaagagcagcgtcgtggcgggggtgcccgtcatgaagtcgtacatcgtcacgtgcatggggcccatcatgcgcatgatgaagatcgcgcaggagtagccgcccacggacatgaagcccgcgtggccgagcggcagctggccgaggtagcccgtggcgatgttgagcgagacggccatgatgatgtagatgccgacctgctcgagcacggagccctggtagcgcgagatggagccgttgtcgatcatcatctggccgatgacgatgacgagcacggtgagaacggtgttgatgatgtagcgcttgcccgttgagatggtcttgcgcttcttggaacccttgggcgagcccgtgctgattatcggcttgcccttggttgccatatcctcttccacgtttgcctccttacactttctcgttcatcgtacggccgaggatgcccgtgggcttcacgacgagcacgatgataaggagcaggaacacgacggcgtccttccagacggagagtccgagggcggagacgaacacctcggcgaagccgacgagcaggccgccgatgacggcgcccgggatcgacccgatgccgccgagcacggcagcgacgaaggccttggtgccaagcatgatgcccatggtcggcgtcgcctgcgagtacgccatgctgtagagcacggcgccgatgcccgcgagcgcggagccgagggcgaacgtgaacgagatcgtcgtgttgacgttgatgcccatgagtcgtgcggcgcccatgtcctcggagacggcgcgcatcgccttgccgagctttgtcttctggacgaggagctggaggaccaccgtgcagaccgccgtcacgatgatggtgatgatggcgttgagcgagaggctcacgccaccgaccttgatggtcgaggtgctgatgaaggcggggacgaccttcgcgtccgcgccgaagaccagctgcgccccgttctcaaggaagtaggagacgccgattgcggtgatcaggatggaaaggcggggcgcgtttctcagcggtgcgtatgcgaccttgtcgatcaggacgccaagaagcgtgcagcccgcgaccgagagaacgacggcgagcgcggggctcatgcccagctttgccatcacgatccaagaaatgtacgcgccaaccatgatgatgtcgccatgggcgaagttgaggagcaggatgattccatacaccatcgtgtagcccagggcgacgagcgcgtagatgctgccgagctgcagtccgttcagcaactgcgtcaaaaacgtcacggcaaacacttcctctcgtaagccattgaacagtacgtagacagggtgccatgtcaggcagagaagcgcaacgtggcacccgtatccccatggggcgccgagggaaacccccggcgcccctgtggttagttcctgtcgaaaccgaaccttacatggtggtctcgatgtactccttgccgtccttgaagccgatgatcagcgtggacttgacggggtcgccagtgccctcgtacttgatggtgccggtgacgcccttgacggtgcccttggcgatggcgtcgatgacagcctgcttgtagtccttgtaggtcttcgccttgccagccttctcgaccttgttgatggcgtcacagaggatcatcgcggcgtcgtagccgagcgcgcagaagttggtcgggtcagcgttgtactcggccttgtagtccttgatgaactgctggacgctcttgtccgtgttcgcggagacgaaggaggtgtcgtagaagcagccctcgaggtccttgccggaggcgtagtcctcgtcgccgccaacgatgttcgcccagccgtcggcgcccaggaagacgccggtgtagccgagctggcgagcctgggtcacgatcttgccgtcgtcctgatagtagttgggcgacaggacggcgtccggcttcttggcgatgatgttggcgagctgcgccttgaagtcgacgtcaccggcggagtagctctcctgcgtggcgatcttgagacccttcttcttggcctccttgacgaaggcgtcgttcacgcccttctcgtagtcgccgccggagttgtagatggtgcagagcgtcttgtagcccttcttggccgcgaagtctgccatgagcttgccctggtaggggtcggtgtagcaggcgcggaaggcgttcttgccgtacttgatgaagtcggccgcggtcgcggatgctgagacgagcggcatgttgtccttgacggcctcctgcgcgacggcgatggagggcgtggaggtcacgtcgccgaggacggccacgacgttgctctcggccatcttctggtagacgttgacggcctcggtggcgtcgcccttctcgtcctggacgatgagggagatcttcttgccggtggaggtgccgcccttcttgttgaactgcttgaagtagagcttcgcgccgttgcggaccgcgaggccgtactgggcgacgtcgccggagtacgggcccatgaggccgaccttgagggtcttgccggagatggcggaatcggagctggagccgccgcaggcggcgagcagcgagctgaggctgatgccaacggcggtggcgccgctgaccttgaagaggtcacgcctcgagatgttgttagacatttgttttcctcccatgtaactaaaggtcttgcaaccagcagttatcctgaaaagaaattaagccttcaagcgcgtgatatgtgcctgaacgatgaatggttatcgttcctgcaacattagaattcgtttggaaacatatgcaacttgccagaaatgggcgagaagtgcgcactgcctgcggaaacgccgtcacgcgagcagccagacacttttgcacgcatgtgtcgcagtctgcacgttaggagtcgcgaccggcacgagcacctcgcagcgccgccgcgatgaccgttcccaccaggacgccgcagaggtcgattatcacgtcgcgcagctgtctcgagcggcccgggacgaagacctggatcgtctcgtccacgacgggcgcgacgcagccgacgacgacggtgagaaggacgaggcgaagctcgcctgaagacatctgccaagtgcgcgccttgctggcgggaaagcacgaccttctcccctgccccatgagctccgtgcgcgccttgccgcagacgagcccgagcacgaggtactcgaggaagtgcgccgtcttgcggatgacgaacgtcatcgtgtgcgtgctggtgacgcctgccgcctggaagaccggacgcaggacgaccatcacgcgcgagctctcgccgcgcgacgccgcgccgggaaccagcgagtgtccccagatgaaggcgagccagaccacgacgagcacgagccacagagccgcgtggcccttgcgtccggtgtgctgcccctcgccgttgtttatgtggttgccgccaccctcctgcaagggctacgcctccctgacgatcgcggccatgtggcgcggcttgtacgcgccgcgcttggagcggttgcgcttggggagctttgcggtgctgccgaggttctggctgccgccctcgatgacgtgcaggtactcgcgggaggaacggcgtgcggcctgggactcgttgcgcgagaactcgtcgtttatcaggtagtcgacgtaggagtccgtgtccacgacctcgggatggccggcgggcgtcctgaacgggatgaagttcgtggggtcctcgaggcccgtcgggtcgtcgatcgtgtcggcgccgccgatcacgtccacgaagggcgcggcgctgcgggggccgttgtcgatcttctcgtccatcgcctcgagcgcgacgttccagaggtcctcctggtccagggcctcggcgtcgcggtgctcgggatacttgccctggtcgacctcgggcacgctccgcgcgatgcgggccgcgcgggagcgcgagaactccatcgcgggcgtgagcgggcgctcgctcgcggagggggcggcatcgtgcgacgcgtcgcccatccacgcggggacgctcagctcgttggaggtctcctcgaccgtggggaggctcgccatgacgtccttctcgcccacgtggcggacggagtcgcccagacgcgcgtcccaccagctggtgcccacgtcgcccacggtaccgtccgcgcgctcgatgatgggaaggccctcgaacttgtccgcgccgaggcgctcctggaggacgtcagccacgccgcgcgcgcgtgcggccatgcgctcgcgcaaggtctccttctcgacgtagttctcggccacgttgacgtagtcgttggtgtcgtccagctccctgtcaacggagggaacgcgggaggcgatctcctggttgatggcgcgtgcggcatggggggcgtcgctggacgcgtccgccatcggctccggggcctggtacgtctgaggcgcggggacgtcggcttgctggtcagccgcggcaggggcgtcgcttgagggcgtggtcacgttgaggacgagggttggcgcctcctctacctcctgggaccgtgcgtccttctcgcccttgcgacgtgcggcgaccgagacgcccacgatggcggcgcccgtgacgcagccaagcgcaaaggtgacggcggggttagcgatcgcgtcgcgaccgaggtcggatgccacctggaggggcgtcgcggcttccgcgacgctggggacggacatcccaagcgcgccaagaagccccgccacgacggccgggttcctccttgccatgaacattgcgtcgctcctcccgcatggcccccgcacgtgggacgggaacgaagcttggcagccagctggaccccaatgatgcggccactggcagagacaacggcgttgtgcgtcttatcttcgtttaccgtcgtattatgcagtcggggcaaatccctcagactgtgttcgatattagccgaatccagccgtttttcaaggctcggggccaaatagagggggcaaacatggcgaaatccatcgcgatagttacgggcgcctcatccggcgtggggcgcgagttcgtgaggcagttcgaccagggcgcgggcggtcccctggacgagatctggctcatcgcgcgccgccgcgaggtgctagaggacatcgcagccacgtgcaagacggcgacccgcgtgctcgcgctcgacctcacggacgaggcgtcgttcgagaccatctccgccgagctcgaccgagagcagccgcgcgtgcagtggctcgtcaacagcgcgggctttggcaagttcggcgacttcaacaccataggcgagaaggacacgcgcgacatggtgaagctcaactgcctggccgtggtcgagtcgtgctatcgcgtcctcccccacatgggccccggctccaggatcatcaaccttgcatccatcgcgggcgtcatcccccagcccaggctctcggtctacagcgccaccaagtccttcgtgctcgagttctcgcgcacggtcgaccacgagctccacggcacgggcatccacatcacggcgctctgccccaagttcatgcacaccggcttcctggacaagccaaacgacagcgaggtcgcgcgcaagatgtgcgtcatcggcttcagtcccgtggacaaggtcgtgcgcaaggccatccatgctgccgtactcggccgcgcgctctgcataccatccgcggacatgtgggccgcccacatcatcacaaagctcctaccctcaaacgtgagcatggagctcgaggacatgttcatgggcatgtgggagcccatgcgcacggcagacaggcgctagcgggcgcccaagcaccataaggcagaacctagcaaaatgccgccgagaagaacgcgtcgtccttctcggcggccttgccttgtgccatgcaagcgcgtgctagacggcgaactccgtctgctgcgccttctttgcggagcggatgaggaactcctcgttgtccctcgtggccttgagtccacgcaccagcgcctgcgcggcgcgctccgtgttgttcatgtttgccaggagtctgcggattccccagacgaacggctgcatgctggggtcgatcagcaggtcctcgttcctcgtgccggaggcgacggggtcgatggccgggaagatcctgcggtcggccagctcgcggtcgagtttgagctccatgttgccggtgcccttgaactcctcgaagatgacctcgtccatcttggagcccgtgtcgacgagcgcggacgccaggatcgtgagcgagccgccgttctcgatgttgcgcgcagcgcccaggaacttcttgggcgggtagagcgccgcggagtcgactccgcccgagaggatcctgccggacgcgggggccgcgaggttgtacgcgcgggcgagacgcgtgatggagtcgagcacgaccacgacgtcctcgcccatctcgaccaggcgctttgcgtgctcgatcacgagctcggacacggccgtgtggttggatgcgggcatgtcgaacgtggatgccacaacctcgcccctgatggagcgctccatgtccgtgacctcctcgggacgctcgtccacgagcaggcagaacaggtgcacctcggggttgttggccgcgatggactggcagatcttcttgaggaccgtggtcttgcccgccttggggggcgacacgatgaggccgcgctggcccttgccgatgggcgccaccaggtcgatggcgcgccccgtgatggagtccttgccgtgctccatgacgagtcgctcgttgggatagatgggcgtaaggtcacggaagcgcgggcgcgactttgcctcctcgggcgcgcggtcgtttatgagctcgatcgtgtgcagcggcgggtacttgtttcctgcctttgcgggagaaacgcttccctttaccttgtcgcccgggcgcaggccgtactgtctgatcatctgctggtgcacgaaggcgtcgttgtcgccgcgcatgtagttgcccgtgcggacgtacgcgtagccctcgttctggaactcgagcacgccctcgacgggcctgaagccctctgcgtacgcggcggcctcgtacacggcctccgccagctccttcttgcgcatgcccacgtactcgatctcgagctccgcggccttcttgcgcaggtccgcgaccttcatctgggcgacctcgtcgcgcgaaagggtgggctcgacggtctgctcgcgctggttgttcttgcggttgcggcggcgctggttcctgccctgcttgccattctggccctgggcgttgtcctgccggccgttgtggcggcggcgacggtggttggggcggtcgttgcggtcgtcgtcctgcgacgtgcgctcgcccttctcgccccgctcctgctcgccggtggtgtgctcctcgcgcgcctcggcgtcgggctcgtgacgctcgggctgccttgcggccgcctccgctgcgtcggcctccgcgagcgtcgctgcgggcgcggccatgacctcggccgtcgcgtgcgtggcctcctgcgtcgcgtgcgtcatgtcctccgtggagggcgccgcgtcgtccgcgctggcctttggcctgcggcccctgcgacggggcttcggctcctgctgggcgtcctgcgcctccgcgggagcctgctcgccgcgctcgtcggcagcgtcgtccgcctgcttcttgcgcggcctgccgcgacgcctcgcgggcttgggctcggcctccgcctcgcctccagcctgctcgggctgctcggcctgtgttgcctgcggctcgccctctgccgcgtcggccttccttacggcgcgcctgcgcgtcctgcgcggctttgcctccgcgtcgtccaagctgccgctttcctgcgcggactcagccgatgccgcctcgatcttctccgcgcgcctcgtcacgcgcctgcggcgcttgggcttctcctccgagggattaccgtcagcgtccgcgccctccggcacgcccgtgccggcgacttggttctcttctgccattcaagacccttcttgatgtctgtcttgcagcacgcaggcccgtcggggacgattccggcaccatgcacacgccatctggtggctttctgcaaccagggctcttggatgccgagtgggagattgggctcacatgcgataaaaactgcgaccatgcgcaaatacagcgtcactataccattttgcgtgcaaatgcaaaacaggaaatatcgggcccacaacggcccaagaactcaagtgcggcggaaatccgttgccacgcgcatgaaaaatgcgggccacagtggcccgcactctacatcacttgccttgtcgctactcctggccgccgcggcgcctccgcctcacgacgagcgcgttgatctcggactcgatgtcatccgcgatctcgcgcccctgctcggtgaggcccacgcggaagccgtggcgactcttgcccaggcgctcgacgtagccctcctcctcgagcgcggacaccgacatcgacaccgtcggctgcaggagccccaggcttcccaccagctcgcttatggtgtgcgcgccgccgccaagggacttgatgcccagcaggatgagctcgctcgcgtcgcacgatatggagcccatcgcgtccacgtacgccctgacgcgcatcgccgtcgtgcgcgagagcggctcggtcggcttgatggagctgcgggtcttctcgcacagcgagtccgccacctcgagtccccgctccgatatggagcagaagatgttgcgcttgtccgcactcccctggtcccggatgatgagtccctgcgccgcgaggtgcttcgtcctgtgcgtcatcgtcgggcgcagcacgtgctggtagtccgcaatgtccgaggtcctcatgccgccctcgcagttggccaggcggcagagtatggagaactccgagaaggagagcctctcggccttgtcctcgccctgccgtacgaggttgtaggccttgcggatcgacaagtattccttcgcgtccatataaaaaaccgccgctctcatcgttgcgtatcacactgcatgcatatgcaaggtgcgccccgctacacgcgataggcgcacctatatttgcatgtgccgccttacggacacaatacaacattgaattaagcaaacggctcagagcgctcaatcccgcccgtaacgttacgaagtagaaagatttgggcgagaagaacgtacgcttaaaggcctacatcacgtccggtgcggacactccgatcagcttgagagcgacctccaggttgatgcggaccgcgtcgcacgcgcacaggcgggccttggagagcgcctcgtcgacgggacgtccctcgctggggagcacctggcagttcgcatagaagccgtggaaggcacctgcgagctcctcgcagaagtgcgttaggcggaacggcgcacggtcgcgggcgcagccgagcacgaggtccgggaactcggagatcttgcgggcgagcgcggcctcggtcgggtcggtcagcagcgacaggtcgacggagtcgccgatcgccttctgcgcgaccttctccatgcccatctcgagcgcctcgtcctcggtgacgcctgcggccttgcgcaggatggagcacacgcgggcgtgggcgtactgcacgtagtagacggggttcgtgttgttgcgctgcttgacggcctcgatgtcgaagtcgatggtctggttggaggacttggacacgagcgtgtagcgcgtcgcgtcgacgcccacctcgtcgatcagctcctggaacgtgatcatggttcccttgcgcttggacatgcgcacgggctcgccgttgcggagcaggttcacgaactggccgaggtcgacctcgaacttgccggggtagcccagggcgtcgcacacgttggtgacgcgggcgatgtagccgtggtggtcggcgccccacaggtcgatggagtagtcgtcacgctggaacttgttccagtggtaggcaacatcggaggcgaagtaggtgtactcgccgttcgacttgatgaggacgcggtccttgtcgtcgccaaaggcagtcgacttgaaccacagggcgccgtcatcggtcttgtagaggtagcccatcttgtcgagcttctggaaggcacggtcgacctgcgaggtaccggactcgtccttcacgtagagggagcgctcggagaaccacaggtcgaagtcgcagcgcacctcgtggcacgttgccttgatgcgcgcgagcatcgactggtaggcacgctcgcggaactggtcgagcgactcctcgacgggaatgtcgacccacttgtccccgtccttctccacgaactcgcgggcgatgtcgacgatgtagtcgccgccgtaggagttgccgcccagctcctcgttgaaggtgtccatgaacgggtgcgtctcggggtgctcgtcgtcctcgtcggcgacgtaggcctcgcggtccgcgatcagcttgtcgtgcgcggcgtccaggtcgcagccgtcatccttcatgatctgctcgagctgcaggtagcgcctctggacggagcggccgaagacgtccatctgggagccgtggtcgttgatgtagtactcgcggtccacgtggtagccggcaaagtcgagcacgttgcacatggagtcgcccagcgcggcccagcggccgtggccgacgtggagcgggccggtggggttcgcggagatgaactcgtagttgatcttgaggcccttgccctcgtcggagcggccccagtcggcgcccttctcgcgcacctcctggaagacctcgttgttggccgacgcgttgaggtagaagttgatgaagcccgggcctgcgacctcgaccttcgcgacctcgttgctcttgggcatgtgggccacgatcgcctgggcgatcttcgcgggggccatgtgtgcgaggcgcgcggagcgcatggcgaccgtggagctccagtcaccgttgctggtgtccgccgggcgctcgacgccgtactccttcacctcgaactcgggaaggtcgccagcggactgtgcggcctcgatcgcttgctttacaaggtcctctatggtctcgggcatgttgtctccttagctcttgccacacgatgcatgttcctgcgtgacgcagacagttgcagacagtctagcagaccgccgagccaaaccccacgtcacgccgcgtatccgacgcccctagtggcgcgccgagtccctgcgctccgcgcgcgtgaggtcgctcctcagcttggcgaggccgggctcaagtcccacggggtagatctgcgggttgaggaagcgcctgacggcggggtcaagcctcatgaccgcctcgcggcagcgggccttcgcctgctcgatggtgtccggctccttggagcgctcgcccttctccaccacctgctccatgagctcgcgagactcgtagccgcccatgtcgtaggtcatgagctcgtccagcacgtcgaccatgttcgtgtcgccgtcggcgctcctcacggagtcgtccacgatcatgtcgcccacggggcagcccgcctcgtcgtagaagcgcgtgatgtgctggatgcccgggatcgtgcgcttgtaggccatctcggagagcttgaggacggggtcccacggctcgtccgcagacgagcgcgtggcggagagcttgtacacgccgccgagcgacggctgcgggtcgcaggtggcgagcttggtgcccacgccaaaggagtcgatgggtgcgccctgcgcaaagagcgactggatggtgtattcgtcgaggtcgttcgacacggagatcttgacatagtcgagccccgccgcgtcgaaggcggcacgcgtctccttggagagcttggcgaggtcgccggagtctatgcggatggccgcaagcctctcgcccgcctgctccatctccttggcgacggtgatggcgttcttgatgccccggtgcacgtcataggtgtcgaggagaaggacgcagttcttggggctgctcttcgcgaacgcgcggaaggcgtcgagctccgtgggaaacgccatgacccaggagtgcgcgtgcgtgccgaagacggggattccgtagatcttgcccgcgagcacgttggaggtggagctggcgccgccgatgtaggaggccctcgcgaccgcgaggccgccgtcgggaccctgcgcgcggcgcaggccaaagtcggagacggggtgcccctcggcggcgtgcaccacacgcgccgtcttggtcgcgacgagcgtctggaagttgacgaggttcagcagtgcggtctcgagcagctggcagtcgatcagcgggccctcgaccctcaccatgggctcgcgcgggaacacgaggtcgccctcgggcacggcccagaccgagaccctcatcctgaagtcgcgcaggtagtcgaggaagcccttcttgaacatggggcctccgctgggtgcctggacgctcgcgaggtacgcgatggagtcgtcgtcgaacacgaagttctcgaccaggtccgcaatctgccccatgccgcacgccacggcatagccgccgccaaacggcgcctcgcggaagaagacgttgaagcacccctcagcgtccacaagtcctgactcccagaagccctgggccatggtcagctcgtacaggtcggtgttaagcgaaacgtcggtgggtttcgtcgcgtcggtcaatgccattgcagtctcctctgcttggaccaaatcgcgtaaagctatccaataacagaagggtaccactcagggcgagaagggcgtggctaatggcccaacaccgtcacgaggatgattgcgacgaccagcacggcgaggcagatgaggacgaccttctggcccttcggcatgttgaggtcgtcgtccggctccatgaggcgggcgttcttctcgctcatctcgcggacgcgcctgtcgcgctccgtctcggccttcgcgcgctcgcgttccgccttgaggtgctcgagctccgcacggtcgcggcgggcctgcctctcccgctcgctgcgggccttctcggcacggagctcctcgagctccttgcgctcctcgtcactcagcggcttcgtcgaatctgccatgctcttccccactttccggccttcgcggcacgcgcgccattgcggggtgcagtcccccgtctacggttaactggtacccaactctagcattccagctccggacccctcacgcccgtcgcgtcgaaggctggcacgaagctctccgagacggtgccgccctgctgccaccacaggttctcgaagcccaggtcgtccgcgtggtcgagcacggtctcgtactcgtcgttcgtgacggaccgcgcgaggtcgcctccacggctcctgcactccgcgttgggcgtgtactggttcatgacggaaaggtcggcctcgttgccgcagacgtcccacacgcggtcgagcacggccagcgagtcgtccacgtgtccgggcagcacgaggtgccgcacgatgatgccacgctgcatgatgccgtcgcggttgagcctcctgccacccgcccgcctgagcgaggcgagcatctcgcgtagcgcctcggtggctcgctcggcgtaatcgggcaccgcagagagcctgcccgagaccgcgtcggacgagtacttgaagtccgtcagccagatgtcaaccacgtccgacatggcgcggatgacctccgcgcgctcgtatcccgaggtgttgcacacgataggcaggtccatgcccgccttgcgcgcctcgaggatcgccttgcgcacgtgcggggcatagtgcaggggcgtgaccaggttgatgttgttagcgcccttctccatcagctcaagcatcatctgggcgaggcgctcggtcgtgacctcgagcccaaagccctcctgcgagatctcgtggttctgacagaacacgcacctgagggggcatcccgtgaagaagatcgcgccggagcccgacgttcccgatatcggcggctcctcccagaagtgaagcgcggacctcgcgaccctaagcgttgccgtggcaccgcagaggcccgccctgccgtcggagcgacgggcgccgcacttcctgggacagagctcgcagcgatcgtacagaccaaagtcgacttccatgctgactccgcatacgaaaaaacccggatgcagaacatccgggcctacgatacaaatggtggagatgaagggattcgaaccctcggcctctgccttgcgaaggcagcgctctcccagctgagctacatccccagtgcaaaacgcgcgagaagtattgttgcaagaagccgtgactctgtcaacccaaaatctcgaacatattttggagaccagaatcggccgtcccgcaacgccatgagccccacgcgtacatgacggaaaagtcgtcccctgcggttgcgaaatgaacccacctctcaaaaggtgggtgccctcatcgccttttccagcttcctcaacaacggaggatgcctgtaatggggacgatatgtgggctccctcaaaacgcttgtcggttcacccagttgtttccgcaggggaacgacacttatgactataggggacccgtcgccaaagtacagtcttgacttgcccgcccttcctgccaacataagtgtatgtggcccgccaactggtgggccgtttccattttggtgggccgtttccacattcggccccggctcacgtgccgaaaccatgcgttcctgtatcattagaacgtaaatacgttggacgaggaccattcggagggggcgtacatgtacaggccgtgggtgccatacctgtgtctcttcctcgcagccctgttcgccgcacttctcaccactcccctcgcccgtcgcatagcctggaaggtcaacgccgtcgactacccggacaagcgtcgcatcaacaaggttcccatacccaggatgggcggcatcgcggtgttcctgggcatcgtggccgccttcgtcgtccagtaccttggcaccaagttcctgaactggcccatgatcctctcgccggcaccgcacctccagaacgtcaactaccggctcctcgcactcggcttcgtcgctatcttcgtcaccggccttctggacgacgtgttccagctcaagcccctgcagaagctcgcggggcagatcgtcgcggcgctcatcgccgtcgcctcgggcgtcgtcatcggcgtgatcgtcaaccccgcgaccgagggtgccttctacctgggaatatggacgtaccccatcacggtaatctacctcgtggcatacgtgaacatcttcaacctgatcgacggcctcgacggcctcgcctcgggcctcgcgtgcatcgcgagcttcaccatgttcgcgctctccatcatgtccggccgcacggacgccgccgccctcgcgatcgcgctcagcggctcaacgctcggtttcctccgttacaacttcaaccccgcaagcatcttcctgggcgactctggctcgcttttgctcggctacacgctcggcgtcgtctccatgctctcggtcacgcgcgtcgccggcctcacgaccatcatcgtgcccctcgtgatcgcgggcatccccatcatcgacacgttctcggccatcgtgcgccgcaagcgcgcccacgtcagcatcggccaggccgaccgcggccacatccaccaccgcctcatcgccgagggcttcaaccagcgccaggccgtccttctcatgtacgcctggaccgccctgctctgcctcggcacgttcgcgatgacccaagtctccgtcatcccccgcatcggcatcttcgcggtgctgctgatcatctccgccgtcatcgcggcgagactccacctcttccgtcccgtgctcctgcaccacaccgacccctcgaccggccaggacgagcttgtgtgcccccaggaccctgaatttgaacaagagaaggagaagttcgaggagtcccaccccgacaagattcaccatcgctcgtaaccgagctttctaccagcggttttgtcgctatttacctcgctccaaagcctcgtgatagacaacggaagcctcctgcaaggcccatgtcgtacccttcttccaccatccgccgcgacgaagggatcacgcatgatgtcatcagatgcaagcacgcacccaaaccacgaggtaatcgacgtcctcgagcgagacgagaggctcttctccgccatgctcgcccatgacctcgaggctcgcgtcgtctccgaagtgttccgcccccatgctcagcgtggatcggacgcgtgcccatcgtgcatgcatggcatgccggtaaaggacgatccagtcccagacccatacacatgcgaccaggcggcggagccgtacctggcatggctggcagacgtggttgccgcgagggagctccatatgccggacaccatctccacgctggacgataggggcctcctggaaggtcttctcgagcgagagcgcgaggacggcgctcgcgagggcatggaggagacgctatccaaggtacggaagctctttctcgccctcaaggcggaagaccgtgagggcgagcttgtggacgacctcgcgagcccattggagttcgcctgtgcgctcgacgacctctccattgcgtagccgtgcccaaatgatggtcgcattgtctctgtagtgtctctccatacaaaagcggggcccatgtcatccatgggtcccgctagaaatgcgaatgtctgcgtcgactactcggcgtcggcgagggccttcttcgcgacctcggcgaggtccgcgaaggcggcctcgtcctcgtaggcgacctgagcgaggaccttgcggtcgagctcgacgccggcgagcttcaggccgtgcatgaacttgctgtaggacaggtcgttcatgcgggcggcagcgttgatgcgctggatccacagagcgcggatgtcacgcttcttgttgcgacggtcacggtactggtactggccactgtgctgggcctgctccttcatgccgcggaaggtgcgggaggaggtgccatagtagcccttggtgcgctccaccagggtctgacgcttcttgcggccggcaacagcgcgcttcactcgtgccatatctaatcaactccttggaaatgcgattctaaatgacgcgtgcgcgcctctctacttcgtgcccatgcgctgcgaaacgaccttgacgtccgcgggggcaagctcggtctccttgcggaagccgcggatgcgcttctgggacttcttggtcaggatgtggctcttgaaggcctttgcgcgcatgatcttgccggttccggtgcggcggaaacgctttgccgaacccttgtgcgtcttcatcttgggcatgctagttctccttctcactctcggtgtcgtcctccggcgccttctcgtcaaaggcacccttgatgggggcgacgagcatgtgcatgttccgaccttccatcttaggcttggactcgaccgtcgcatacggcttcaggtcgtctgcaagcctattcaggacgttgaggccctgctctggatgagccatctcgcgaccgcggaacatgatcgtgaccttgactcgagcgcccttcttgaggaagcgcatgacgtggttcttcttggtcgtatagtcgcccacgtcaatcttgggcctgaacttcatttccttgacctcgaccttgacctgcttcttgcgcgcggccttggccttgcggtcctgctcgtacttgaacttgcggtagtccatgaccttgcagacgggaggctccgcgttgggagcgatctccacgaggtcaaggttctgctcgtctgcaatgcgctgtgcgtcgcgaatgccgaacaggccaagctgcgaaccgtcaacaccgatgagacggcaagtacgtgcggtgatctcgtcgttgatacgaggaccctgattcttggctatctttgacaccttcccttccccgcggcgttgcgccgcataaaaaaactcctggccaacagcatccaggagacaagggccgccagtgtggcgaacaagatatctttgtctgaccagacagctgctttcgcgccgtgtaggtgggggcgtaagccccgctttgcaaaacacttatcgaatactagcggttggccgccgccattgcaagcggcatccgaggacatccgcagcttcacaagttgcagacattcccgtcggaaccaacgcgcaagtggcgcgccgcagtacccgataccccattctccgctggttgagcctggtgcccgaggtgggactcgaacccacacgccgtttccgacagcagattttgagtctgccgcgtctgccagttccgccactcgggcgcgtcacgaagacttgcgtgcttgaactatagcagagcttcccccatggcctcgcaacaattagcgaaggtacgggttctgcgcaagctcgtcctccatggtcgtggggtcgccatgcccgcagaacacgttggtgtggggcgggatctcgcgcttgaggcggacaagcgtctcctcgagcgcggcctggtcgccgcccgagatgtccgtgcgaccgacggagcccttgaacagcgtgtcacccacgaagcagatgtggtcggcgcttcccgagccgagaaggacgaggcctccgggggtgtgccccggcgcctcgatcaccctgaagctcgccgttcccacctcgagggtgtcaccctcccgtagctcgaggtcgggtgcgggggcatcgtcgtcgtacgagaggccgagctcgttcttctcgcccgcgtggctcgccatctcggcgtccctggggctcatggcgaaggtggcgcccgtggcctccttgagggccttcacgccacccacgtggtcgccgtggccatgcgtcgcgacgatgcacttgacgcggacgtcctcgggcaggtgctcgtagatggcctggccggagtcgccggcgtccacgaccatgcactcgccctgcgatatgtacgcgtagcagttggtctctatcgggcccacgacgaacatagcgatctggtcgcggccgtcgtcgtggcagccgccgccacagcagccaccgccgtggccgtggctgccgcagcagccgccctcgtgctcgtggtcgtggtggccgccgcagcagcagccctcgtggtcgtcgcagtggtcggccatcagaccctcctcttcatctggttggcgccctcgccgggcaggatgcgccgcgcgctgtagaccgagggcaccctgcccacggaggccagcagcggcgcgaggcgcgatgcgtcggatatcgcgatcaggaagcgcaggcgcgcggtgcccgacttcgcggtctgcgtggccgcggagagaatgttgccgcccgagtcgccgatcgcgatcgtcacgtccttgaggagtcccatcctgtccgtggcctcgaccacgatctcgacctggaactccgtggcgcccgtcgcgtcccactcgacgtcgatcatgcgctcgggatgcgccatgaggcccttcacgttggggcagctcgcgcggtgcacggacacgccgcggccgcgcgtgacgaagcccacgatgtcgtcgccggcgacggggttgcagcagtgcgcgaggtggaccagcaggtccggatcgcccttcacgacgacgccgcagttgttctggcggcgcttcctgagcgaccggctgttgcccgcgagcggagccagcggcatgtcgtcctcgatggccttctgcttggccgcgtccttctcgcgctgtgcctgcgtctccgcgctgtccttgccgagcgcggcctcgatgcggttcgcaatctgcttggagctcaccttgttggagccaacggcggcaaacaggtcgtctacgcgaacgtagtcgagctgctgcaccacctcgtcgatcgccttgaccgtacgggggttgctgatgccgtagccgcgcttgcgcagctcgtgcgccacgtcgctgcggcccatctccgcgtcgtcgttcttgctggcggtcgtgaagtacttgcggatcttggccttggccgagggcgtcgccactatgttgagccagtcgcggctcggcttggagttcttgttggtgaggacctcgatgcggtcgccgctctgcaggtggtacgtgagcggcaccacggcgccgttgaccttggcgcccacgcagtggttgccgacctcggtgtgcacggcgtaggcaaagtcgagcggggtggagtcgcggcgcaggctcatgacgtcgcccttgggcgtgaagacgaagatctcgtcctcgaagaggtcgaccctgaggttgttcaggtactcggtcgcgtcgcccatgtcgtcgtccgtggcccagtccaggctgcggcggatccagttgatctggctgtcgatgtccttgtcggagttcgacatgttgccctcggagttgccggccttcttgtacagccagtgggccgcgatgccgtactccgcgcggtcgtgcatctcgtacgtgcggatctggatctcgatggggcgcgcgtccgagccgatgaccgtcgtgtgcagcgactggtagccgttgggcttgggcatggcgatgtagtccttgaagcgcccgggcagcgggtgccagagcgtgtgcaccgcgccgagcgcggagtagcagtcccccaccgtcttggcgagcacgcgcagcgcgatgaggtcgtatatgtccgagaactccttgttcttgcgggtcatcttctggtagatggaccacaggtgcttgggcctgccggttatctggtagtcggaaaggcccacgcgcttgagctccgcgtcgagtacgcggatggcctcgcgcgtgttctgctcgcgctgggcgcgcgtctcctgcaccatgcgggcgatgcgctcgtactcctcgggctcgaggtagaagaacgccaggtcctcgagctcccacttgatggagctgatgcccagacgatcggccagcggcgcgtagacgtccatcgtctcgcgcgccttgaacttgcggcggtccgccggcagcgcggcgagcgtcctcatgttgtgcagtcggtcggccagcttgatgatgaccacgcggatgtccttcgacatcgccaggaacatcttgcgcagcgtgagcgcctgcttctcgtccatggagctcacgttgatggaggtgagcttcgtcacgccgtccacgagctccgccaccgtggggccgaacttctcgctcagctcctcgagcgtcacgggggtgtcctccacggtgtcgtggagaagggcggcgcaaatggggtcggcgtccatcctcaggtccttggccaggatgtacgcgacctccacggggtggttgatgtaggcctcgccggagcggcggcgctggtcgcgatggctcacggcggcaaagtcgtaggcacgctccaccttggcgaggccagcctcgtccaggtaggaggcgcaggtgctcctcagcacgcgccagttgtcggcctgcggtacgttctttcgtcgcgcggggtccgcggcgttttgggtggtgtctcccatgggaacccctttcaatcagattccactagcctaccacgtggccgaagtccggtgtgatgggcctcgtgattctctcgagcagctcctcggtgggcgccgcgagcacccagtccctgaaggcgtcaaacgcgtcgcgcgagcgcagcccctcgaggtagcggatcgactcgttcagctccatccggcggggcgactccaccatgcggatgcgccgcgcggagccgtagcccgaggtctccaggaacccgagctcgcggaagatcgacacgccgcaggacacgctcttctcgtccagcctcgacgtggggtcgatctcgagcgcgagctgcgcgatgtcggcgttggaggacgagaaggacgcgtcgtccgcctccgtggccgcctgctgagccagcgtcctgagcgatcggtacagcagcactaggtcctggcgcgcaggcgcggccgaggacacgatgcgctcgttgatgcgcgcgtcacggctgccaaagagcaggtagatctgggcgtcggcgccgtcgcggcccgcgcggccgctcatctggttgaactcgatcgagccgaagggcatgtggtagagcatgacgttgcggatgtcagggaggttcacgccctcgccaaacgcgctcgtgctcacgatgcagcagagctcgccggagcggaaggcctcctcgacgcgcaggcggtccgcgcgcgagaggccggcgttatagaacgcgatgcggtgcgcgagctccgggatgttctgcctgagcatgcgagcgagcgagacggactgctcgcgcgagttgacgtagaccacggtcttgaggcccgtggagaccacgttgacgagcaccgcctcgcggtcgcgcacctcgcgcaggtcgcgcaggtgcaggttctggcggacggagtcgtccacgatcacgtcgtcgggcgcgatgggcagcaggctcaggatctcgcgcgcgaccttgggctcggccgtcgccgtgacggcgagcgccgtggggttgcccagcgcctcgagcacctgcggcatctgcgcgtacgcgctgcggttgccgccgcgcgcgccggccatgtggtgcgcctcgtccacgaccacgaaggacacgcgtcccgccttggcaaactggtcacggtggatcgcgaggaactccggcgtcgtgaggatcacgtccgcgtcgcccgccgcaagcgcctcgaacgtgcggcggcgctcctcgagcggggtctcccccgtgaggacctccacgtgcatgccgagcttgccgaacgtggcctccaggtggtaggcctggtccgctacgagcgcgcgcagcgggtacacgaagacgctcgcgccgtggcccaggatggcctcgcgcgcggcatgcaggtggaagatgagcgacttgccgcggcccgtcgccatgacgcacagggtcgacctgccctggcccagctgctccacggcgaggcgctgcgcctccaggagctggtggtcgcctatgagcgcgcggcggagctcgtccgtcagctcgtcgggaccaagggtcgccaggtaggagcggacggcaccggccgtctcctcggcggcctcggcgcccgcgggcgcgcacgtgcgctcgacgctgatgttgacgccgcgcgagggcttggcgccggcgccgcccgtcacctcgagcacgctcgcggtgtacgtggcgcccgcgtccatgagcggcgcgagcgcagccgcgatctggcggcgcaggtagcccagggggcggccgtcggagcgcctcacggcgatggcgtttgcgtcggcctcgttgttgggctcgcgcacgagggcaagctcttctcccccggcgaggccctccgtcgcgtcctgccgcccgtcgaagctcacgcccacgaccttggtcgagaagcgctcggcctcggcgatggtggcgtactcgtcgcgcgaaagaatctcgccggcgcgcgagaagagctcgtcagccaggccgtcgggcccgtcgtcgggcgcggtcgcgtcgcggtaggcgatgtccttcaccatgagcttgggcttggtgcggccctgccacgtctcgctcacgggctcgaacacaaggtccacggcgccctcgcagtccacggcgcggtcgatctgcggcgcgcggaacatgatggccgcgacgctgctcacgccgtccgtcgccacgaagcgcaggtggttgccctggccgcccaccttggcgcggttgcgcatggtgacgccgcgcacgccaaagagcggcttcttgttgccctggccaaacggctgcataacctcgagcgcgtcgatgttggcaatcgtcatctcgtcgagccccacgatggccgtgacctcaccgcggtcctcgaagtcctccgcagggagcgcctccatggcctcctccagggactcgcggaacgagtcgaggttggcggcgtcgcaggtcacgcccacggcgccggcgtgcccaccaaagcggacgagctggtcggagcactggtcgacggcgtggaagaggtcgacgctgccaacggagcggcccgagccacgcgcgatgccgtcggatatggaaaacaggatcgcgggaacgtggtagcggttggcgatgcggctcgccacgatgcccttcacgccctcgtgccagccctcgccgccgacgacgaccacgcggccgccgtcgtaggtggcctcgaccttggccatggcctcctcggtgagctgggactcgatctcgcgacgctccgtgttggtctgctcgagcctgccggcgagcacggccgcctcggcggggtcgttggtgagcagcaggtcgaaggcgacgtccgtcgtccccatgcggccggccgcgttcaggcgcggtatgagcgagaagggcagctcgtccgaggtgatggtctgcaggtcgacgccggccgtcgcggccagcgccagaagcccgggcctgcgcgtcctgcgcatgcacgagatgccgtccgccacgagggcgcggttctcgcccgtgaggagcatcatgtccgagatggtgccgagcgtcgcgacctcggtgtaggagcgccacaggtcgtcgcgaccgtggcggcgtcccagctcctgcacgagcttgagggccacgcccgcgcccgcgagctcgcgggaggggttcttctcctccagctttgggtcgcacacggggacgtcctcgggcacgagctccgcaggctcgtggtggtcggtcaccaccacgtcgatgccctgggtcctgagccacgcgacctcgaccttggacgcgatgccgttgtcgaccgtcacgatgaggtcggggtggcagccctcgatcacgcgcgtgagcgcgtccttcgagagcccgtagccctcgccaaagcggtgcgggatgtacggggacaccttggccccaagctcgcgcaggccgagcgtaagcaggcaggtggcggacatgccgtccacgtcgaagtcgccgaatatcgcgatggactcgccgtccgcgatggcgcggtcgaccctgtcggccgcctcgcgcatgccggggatgacgagcgggtcctgccaatcgcgctcgagcgagggcgacaggaagcgcttggcctcctccacggtcctgatgccgcgcgcggccatcgtcctcgccacgagggcgggaacgtggcacccctcggcgagcctgcgctcggcctcggggtcctggggcaggagctcccaccttctgctgtcggcgagcccgggcatggctactcggcttccccggctgcgtcggccttacggacggacgcctcaggcgcgtcccacccgtacttctcctccagcttcttccacttgggctcgcgcgtcttccagatggagagcagcgggctcgcgacgccgaagctggagtacgtgcccagcagctcgcccacgaggattgcgaacgcgaagtccttgagcgtggagccgcccagcgcgagcatgcagatgacgggcacgaccgtcgtgatcgtggtgttgatggtgcggacgatgacctcgttgatcgagaagttcgcgatctggtggtacgtgcggtgcacgccgtccttgagctgcttggcgttctcgttcactcggttgaactcgaccaccgtgtcgtagagcgagtagcccatgatggtgagaagggcggccaccacgttgggcgtgatgggcgtctgggtccaggcgtagacgccgagcgtgatcacgaggtcgtgcagcagcgcgacgacggccgtgatggacatcttgaactcgtagcggatggatacgtacgcgatgatgagcgcgatggcgatcacgaaggccagcgcggacgagcgcgtgacgtcggcgccccagtccgggccgatggtggtcgcggtgtagttctcggacgtgaggccgagcgtcttggcggccgcggccgcgtggcggttggccgtcgcggggtcggtcgtgtcgagccgaacgatgaagcccctcttggcgtcgctcaccgtggtctgcacggaggggtccttctcccccgccttcacgagcgccgagcgcatctgcgagattgtgatggatcccgtgtccgtgaagtcgatctcggttccgcccttgaactcgatgccaaagacgagcccgcggacgacgaggcccacgacggccaggaccacgagcacgcaggacagcgtgaggagctgcctcctgtgctggatgaagggaatctcgtgcctgaagtgactacgcattgcgggcaccccccttctggtccctctcgtctgccttgcgacgcgcctccgcgaggtcctggtcgacgccccagaacttggggtggcgctctatggtgcccagggcgagcaggcgcagcgcgggcgccttgaagcagaacatggtgatgacgtcgcacacgatgccgagcgcgagcgtgaggccgaagcccttgaccgagccgatcgcgaagaagaacagcgcgagcgcgcacacgagctgcacggcgtcggcatcgagcgacgtcatgatgccgtgcttggcgccggagaccgacgcctgcttgacggagcggcccatgcggatctcctcgcggaagcgctcgagcacgaggatcgaggagtccgccgcggaacccgtggtgagcacgacgcccgcgaggcccggcagcgtgagcgcgaagagcccgaagtgcgagagaagcgcgaggattccaaggtagacgatgccaaacaccgcgagcgagcccatggtgaggatgccgaggccgcggtagaagacgaagaggtacacgatgacgatggcgaggccgatgccgatggcgaacacgccctggttgagcgagtcctggccgagggtcgggccgacgacgcggctctcagagtatttgagggtgacggggagcgagccggagtcgagcacggtcttgagcgacttggcctcgttcagcgtgaacttgccggtgatggacacctcgccgcccgtgatctcgctctggacggccggcgcggacttgaccacgccgtcgagcacgatggcgatgcggccgttggtgggcgcgagctccttggtgacctcggcaaagtccttggtgccctcggagtcgagcttgacgttgacggagtagtagccggacagcgagttgctcgactgccccaccgtgacgctcttgacgtgcgagccggtcatgaacggggtgtatgtgccgctcttgagcttcacgttctcggtcccggcgttgatcttggcgagcgcgtcggcgtcgccgatctcgtccaggcgcacgaactcgagcaggcccgtctggccgatggtcttgatggcctggttcgcgttggtggcgccggggatctggatcaggattgacttgctgccctgctgctggaccgtcgtctcggacgcgccgagcgagttgacgcggttctggacgatggtcgtggccgtcgccatgtcctcggcggacggcgtcttgccgttggacttgctcgcggtcatgacgaccgacacgccgccgcggatgtcgagtccctgggtgatcttctcgcccacgggggtaaagccgatgacgcacgccacgagcacggcgagaaggaccaccagcgtggtcacgtagcgcctcttttgcggatcgcgcctcctgcccctacggcgcgacttgggcgccttgtccctcttggccgcggactccgtggcgttccagcggtcaacgccggacagggactcggaggacttcttgtctcgagccataaacctttgccttctgtctgggggcacatgccccgggtgtttgactcgaccaatgatagaacacttggacgaacgcatcgcggcgcgccccggcgccgcgtctggccgctaccagtcgctggcggcggggagctcgtcccaggcgcgcacgaactcgccgtaacggtgctcgatgatggcctggcgggcgcggcgcatgaggtcgagcaggtagtagacgttgtggagggacagcaggatggagccgaccatctccttctgcttgaccaggtggtggatgtaggcgcggctgtagccgcccgtgcacacggggcaggtgcagtctgcgtcgatggggcccgcgtcgtgcgtgaagcgcgagttcttgaagttgaggcgcccctcgctcgagaacgcggagcccatgcgcgccgtcctggtgggcagcacgcagtcgaacatgtcgatcccgcactccacgccgtgcacgagcgtcgtggggttgcccacgcccatgaggtagcggggcttgtcgcgcggcatgtactcgctcgcaagcggggcgagcgtctcgaacatggtctcgtggtcctcgcccacggagtagccgccgatgccgtagcccgggaagtcgccgcagtcctcgaggtggcgaagcgacctcaggcgcaggtccatgtgcatgccgccctggacgatgctgaagagcgcctggtcctcgcgggtgtgcgccttgtagcagcgctcggcccacatgccgctcagctccacggcgcgctccacgaaggagcggctcgccgggtatcccgggcactggtcgagctgcatcacgatgtcggcgccgagcttctgggcgatgtccatgttgcgctccggcgtccagaacacgtgggagccgtcgtagtcgacggtgcggaactccacgccgtcgtccgtgagcttggtgaactcgccgtggctgaagacctggaagccgcccgagtccgtgaggatcgggtggtgccactgcatgaagtcgtgcaggccgcccatctcggcaacgacgtcctcaccgggacggttggagaggtggtaggtgttcgcgagcacgatcttggcgccgagctgctcgagctgcgggggcagtatgcccttgaccgtggccttggtgccgacgggcatgaagatgggcgtcggcacgtcgccgtggggcgtgtgcagcacgccggcgcgcgcgtgcgtcgtgggatcctccgc

SEQ ID NO: 178 - DNA, 2296 bp, Unknown
  Metagenome-assembled genome
ctcgcgcgggtcgtgccagcgcctcagcgagcgccactcgtccgccagcctgcgaaagtcagacggcccgcggcgccagtccttctcgcccgcgaccgactcggcctcggagcagagcgcctcgcgcttcttgagctcctgctcgagcgcggtctgtccctcgccctgggcctgcgcctcgtcctggacgtcggtcgccgtcacgggcaggtccgcggcctgggacgtatcctcggttggattgttgtcgagcgtcatgtgtgtctcctcgcagcagacagaactggtttccggacatgccgggacggggcaaaccccaacgtcagccgccatgtccacattcatgaaagactatcacatgaacgccacaattaagccgcgactgtcgccaacgggcggctatgcggtacgtctgcgacgaccgtcgcgcgcgtgccgtcgcgaggcgcgcgcccctcgcattgctatcatcttggtgacggatgcgagcgagggaggcacgatggaggagaaggacaacgcctgcggggatggctgcgccgtccgctgcccccatctcctggacgacacgtcgtgcatggacggcatcaggatcttctcgggccttcccgaggacgccaagcgcagcctcatggccggcgccatccgctcgacccatcccgcggggagcatcatcgcgcacgagggcgaccccatcgagtcgatcctcatcgtgcgccacgggcgcatcaagacgttccacgtcgacgcggacggcgaggagtacctgctcgacatcctgcacgacggccaggccatctggcacggcatgttcatgcaggaggacgacgtctaccactactccgtgggctgcctcagccgcgtcgacctgtgccgcatccgccgcagcgacttcctggcgctcatcaagcgcaacccccaggtggcgctcggcctcatgcagacgctcggttccgagctggtccaggcggaggagaagatcaagctcctgggcatccgcgacccccggcgcaggctcgcgcgcttcctgctctaccgcgacgaccgctgcctgggcgcggagatcaacctcaagctcaacgacatcgccaactcggtgggcttgcgtcccgagaccgtgagccggagcctcggcgccttcgagcgcgagggtctggtgcagcgcgagggccgcgggcgcataaaggtgctcgaccgcgcggcactgcggcgcatggcggagtagcgacccaacgggccaggtccttctcgcctgtgtatcatgccgcttgccggcggattccgaccgttcgccccgtcgcgtaacggtcaatttttcgttacttgattgcaatcaaggaaagcctttcgtaaagaacgtacctttgcctcacgcgccgcgagcgggcaggcaccagccgccagctgccgcgcacgtccccgtatcgcgaggtcaagaggaggcagctccgtgcttggaagggtccactctctggaatcgtttgggtcggccgatggccccggcgtccgcttcctggtgttcctgcagggatgcgccatgcgctgccgctactgccacaacgtggacacgtggaccatggacggcggcacgatgatgtccgccgacgagattctggacaaggccgagcgctaccgcggctactggggcgaggacggcggcatcacggtcagcgggggcgaggcgctcctgcagatggacttcgtggaggagctcttctccaaggcaaagcagcgcggcatcaacacctgcctcgacacggcgctgcagcccttctcgcccaaggcggagtacgtggagaagttcgacaggctcatgcagtcgtgcgacctcgtgctcgcggacctcaagcacatcgaccccgagggtcaccgcgagctcacgggccacggcaaccagaacatcctcgccgcgctcgagcacctcgacgcgatcggcgagccggtgtggatccgccacgtgctggtgcccggcatcacggacgacgacgcgctgctcgagcgtacggcggagttcctctcgcgcctgcacaacgtggagcgcatcgaggtgctcccctaccacacgctcggcgcctacaagtggggcgagctcggcatgaggtacacgctcgagggcgtggagccacccagcgcggagcgcgtgaggaacgcggagcggatcctgcgacgcgagggctagcgccgcgacgttcaccttggtaccacctgcagagactgcagaccagataggaagcaacatgcgagggcggcgctgccgccggaaagcgaggagaaatgcaggacgttaaggagtggg

SEQ ID NO: 179 - DNA, 3518 bp, Unknown
  Metagenome-assembled genome
cgcccacgcgcccgtactcgacctgcatgaagcgcacgaggtcctcctgcgtgagggtgcgctcgtagttgaagaggcccgcgtggatgtccgcgagcttctcgatgagcacgaggagctcctcgtgagtgaggggctgcagcctgatgaccggcgcaagcatgtccacgaggccgtcctgcgcaaagcgtccctgcgtgagcctgctgcggagcgcctcgtaggagtagatcccgcgccgcctgtcctcgatggactggggcgtgccgctcatgatgatgcccaggtagtgcgccttgccctgcagggtgtcgttgtacatggtgagaatcttctcgtagttgtactggcgactgatggcgttggggatcttgtagaggttgacgagctcgtccacgagcacgatgagcccctggtagccggcaccgcggaggaacgtggcgaagagcttgaggtagtcgtaccagtcgtcgtcgccgatggcgatgttgacgccgagctcctggcgcgcctccgtcttgttgcggtactctccgcggaaccacttggtgacgttcgccttggtgtcgtcgtctccctcgaggtgcgcgcgccagtacatggtgaggagtctcgcgaagtcgtagccgtgcaccagctcctgcaggtcgcggatcgtggtgaggatgcgacgctccactgcgtctgcgaactccggatcgtcggggccgatgccgtcctcgagggtgacctgcgactcgacgttcgacacccaccggtcgaggatgaggttgagggcgccgccttcgggctgcgtcttggtggagaggttgcgtatgagctcgcggtacgtggcgagtccctggccgttgccgccctgcaggcgccgctccggcgagaggtccgcgtcgcagacgacgaagcccttgcccatggcatggttgcggatggtctgcagcaggaagctcttgccggcaccgtagcgccccacgacgaagcggaagctcgccccgccctcggacacgagctcaaggtcgtgtagcagcgccgcgatctcgcgctcgcgaccgaccgtgatgtagggaaggcctatgcgcgggacgacgccgcccttgagcgagttgatgatcaccgctgcgatgcgccttggcacgcgcctgtgcttctggtctgccatggcttgtccctcctcgtgtgagctgtggcaaaccattgtagcctatggaacggaaacagaacaggtgttcctacccgatttgtgaagtcgtgacaaatgtcacgggtgcgcagcgctgcgggcgagagcgctgtgctcgctagagtccgcacagctcgcggacgtcatccacgtagtcgggaacgagctgcggggcgccgtccacgtactcgattgcggtgtcgcccagctcgtcgaagaacttctcgttgatggagtcgaccaggaccgatgccatgggcttgcctggcccgagcaggtcctggaagtcctggccggcggcgattcgccggacgacctcgagctcgagctccgtcaggccgcagggggcatcgtcctgcgcggcaggcgtggcctggggcgcggatgcctcgtccttctcgcccgcggggaaagcggcgggagagaaggacgaggcctctggctcggcggcatcggacttggactgtgcgggcgtggtcgtcgcggctggcgccgctgctgcctggggctcgtcctcgatctcctcgtccaccaggagggcatcgcgcgtggtcgcggcggccgtgcggatgccttggagcttggagaggtcgatcgtgatcttgcggcgctccgcctcggcctcgcgctcgtactgggcggccgaggcctgcacgatgaagcgttcgaggtacttggggagcggccgcggcttgagcgggtggccgtcgtcccagtcgaggcgcatctgacggtccatggcgcgcaggatgcggccgaggtcgcgactcttgctggtgcgctcgtagccgcggttgatgaacaggcggcccgcgcggctggtcacgctcgtgcaggcgtcgatgcggtaggtcctcacgggaagctcgcgcggcgggcggtagggcaggtcgggcaggggataccagccaacgcgcgactcccagcccacgagtccgtccacaaagttggtcttgcggcgcttgccgcagtggcgtgcgagcgagcgaaagatctccgccccgacggccgccgcggagtcggggtgctcgcgcaggaagggcgagcggtccacgttgtagctggagacgacgcccatggcgtgccacagctgtgcgtccgagggggcctcctttggcatgtctgccgccgtgaggccgcgggcgcccgcctcgcagaggacggcgcgttcggccgtgcgcagcgtggcgacggcctgggcaaagccgcgctgcgactcgggttccacgagttcgggcggcaggttgtgaaggacggcgtagtcgcgcatccagcgccgcgcgtcgagggcgaggccggagtcgagcccgtccaccccaagctcgaccgagcgctggtagagccgcctgagctgggccaggcacggctcgccgggcgcggcgcccacgccgttgacgagctcggccgccagcaggcgaccgtacgtgtagggaaggcgctcctccttcccgctgcgccacgccgtgcgccagcggaagtagtcgacgagctcctggtccgtgaggtcgcggtacgtgacgccgtagcgcgggcgcggagcgtagcgggagggagacgtgtcgtccgcgtagtccgcggcgacttccgcctgccttacgaaaagcgtgacgcctgtgagcggctgcccgtcggggagccgctccgcctcgagtccgcggagcgcctgaagcgtctggggaagggggctcctgcgctgcgtcggcctggtggcgcgctcgcccggcgtgggccagccccaggccgaaaggacggggtcgtccggctcgtccaggggcgtgtcgaccacctcgagccaggcgggaacctgctgcgtctggtcgtgtttcgcatgcgtcttgggtgcgccgctgccaaggtgcgcggggcgcgggcggggtggaacctccgagcgcgcctgcctgcgtagggccgcgcgctcttctcgcccaagggcgcctgcggcggggcgtgcgggggagtcggccgcggcggctgggacggtgccggcggcggcctcgtggtcgcgcctgaggtccgcgccggtgcgcaggatgggctcctcgccaaaggtcccggcggagaagatcgtgcgctcccgctcggtggcattacgcatgatctggtcgagcacctggcgtgcgcggctgggcgctgcgtcctgctggccctccgcggcggggactccacccttgtgccgatcccgctcgtcctgcgggtcccggctccgttcctggtccatggcgcctcttatcctcttaatcgtcgcctcccggcgactttagtcctgtattacgggcaaccggatatgggacattgttcctgacggcgggggatcgcgtgatgcttgcgccttgggacctcg

SEQ ID NO: 180 - DNA, 37388 bp, Unknown
  Metagenome-assembled genome
gtgacggagtggtccttctcgtcatgccctatgtccgcgaagtgctggcgcacggccttggtgatgctcacctcgcgcagggtggcgcccagcgcatcggccagcacctcggagttgccgtgcgtgcgctccgtcgtgccaaagcccggcatcgtgaccgcgatgatgcccgcgtggtccatccccaggatgtcgaaggcgcgcgcgatcaccaggagcgccagcgtggagtccagcccgccggagacgccgatgacggccgagcgcgagtgcgtgtgcgccaggcgcttggcgagcccatacgactggatggaaagcacgtcctcgcagcgggcgttgcgctgagccgggtcggacggcacaaacgggtgcgggtccaccgcgcgcgtgagctccgtctgctccacctcgagcgagaaggacgtggccacgtagcccgcggcctccgccgtgggcgcgctcacgaacgtgctcaggcgccggcgctccgcggcgagcatgtccacgtcgacctcgctcgtggcgcttgcctcgccaaacgggcgcccctccgcgagcagggagccgttttccgccaccatgtcgtgcgcggagaacacgaggtcctgcgtggactcgccccatccggcgctgcagtacacgtagcccgccaccaggcgcgcggactgccccgtcacgaggctgcgccggtaggcggccttgcccacgatcgcgttggaggcggacaggttgcagatcacggtcgcgcccgccagcgcgtgcgcgatggagggcggctcgggcacccagaggtcctcgcacacctccgccgcgaccacgaggttgggcaccgtggcgcagcggaagagctgcctcgtgccaaagggaacgccctcctggccggcaaagtccaggcgcgtcacgtccgccgggcccgccgtgaagtggcgcgcctcgtagaactcgttgtagttggggatgtgcgccttgggcacgatgcccagcaccctgccgtggcagagcgcgacggcgcagttgtagagcttgccgcccgcacgcacgggggcgccgaccagcaccagggcgtccaccttggacgtaccctccgcgatggtggccacgcccttctcggccgcattgagcagctcgtcctgccagaagaggtcctcgcaggtgtagcccgtcacggcgagctcgggcagcacaatcacgcgcgcgccgtcgagcgagaaggactccctcacctcccgcacgatgccctccacgttggcgtccacgtcggccacgcgcaccatgggggtgcgtgccgcgaccttgatgaatccgtcctgcatgctatgcctcccataccggggtgccgcccacgtacgtggcgatggccttcacgtcctggatgcgctcggggtccgcctgcatgaggttggcgtcgagcaccacgaagtccgcgagcttgccgggcgcgagcgtgcccagctcggcctcgcggccgaccaggcgcgccggcccgcgcgtgtaggcgtcgatcgcctgcgccatggggatgcgctcctgggggagccacccgcccgccggctggttggtccgcggcacctcgcgcgtgacggcgcagctcaggacctccatcgcgcggtcgggcacgcagggcgagtccgtgccgaaggccatggtgacgccctccttgcggtaggtcgcgaacggccacatgaagctcgcgcgctcggggccaaggtcgcgctccggctgcgtcacgtcgatcaccacgtgctgcggctggacggaggccacgaggtcgatcttggccatggcccgaacgtcctcgggcgtgaggttctctatgtgctcgatggcgttcatgcccagccgagggcggccgtacttctcgcgcgcctccgtaaagatcttgatggcgcagctgatggccttgtcgccgatggtgtggatgcgcgtggcgatgccccgctccgccgcggcgagcacgtagccgcgcatgacctccgggtcgacggtgggccggccgcagtcgcccgggaagtaggggttggcgtagggctcgtgcagccacgccgtgtgcgcgctcgatatgccgtcgaagaactgcttggtgccgggcacgcgcacgagactgcccgtgaactcgcgctgcaggcgctccacgcggtcgaactcgcccacgttctgggggtacaggttgaagcgcatggggatctgcccggctccaagcagctcgcggtagatgtcgtcgtagacgaagtccgtgccggggatggcgcacagggccatgtcgcacacgctcgtgatgccctgggagaggctcatccgcatgtagtcgcgataggcgtcgatcaccttctggcgcggcaggctcgcgaagaccttggccacgtagtacatgcccgcggcctcgtggatgacgcccgtgaggtggccgtccgcgtcgcggtcgaagaagccgcccttgggaggctccgtgtcctccgtgatgcccagcgcggcgaggccggcgctgttgacccagagcgtgtggaggtcgccctcgtacatgcagacggggcggttggggaaggccgcgtcgagtgaggccttggtgggcggcacggccgggtcccagagcgcccagcggaagccctggcccaagagccagccgtcgccggggtgcgcctgggcaaactcctgcatcctgcggacgcagtccttctcgctcgtgcccgcgtaggagagcgcgaggtcgctcctgaagagcgccgtgtggaagacgtgctggtgggcgtcgtggaagccggggcagacgaaggcgtcgccaaagtcgcgcaccggggcgccctcgggcagcacgtctgccaggcgctccggcgccacgacgtccgctatggcgtcgccgtccatgacgagggcgcaccgcgcgtctggatgcgcctcgtccaggtagacgtggttggaacggacggcgctgagtgagcccacggtgaacactccctagagtagtgcctcctgaacgaggcggatgaggaacctgattccctgcaggtaggagcggcgcgtgatgcgctcgttggtgccgtgcaccccgcgctcgatctcgtccgcgtccgcgacgaagggcgagaagcgcaggcacgcgtcgcataccccctcgtacatactagcgtctgtcgcgcccgattccagggacggcacgagtgggagcggctcggcggtctgcgggtcgcaaaagtagcgcgacgccacggactcgagcagggcaaagcccacgccgtccgagcgcgacgtgtgcgaggggccgttgctgacggagcggtcgagaaggacctcgacaccaaggtcgtcaaccagctcgtggacgcgggcctctatatcgtccatggtcgtgccgggcaggatccggaagttgatcgtggcgctcatgtcctgcggcatcacgttggactgctgggacgagccctcgatcatggtgggggcaacggtggtggtgaccagcggatagagcgcgggcgtcgccgcgaacacgcgcgcgatggcgtccgcgttggcatcgatggcggcacggccgcctgcggtcaggctcgcgagcggctcctgcgtgatgtggggggccagggtctggagcatcgtgcggtccacgtcgatcagctcgaccggccaggcgtcgctggccacgcggtcgatcgccttggcaaggcgtgccagcgacgtgccgccaaaggggttcgacgagtgcccgcccgcgctccgcacggtcagcacgacgtcggcgtagcccttctcggccaggcccacgggcatgcagtggcagccgggcgcgccgtagacggaggcgtccacgacgtcgtagtcgccctcgtccagcaagaactcaaggcgcacgccgcgccgctccaggagccggcccatggcgcgggcgccggactggagggtctcctcgtcctggcccaggcacaccaggagcgtgcggcggaactcccagccgtggcgcagcgcgtactccacggcctcgagcacgcccacgacctggtcggtcatgtcgagcgcgccacggccccagacgtactcgccgtcgacgtagccgccaaacgggtcatgcgtccagtcgccctccgtgccggccacgacgggaaccacgtccatgtggcccatgaacatggccgggcgcagggtctggtcgctgccgtggagcgtgagcatgagcgaatggtcgaccttctcgacctccgccgtctcgaacacgtaggggtaggccctgcggaagaattcctcgagctcgtcgaaggctgcccagtccgtgccgtcgtgcgtggggccgtccaccgtggggatggagagcgcgtggcccagccgctggcacagctcgtcctcgttgaggtccgggtagtcgtcctcgtgcgagaagaaccgccacacgtccgccatgcctatgcctcctgcacctggtcgggcttgtcctccaggtagcgcgagaggaactcgcgcgtgcgaggcttcttggggttggtgaagatctggcgcgggtcgccctcctcggcgatgacgccctggtccatgaagacgaccttgtcggacacgttcttggcgaactccatctcgtgcgtgacgacgaccatggtcatgccgtccttggcgaggtcgcgcatgacggagaggacctcgcccacgatctcggggtcgagggcggacgtgggctcgtcgaacagcatgaggtcgggcttcatgcacagggcgcgcgcgatggcgacgcgctgcttctggccgccggagagcgacgtcacgggcgactttgcgaagtccgctaggcccacctcgtccaggtggcgcatcgcctcggcctcggcgtcggccttgctcgccttcttgagcgtgacgggcgcgagcgtgcagttctggagcacgttgaggttgttgaagaggttgaatccctggaagaccatgccgatcttctcgcgcagcttgttcacgtccacgtgctcggccgcgaggtcctggccgtggaaccacacgtggccggcgtcgggcgtctcgagcaggttgatgcagcgcagcagcgtcgacttgccggagccggacgcgccgatgatggtcacgacctcgccgggcatgacctcgaagtcgatgttgcgcaggacgacgtgcttgccaaagctcttgcgcaggccctcgatcctgatgacgggctcacggccctgggtgctctcgcttgccatggcttacatgcctccccttctgacgcggtcttccgtatggtcgacgtccaccttgatcgtctgatccgcggagccggcgatgcccgtggtcacggcgacctcggaggaggacagggcgggacccatcgcgggtgcgtcgaggtgcttggccagcatggagaggagcttggaggcgaccatcgtgaggatgaggtagcagacggccgcggcgatgtaggtctcgagctggcggtagtagatgccggcgacggtcgtggtggcgaacatgaggtcgaacacgccgatgaccgagaggaccgaggaatccttgatgttgatgacgagctcgttggagagcgccgggatggagttcttgatgccctgcgggaagacgaccttgctcatggcctgccactgcgagaggccgagcgagcgcgccgcctcggtctggccggggtcgacggcctcgatgccgccgcgcaggacctccatcatgtacgcggtggagttgagcgagatcgtgacgaggccagcgacgaacgtggaccacacggcgcggatgtcgttggtgctcatgccagagccggagagcacggcgaagcccgcgaagtagatgatgagcgactggaccatcatcggcgtgccgcgcaccacggcggagtacaccttggcgaagccgcagccgatgaccttgaggaagcgtacgaagtcgttgtccgggcggtcgatctgctgcaggcgcaggaacacgaggagcagcgccaggaagaacgcgatgacggtgccgaagacggcgagctcgatcgtggtggcgatgcccctcgcgaagatgccgcggcccttgtagaccatgtacaccatgccgcccacgaagtcctgcgggttggcgttggagcccacggcggacttgacgatggcgacgaagcccatgatcgcgcggtccacgaagagcacggccgagaagagccagaccacgtaggagcagatccgctccacatgcttggccgccggctttgcgaacggggacttctgctggtagtcacgccagtgcacgagcttggtcacgagcgcgaccagcgagacgacgacccacgccatgagcgcgtagtacatgacgacctcgagagcgtaggcgttggcgaggaagctctggctcgagcgcggttgcatggagaaccacatgccgatgagcgccacgacgctcgtgccgagcagcacgtagcggtggtcgctcgcgaagaagcggacgaggccgcccttctcctcttccatcgaaggctcctgggcctcctgagttgtgcccatgggcacgacctccttaaaagcaatgcgtgtccccgtcgtctgcgcgaccacgggggcacgtccttacgaagctatcttgcgtgacgcacgcctggctacgacggctggcgctcgacgcaggcgtcgaacatcttggtgcgggtgtcctggtcgacggccttgatcgccttgttgatcttggcgaggatggccttctggcccttcttgaggccgacgttggccgggacggtctccttgaagcccttgcccttctcgaactggatggcgacgaggtcagggttggccttgaggaagccgttggtgttctcggtgttgtacgtgatggcgtcgcacgtgccctggttgagctgcgagagctggttggggacggagtcgaccggggtgaggtggttgacgttggggatctcgtcgatgacggtgtcgagcagcgtgtccttctggccgaggaccgcggcgcccgagaagtccttgagcgaggtcgcgttggcgtacttggagcccttcttgacgaggaggccgaagccgcccacgaagtacggggtggagaagtcgacggactgcttgcgcttggccgtcgcggacatgccggcgatgatgacgtcgatctggccgttgttgagggcgtcgatgaggccggagaagctcatcttgacggcgacgggctccatgtcgagcgccttggcgacgatcttggcgaactgcacgtcatagccgtcggcataggcgccgtcgacgttctcgatggggatggtgtactcggtcttggtggtcgtctgccagttgtagggggcgtaagcggcctccatgccgacgcgcatcttcttgccgtcgccgaggacggtcttcttggaggacttggacgagctggaggagctgctgtccgaggtgccctgggccgcgggtccacaggccgtgaggaacatgagcccacctgcggtgaaggccgtgatgccggagagcttcaggaagccgcggcgggacatgtccttctcgcccagtcctcccgccttgcccgtctggccggtaatgcgtccattgaccttgctgttctccatcgtttcctcgattccctgtggagtgatgcggttggtttcccctttcgcgcgacgcaaccggaggggacccattcccctcccccttgcaacctaatgcgagaaagttacgcgcacacgtacaccttataacgatttgggcctgaagcagacccaaatgagcggccgtaacgactgcgtaacgactttggttggtaaaaggacacatgtccgcttggcgccgcgggcatgtgtccttcatgatgctttgaaccagtttgttgccgttgctatttggccttgggccacgggccgctgaccacgggcttctcgccctttgcggaccagcagccgagcttggcgttggggttggcgtcgagcgagaggtcgctgaacacgccggccttgtagttcctgagggcggcgaccgcgatcatggcgccgttgtcgccgcagacgaccatgggcgggaccgtgacgcgcacgccgcggcggccgaacttcttgcggtactccgcgcggagctccgggttggccgcgacgccgccgccgacgcagaagtcggacacgcccgtctcgtccacggcggtcatggccttggagacctgcacgtcgatcacggccgcctcgaaggaggccgcgaggtcgggcaggttgatgggccggccggccttgttctcgccctcgatgtaggtgatgacggccgtcttgaggcccgagaggctgaagcggtagtcgtggctgtgcatcatggcgcgggggaagtggatggccttcttgttgcccttggccgcgaggcgcgagatgacggggccgccggggtagccgaggccgagcgcctttgcgaccttgtcgaacgcctcgcccacggcgtcgtcgatcgtggcgccgaggatctggtagtcgccccagtcgcgcacgtggacgagcatggtgttgccgccggagacgaggctcgccacgaagggcggcgtgaggtccggcgtctcgaacaggttcgcgagcaggtgcccctcgaggtggttgacggccgtgagcgggaggcccgtggcggcgcagaggcccttggcgaaggcgacgcccacgacgagcgcgccgacgaggccggggcccgccgtgacgcccacgcaggagaggtccgccggcgtgagggtgtcgcagccgaagtgcctgcccgcctgcgccatggtctcctcgtacacgccgacgacggcctcgacgtgcttgcgcgaggcgatctcgggcacgacgccgccgaagcgcgcgtggaagtcgatggaggtcgcgacgacgttggcgcagatctcgccgtgggagtcgatcacggccatggccgtctcgtcgcaggaggactcgatggagaggaccaggggtcccgcggccgcaagacgctcctgggcctgggcgtcacgcgggcccacggcgatgggccacggcctgatggacgccgacggctccacgtggtcgagcgtgtgctccgcgtcgaccttgagcgggaggtcgaccctcatgacgagggcgtcgtgcccctcgccgtagtaggcgcggcggcgccccacctccttgaagccgagggaggcgtatgcggcccgcgcgggctcgttcttctcgtccacctcgagcgacgccgtggccgcattgaggacgtgcgcgtcgtagcagatgcgcgagacgaggcgcgaggccacgccctggcggcggcggtccgggctgaccgcgacgtcgtccacctcaaagtcgtcgccggccatgtggccgccggcgaagccgatgatcgtgcccagatcgtgcgcgacccaccagctgcggcctggctgctcgagctcctcgtagaagagcttgcgcgtccagggcgtgtgggcggcgccggcgtacgcgacggactcgatcttgctcacggcgtcgaggtcgttgacggacatggggcgcagctgcaggtgacggtcggcaagggcgtcgtccacgcccgtgacctcgacgctcgcgggcgccttgaggcccaggcgcttgcgctcgttttcctccgcgtcggaaaggcgggtgtagatgggtagcacgagcgccgggtcgccggcaccgcgggagctggacgcggcccaggcgcgggcgaggccctccgccgtgggatgccagagcgactcgtccaggatgcgcgtgaggcctgccgccccgaagcggtcgcggtacttcttgaggccgtcgcccgtaagcgtgagctccgccgcgtccgcacgggccgcgagctcctgcaccgcggcgtcggccttcacgacgcgctccgcctcgaacgtgcggtgggcgcccttctcgtccaagttgtagacgccgggatagacctcgccgcgcatggcgtcgtccaccacggccacgaggccgcgcgtgccggcgacccaggcgcgccaggccaccgcgtcgagcgtggacgcgccgtagagcggccgctgcaggccgcaggccaggccctttgccgtggcgatgccgatgcgcacgcccgtgaacgagccggggccgcgccccacgaggaccgcgtccacgtcggacatggcgaggcccgccttgcccaggcagtcgagcgcggtgttgacgagctgctcgttggcgtggcggcggcacaggtggtcacccgcggcgagcacggtcacgcccgcgtcgggcgccgggccgtccacgcgcgccacggcgcacgcgagcatgtcggtggaggtgtccagggcaaggacggtgagcgccccggactggtctgggttgtggtctagcatgcaagtctcttttccgggcgtcgagcgccctgtggatcaggccccgagctcggcgtcgagccggtcgatcagctcttctcccctggcgttgcgcgcgacgagcctgatgcggcgcggcggctcctcgccgggcgccacctcgtcgtccaggcgcgacacgaagacgtccacgcggtcgtccccgatctcgtccgagaactgctcgccccactcgatgaggcagggtccgtcgacgcccatcgcgtcgaacaggcccgtgtcctcgagctggtcggcgtcgtccaggcggtacaggtcaaagtggtagaggggcatcgtggagccctcgtagaccatctcgatggtgaacgtggggctcgtcacgtcgtccgtgacgcccatgcctcgtgcgacgcccttggtgagctgcgtctttcccgcgccgaggtcgcccgtgagcaccaggacgtccgtcgggccgagcacgcggcccagggcctcgcccaggccgatggtctcttccgtcgaggtcgagaagaactcgcccctcgcgcttcttgttgcgatctggcccatggctactcctccttgggaccctcgggcgccgccggcgccgcgggcgtggttccgggctgcgccgccccgtcgcgcgggtgctcgcgcagccacgcgccgaccatggcgaggtcctgctcgagcagcggctgccagtccgagtggtagatgcaggccgccgggtggaacgtgggcgccaccacgaagtggcccgtctggtagagcctgccgcgcaggtgcgtgacgcccttgtccgtgcgcagcacgaactgcgtggcaaagttgcccaggcacaccagcacgtcgggccacacgctcctgatctgctcgcgcaaaaacggcgagcaggcctcgatctcgcccggctgggggttgcggttggagggcgggcggcatttcaccacgttggcgatgtagatctgctgccgcgtgagccccgcgatggagaggagcgagtcgagcttgtgacccgccgctcccacaaagggctcgccctgcaggtcctcgttgcgcccggggccctcgcctatgaacatcacgcgcgcgttggggtcgcccacgccaaacacgatgttcgtgcgcgtgtcacccagcgggcagcggtggcagttgcccaggacgtcctctatctcggcgagcgagacctccctggggcgctggtgctcgtgccccggtatgtgcatgacgggcatgcgggccgccccctagacaaatatcctgtcgaggcgctccgagaagttgcagacgacctcgtagttgatggtgtcgcgacgcgcggccatctcgtccgcggtgatctgctcgtccccgtcacggcctatcagcgtgacgacgtcgcccttctccaccggcttcgtgggctgctcgtaggcgcgtgcgccgcccgtgtccaccgcgaacatgaactggtccatgcagatgcggcccacctggcgggcgcgcgtgccgttcacgatcacgtccatgttgttggagagcgagcgcgcgagcccatcggcgaagccgatgggcacggtcgcgatctggatgctcgacttgggcacgcggtacgtgaggccgtagcccacgccctcgcccacggcggggttggtcacgcgcagcacgcgggcgcgcacgctcatggcgggcgtcagcttgatgcgcggcgccgtgctctccgcgggctgcaggccgtagaggccgatgcccacgcggcacatgtcgttgtggaactccgggtgcaggatggtgcccggcgtgttgtcgcaatggacgagcccgacctcgaggttggcctggcgcagcgcctccacggtgtccatgaagcgcctggcctgctgcttgaagtcccagtcgccgatgacgtccgcggtcgcgaagtgcgtgaacgtgcccgcgcactcgagcccgcggtggaagtcgatcatgtggcggaactccacggcgtccgccgggagcacgccgatcctcgtcatgcccgtgtccacggcaaggtggtacttgcccaccttgcccagcgccacggcgcgctcgccgtaggccagcgcaaactcggagtcgtacaccgcgggcatgatgtcgtactcgagcagcgtgtccaggctctcgagcggcgactcgttcagcatgaggatgggctcggtcacgccgcctcggcgcagctcaacgccctcgtccacggtcgccacggcaaactggtccgcgccggccttcgccatcgtcttggcgcactccacggcgccgtggccgtaggcgtccgccttcacggcgcacatcatcttgacgcccggctcgagcagcgccttgaacgcgcgcgtgttcttgcggatggcgtcgaggtctacctcgacccacgcccacctgttcttgggatactcaatcgccattgctcaaccttccagtctattccgcgttgccagagtcgggaaacgcgatctgctcctccagggcgtcctcggcaaggccgatggcgtcgatgatgtcgcgcgccatcgcgccgcgcgagccaaagcgctccgccgcgatggagcccgcgtagccgtggacctcgcacgcgagcgccgtgagcacggggatgtcctcgttctccacgttggcgcgggcgagaaacgcggcgatcacgcctccgagcacgtccccggacccggccgtcgccagggccgcagggcccggcttgggaagtatcgccacgtccacgccgacgcaggccgtggccgagcccttcgccacgacggtgagctcggagccgccgtcggcccaggcgatcctgcgcgcggcctccatcgcggaggtgagcgacgcgggcggcgtgtcctgcagccccacgagcctgcccagctcgcggcggtgcggcgtcagcaccagaggcgcgctcctgcgcagcagctccgggaactcgtccagcctgttggacgtgagcctcgcgatgcagttgaggccgtcggcgtccaccaccagcggcaccttggactcgagcagcctcgacaccacgcccacggtgcccgagctcacccgcatgccgggccccaccagcgtggccgtgcgcttctcggccagctccgccacgagctggatcgcctcgttcgagaacgtgccatccttgcccgcgggcaggcccagcaccgggatctccatcatgcgcgcctggatgatgggcgcgatgggctcgggcacggcgagcgtcacgtagccggcaccggcgcgcgccgccgccatggccgccatcatgggcgcgcccacaaagcgcgtggagccgcccaccacgagcacggagccgcgcgagaacttgtcgacggcgttcgaggcaggctcgagcacgtcgatgtagtcctccaggtcggcgcgccacgccacggggtcagcctcgacggccaggtgctcggtctgctcggccaggggcgccaccacgatggcgccgcaggcgtcgcgacccttgtcggaaagcaggcccggcttgagcacgagcatggtcacggtcgtgtccgcgatcacgcactcgccggcggaaaggcccgtctgcgcggaaaggccgctcggcacgtcgacggaaagcacgcgcgcgccggacgcgttgatgcagtcgatccagatgtcgaagggcgcgcgggggctgccgtggaagccagtgcccagcatggcgtcgaccacgacgtcggtggacgagaggagctcctccacctgctcgcgcggcggtgccaccaggatcttgacgccggccgcctgcgcgctcttggcgaccacgcgcgcgaggtcgcccgcgatggcgtccgggtccttgggcgagacgacggtcacgggcacgcccttgcccagcagcgcctcggcagcgacccagccgtccccgccgttgttgcccaggccgcagaagaccgcgacgctccccaggtcgcccatgcggacgacctcgctcgcggcggcgtttcccgccctgtgcatgagctcggagatgctgacgcccacctccgtgaggccagactcgacgcgcttcacgtcctcaacgtttagaacaggctgcatgtgcccctcactctccaatagggccttgcgtgggcgcctcgtccgtgcggggacgctcgtcttgcccttctccctcaagcgtatccattatgccgtcctggagccgctcgagctcgtcgattatcgactttgcctccctgaaggaggcctggagctccctcttggggtcgtgctcctcccgcggccgcgggcgcgcggcgtccgtcatggccacggcgttggccacggccacctcgtgcgtgcgggaaagcgagatcacgacctcctcgaccccctgctcgcgcgccgcctgcgccaccttgcccgcaagccccgccacgagctgcccgcgctcgccggactcgacggccacgtcgcccaggcgcacgccggccgcgtccgtcatgcccagcgacttgagcaccgcgccgtgggccgccaggcactgggcgtagcgctcggaggggcgcacgcccgcgtcgcagtacgcgcgctcggcggcggagaagaccttctcgccaaagctgggaatccgttccaaggcgccggccaccctcgatatctcgagcatgccgacgcccacgccgactcgagccacgcctactccaccgtgacggactttgccaggttcctgggcttgtccacgtcgcagccgcgcgcgcgggccacgtagcgggccagcagctgcaggtgcaccacggccaccagcggcaccacccactcctcggggcagggcggaatccacagcacgttctcgcagagcttcgccacgcgctcgtcgccgtcggtcgccacggccaccacggtcgcgccgcgcgcgatggactcctcgatgttgctgaccgtcttgtcgtgcacgtggtcggcgggcacgatggccaccacggggaagccgggctccagaagcgcgatcgggccgtgcttcatctcgcccgcggggtaggcctcggcatgcaggtagctgatctccttcagcttgagcgcaccctcgtaggccgtggtggagttgacgccgcgtcccaggaacagcgcagactttgcgttgcggaagacgcgcgcggcctgcttgtcctgccagcggcgcttgatgacctcctccatgagcgagggcacctgctccaggctcgcaaagtggctgcgcacctcgtccaggcccatgttgccgttggtgtaggcaaggcgcagcgccaaaagcgcggacgccaccatctgggccgtgtaggccttggtcgaggcgacgcacacctcggggcccgcctggatgtacatggtgccgtcggactcgcgtgccgcggaggagcccagcacgttcgtgatcgcaaagaccttgcagcccatggccttcatgcggcgcgccgccgtgagcgtgtccgccgtctcgcccgactgcgtgatgatcacgcagagcgtgtggtccgtgacgagcggctccttgtagttgagctcggaggcgtactcgcagaacaccgggatcttggcccagtcctgcacgagctcgcgcgcgatgaggctcacgtggtaggacgtgccgcacgccaccatatagatgcggtcgatcgccttgaggtcggcctcgctcatggaaagctcgtccagctccacgccatgctcgcccaggcggtccttcagcaggcgcgagatcgccgcgggctgctccgcgatctccttcgccatgaagtcggagtatccgcccagcgtcgccgcggaggcgtcccagtcgatgtcgagcggcttggggtgctcgacggggttgccctcgcggtccacgatgtcgatcgagccgtcctcgtgcagcgtcgcgatgtcgtagtcgtcaagctgcaggcagtgcgaggtggcctttgccagcggcatcacgtcggaggcggcgtacgcgccgtccttggtcgaggcgaccaccagcggcgacgccttcctcgtgacgacgacctcgcccgggcagtcggcgcacaccacgccgagcgcccacgagccctcgagcctgtcacaggcgtagcgcacggccagcgccaggtcgcccttggccggacccctccaggcgtcctccaccaggtgcgccacgacctcggtgtccgtgtcgctcttgaagttgtgaccctcggccatgagctggcgcctcagggtctcgtagttctcgatgatgccgttgtggaccacggcgatcctgccgtcgcagctcgtgtgcgggtgggcgttgcggtccgtcggcgcgccgtgcgtcgcccagcgcgtgtggccgatgccggtgttgcccacgaggttcgccgcgtcgcagcgctccttcagcgcggccacgcgcccggcgaccttcaccagatgcaggctcttgtccggcgacagcacggcgacgccagccgagtcatatccgcggtactccagggtctggagcccgtacagcaaaaagtcgattgcctgtcccttgcccgtgtagccaacgacgccgcacatgtggttgcctccttggtgcgcgccccgcgcgcatggtcggtcacagtcatctgactatggtaccagcacgaggccacgcccttctcgccctcccacaaaagacatgccactacggggaaacatggttacacaggggagaagaacgggcggatgccggttggcacccgcccgcaggcctcacaccttggttgtcgcaacccgtgtcgctacttctcgcgatacggctcgagcgccttgatcacgatgtcgtccgccttcttgcagagctcgtcggtcggcgcctcggccagcaccctgatcagcggctcggtgccggaggcgcgcacgagcacgcggccgttgccctccaggaactcctccgccttcgcgacggcggccttcacgtcctcgctcgccatcacggcgtccttgtcctccacgcgcacgttgatgagcagctgcgggtagagcttgaccggcctcgtgagctcggagagcttctcgcgctccgcgccgaggacctccatcacgcgcaggctcgtcatgatgccgtcgccggtcttctcaaggtcgccaaagatgatgtggccggactgctcgccgccgagcgtgtagccgtgctccatcatgcaggcccacacgttcttgtcgcccacggcggtcgagacgtgcgcgatgcccgcggcgtccagcgccttgaagaagccgaagttgctcatgacggtggggacgacggtgttcttggcgaggcgaccgtgcttggccaggtaggtgccgcacacgtacatgatgaggtcgccgtcgaccacgtggccgcgctcgtcgaccgcgatgcagcggtcggcgtcgccgtcgtaggcaaatcccacgtccaggccgttctgcaccacaaagtcctgcaggcgctcgatgtgcgtggagccgcagtcgacgttgatgttgaagccgctcggcgcgttgttgatcacgtgcgtctcggcgcccatcgcgtcgaacacggggcgcgccacggaggacgcggcgccgttggcgcagtccaggcccaccttcacgccctgcatgctgaatccgcacgaggcgatcaggtgcgcgatgtagcggttgcggccctgcatgtagtccacggtgcagccgatggcgtcgcccgtcgccaggggcacgtcgaacttgccgtcgatgtagtcctcgacctgctcgaggacgtcctcctccatcttgtagccctcggtgttgacgagcttgatgccgttgtcggtgtaggggttgtgcgatgcggtgatcatgatgccgcagtcaaagccgccgtccgcggtctcgtacgcgaggcccggcgtggggatgacgtggagcatgtaggcgtccgcgcccgatgccacgaggcccgccacgagggcgctctcgaacatgtagctcgacctcctggtgtccttgcccaggatgacgcgggccttcttgcccacgcgcgcgccgtagtgccagcccacaaagcgcccgatcttgtacgcgtgctcgacgttcaacccctcgttggcgacgccgcggaagccatccgtcccaaagtacttcatgctcgaccctcctcgctcgcgtccgcgcgccggcgcgacgcgaatccattccctatagacaccttaaccaaaaagggcctgccgaccagagtcgacaggccctccgatagcacttcgtaaagccagtgggccttagcgcttggagaactgcgggcgcttgcgggccttcttgaggccgtacttcttgcgctcgacggcacgggagtcacgggtgaggaagccggccttcttgaggtcggcacggtactcgccggcgtccagcagggcgcgggcgatgcccaggcgcagcgcgccggactggccgttgatgccgccgccatcgcagttggcgaggacgtcaaagcggttcacggtgtccgtcacgcggaacggagcgagtgcgttgtcaacgagctgctgacggccaaagtagttgagggcgtcgcggccattgacggtaaccttgccggtgccgggaacgaggcgaacgcgagcggttgcctccttgcgacggccggtgccggtgtaaacagcggtgttgtcagccatcggttaagcctccagatcgatcttgacggggttctgagcggcgtgcggatgctcggggccagcgtagaccttgagcttcgtgccctgctggcggccaagggagctcttggggagcatgcccttgatggcgtgctcgaccacgcgctcggggtgcttctccatggcctccttgaaggactcggtcttcaggccgccgagccaaccggtgtagcgccagtactccttcttctccgccttcgtgccggtaagctggaccttatcggcgttgatgacgaccacgaagtcaccggtgtcggtgttgggggtgtactggggcttgttcttgccacgaagaatcatggcagccttggtggcaaggcggccaagagtggcgccgtcggcgtcgatgaggacccagttgcgctggacctcgcccttcttggcgtaatgagtcgacttgttcacttgactcctccatgtgcttactaaacaaaacgcgttttcctatgagattacggggctcagtggaaaagccttagaagtatacaacacctacgccctgggggagaaaagctcaatttccccacacaaagcgaccactttggccgggccccgccaccctcgcggcacaaggtcgcggcgccacccgagggcgacgccgcgaccgcgcttgcatccggctctgtcaggccgtccctagcccacgaggagcttgaggtcgtcctcgacgttggtgatgccgccgatgccaaagttgtccacgagcaccttcgtcacgttgggcgagaggaacgcgggcagcgtcggcccaaggtggatgttcttgacgcccagggcgagcagggcgagaaggacgatgactgccttctgctcataccacgcgatgttgaaggccaggggcaggtcgttgatgtcgtcgagcccgaagatctccttgtgcttgagcgcgatgagcgcgagagagtaggagtcgttgcactggccggcgtcaagcacgcgcgggatgccagtgccggggacgttgcccaggccgagcttgttgtacttgtacttggcacagccggccgtgaggatgacgacgctcttgggcagggccttcgcgaagtcggtgtagtagctgcggctcttggcgcggccgtcgcagccggccatcaccacgaacttggtgatcttgccggtcttgacggcgtccacgacctggtcggccagggcgaacacctgctcgtgcgcgaagccgcccacgatggtgccctcctcgatctgggtcgggggctcgcaggtgcgggcgagctcgatcagctgcgagaagtccttctcgcccttctcgttcgcctcgatgtggacgcagccagggtagcccgcctggccggtggtgaacatgcggcccttgtaggagtccttgggcggcacgatgcagttggtggtcatgaggatcgggccgttgaagctttcgaactcgctggtctgcttccaccaggcgttgccgtagttgcccgcgaggttggggtacttcttgagctcggggtagtagttggcggggagcatctcggagtgggtgtagacgtcgacgccggtgccctgggtctgttcgagcagcatctcgaggtcgcgcaggtcgtggccggacacgaggatgcccgggttcttgcggacgccgatgctcacctcgctcacctcggggttgccgtaggcgccggtgttggcggcgtccagcagcgccatgccgtccacgccgtgcttgcccagctcgagcgtgagcgccacgaggtcgttcaccgtgaggctgtcgtccagcgtcttggcgagcgcctcctgcatgaaggcgtccacggactcgtcgtacttgaggagcgcgttcgcgtgcgcggtgtaggcggagaggcccttcacgccgtaggtgatgagctcgcgcaggctgcggatgtcctcgtccttggtggacagcacgccgacggtcgccgccttggcctcccagtcggcctcgggcgcggtccagagcgcggccgcgggcaggtcgtgggcgttgtccagctcgcccaggagattcgccttgacctcgagcgtcttggcgatgcgctcgcggatggccgcctcgtcgaagttggcgttggtgatcgtgcggaacatgttggtcgccacgaggttgttgacctcgcgggagacctcgccaccctgcgcgcgcagcgcggtggtgacggcgctcaggccgcgcgtcacgtacacgagcaggtcctgcagcgccgcgagctccggcgacttgccgcagacgccgcgcacggtgcagcccttgcagcccgcggtctcctggcactggaagcagaacatcttgggatccatgggtacctctcctcttcttgtgcggccccctgccgcatccgtttcaagagtgaggttacgttgcgcgcccgcgcgagtctgttgctcgtgcaacaatcacgatttggcgagaaacgcgcgaatctcgtccagccgctcctccgcctgctggcggccgcgcacgtagagcgcgagcagggacgcgccgtccgagccggtcacgtccacggtcacgggctccttgggggcgatcacgagcacgcgggggtcctcctcgcgctccatcgcgaagagcaggtcgcgctgggcgttgtagcgcaggtagcgggtctcgagcgcgtgcgtgaagtaggggtaggagtcgtagcggtggctgcgcagcaccaggccctcgttacccagctccttcacgtagtcgcggtcgcgcgtgagcaccaccaggccgcggcgcgctggcacgtagccgtctatctggcggccaccctcgagccccagcgccgtctggaacgggatggagtccgtcgtgccgccgtcgaggtagcggttgccgtcgacctcgaccatctgcgagacgccgggcatggaggccgacgcctggaccttggccacatcctcgggaaagctcttgcactccaggtagtccgccgtgccaaagatcacgttggaggccacgctgaacatgcggatggggttcgcgttgaacgtcctgacgtcgcaggggtcgagcacgttctggacctcgtcgtacacgaactcgccgttggcgatgttgcccgtggtgaggagcgaccagaacgacatgaagcggcggtcgtctctgaaggcgagcatgatgcggcacgtccggccgatctggcggctcttgaagctcgaggcgctcatgctgccggcggatacgccccagacgctgccaaagtcgtagatgccgtgctccatcagcacgtcgagcacgccagcggtgaacatgcacctgaagccgccgccctcgagcacgagcgcggtgccggagtggcctgcctgcacggcggactcccctgtcttggcgttgtcttcggccatgtctcccccttcgctcggcgcgcgacggcgcggcgtacaaacaagcggcgcccgtgcaagggcacggacgccgcggcaaactcatggtggaggcgcggagaatcgaactccggtccaaagcaatcccctggcaggtgtcttcaagctcagtcgtcagttaggtctcgggcgcatcgcacctggcgacacgcgctcagcgccccagctggttcggtcttacttccgggcataccagccacgtcccgaaaggcatctccctaaatgacgtcgcacccggagcgggagaatatccgggattgacggctgctagttaaaagttaagcagcgagggcatagccctgataagaatcgttgtcaattaaatttgacggtacccctgttttacgtggcgaggagaccacggcttgctgcccacctcagaactaccctgtcgaaaccagtcgcccccacatcgtgcctggggccgattgccaccatgcatctgtcaaagtcccatactgccttggaccctaacagtctacccaaaagtcgccgccggattgcaacgcttttctcgcccaggcgcctttgcccttgggcgagaaggacggagcccccgcagggaccccgtccggacgtgccatccttgcgatgcggcggccgaggctactcgtcgacgcgctcgaactggtcgggacccacgccgcacacggggcacacgaagtcctcgggcagctcgggggtgtcaacctcgacctcgtagccgcagacggtgcagacaaacttgtaggtcttcttctcgtcggccatggtgcttcctctctctatgtggtcgtccgcgtttgcggaaccgtccccggatttgatcgcgcctgcgtccacatacgaggacgcgcgctggggcgtcttgcccttgagcacagcatgatagtacgaatacgtgagcggctcggcgtcgcccaggaccttcgcgtcgagcacctcgcccacgaagaccatgtgcgtgcccacgtcgagcgtggacaccaccctgcaggcgagcatcgcgcagacgtgatcggtgggatagcggtcgcccagcgtggtcgtggcggagccgatgccggcaaacttgtcgaagtccgccgaggacctgaagccaaagcggcccacgaactccatatcgcacgtcaggtcgagcgggcagagcgcgaagtggccggcggaaagaatcttgcgctcggtcgcgttctgcttgttgaccacgacctcgacctggagcggcgagctcgtgagctgcagccccgtgttgatgacgcagccagccgagccgtccgcatcggttgccgagaccacatacagaccagaggaaaacttgtacagcgcctttgcgtccatccgtcctccttgcacgaaccttgcacgatccctgtgcgagccccacgccgagccgacgcgccggcccacgaccacattgtagaccgcggccgggcccctccgggcgagaagtgccccgctcagacccggctgcgctgcttgagcgcgcggcgaatctcgcggtcggagtcgcgcgcggccatgtcggcgcgcttgtcgtagagcttcttgccgtgggcgagcgcgatcgtgagcttgacgcggttgtgctcgtcaaagtacatctgcagcggcacgatcgcggcacccttggtgcggagcttctgctccaggtagtcgatctggcggcggtgcagcaggagcttgcgccggcggtccgggtcggggttccacacgccgccgttcacgtacgggtggatgtgcatgccgttgagccacacctcgccgccgcggatgagcacgaaggtgtcggttatctgcgcggcacggtcgcgcaggctcttgacctcggcgccggtgagctcgatgcccgcctcgaacgtctcgtcgataaagtagttgtggtgcgccacgcggttgcgcgatatcaccttgatgttgggcttgcccttggccttagcgcccgccatcggcaccatcgcccttctcgccctgggcggagccctccgcggactcgcgctcgaggtccgcgtcgctctggcggatcaggcgcagcagcgccatggacgcgtcctcgcccaccaggtcgcgggcgcgcacggtcaggttggtggccacgtcctgctggccggcctgcgccgcgtccgtcgcgcacatgaggaggcagatcgcgatctccgcgttggcgccgtcgggcaggccctcctgcgccaggaggtccgtcgtctcctcgtccgtcacggagtcggggtcgtggtccgtgccctcggcctcgcccagcgcctggtcgagcgccttgtcgcgcacgtccagacggcgcgccgcacgcagcgccgccgcggccgtgcggggcttctcctgcacgaggaagtactccgcaaagttggagaacgcgcgcgccaggtgccgggcgtcgctcgcgcgctcgaacacggagtacgtgagggccaggtactcgttcacgtcgcccgcgatgcggaagaggtccgccaggttgaggcggtactcgcagcccatggggttccagcgcacggcctgcttgagcgccgcagtcgcaacgtcgtagtcgttctcgtgcaccgcggcgagcgcgaggtcgttgtagagacggtccatgggctcgcccacgtcgcgcagctcgcgcgggtccttctccacgcggcggtacgccagccgctcgaacatcgtggggaagctgaaccactgcacctcgtccgtcgtgggacagttgcggtccacgtactcctccgcgtcctccgcgatcctcctgagctccgcgagcgcctgctcgctctggccctctatcagcagggactcggcgtgcgccagcccctcggtcattcccgtgtagtccatcaagcctccaacggccgcagcacgcgcgcatccgcgcccggtccgccggccaatccttatgtccctaggctacccatgggacgtcactttgatgcatcgcgcccccgcgccagcgcaaagtcgatctgcccgcgctcgggccgggcgtccgtcacggtcacggccacgcgctggcccggccgccacgtgcgcccggactcgccgccggtgaggcacatgcgcttctcgtcgaagtcgaaccactcgtcccccagcgcgcgcacggggacgaggccctccgcgcaggtgtcgtccagcatcacgaagagcccgtaacgctccacgcccacgactatgcccgagaaggactcgcccacgtgccccttgtagagctcggccatcttgaccctctgggtgtcgcgctccgcgccgtcggccaggcgctcgcgctccgagcacgtgcggcagagctgcggcagcacgtgcagcacctgcatctgctcgcagctcgtgcggcggccctccagcagcgcccggagcgaccggtgcacgatgtcatccgggtagcggcggatgggcgacgtgaagtggcagtacgccggcgcgcccagcgcgtagtggccctcgttcctgggcaggtagacggcccggcgctgcgcccgcagcagcacggagtttgccaggaactcgcccgaggtgccccgggcggcgcgcagcacgtcctggatggcgtgggggtcgccctccgccacgcgcgccgcgaggggtgcatccaccagctggagttcgcgcaggacggggagcgtcgtacgcaggtcctccgccgcgggcggctcgtgcacgcggtacgccgcgggggcctccgcgtccgagaggaacttcgccacgctctcgttcgcgatcagcatggcctcctccaccagactcgtggcccgcgtcttgcggcggaccctcacgcccgtgggcacgcccttctcgtccagcgtcaccttggcctcggcggtgtcgaagtcgatggcgccgcgctcctcgcggcgggcgcgcctgagtgccgcgacctcgtccagcacgcggatgggctctgccacgcgcgggcggtccgcggcgtcgcagcagggcagatcgtctggggtcgccgtgccctcgagcaggcggtccacggtgtcatagtccagacgcgcgaccgagcggatggccgtgggcgcggggtcggcgctcacgacgttgccgcggcgatcgagccgcatgaagacgctcatgcacaggcggtcgacgccgggcttgagcgagcacacgtcgttgcagaggcgctccgggagcatgggcagcacgcggtcgaccaggtagacggagcaggtgcggcggcgcgcctcgcggtcgatgggcgtgtcccagcccacgaagtgggtgacgtccgcgatgtgcacctcgacctcgtagccgtcgtccagcctccgcgctcccacggcgtcgtcaaagtcgcgcgcgtccgtcgggtcgatggtaaagacgcagtggtcgcgcacgtcgcggcgcagcggctcttgggcaagcgcctcggccacgtcctcgcgcatgcgctccgcctggtcgagggcctcctgcggaaactccgtcgcaaggtcgtacgacgcgatgacggactcgacgttcatgtccacatcgtcggacgagccgatgcgggcgtcgatggtcacgatgcccgcggagtagcgcgtggggtattccacgacgcgggcgcgcacgaggtcgccctcgcccacgccgaggcgctccgggctcttgtcctccggcaccacgaagaagtcccgcttcacgcgcgcgtccagcggaacgacggcgcccaggggctcgaggcggcggtacacgccggcaaaggtggtcgtgtggcgcacgagcacggactgcacgcgtgccagcctcctgccgtcgcgggcggaggacaggctcgcctggacctcgtccccgctcatggcctcgcggatgccgccgcgcgcgacgtcgaacgttccctctgaggtgtagagctcggccacgcccggcttgagcacgcgcaggatgcccgtcacgagctggtgcggcttcctctgcctggactggccccgccgtcccctctggtggcgcgcccgctttcttcccatggtgtccccctcaacagaaggaggcggcgtgacccgtggccgcgccgcctcgccagatggcagtgtgtcgaagcttgcttagaccttgaggtagcgcctcatggcaatcatagacccaaacatgcccaggagcatgccgatcacaatcaggccagcatacgtagtcacgagcacgttggtcggcaggttgaacgagaggaacttgaggctcgtctgcagcttgggcatcacgacggaaagccccgcatgcagcgcgatgaccgcaagcaccgagccgatgagcgcctcgagcaggccctccatcatgaacggcccgcggatgaacccgttggacgcgccaaccaggcgcatgatggcgatctcgcggcggcgcgccgagatggcgagcctgatcgtgttgttgatgaacacgaacgcgatgaaggccaggagggcaacgagcacgatggccgcaattctcagatagtacgtgaccgagaagagccgctccacggtctcgcggccgtactggaccgacgcgctaggcttgctggagttatcggcaaccttcgcgaagtcagggtccttgatgaggcgcgccgcgaccttctccacgttctgcgggttcttgagcttgatgacgagcgacgcggggatggggttcgtcccgtcgagcgccgccacggcgtcggccgcgttgcggttgctcatggtcttcttgtactgctcgagcgcctgctccttgctcttgtaggtgacggactcgacgtacttccagccgtcgaccttcttctggagcgcggtgatggccgtcttgtcagcgttgtccgagaggaacgcctggatcgtgacgcgatcctccacgttgcccacgaggttgccgaccatgacggagccgagcacgaacatgccgatcacgaagagcgacaggaagatggtgacgatggcgcccagcaccgtcgaccagttgcgtcggaagtggcggaacgcctcgtggagcgaatacccgatgttagatggcaccatagaagccgtagcctcccctctcctggtcgcgaacgacgtggcccgcctcgagcgcgatgacgcgacggcgcatggagtccaccatctcgcggtcgtgcgtcgccatgacgacggtcgttcccgtgcggttgattcggtcgagcagcctcatgatgccgagcgagatcgcggggtcgaggttgccggtgggctcgtcgcacaccaggagcggcgggcggttgaccatggccctggcgacggacacgcgctgctgctcgccaccggagagctggtcggggtagttgtccatcttctcggcaaggcccacgaggcggagcgtctcgggaacctgcaccttgatgacggcacgcggcttgccgatgcactcgagcgcgaacgcgacgttctcgtagaccgtcttgtccggcaggagcttgaagtcctggtagaccgtgccgatctggcggcgcaggtacgggaccttcctgtcgcgaagcttcgtcaggtcctggcccgcgacgatcaccttgccgctcgtggcgcgtagctcgcgcgtgatgagcttgaggagggtcgacttgccggagcccgagtgccccacgacgaagacgaactcgccggggtagatgtcgaggctcacctggtcgagcgcgggcttgttgggttgggccgggtagatgagtgttgcgtttcggagcgagatggtcggccttcccgtgtgcgggacgaccctgttcccatcatcctgcaggggtgcgaagacgctcttggtctcgggctgcgccgtcacgtcgccggcgtccttcgagaccacgatgccctcctgcccagtcgcctgggcatccgatgcgtccggtgccgccgatgccgtgacggtcgtcacgggctgcggctcgtcggagccgtcacccgcctcggacgccgctcgaggcgccgcgtgcgatgccatatggctcgcctcggcggccgtctcctcgcgtacgatctcgtccacgcgagacgcggggtccatcgacccggtgtcctgcgtctggtcgggcgtcgcgggtgcctggctcaaaggctcgggcttctcgttcccctgccgctcgctgctgcgaaagtggttggccacaagagctcctttttctacaaagcgatactgacagaatctgtataagtctacacaacgcggcgcgatccccgcccgcgctcacggacgtcgcacatttaaatcagaggggtgaaggctcccttgcgcccgcattaccccgggcgagaagaacgcctacgaacctatgcgcgcgaacccctcgccaaacgcctcgtgcacctctcccaggatcacgatggcatccgggtccgtctcccccacgatctgcttcaggcgcgccgtctccgtgcgaccgcagacgcacatgagtaccggccggtcgttgccgctccagacgcccctcgcctgcagctcggtgcagccacggccaaggtcgtacatgatcttgttcgcgatggcctcgtgctcgtcggatattacgtacgcgaccctcgccgtgcgtgggccgtccaccaccgcgtcgatcacgcgcccgccaatgtacatcgcgacgcccgcaaacagcgcgtttctcagcgagaacaccggaatcgacgcgaggacgatcacgccgtccacaatcatgctcagcgtccccagcggcatgccgtttcgcttcgcgatcagctggcacacgatgtccgtgccgccggtgttgccgccagaaagaaacacgacgcccacgcctgcgcccacaaacacggcgccccagatggccgaaatcaggagctccccgtgggtcgggacgggcaggacgggctgcagcgcgtccatcatgaaacccgaaaccagaatgcccgcgatgctcctcgacacgtagctccagtccctcgtcgtcaagaccacgtaggcgagaaggaccacgttcatgacgatggtctgcatgccgacagggaggatgacgcctgcctgccgggcgaccgcgtgaatgatcgtcgccaggcccgtcagaccgccggccgcgatgccgttcggcagctcgaagcagtcgatgccaatcgcatagagcacggagccgcccacgatgagaagggcgtccctcacgagacgccgccagtcactcacaagcctcatttgccctccttgctcgtccgccatctgtggtagccgatgatgaactggtcaaggtcgccgtcccgcagtaccgcgtcgacgttgcccgtctccacccccgtgcgcaggtccttcaccatcttgtagggatagagcacgtagctcctgatctggttgccaaagccgatctcgcgcttgggcccgcgcagctcgtccatctcggactcgcgttcctccagcgccctctcgtacagccggctcctgaggatccccatggcgatggccctgttctggatctggctcctctcgttctggcacgtcacaacgatgcccgtcgggatgtgcgtgatgcgcacggcggagtcggtcgtgttgacgccctgcccgccatggccggtcgcgtggtacacgtcgaccctgatgtcgttcgggtcgatgtcaacgctcacgtcctcgggaagcacgggaagcacctcgacgcccgcgaacgtcgtctggcggcgcttcttgtcgtccgtgggcgagattctcaccagacggtgcacgccctgctcggcgcggagcatgccgtacgcgttcctgcccgagacggtgaacgtcgccctgtcgatccctatgacgtcggccacgggggcgtcgttcacgtccaccttccacccgcggcggtcgcagtagcgcaggtacatgtggaacagcatgtcgcaccagtcctgcgcctcgagcccgccctgtccgggcgtcacggtcacgatggcgtcgccgtggtcgaactcccccgtgaaccagctcgagagctcgagctccccgaggtccttctccagcttgtcgtaggacgacttcgcctcggcgagaagttcctcgtccgaggtctcgagccccagctcgagcgcggcgcttacgtcgtcgagctccgcgcgagccgagtcgattgcggacacgtcctccttcgtgcgggtgagctccgccatcgccttcgtcgcgccgtcggcgtcatcccagaagccggggcgcgtgctctccagctcgagctcggccaccctgccgcgcttctcgtctatgtgaaggtagctctcgaccttgtccaggcgttccgagagcttcctcacgtcctcgttcgaaatgtcgaccatgttccaacgttccgctagcggttcctaccgtgacagttcttgaacttcttcccgctgccgcaggggcaggggtcgttcctgcccacgcccacgtagggatcggggtcgtcggccttcctgtacgtcgtgggcttcgccggcgccgcgtgcttcggggccatgtgcgcgggtcccgcctggccggactggccgcccgacgcgagcgcgccgcgcgccccgccgtggtcgccgtccacgtccgccggaccggagtagctcgccccgcgcaggtcgtcgggatcgtccgtctccgtgagcggagccacgatctccaggcgcaggatggtcctgaggaagtcctcgtacatggtgttgacgagttcggtaaacgccgcgtacgcctcggtcttgtactccacgagcgggtcgcgctggccaaagccacgcaggccgatacccgtcttcaggtagtccatctcctgcaggtaggccatccacctggtgtcgatcacgcgcagcatgacctgggcggagagctgctgcatgatctcgtcggaaagccgcttggacttctcgtggtagcagcctatgacgtagtcgttcacctgttccgtcaggtcctcgatgtcgatgtcctcgtcaaactcgggcaggtcgtcgcggcccgtcagctcctcgacccacttgcggaggcccttcaggtcccaatcctcggaacccttgtcctcgccgcagaactcccgtaccttccgctcgacggtgtcgtgcgtgacctcctcgatgtgcgccacgaggtccttgccgtccaggatcttgttgcgctcctcgtagattacctggcgctgcttgttcatgacgtcgtcgtagtcgaggacgttcttgcgcatcgcgaagttgatctcctcgaccttgcgctgcgcaccctccacggccttggtgacaatcttggcctgtatgggcatgtcgtccggcatgtcgtacttcgacatcagcgccgagatcttgtccatgcggtccccgccgaagagcctcatcaggtcgtcctcgagcgagaggtagaactgcgtctcgcccgggtcgccctgacggcccgcacgaccgcgcagctggttgtcgatacgacggctctcgtgcctctcggtgccgatgacgcacaggccgccggccgccagcacgtgctccttctccctctcgcaggtctccctggccttctcgaggtaacgctcgcgcactgcggggtcgacgccctcgtccacgtcgatgccgtccgccttcatgcgctcgacggcaagcacgtccgggttgccgcccagcaggatgtcggtaccacggccggccatgttggtggcgatggtgacggcgccctcgcggcctgcctgcgccacgatctgcgcctcgcgctcgtggaacttcgcgttcaggacctcgtgcttgatgccgcgcttgtcgaggatcctcgagagtcgctcggagctctcgatggacaccgtgcccaccagaaccggctgccccgtggcgtggcgcttctccacgtcgtccgcgaccgcgttgaacttcgcgtcgatcgtcctgtacaccaggtcgtcgtggtccacgcggatgactggcttgttgggcgggatgacctgcacgggcaggttgtagatctccctgaactcggcgtcctcggtcatggcggtacccgtcatgcccgagagcttgtcgtacagcctgaagtagttctgcagcgtgatcgtggcgagcgtctggttctcctcgcgaacgtagacgttctccttcgcctcgatcgcctggtgcaggccctcggagtagcgcctgccctccatgatgcggccggtgaactcgtcgacgatcttgacctcgccgtccaccacgacgtactgctggtccctgtggaacatgtactgggccttcagcgcctgctgcaggtggttgacgagctggccagacatgtcggagtagatgttgtcgatgccgagcctcgcctcgatcttgcgaaggccctcgtcggtcgcggcgatggtgtgcttcgcctcgtccatctcgaagtcaacgtctggcgtcaggccgcggaccgcgcgcgcgaagtccttgtacgtgctcgcggacttcgtgcccgcacccgagatgatgagcggcgtcctcgcctcgtcgatcaggatcgagtcgacctcgtccacgatggcaaagtggtgacccctctgcacgcgcatgtcggcgcgaccgaccatgttgtccctcaggtagtcgaagccaaattcggagttcgtgccatacgtcacgtccgcgttgtatgccggcttcttgaggctgagcttcatcccgttctgcaggatgccgacgctcatgcccaggaacttgtacacctggcccatccactcgctgtcgcgcttcgcgaggtagtcgttcacggtgacgatgtgcacgcccttgccgggaatcgcgttcaggtagccggcgagcgtggacacgagcgtcttgccctcgccggtcttcatctcggcaatcatgccacgatgcagcgcgatgccgccgatcacctgcacgtcgaagtgccgcatgcccagcgacctgaccgaagcctccctgacggtggcaaacgcctcggggagaaggtcgtccaacgactccccgttgtcgtacctctcgcgaaactttgccgtctgcccgcgcagctcctcgtcgctcagagccttcatctgcggctcgaagtcatttacctgctcggcaatggcctcgaactccttcaattgcttatccgcaccgcgcgacaggagccgcgcaaaaaagttcgccatactcttcccccgcatagtcaatggcacaacggccacgagcgtcattcaacatttcactctatcaatagagcgccactcggacgccctcgacgcccgcaaccatcaaaatggcactacgaggtggggtcattactaagattgtcaatctctttggtcgtgaggtcgctcccactgcgctccagcgcctcgtcaacgccccgacataccgtctttgatggcgtaatgtgaagctcgcggagaagaacgtccctatagcgccggtatgctgccgcaatttccgcagtcctgccgagcatgccaagcgcggtgacgtgcgagattacggcatcctcacgcatacagtcatcctcgagtgcttccctggagaattgagacgaaaggtaggccttcccttcccgcagtgccgccagcgcacccgccgccatcgcatccgcgtgcagctgaaccagcgcctccatgcgcgcggtactgttccccgacgggtcgtcgaaggcctccgcgatgccgcccgagtagacggccctcgccttgcccgccagcgccatgacgctcttatccagcccatcgctcgccaacgcggcgatggcgcaccgctcgaagtcgtctacgtccacggagaccttggacatgtcgagcgaaatccttcccgtgccgcgccccgtgaggatgaacgattcgtcctcgtcacttatgcggagcgccttccttgccatgcagaccgactcataaagcttctggttgcccgtgtcgtagtcgtaatctccccagatcatctctatcgcatccctcttcgagagcgagtggccccttgtgagcgccagcgcaaacacaaggctccgtccgcggcgagcaccgagcgccttgattggcagctcccttccgttgatcatcacggagaacgtcccaaggatccttatcctcaccggcttctcctttggctcttcctcgttagggatggtgtcgcccatcgtcagttccccctcgtccacctgagtgtctccaacggtctcaagcaatgcggtcgtgaagttcttccagttgaccggcataagctgtctaaagttctgcgaaaccagcccgcagtcgttcatgaggacgttcagcgcccagaggacctctcgagagcagcttgccctcgagagcgtgtcaaggcgaatcggatagtccgtctccgacctcgacgcctgtccgagcatccttctcaggtccatgagcgcgctaacctctggcgtcacctttgctggagcaacaccgaaggagtccccgatctccgaccccgttgcggcttccaccgcatccgccaacaagcacgccgcggcctcgaggtagcctgcagatgcacttctcgcaatctccaccgcccgctttgcgcgtacgctggcacgcgcgtatgccttgagccttagatcggcgacagcggctgcgcagagaaagaaggcttccggaatcttgtcgccagtggcgcgaagccgcgtgactatctgctccacatcgggaaatacagtcacccttccaacaagaatgcgcagcgcagacatagttcccgtatgcagcgccgcaagtctccccgacccagactcgactaagattcgatttgcgtcggaggaggcggggtcttgccgcgcagtcggcgcctccccaagcaacgcttcgcaaatcctgaagtcatctacaagaaaggagctggggatgctgttgggggactttcgtctaggattgtccaggagggaatcgaagccctcgagaaactttccgtcgatgattttcctcatcacgtcaatgtgatctatcatcgtgcagatttgctcgtcatcgagatttgggtccctctcgacctcgaatatgggcgacctcgcaaatgcgtccctgcacacgccaagcattgccgcgtgccggagcatagacttctccgactgcctcaatcgtgatagagaggcacaggactcgcgaaggtgcagggcctcgtcccgccgcgccgagacctccgcaacggcgagggcgttaatcaagctcactgggccaagtgcgtcggcacgatctccaagaaggcgcgtcgaccttgccacaagctcaacattcccagagcaaacaaggttggccccactcttgacagccttctcggccgcctccggtgaatcgccgatcagctcgagcaccattcccatgcggcgatattgcccccgcttccggagtacgtccgacacgcccaaagcggcgtcctcatgtccgcgtacgacgcccccaagcacggcaaagcattcgcgcaggatacagtcatcgcccaacgctgccactctgaatgttgagtcgatgttcgagacgccaaagaagggcgcctccctctcgagaaggttgaaggcttctccatccgcatgccgacagatacgaactacgtcatcaaaagttcccttgccgagaagaaccatggcaagcctaagatcaacgtcctcgtccgcaagtgagtccctcagcgacgcagctaccatttcctttaccgcattcgtaaaggtggcgcccctggaaaccttactccctaagacggcgacatcctccctgagagacacgaggagttttgggagcaaatttgtcagcgcgtgcgactcaccatctgatgaacgtgcgataagccttgacgaatcgataatggaagctccatccaccgcctcaaccaggccctcgcattccggcctggcagaaatcagaagcctgcagccagcgctcaccatcttccccatcgcctttgctacgcgaccatacgccctctcgtcagcagcaggcatatcatcgatgcagaccgtcattcgcggcgagccgtcgcaagccctcatcatctcacgggaaaagcgaccaaaacgagtagcgagatcggactctttgcaacctatcagcgaggcatgttgtactctcgcgccaatgctcttctcgtacgtcatggcgcactcgatgaagtaagtcttaccaacccctgcgtctccagttacgaaaacaatttgcgactggccctttagagtgttccaaattccaaccgcctcgcccctggtcatcagaacgctagattctagctcggcatcacgacgatatgcgtccacgtagcagtcgtccacttccttctcctcttctcggctaatacgaacctgaaaagtacctatacatataaatgcacctatttagcttctttgtcactactaaatagtgaattattcttctgagccgttacttttttcaaagctagccgaaagattcgagagtattgcctcattaacataaagaca

SEQ ID NO: 181 - DNA, 16477 bp, Unknown
  Metagenome-assembled genome
ccccttccgtatgtgcggtagcggtgccaccgcccgagccgatgcgtctgactcacattgtggcagcatccaagcccgcgtgacgatacgagcgagggggctccaatgcttggctcatatcgtctcccttaccatctctctcacctccctcagtatgttgaggaaagattgagcgatgctcacgacaagcgcgagggcttgtaggaattcaaggacaaagtgcatgtccatagccacgcgttcgtggcatgatgtagcaaacaaggatcgttgtgcggacccaggaccgatggttttgggcccgcttgtgctgtgaagaggtttccatgctcataaaccgcgtcgccctgaagctgcttgccgcgccggaccttgcgcccgtgctgcaccagctggactccggccacgatgccacgctcggcgttgcgcagagcgcccgtccgctgcttgcggcatcgctgtgggcgcgcgacccccggccgtgcctgatggtcgtgtcgggggaggaggccgcggaccgcacggcccgcgcgctggccgcgtggctgggtcgcgacgtggtgagccgctacccagaccgcaaggacctgccgtggtcggaccgtcccgcggacgacgccgtggtgggtacccgctgccgcgccgtggcgcgccttgccgcgggcgagaagtgcctggtggttgccagtgcgcgggcactgctgcgccgcgtgccgcccaagggctctggctactttgcttccagcacgtttgccgtgggcgaccagcttgactttgaggacgtgccgcggctgcttgtggacatgggctactccgacgcgggcgacccctctgaggtgacggccgccggcacgttctgcgtgcacggcgacgcggtggacgtgttccccgcgcaggcgacctcgcccgtgcgcctggagttctttggggacgaggttgaccgcgtgcgccgcatggtgcccgcgaccggtcagaccatcggcgagctgcagagcgtgaccgtgagtccctgccgcgaggtggcccttacggaccagaccgtggcccgcgcgcgcaaggcgctgtacaaccgagcccagagcgactcaaaggtggccgcggatctggagctgattgaggcccgcgccgcagagcccacgctcgacaagtacctgcccgagctctatggcggcagcgccacgcccatcgagcacatgtccaagcacgcgctcgtgatcctggcggagccgcgcgccctgtttgacgactgcatgcacgccgcggacgacgtggaccaggcggcccgcaacgcccgcgtggacgcgagcggcctgtttaccaacccgcgccagatggactttggcaagcagcagcgtttgtccttctcgtccatggcacgcgtgggcggacaggcggacgcggagctcgacgtgcgccagccctccattgcgggaagcgacgccaagctgctgggccgcatgcgccagctggtgcacgaccgccagagcatcgtgtttgcggtgccggaccgcggcgcccgcgaggcgctggagctcacgtttacggacgagaagatccccatcgcggagtcgctggcgactgctgggcccaaccgcgtgccggtgtgcgaccccgcggccatgcggaacgtggagccgctgccgcgcggcatcgtcacgtttgtggacgcgcccattcccgcgggcgtggtggtgccctccgccgggctcgcgctgtttagcgtgggcgacctcacggctcgcatggcccgccacaagcaccgcgtgcgcaaggtggaccccacgagcgtgaccttccccttcaagccgggggactacgtggttcacgccacgcacggcatcgcgctgttcagccagatcgtgcggcaggaggtcgcggggcgcgagcgcgactactttttactggagtacgccggcggggacaagctgttcgtgccgctggagcaggtggaccgcatcacgcgctacgtgggcccggacgggtcgagcccgcggctgacgcggctcaacacggcggactggtcgcgcgccacgggcaaggcgcggcgctccgccaagaagctcgcgtttgacctggtggacctctatacccgccgctccaccgtgcagggctacgcctttagcccggacacgccggcgcaggcggacatggaggcgagcttcccgtacgagctcacgccagaccagaaatctgccatagaggacatcaaggcggacatggaatcccccaaaccgatggaccgcctgctctgcggcgacgtgggctttggcaagacggaggtggccctgcgcgccgccttcaagtgctgtcaggacggcaagcaggtcatggtgctgtgcccgaccacgatccttgcgcagcagcactacgagacgttcttcaagaggttcacgcccttctcgctcgacgtgcgcgtgctgagccgctttgtgacgcctgcgcagcagcgcgaggcgctcaagggctttgccgagggcgatgtggacgtgctcataggcacgcaccgcctgctgagcgcggacgttaacccgcacgacctgggcctggtggtgattgacgaggagcagcgctttggcgttcagcacaaggagcagctcaagaacatgcgcgagcaggtggacgtgctgacgctttccgccacgcccatcccgcgcaccatgcagatggccatgagcggcgtgcgcgacatgagcctgatcatgacgccgccgccgggtcgccttcccgtaaaggtaaaggtgggcgagtgggacccggacgtggtttccgccgcaatccgcgcggagctggcgcgcggcggccaggtgtactacgtgagcaaccgcgtgaccaccatagacgacgccgtggagcgcgtgcacgaggccgcgcccgaggcccgcgtgggcgtggcgcacggcaagatgagcgcgcagcaggtagaggacgtgatgctggagtttgacgagcacgagattgacgtgctggtggccacgaccatcatcgagagcgggatcgacaactcgcacaccaacacgctgataattgaggacgcgcagcgcctgggcctggcgcagctgtaccagctcaagggccgcgtgggtcgcggtcgcacgcaggcgtacgcgtacttcatgttcccgggtcagattccgctgacgccggaggcgacggaccgcctgatggccataaacgagaaccaagacctgggcagcggcatgcgcatcgccatgcgcgaccttgagatccgcggtgccggctcgctggtgggcgcggagcagcacggcaacctgagcagcgtgggctttgacctctttacgcagatgctgggccaggccgttgcggaggccaagggcgaggccacggccgaccaggcaccggaggtcaacatcaacctgccggccgacttctaccttgcggaggagtacctgcccgaggtggacaagcgcgtgctggcgtaccgccgcctggcgtctgccacggagcttgcggacgtggaccgcctgcagcaggacctggagaacagctacggcgcccttccgcttgccggcagaaacctgctggaccgcgcacgcatccgcatacgctgccagcgcctgggcgtgacctccgtcagcctgacgagcggccgcatcagctacgtggggattgaggtgccgcgcaaggtggccctgcgcctgaaggagcgccgcgccgtgatctaccccaagaccaggaagctgagctaccccttccacaccgggcgcgaggagctcttgcccgccgcgcttggcgtgctggaggaagttggcggcgacgacgagggcgaggagtagcgcatgggggagaagaacacgctgccggttgagggcgagcggccaggtgcggccgacgcgcggactgcgggccgcgggccggttgtgagccgtgcggccgtggggctggagctgcccggcgaccgcgccgcggccgacgccgcggacgagcagagccgcgcccgagcggacgcgccgggcacgcacccggagtttgaccggctggtgcgcaccgtgtggcggctgcgccaggaggacggctgcccgtgggaccgcgcccagacgcaccagacgctggagcgcagcctggtggaagagacctacgaggccgtggacgccatcgagcgcgggagcgacgtgcacctggccgaggagctgggcgacgtgctgatgcaggtgcttctgcacgcggagatcgcgcgcgaggacggctcctttacgattgacgacgtgtgccggcagataaaccaaaagctggtgcgtcgccacccgcacgtgtttggcgacgccgcggcccaaagcgagcaggacgtgggccgcatctgggcggacgtgaagcgccgcgagcgcgaggcccgcgctgccatgggcgagggcggggcggacaccgcgccggagggtctgctggacagcgtaccgcgctccctcccggcgctgctgcagtgccagaagatatccgagcgcgcggcgcgtgcgggcttcgagtgggcgagcgaggccgacgtgtgggaccaggttgcctccgagcggcgggagcttgaggcggagcccgccgggagcgaggcacgcgccctggagtttggggacgtgctcttctcgctcgtgaacgtggcccgctgggagggaatcgacgcggaggcggccctggccgcaagcaaccgcaagtttcgctcccgctggggtgcgatgcaggccatggcccgcgagcgcggcgtgcggctggaccagctggacacggccgagctcaaccggctgtggggcgaggccaagcggcaggagcgcgggggtggcgcggggaccggtgcggcagactgatccgcggacggtctctgctgagtttgcggtcttgggatggggctggcggcggcgcgccggcctctgctataactaaaggcgcgcgcaaggcgcgcagcctaaacgaagctcaaacgaagacgatggcgtgaacatgcagaacccaaacacccagggcggcccagccaccctcagcccccgcagcgcccaaggcagaaggaggaccgtgcagaccgaagacggcaacccccaggcaggcgcaggcaaggcaaaggttacgagcgaggggcgtcgcgcgcgtcgcggcactcccaggacggacggtccgctcaagcaccacaccgttggaaccaagcagatgatcgaggcccaggccctggacccctcgcgcgatcgcgcggcggaggagcgcctggcctttgggcagcagcccgccgctgcgccccgccccgccatgaacgttcgcgtggctccggcgggggagccggcggagggcgcgactggcgcgcctgcgaagccggccgcgaggccgactgcggctgcgactacggccccggctgccggcgccgcctcgacgccggccgcaaagcccgccccggcggaccactgcgaggccctcgcgcagagcgaggccgcgtacggcgtgcgccgctcggccacgtacgaccaggtgcgtgacgcccgcgccgcccgtgcgaccgagcacggcacgccacgccgcacagccggcacgccgcggaccgaggtcggcgtccgtcccgagcgggccgatgcccgggacgcgcgttcctctcgcccggcggatggccgtgcggagggtcgtgcggaagccgagcgcaggcaggcgccgtccgcccgtgagcgcgccgcggccggtgcggaggccgctcgcgacaccgccgccagcgcccgagacttcgcggtgcgccacaagcggctgtgggtggccctcgccatcgtgtttgcgctggtggcggccctgtatggcccggtgcagcagtactacacgtccgtgcggcgctctcaggacctgcagacaaagtacgccgcgctcaagagccagaacagcgacctttccagcgacgtcaagacgctcatgaccaagagcgggatcgaggaccaggcgcgcaagaacggctacgtgtatcccggcgagaagagcgtgaaggtcaagggcctcaaggaggacggaaaggacccctccgcggccatcacctacaaggacgaccgcacgtggtacgtcaaggtgcttgacgtgctgtttggatacgacaggaagacggtgctcaaatgacgcgcgttgcgtgcatagacattggaacggtgaccgcgaggctcgcggtggccgacgtcgagggcgggcgcgtggtccgcatgctcaagcagtcaaacatctgcaacctgggcgagggcttgacgcagacgggcgccatcagccgcgccgccgcggaccgcgtgacggagtgcgtcgactcgtacctggcggccgcccgcgaggccggcgcgcactccgtgtgctgcacgctgacctccgccgcgcgcgacgccagcaactccgaccagctgctcaaccgcctgggccgccgcggcctgcacgcgcaggtcatccccggcacggtggagggctcgctcaccttcttgggcgtggcgcaggactttgcgggccaccgcatcctggtggcggacaacggcggcggctccacggagctggccgtgggtcgcatggacgcgccggccgatgccgcgccggcgcccaagcttgcacttgactgcgtgcgctccgtggacgtgggctgccgccgcctgaccgagcgcttcctgagcaagcacgacgtccccaccacggacgaggtcgcggccgcccgcgcgtgggcgcgccagctgtttgacgacgccatgcgggaggagaagatcctgcgccttgccccggagcgcctcgtgaccacgggcggcacggtgaccacgctcgtggccatcaagctggggctcgttccgtacgacccgcgccgcgtgcacctggccgagctcagcctgggcgacgtggagggcctgctggcacgcctggccgcgattcccgtggaggggcgcgcaaagctacccggcatacaggccaagcgcgcgcccgtgatcctgggcggcgccatcgcggtggccgagctcatgcgctccgtcaacgtcgaccgcctgaccgtgagcgaaagcgacctgctgtttggcctctccatctgcgcggcggccacggcggagggcacggccaacccgctgggctgggagccggacctcacgcccctgcgctaaggcgcggcggcagcgggcagcccgcggcgcgatgggcgcggcggcagcctgtggtaaggtagcgacaccggcagcgcgacggcggcgcaatcatgcgggggcgtggcggaattggcagacgcagcggacttaaaatccgccgactttggtcttgtgggttcgagccccaccgcccctaccaatagcagacgagcggcgggcgagaagaacgttcttctcgcccgccgcccttttctttcggatgtctgccgtcggcagcggcgcttgccgcgcgcctggcgctacgcgaagtagccgtacacgatgccgaagaggaagccgccgtactccacgatgcagaacaggatcatgagcgcgtactggaaggcggaggcggaaagcggcgagttgggcagcgccgtgacgatggccaggaccgcgagcaccgcgtagatcgcggcgatcacgatgacgacggcctttcttgcacgtgcattgcgggcggccttctggctgttgggctcctcgtcctcgttggggttgagcttgtgcgccaggaacacgcccagcgcaaacagcaggacgggcatggccaccaggtcgagcagcgagtcgagcgccgggctgtagcgcgcgcctgcgccgcccatcaggcggacaaagtagaagagcacgtacgcggccgagacgatgaccagtaggtacggtgcgttcttgcggattgtcttcatgcggggcctcccggcggattgtgcttgaaggtgctgaaacgtagcaagtatatgctataaaagtctcagactttacatcgtgttgcgcttgcgaagcggatgggaacggcatactaacagcatgccgtgtctcctggaatactgcgatacgcgttgggctatcgtttcttccttctcatccttcgagaacgcagcgtttgccatcctgcatgcagtagagacacctctgcggaggacaaccctagatatttttccaacagaactttatctacgtgcgctatcaattcctctgttctttcttgacgaacgaggtggtttgccatttcgaaatcaaattcggctgatgggtcataggggatcggaagatctctagattcacttggctcgaatgttagaacgccccctccgtagcttcttcccatgagttcgctcattaaaaaagttaatgaattattgaacgatacaatcgcagaaccggcgtgcacgccagtgtggaaacgtatcttgtgcagcgtgtcagtggagtacgcggcggttttgttcaatactattcgagggtatgcacctacctgtctgtagaagaaggcgtctggcttccaggatgtgggcacctgataccaaggcgtccgaatcctgcacttgtagttcttgttgactccctgcatctcgccctttttcacgtactgcagatcagctgcagaaaggcggttcttcggaagaaagagaagaactttcctccccaaatctacttggctttcgtaatcagcgtccgtcaagcagagcccgtcgagttgaaaggacctactgatgattggaacacaagagttcaatatgctattttcctcggctgtgctcttgtctaggacgaagaaagagttttggccgcttaccaagcccacgttaacatcaaataggtttgagcacctccggacatgtggatcttcaagcagcctagaaaccagatctattgtcctctggtcaagatagtacgcctgccactttgtagagtcggggagtttacgtttcggctgaagcgtctggatcttccgcggcgtaagggtagcgagagagtcggcatctttgagctcaatgattcgaacgcctctatctttatcttttgcatgtcgttcggctagaaggagtatgacctcctgttgcgcattctcgaagattaaattctcgaatgtgacgatggagacgctctcaaaatagtccataaggaagtgtcgcgtttcggaagcgtacttcacttggaacagctctgccgggataaccattccgagtcgtccgcgatcgcttataaggtgactgcacacaacgaggaagggtagccaaatgttggtaaggcggtttggcgagaaaccatatcggtgcattagctcgaaagccttttcgcggtatcgctcttcgaaatcctggtagcggatgaagggtgggttaccaacgatagcgtcatatttggcgccgttaattttatcggtgcagaaggtgaagaagtcccccgtgatgactcttccgccacatttggccgctttcttagcctcgctatcatatagctctatgcccagaattgagggctcggggttagtgcacccaagcttagagagacgttcgtgggcggcggcgataaatgcgccgtccccacagcttggctcaagtatattgtccgagggagatgttattgcccaattgcaaataaagcgagcaactttatttggggtgtaatatccgcctcgaagcttgttaatcaaatctgtcatgtagttaccgttgccttcagctccggacttacttcgtatagcgtatccagagtagactcaagcttcttcgtcgtggcctctaatgaccttgagtaaagttctttatcacttttatcgtttgccttgtcgcgtctgactgtcagattgctcgcttttttcacgagcctgattacatcgttatacttttcgacatcttctttgctgtcaaagtcaatcctccgaattggcaagtctgagacgaactgcttgccatgggaatagtaaccgccccggaacacgcttgttctgcttcggacaagctcttcagtaagccagtagtttaggactgcctgtatatactctatttgctcggggactccaggtctcattcttagaccgtaatacggcccatttcccccaccagtaaacattatcgttccgctctggtcgagaacatagcgaggtccggttgaaagaactggccagatgagatgcgcgccgccagaaaactttccaagactttgggacctgccgaacttgtgccaatcattgcctttccgtcgcgggctgacagccctcttgtcaaggatgctttttatagatgtgaggtaagaataagcttgtggatacaacctcttgatgtccgaagctgctatcagtacgggtttgccattcttgaatacatagggaaacagaatctgacgattagggcatggtgatccgtattcttcaaagctcacgtccaatagacacgggcgacagagttctttttctacatgcgatgtgtgaccaagcatatcgacaaatgaaaatgcaccgtctgatactcccgtaggttcaaatatataagcatcatctttactcgtttggagtcctacgaatacctcagcaatgtccgagagctttgagcacgtcttgtagatagaagataggtgtttagttagcgcctccggtgggaatgcccacggggcttcgcttaggctttggctagcgtattcggttccagaacagagcggatctgccatgaactcagagagcgaggagacctgatttctcgtgaaagatttcgctttgcttggcgttgcgacaagtatgcaagtgtacgtgctccgttcggggaacacctggagagttccaaagtcgataatttttagaacatggcttccactggtcaacgttaaccgaagagattctcctgtctttgaggtcatgaacttgttcggaactatcattccgagcttgccgtcttttttgagcaatccaagcccacgttctaggaacagctggtacttgtcaagaagttcagcttttgccaccttgagcttgcatgatggactcctgtagaacccatattccttcggagtgtatttcgccatgttctggacacgaatatagggtggattaccaacaacggcatcaaagccatcaaaggggaattcggttctccagtcgaaaggtctcacatttcgaagcacgtcaatgctgctcgtcgcatacttgtcatagtcaaaatactcatagcctacgaggctgttcccgcattttatattgcttgtcatgtcgggcagaagccgatttcctgtcatcgacctgtattcgtcgagttcttccgagctgcacccctcgagaagtctaagcgagaggctcaactgggcgacctccacggcacgcggatcaatgtcaacgccatagattgcctcggacaatatctgacgctttcgccagtagggcagatcaaggcccgatggtttctgtatcagctctatagacgagctttcttcgctggctacgcgagcaagttccttggcgactaagtactcgtaggtagagagcaggaagtttcccgatccgcagcatatatcggccaccttgcaaggaaagtggattccttctagggtgttcgcgactatagcatcggttacgggtttgggagtcggtaccactccgtttgattcgatggcctctggggtgtcaataaagctgacctttccattatcaatgtcgacacgttggcctaggaacctctcgtaaatatgacctataacgtgcggctgtacgacgttgaagtcataggagctgttcgggtagtaaaggtcctggaaaatattgattagcaggtagtcagacacatgccatggagcatcatcaatgtaatcgaatagtccagagtcatatttcttgtctgccgcttcaaatgacttgtgcagatcttcgtaggatgtaatacggagtagctcttctgggtcttcgaaactcctgtcctcgcagacgcgaaggaatactatacggtcgagaagcttctgtgtaaacgtattgagcgcgtcgctgtctttaacgccatggtggtcatagatatcttttgcgatgtctccgcgccaggagttgatttgcgcaaggaacagatcgtcgaatgggactttggcggcttgctcccgtgcgtctataaagttcaatgaaccattctctacggctttcttcgaaagcacggaagcaatctctttgtatttcgtcacatactcgtcgtagtggtagcaggctatgcgcgcgaagctggccggctgccctgttgtaggacgatacccgcagtcgtagattgcaaggtcttcgaaatttgaaagtaccgcgatggaatggttgccattccatccataacggcgcgcctggaatgctggccttgggtttttgacgatatctacgcttggctttttggcctctaggtagaacttggtctctccaccaattcgaaaagcatagtctggcttcttgtttgcatgggcttcatcctcgtcatcaactgtgacggtcgcctcgtgaatgacttcgcggctataaatagacaggccagactcgttgtctacatcccatcccaagatacagaatagcgggttgagaaactccactctaagtgacgtctctccatactttgggttcgtgtactcgggtctattggccttataagccgagacaaggttccgtagtcgggccaacgaatcgctgcaagttgagttcatgccgcctcccccgctatcgacactgaaaagacctcgagggagagcgctgcgagtatgagccgttagcttcatattcgccatctcatcctcgcggtaactgtcgtgtggtgaattatacctactgcagaagacacgaattgattgaggggtggcagtgcaccctaaggcggagaacgtctcaatgtgagccacgggtgtggtgaccagttgcggccggtcgtggcggcgtgatggaaatttggccacgcgtaaggatggcgtaatgcgacgcgctgcgggggcgtacagtcatcctgttcactaattgtcctgtccacaacctgtacacggctgggccgtgcggctgtggcaattgggggtgcgcatggctgacacggactttggctttcccacgccggacgggcgggcggaagcgcccgcggccgcggggcaaggcgccacgctcctctcgcccagctcgcccgatccccttcacgtgcagctggcccgcatcatgcgcgagaagatccgcagccacgagtggcggcgggggagctacatcccgtccgagtccgagctgatggcgcgctttggcgtgagccgcggcacggtgcgcaaggccatcggcacgctggtggccgagggcctgctgcagacgcgcaaggggagcggcaccatcgtggcggacggcggtattgcgctgcccggcaacgcaaagagcttctccttcgcggcggcgctgcgcgacgggggcgtgcgctatgtcacgcgcgtgctcgccaaggaggtgctgcccgcgcccgcggccgtggccatgcagctgcagctggacgagggcgcgcccgtgctctttatgcgccgcgtgcgcagcgtgggcggccaccccgtggtgtgccaggagagctgggagaacctggcggcgtgcccggggctcgagcaggcggactttgggacggagtcgctgtttgacgcggtggagcgctgctccggcggcaaggtcacgctttcgcacatgcagtacgcgagccgccgcgcgggggtggagcacggcggctacctgggatgttccgcggacgacccggtcatggtgctcgagcagcgcatagagctggctgacgccacgcccatcgagtggagcctcacgtggctggggcccaaccagtccatcgtgggcgtcagcatgcagtcggacgggttcccggggccgctggggctggacggcgtgcgcacgcacgagcccgccgcgccggaggaccccggcacgcgcgagctgcgccgccgcctggagctggacgcgctggccgtgcggcgcggcgtggttgagctggggcaccgctacccgtggagctcgttccactttggcggtgcgctttccatggcggagatcgtggccgtgctgtttggcgaggtcatgcacaccgggcgcgacggcaccccgtgggcggagcgcgaccgctttgtggtgagcaaggcgcacgcttccgtggcgctgtaccccatgatgctgcgctgcgggctgatatcgcaggaggacgtggaccgcgggctgtttggcccggacgcgcgcatcttcaagcacccgcagcgcgacgcctcgcgcgggatcgagatttccggcggcagcctgggcatgggcctgggctacgcggcggggctcgcgctggcgcagcggcgcaagcggctgcccgggcgcgtgttctgcgtggtgggcgacggcgagtgcgacgagggctccgtgtgggaatccgccgcgtttattggatacaagcgcctgagcaacctgacggtgattgtggacgccaacggcatgcagctggacggacccaccgcgcaggtgctggacaacggcccgatcaaccgcaagttcacctcgtttggctttgacgtgctcgaggtggacggtcacgacgtgatacagctcgcggacgcgctgcgcaaccccggcgaccgcccgcgcgccgtcatcgcgcgcaccacaaagggcaagggcctctcgtttgcggagggcaacgtcctctggcacgacatcgccctgacggacgagtactacgagcgcgcgacgcgcgagctggacgcgcgggaggaggcgatccgcgatgagtgacaccgtgagcgcggaggagtccgcgcggctgtgcgccatgaaccccaagcgggcgtttggccaggtcatgggcgagctggcggagcgggacgcagggctttcggtcgtggtttccgactatgggcgcaggctcaacctcgaccacatgcgcgaggtgctgcccgagggctttgtgcagtgcggcatcgcggagcagaaccaggtggaggtcgcgagcgcgctggccaacgaggggatgacggtgtttgcgccgggctacgccacgttcattacgggccgcgtgtacgaccaggtgcgcgtgaacctgggcatgatgaagtcgcccgtggcgctggtgggcgtggctgcgggctgcgagtctggtatgctgggcgcgagccacatggcgctggaggacgtggccctcatgcgagccgtccccaacgtggaggtgttctgccccgcggacaacgcggagctcgcgagcgtgctgcggctgctggccgcgagcccgcgtccggcgtacgtgcgggtcaacacgttggacggggccaacctgcatccggacggggtcacggtgcggcccggggtggcggaggagctcttctcgcccgacggagcgccggaggtgagcgtgatcgccacgggcacgatcgcgtcgcgcgcggccgcggcggcgcgggagctgacggccgcgggcacgccgacggaggcgctgctgatgccgacggtcaagccgctggacaacgtgctggtggacgcccttgcggcgagcggccggcacctggtggtgacgctggaggagcacagcgtggtgggcggcctgggcggcgccgtggcggagcgcatgattgcgacgggcggcgcgccggcgctgctgcggctgggcatgccggaccgctacctcaacgcggacacgcaggagtcactgctggcgcaggtggggcttacggtcgagggcatcgtcgcgagcgtgcgcgagcggctggtgcgcgggtaacgaggtcgcgagcgggcggtttgaccctgtgacctgggacttttgcggcgtggccgccctctgagcgaccagcggatcgggacgtggcccatcatgggctgcgccccgttctcgtggcgccggaacttttccgagtcgtctgcacgcgaagggggttttgagggtgctttttcgttcaacagtctatgaacgaagcgggttgtcgaccggatgctcgtcaattagacacgaaatcatgcgctaaatatcattcgacaagctctggatgcaatcgagtcacctccacaatctcagggcggagtccaaaaacaccctcaaaccccttcgaagtgcacacagccagaaaagacttcaagtctagctaggacggagtctcgttaatggcgcccaggaggcgttttgcgccacgagtgcgacgattgtgcgcgcccgtagtgtggccacgaggctgggggtggagagtactttggccacgcatttaataaagttcacgaactgggcgtttaatagctaaaaatcttatgaatatgccgctcgtcgcccttccgagggagaccagaaacgcccacatcgtttccttctttgccgacgagggtgcatctgggtgtttgcgtcggtcccgcgttctcttgacggggctccaaatcgcccagttcggagcattaattcaatgtggccaaaattaactctgggccgacttcagttggttccttcatcggggcgttttgcgccgcgcccacaagcaaagagcgcccgccggtgctgccaggcagctgccgacgggcgctcgcgcatgcgatggtgcccccaacgagactcgaactcgtgttaccgccttgaaagggcggtgtcctaggccactagacgatg

SEQ ID NO: 182 - DNA, 8063 bp, Unknown
  Metagenome-assembled genome
agagcgccgacacggcgcccggtacggtaagattgtccatgggtcttccttcctcttcgaacgtagacaatccgaaggttagggagacccttcccttaggtcaaaccaacagaaacgttatgccgacggttcgcacttttcgctaagagtgcggaccgtccctctcaacctgaaggatggcgcgatgcttaaggacttcttccacgaggcgtggccactactggtcgtcgatattgtgatgggattcctcatgggcttcgtgccgaggctcatcgttggttggtgaggaccacggcgagtagaggccaagcgtacatcccattgtagatgttgagtcagctaagacatggaaccgggccgcccacgtcgggcggcctgtccatatagcgccaccgcacggtggcgcacgaacgaaaggcgccccgcacggggcgagtgacgcgccgcatggcgcagaagggtggtcggagtggccgaggaacagcagggggagcagcaggggcaggacggtgccggagaggcgcaggagcccgactacaaggccctctacgagcaggcgaaggccgagaacgagagggtcaaggccgagtcgcgcaagtgggagaagcgctcgaaggcgaaccttgacgccgcgaggcaggcggagagcactgtcgaacggcgggacgaaatcagcccgccgttcgactaagatacactatgggacaaggaggcagaccatgcacatcgttcccatgagggggaggcggcgcggcaatgattgacgataccggaatcaatgccggggacgggatacaagtcaccctgtcaaacgggcacgcatataccggtgagttcatgaacgtcgactgggcggaagacaacgagtcgagagtcgacgagctgtgcataatcgccgacgatgggacgtgctattcgttccgagaggacgagatagcgaacatctcgagagaaagctagcccattcggctcggagacagctcaattccgtgaggaaggccatccgataggatggccttcctcatgtcgcaagcaggcatggtcggacggaaacgctccgagaggagaacgcgatggtcaaggacttcctccatgacgcatggccgttgctggtcgccgcggttgcgatgggattcctcatgggcttcgtgccgaggctcatcgtaggctggtgaggaccccggcggacacgagtccgagaagccagccaatgacgacggacgcgatgctcattacggccgaccacaggcgcccatcgcgccggtcagccatgcggttgaacggcgggacgaaatcagcccgccgttcaaccgagacacgctcgatatagctcccatggaagtccgcccccgtgaggcgacaatcggagagcctgcagttgcgcaggaagcttatggccatgtgcacgcccgtgaaatcccaggacgagaacgtgcatccgtcgaagctcgcatgtgcccagtgggtgcccgcaaacgatacctggcggagcgtgcatcgctcgaactccgcatatccgaagggcacctcgagcgtatcctgtgagaacgcgcgatcaacaatttccgcgacctcctccatgagaaggacgtccagcggctcgtcctcgtctcccacctcggagaagagatcatccgcgtcgtctgccaccctgctcatgccgtcccccatcgcgttgggagggtccaacatataccatacatcatgatgacaaaccatatgggtaccgaatcacgcccatacacttccaccgcctgcgtgcgagaattgctggatcccgcttcagctatcatcaagtctgtcagttcttctccaacaccttggccacatcggcgccaccgccagaccagtcgattgttcgaaccaaagcgagcttacacgcgcctcactccagatggcattcaacacaaccgcagaggaagacatggcgaaggcagatgacatctacgagcagcagacggcgcttcccgaggactattcctgggacgcgaggggactcgcgctcgcgaaggtcgcgtgggtgggacagggatcgcttcgcgtggcggccgtcgtgcttgcgatcgttgcagcgtgttggtacgtcgcggagagcggcgcctttggaagcgtgctcccgcttctggcgttggagctttcggtcatcatcctctgccttgggcttgcctttgccctcgcgtccgcggtacgcggtaggctctggaaggccggcccgtccacgcggcacgactactcgctctggctcttccgtcgcaggtcgggaaggctgcccaagcaggcggcgagcctgctcctcggcatggcacgcgcgagcctggaaaccggcagaatcgatggggcgcgacgcgcgctggagcgcatcgacgagggccagctcgaccaggacggactcaagctcttccacctcctcgggttcgtgacgtgcctttgcgaagatgactgcaagacagaggatgcggaggaactgctggtccgctacgaggcggtcccgcggaaggcctgggagggattccccgaccccgacgaggcaaggtcatggctgggatccgaggatgcccgcgccgatgccgtagccgccgtgagccgagtccggaacccccgcggcgcccatcccgtgcacgcccttctcctcacgctcatagttgcccactgcctggcatttgccgcccttctctatggcatcaatgccgaaggcggatggaagctgcggtgcgggtacgccacggtcggtggcctgtttgcggccctcttcctgcttgtattgggcatcgcgctcgcgatcttcatgtggcgagaaggaccaaggaggcatcgtcgcggccccgtcgggacggtcctctccattgttcttgttgtggcgacgggcatccttgcactggcactctcgttcgagacgttcgtgaacggcgtctttgcctacgacggaaccgagcgcgtgatagcgagcggcgtcgaggacaagtattcgggtcgaacgtacgactaccttgcggttgactggcagggctacgacccgcgcgacgtgacgacggactggtggcgcgcggacagcccgctcctgatggagaagtggagcgacgccaaggaatacgacaagaaggctgtcaagagtccgtcgcaaacgggaacgacgtccgggaccgctgatagcgggggtagcgcgtctgatgggggcgcggcaacctccgacctgagttccagcgcggatggcaccgacgcaagcgcgagcacgtcagaggcgaggatgcgcacccttgccacctaccttgtggaccgcggcatcgtgcccaagacgggcgtgttccagattggcgcggacgcgaagggaaactcctacgcaagcctcggcaccggcacggacacggaggacggcaaggcggtcgtggtggagtaccggatcctttccaacggcgagacgaacgacgcacaagggcagccatccgaggagttcgtactggagaaatggtatccggaggacgagggaagggacccgcagatacttggcttctacctcgtgaacgagtcgacctccgcggtgacggacgaagggcgcacgagctggtagggcactctagcgacttgcgagctcgtgcagatgtccgagatggatgccaatgtggccgacgccgaggatgatcgcggaagccaaggtgacgggcgactgacaccagacgccgagaagggcgagggctgccacaggcaggctcgcgatggggacgggcaccgggccaaggggctggtacatgccggcgagcgtctctccccctctgaagtagcggacccaggcgacctcatagaggaccatgagcgcgaaggctgctgccagaatgaggagccacgggaacgagtagccccgcgaacaggtgaacgcgaccgcagagcaggtggacaggacctgaccgacgcgctcgagcacgaggagcggtcggctctcgtgactctgcagctccccgtagccgggaggctggttcctcacccacctgacgttgggtgcgaagagcatcagcaggaacgcgacgccaaatggagagaatccaagctgcatatccgttcccaacgtccgtagctcgttcttctcgacattgtacggtacttgcgcaaccgtgacgaatacgctcctcgtaagcgatgccgagggtttcgcactggatgggattcctcttgggacgcctcttacgcctcagggtcatccgcaagcggcacgatccttgtgccgtggagctcggacgcgccggtggcggaagcaactgcgtcgcggtttcgccacgtgacgccgccgccgggaaggatcttgaggccatctggggccgcctcggacaggcgcctcaggtgggatgagttgcccatgatcggcgtgcccgcacgccctccgtgcgtgagcacgcgcgtcacgccgagcgaggcaagacgcgggagcacgtccgcctgtagcgccctgtccagctcgtcgaaggccatgtggaaggtgacctcgagcgtgcgcgtgccggcggccctctgggcagcgaggatgacgcgctcggtggcggcctcatccacctgatagcgtcctggctctcccctcaggcagccgaggacgatgccgtccgtcccccgcctggcggcgaccgacgcgtcctccaccatgacggagagctcgtcctcggagtagacaaaatcccctccgcgcggccgcaccatggtcatgacggtcaccccgtgcgcgtgcgcgtaggcgagcgtgtgatcgagcacgccgatggagggggtggtgccgccctgcgcgaggttgtcgcagagctcgaccctgcccgccccacgggcgatggcgtccggcacaagcgtgaagttctccgcgcagaactcgtagagcatcggcatgttccttccaaagggcccgcaagtccaatcccccacaatgatgccgcaattgccgtgggagaagagcgaggctcgtactcgagtgcggcagaccgaagccaaccctgtcagatggaaaagttaaaagcaaggtattttcgcaggtagatgtgggtaccagaccatcatcccaacggcaccttcgtgctggcggcgcctccctgctacttgaggaggcacagcctatggaacttgtgatcgcgctcgtcaacctggccaccgcggtggtcggactgctttgcaaagtcgtcaagcccaggtccaaagctcgaaggaggcgacataaaaggcgccggtagcgggcaactaccggcgttagagtaaacggcgccgcctgactcccatcgaaggcacgccgttgggtacatggtaccccgcgaagagggcattcatacagagagtggaattgcgcctcaatcttcttttctcgactctacggatgcacgcgacaccatgcgcttcgttccatcacgccacgactcgagcttgccctcattgcagagttgcgtgacgcgacctctcgtgacaccgagctcgcgggctgcgtccgcagccgttatcgcgggtatgtcccccagcgtacgcgacacggcaacggcgatgactcgcccaccgtgcctcagggcatgaccaaacgagaccctttgcggctgctcgcctctcataaggcaatcgtccaggtacatcgacagccaatcggcagcgctctcgacggcgtcatcgagactcgtaccaaacgtgccctcacggtccagtgacagtggctctgcaattacattcccgcctggtgacgcccagaactcgaactcgcagacatagaccatgacccctcctcgcgacgtcgcaggtagatgctagccccactggtacggaaaagttaagtgaaaggtatttttgcaggtagatgggggtaacagaccatcatcccaatggcaccttcgtgctggcggcgcctcccggattcttaaggagacgatatgagccaagcattggagccccctcgctcgtatcgtcacgcgggcttggatgctgccacaatgtgagtcagacgcatcggctcgggcggtggcaccgctaccgcacatacggaagggggctccaccatgcatgttacctccatcggcctcgacgtccacgcgcgcacgatctccgcggcggcgttcaaccccatcaccggggaggtcacgcacggggagttcgggccggaggccggccccatcgcggagtgggcgaggggcttcgagtccccgaagtgcgtctacgagtccggcccgaccggctggcacctggcgcgcgagctcggggcgctgggcgtcgactgcgcggtcgccgcggtgtcgaagacgcacaggcccgccgcggacagggggaggaagaacgacaggaacgacgccgccttcctcgcccgcatgctcgcctgccacaacgtcgtggaggtcttcgtgccgcccgaggaggtagaggcggcacgcgacctcccccgcgccctcgacgacgcgagggacgacctccagagggcgcgccagaggctctcgaagttcctgctgaggaggggctacgtcttcagtgagaccaaccccctcggccagaggaagggcacgtggtcccgcgcccactggaggtggatcgccgagatcaggctcgagggcgccgcgcgcgtcacctacacccactacgtgacggcggccaggtgcgccgaggccgacaagcgcgagctcgagaaggcggtcgcggcggaggccgccacggacaggtgggcgccggtggtgcgcgccgtgtccaccatcaagggcatcgacgtggcgagcgccttctgcctcgcggcggaggcgggatgcttctcgaggttcgggtccgccggggagtacgcgagccggtgcgggctcgtcccctccgagcactcctccggagagaggaagtcgcacggccacacaaccaagacggggaacgcggcctcgaggaggacgctcgtcgaggccgcgtggcacttcgcgaactgctcggggaggcccaagaggctgccggacgggtgggaggtcccggccgagatcaggaggcggggcaacgactgcacgaggcgcctcgcgaggaggcgcggcgagctcgcggggtcggggcacaacgggtgcgtcgccaacgtcgccgtggccagggagctcgcctgctgggtctgggagatcgggtgccgcgccgagggcacctaccgggcctagcgacccacgcatggcccttctgccggagtgacccctctcgacgcagggctgggacccgctcacgcgctttacattggacaacccccgggtggcgtccgccgtggagactggacttcgcaacgagggtcccagacggagaatcgaactgcggtaccacgtcccctcacataaggcttgccgctggtgcggacgtggacaagagcccacgaatattagcttgccaggcaagcgccgactaaggattgcaagacaggggttccctccggctcaaggaagtggcaggtcccgaggaaaatccgggacctgccacgtcatgccgcttgacaatgcttggctcatattaggcacagcctatggaacttgtgatcgcgctcgtcaacctggccaccgcggtggtcggactgctcagcaaggtcgtcaggcccaggtccaaagctcgaagggggcgacataaaaggcgccggtagcggcaactaccggcgttagcaattacggcgccgcctaatccctatcgaaggcttgccgttgggtacatgatacccgatggggagggcttccatacgaagcgtgagacgcctacgaggtattcacgcttccgaacagccgcccatcacggctagtcgttcttctcccccgcgtcctcgtggtcctggacgggagtgccgtccgtcgtgggtccgccctcttcgggagtcggctcggcctcggctgccgcgtcctgggcatcgtcggtttgcgagtcggcatcggaacgctcgtcgaagccgctctcccactggcggcgcatctgctcgcgccaggccttgagctctgcgcggcggcgttcgcgctgctcgtggaactcggagaggctctttgccgcgacctcgcggaagtcgtcgagggagtcctcgtcgggaagcttgacctcgggaatctggtcgacgacgcgacggtccttgtccatgccca

SEQ ID NO: 183 - DNA, 86577 bp, Unknown
  Metagenome-assembled genome
ccagcttgccgccggtcttcgcgtagagcgacgggttcgtggtcacgccggccaggatgccccagtccgacgcctgcttgatctcgtccaggtccgccgtgtcgataaagaacttcatgtctcgtcccttcttcgggttggctttccagtttgttattggtgcaagccaatcgtagcgtccttctccacaaaatagaccagcaatcggtggtcaaatgtgatgggcacgtaagcggtacgtcagtgtcgccatggcaacgccgcacctgacattaatcgcgcacgatggggtaacatcaattacgtatcgcacgctattaattaatgcggcaacgcatcgtcgcccgcgcatcaggaggcccccatggcccagaacaacgcacccctccgcgccgacgcctgcgccccggcgcagcacaaccccgacccgcttgcgcttgaaaaccagctctgcttcccgctctacgcggcgtccaaggagctcacccgcaggtacaagcccttcctcgacccgctgggcctcacgtacacgcagtacgtgaccatgatggtcctgtgggagaaggacggcatcaccgtgtcggagctcggccgtaggctctacctcaactcggccacgctcacgccgctcctcaagcgcctcgaggcgcacggctacatcacgcgcacccgctccgagcaggacgagcgcgccgtgatcgtacagctcacccccgccggccgcgagctccacgagcgcgcacacgacgtgccgcgctgcatgctcggctgcgtgaaggacggcatgaccctcgaggagggcatggagctcaagcgcctgctgctcaagctgcttgcaacgctctcggaggaggacgccaaggcctagcgccggcggcgaccgcccgcagctgcgacccaacccgcccgcaccaccccgccagaaaggaatatcagtgtcacaacgaaacaccacccgcctcgagcgctcgaccatgcgccgcacgctccagaggttctggaacgtcacgcgcatgcagcccggcatcacggcgctcgccgtcatctccagcgccggctacacgctcatgctcaccttcgccaacacctacgtcatgggcctcgtggtcgatagggtgcaggcgtcgcccgtgcccgcaagccaggtgctcgcggtcttctcgccctacgtggtcgcgctcgtgctcgtgaacctggtagggcagatcctcagcaagctgcaggactacagcgtctacaagctcgaaatcaacggcaactaccacctgtctcgcctgtgcttcgacacgctgtccaaccagtcgatgacgtttcacaccagcaactttggcggcgcgctcgtgagccagaccagccgctttaccagcggatactcgcagcttgtggacgtggtggtgttcacgctcatccccatgatcacctcgattgcggccacgatcctgagccttgtgggagaagtgccgctctttgtggcgatactcgtggtcatgatggtggtctacgttgcgtttgtctgggtcatgtacaagcgcatcctgccgctgtccgagcgcacgtcccaggcgcagaaccgcctctccggcgtgctgagcgacgccgtgaccaacatcctggccgtcaagacctgcggccgcgaggactttgagcgcgacctctttacggcggcggaccgcgacgcccgcgccgccgagaccgtgagcatgcgcgccagtatgaagcgcaactttgccagctccgggatcatcgtgctcatcatggcaatagtttccgtctttatggttggcggcaacgcgtggtttggcatcagcgcaggcacgctcgtcatgatgttcacgtacacctacaacctcacgatgcgcctcaactacaccagctccatgatgcagcgcatcaaccgcgcgctgggcgacgcggcggagatgacgcacatcctggacgagccgcgccttgtggaggacgcgccggacgcgagcgagctgcgcgtcaccaagggcgcgatcgacttcgagcacctgggcttccgctaccacgacgccgcggagggcgactccgtgttcgaggacctcacgctccacatccccgcaggccagcgcgttggcctggtgggccgctccggctccggcaagaccacgctcaccaagctgctgctgcgcctggacgacgtgcaggagggccgcgtgctggtggacggccaggacatcagccgctgcacgcagcagagcctgcaccgccagatcgcctacgtgccgcaggaggcgctcctcttccaccgcagcatccgcgagaacatcgcctacggccggcccgacgccacggaggagcaggtccgcaccgccgccgcccaggccaacgcgctcgagttcatcgaccgactgccgcaggggctcgacaccatggtgggcgagcgcggcgtcaagctgtccggcggacagcgccagcgcatcgccatcgcgcgcgccatcctcacggacgcgccgatcctggtgctggacgaggccacgtccgccctggacagcgagtccgaggccctggtgcaggaggccctagagcgcctcatgcacggccgcacgtccatcgtggtggcgcaccggctctccacggtggcctcgctcgaccgcatcgtggtgctctcgcacggccaaatcgtggaggacggcacgcacgccgagctcagccatgccggcggcgagtacgagcgcctgtgggaccgccagacgggcggcttcctggagggcgagtaacggctggcgcctctgctgctaaatgctgcagttcatcacatttttatgtacttacaaatgtgcagtgagacatcaaactcccgaacggcgcgacatgccctacatcacgacctctattacagttttgtagggtatgcggtaagacccaagcacaagagaaggaccagcccctcgcgtgagaggctggtccttctcgtcttacccgccttgcttgtaggcggaaaggttaactaaagcgcaagatgatgttcctccatgaaggcgttggcgtaggaacgttccttcttggcgagagacgcaaacacagccccgagcttgtttcgatcaagataaggccatagccgctcgatagcctgggcgtcctttacttgcttcttcccgcgctcgtgattcaccgtcatcttgtgcaccacatacgcctctggagaaggaatgttgaccttcagaccctcatagtcgaccgtcacagcaaagcgttttagcgtctccatgtgccttaacgcctgggccgtcacgccaaggttggtcttgagcgcatcttcaagtcccgcaccaaccttaccgatgagaaactcaatctccaatcccgcggtagagtaaatcttcgtcacgcccgtcaatcggtcgctctccacaaggtagccgtcctcacgcgccaaggcggctagctttgcctggggcatgggcctccttagattgcgaacgagaaagccaatgtccatggtcttgatgcttggctcaaacccctcaagaagtccgcatcgctcgaaaagcagctctgcccacgacccaacaagcatgacatgttgaaggcagcctgcctcatcgagcaacgtaaggaacctgaccaactcacgctcctgagtgttcatggatgaagtcccttcccagcgcacgctcaatctgcttccgggagcgctcctgctccttgagtgccgcgacgacctccttcctacgcgcgacaaggcccctgacgcgctttgcgtcgtcacgcttcacgtagtcgctgcggacatgcttgccgtcgcgatactgcaggtagtagtaggtcctgccatccaccacgcgttcgcggaggcttccatgcggaagtgacgcgagctccgcctcaagcgcgctcgagacgcgcttggagcgcccatattcctcgagcagaacctcctcgatgacggacatacggcaccttccaagtcccaggccagcttctgatataccctacaatacagctattttctcatatttgtagggtatgcgcaaagaccaagatacaagagaaggaccagcccctcgcgtgggaggctggtccttctcgtcttacccgccttgcttgtaggcgggggtgttgctatgtgctgggcgcgggcagcatgtgccggcgcctggccaggcctgagtcgctaggcctggacctggggctcggccgtggccttgggagcgttggcctcggcctcggcggccgcgacgttcttgcggccgagctcggaccactcgggctcctcgtccggcatggagcctgccttggcagtgaagaactccttcaggcagttgtaggcgacgatgacgcccaggacgacgagcagcacggcgacgagcagctggaggcccttggtgagaaggacgggcgctgccgcggtggtagcggtcgcggggatggtgccgaagaggccgtaggtggcgacggcggtccagcagctggcgatgctcatggcaagggaggtgaaggtgcagcagagcaggaaggcgacgggcacgtagagcatccagcccttgcggccggtgaccttgcagaagacggcgagggtgatcatggtcatgccgccgagcagctggttggaagcgccgaagagcggccagatgttgaggtagccaccgaagcagagaaccaggccgacgagcagggagaccgcggtggagaagtacacgttggtcatgaccttgcggacgccggttgccttctccttggtagcggcggcggcgtcgttggagctgtagaagaactcctggaagctgctgcgggcgatgcgggcgactgcgtcaagggaggtgagggcgagtgcggagacgttcatggtcatgaagaccgtggagagcgtgttgttgaagccgatggtctccatgccgtgggcgatgccggcggcgaagatctggaacggggtggaggcaacgcccgcgttgagggcaccggtgccggaggtgttcatctggctgaacatgatgccggcggtgacgatggcgatgacgccgacgaaggactcgagcaccatggcgccgtagccgacggggagcatgtccttctcgttagagacctgcttggaggaggtgccggaggacaccaggctgtggaagccggagagcgcgccgcaggcgacggagacgaacatcagggggaagaggtactggccgttggcggcgagctttgtcatggtggcgctggaagcgaccatcggggcggtcatggttgcctggcccctgacgccgagcgcgaagatgccgaacacggcgcagacgatcatggtgaccatcatgatggtggtgaggtagtcacgcggctgcttgagggtctggatcggcatggcgcacgcgaagaccaggtagaccatcacgacggcgatccagccgttggcgctgaggtagatggggaactgcatgccgacggcgaacatgaggacgatcgcggcgacggccacggcgaactcctgccagcccttgaggttgaagcgacggcgcagccagccgaaagcgatggcgacgaaggtgaagaggatcgagatcgtgccggcgcagccggaggcgtaggacttggtgaagtcgacggcgccagaggcggtcggggtcatcgcgaacgtgccggcgaccatggaggtgaaggcggcgatgacgatggtgcagaacagccagctgaagagcaggaacaggcgacggccggtcttgccgatgtacttctcgatcagctggccgagcgacttgccgttgttcttgaccgaggcgtacagcgcgccgaagtcatgcacggcgccaaagaagatgccgccgacgaggacccacagcaggaccggcagccagccgaacatcatcgcgacgatggtgcccgtgacggggcccgcgccgcagatcgagctgaactggtgagagaagacggagaagcgagaggcgggcgagaagtccttgtcgtcctccatgcggcgtgcgggcgtgagtgccttgggatccacgccccagctcttggccagccatcgaccatagagcgcgtagccggcgacgagcgccacggccgcgacgagtattaccagcattccgttcatgtgaaactcccttcgggattcaaacaaaaaagtgggaccgcctggcaagcatccaagcggccccacctgatacgtcagccgcccgcgaacgaggccgcgggccggctcaccaccgactcgcgacctagctaataattacctctgctagcgtgctgacgcccatgttcgaatctcctcataccgggtgcgccgtctgcgcacctcccttgcggtacgcgaccataatcgaccttgcggcagggtcaggtccccaaaatccaccatctgaaacacgcggttaacgaaactccgcaagacccataacgctgaacggtcgccaattctcgccaaacggggaaatgcacatgtagttgtggacaaatcgcgaagggtggcgacgcggccgtgacggcggtgccacgacgtggcagctacgaaaacgtttgcggacgcgtctgggggccgagaagtgccacggcgcgcagtgctgctgccacgttggggcatccgttggctagttgatgccaaggagggcggccgcgtttctccaccgggcgggctcgagcgcggccgcgtgcgggcccgcgaagagcgcgagcgccttctgccgcacgaggggcgccggcgtgtagggccagtcgctcccgtagaggaggtgcgaggggtcggccaccttgaggagggcgtcgagcatgacgggctccgcgtcgccggcgaggtcgaagtagagggtgcggacggcggagagcacgtctgcgctggccatcatgcccgcgggcacgagcacgcgggatatgccctgcatgcggtggacgacctcgggaatgaaggcgccgcagtgcggaacgatccagcgcacgcgcggatagcggtcgagcgtgccgctggtgatgaggttgagcacggcgcgcgtggtatcggccaggaactcgaagacgggtgcgtgatcggccgcgaactggccctgcggcacggccgagggcttggcgggatgcaccacgacgacggccgatcgggcgtcaagctccgccatgagcgggtcgagccgctggttgcccaggtagacgccgcacgcgttggtggggagcttgacggcgagcgcacccgggagcgcaagcgcgcggcgagcctccgtgacggcggcggtgacgtccggcacggggagcgtggccacgaagccatagcgggcggggtcggccgcgcagaggcgcgacgcgtaatcgttcagccggcggcagagccgcacggacgcggcgtcgtcaccccagttgacgtgcggcgacgatatcgagaggagcgagaagccaatgttcatgccgtcggcgaaggaacgcgcgtccttctcgccccactgtggcgtggggaagccgtcctcgcgcgcggggtcgattccggccgcagcgagcgcgtccaggtagaccggcgggaggatgtgctggtggacgtcgaacaggcgcggcagctgcggggctgccgccggctggctgggcgcgggctgccggttgggcgcgggctgccggccgggcgcgggctgctggctggacgcgctacttgaagtcgacaccgggattctcctcgcggatgtatcgcagggcctcgtcccactgctcgcgaaggacctggtcgcgcaccttggtgcgacgcgacttggcccacgcgtagacgctcttggggctctcccccgcatccaggcggtcgctcaccaggaagaacgggtcatcgtcgtcgaagaagtcgtcggacatggggcacctcgctgtcgcattgggttggtacgcaggtcacacgtccactatagcaatgcgcgacgcccccgcccgacgctgcagacagctgactagggtttcactgtcagcgtgacggagcgcgttgttcgatgacaataaccagctcttgcattcagccgaaggaccccaagcctccgcactacgcaacgaaaccgaaagacgactaagcgcagaaaacgatttctgcgcttagtcgttcgggccaacgaaatcaaatacggttaccgtgcttaaacgcactgaaaccgtctaacgcccgtgactagcctcgcctcgtcattcggcgacgcacagaatccgttttctgcgcttactctattaacggtttcagtgcgtctctgcagctccccgagcggagcagccattcatgcctcacaaccccagccgttccgtgaggctccgcggacagccgtctttaggtaccacagcgcagccaaacaagctagtcgcaatcgagcgtctacacctgaatagataatgtaaagcaacgtgtgaaataagcattccatgtgcaatatggcattttttacatttatctttttatattttcacattgccatgacattcccgtatgtggcaacatatccgcatggagatcgtacttgcagacatatcagcactgaggcagattcgcgaggcgcgctgcagcggaaagatgatcagcccacttccgctgccaccgtcagacgagatggcgactggggcgagacagctagacaggcttaaagccggagacctcgcaaccagggaatctcccgcgcgaatcctcgtaccaagcggaacctcacacaccaggtcgcagagagtcgtccaatcggagtggtccctcccaacggacgagaacgccgtcgcccagccagacatggtcttccgagtgcgtcccaatgtggtcgcactcacgccaccggcatgtgccctttccctcgcaagatcatggccagtagagtggcttgcgctcctcctcgacgagctctgcggctgttactcgcttacaccagatgggaacgccttcatcgaaaccacgcccgcttgcaacttggattcaatccgcaagttcgcccgtaagatgtgcgggcagcatggcatcaaacgtctttctacagcaataaaacttgctgggaatggtgccgcatcacccttcgagtcccaagtacacgcctggctctgtcaaaacgttaggcgcggtggtttcggcattccccagcccctcctcaatgccactatctacatcggcagcggctatggtggcggcacagctggcacacagtgccgccccgacctctattggcccgacgcgcgcttcggtgtcgagtgtgacggagcccagcacaacgacccgcttcaaagtgagcaagatgccctacgttccgttcgcctttccaacgtggggattcacgaggcgcgcatctcggtcaaggcattccacagcctcaatgcagcttgcgactttggcatgtcagtcaggactgagctcggcctcctcaacccagtgaacacttcgggcaaccctcaccagagtcactttgagctctggaagtcgctcgtccagtccccctgggaccgcgttcaccttcgtcggccttagcttcgtcgtcgtcccatacgttccccatatgggaacgtcatctaacttgtatttttcatatcgtgcgaaagcgcttacattcaagtgcaaaagcaacgccaaccacaggaggcttcgtatgattctcggaatgggcgcgcccgaactcatcctcatcgttcttgtctgcgtcgtgctgtttgggcccaagaacctgcccaagcttggcacggccctcggccagacggtcaagaacgtccgcgagggcatggaggagacgccggacgagaaggacgatgccacgtcgcaggcaaccgcaagccaggacgcagccgccacgtccgccgattccgacgctgacgccgcgaccaagacctgccccaactgcggcgccacgctcgcggccgatgccgcgttctgctcccactgcggccacaagctcgaggcctagccagcaccgccggcagcccgtcggcagccccgccaaccagcggcaacaaccagccctccaaacaagcgcccgcccggacatcacctcgtccgggcgggcgcctcgctatctagattcgcaccagcggccgcagccagcactcgcgcgccccgccgcggccgcgggccctactcctgctcttctcccgcgtatgccgcgtcgaacatgtccacaaaccgctgcgccagcggagaaagctcccggtcctccggccacaccacggccatgcgggtcgtcagggcgtcctcctccacgcgcttcacggtggcggaccccaggttcaccaaggacaggaaggattccggcaccagtccgatgccaaaccccttggccgaccacacgcaggtcgtgcgcgcgtcgtcgtttacgcaggccacaagctcgtgcagcccctggccgtcaaacaggctctgcagcagcttctcaaagcgccggtagatcaccagcggcttgccgctcagctcggacaggctcaccacgccgtcgcgcgcgccgcacgccatgttgggcgggatgatggccgccatgggctcgggcttggcatagtggcaggtcaggccctcggtcgcaaacggcgtgcggaccacgcccagctccaccacgcggcggcgcagcatctccagcacctcgtacgtgttgccctcgcgaaggtccaggctcagcttggggtagtcgtctaccagcggaagcatctcgcggttgggcacctgcccgccggacgagctgatgatccccaccagcagcgtcccctcgcgtcccaggcccacgtcggaaacctcgcgcgcggtcgagctgcacagccccaggatcgtggtcgccctggagtacagcacgcgccccgcgtccgtgaggtccacgccgcgcggccggcgcacaaacagcttcacgcccagctcgcgctcgagcgcggccacctcgtgcgagagcggtggctgcgtgatgtgcaggcgctttgccgcggcagttatcttgcgctcctctgccacggccacaaagtactccagttgcctcaggttcacgggtgcctcccagctccggggccacatcgtgccccatcatacacggcggggagaagaacgtgcccccatgccagccacttttcacaacgggcaacctcgcgcttacctgcagctaaaagatcagcggcgcgccgccgaagccctccttgtccacggcgtccgccaccgcgttgatgtccgcgcgcagccacgccgcctcgcggtcagattctgccgcatcctccgcgcgggcctccgccagccgagccgcctccgcgcgaacctcccgcggaagctccaggtagcggcggtagcagctcagcgcgcgcacggcgtcgcagctgcagtatgcggggtcggagcacgcgcgctcctccaggccgcgcagtccgcacgcctccacgcgcccaaagaagaacgtgtccaggtacgtccacccgtcgcgcatgtggatgcccgcaaagcgcagcagcgcgcacacgttgcccagcgtctgcttcatgtccgggtcgcggttcacggccaggtagccgatcacggcctcaagcagcagctcagcgccggtaacgctgcgagtgtcgcgcacgcgccagcgctggtagtgcgccaggcggcgcgccagaagctcgcggccctcgggggtcgccgcagcctcgctccagcgcgcgccggcaacggccccgtccacagcggatataagccgctcgttgggctcaaagcggctcgtccccgcgggcaacccgtccgcgtcagagccaccgtccgcagcgtcgtcctcagcgcaggccgcctcgtccttctcccccgccgcgtcctcgtcaaagtcaaacgcaaggcagagcttcccgtcgtcgcccacgtccagcgtcgcacggttcacgtccgcatcggcgtgcaggcgcaccgtggcctcggcctcaaagtggttggtaatctggtcgatgcggcgcgcgcccaggccgctcgcgtgggcctcgcgggcgatcttcccggcggcagcatccgttatcgcaaactcacggccagcacccagaaggttgctcacgcgacgctccaggctgcgctcggagcccttcacgatccgccgcaggctctcgcaagagagcgagggcacgcacaccacggcgccaaagcgacccacaaactcgggcatgaagccccagctcaccaggtcctgcaggttcatgcgagagcgcagctcgtcgggggtcaggagccccggagcgaccttgtcgccgtccccggcaaccgcgaggccgcccgcaagcaggcgcttgcgcacaatgtcctctatccccatgaaggcacccgcaaacacgttcagcacgcggcccgcgtcgagcgtcacctcgtgctggccctgggcctcgggcgcaagctccaggcgcccgccgtccagaagcttcaagaagttgccctggctgtcaaagctccggccgccctcgcgcgtcttgcggaccagcttgtcggcctcgtcccaaaacgccagcacgggcctgccgtcgcccctgcccatcacgccggcaacgcgacgcagctcgctgctcacggagtcgccaacccaaccggcgccggtgatgccgctgcagtcgatgctcacgagctccagccccatcacctttgcaaccaccttcatgatgaagctcttgccgctcgccgtgctgccgctcagcatgaaggcgcaggcacgcggaaggtcaaggtcgtccacgccacgggcgcgcatctccatgcgctgcaggcacgagtacgtcagccccacgacctcctcgagcacggcgtcctggcccaccacgtagcgcttgcactcgcgcacgacctcgtcgcgcggccgcgccagcatgcgctcgatcgcctccacggaaccgcccgcgtccgtcccgaaaccactcgctcgcacgtccgacataccaaggcctcccagcttggcgcaatcgcgccacccacacacgattatgccccgctccggcgccaccaaccatcccgtccgggcgagaagaacgtgccccctctgccgcagacaactgccagacagaaggttctaccgctggaagatcacgtcgttgtggtactcgataaagtcgcggcgaggcttcatgcgcgtgggaagccgcatctcttgcttgtcaaagccccacagccactcgctgcgcggcccatccttgggaaccttaggcgagacgcgtatgcgcatgttctcgtcaatcgtcatgagcccctggtcaaaggccctgtcgtgcagcgcattcagaagcagcccgttatcgggcgagaccttctccctcgcatctgatgcagcccacggttttatgtggcttgcaacaagaagcttgtccatccccatgcctgtaaagcagcagtggtggtcgtagttctccatcagggaattcctaaagtagctctggttcacgcgaacagtcgcttcgacaattctgtcgtgaccctcgggctctggcatgaacaggtagcttacgctttcacctttgttgttgatgccgcccattcttgcgtcaagctgcgagactgcctcgaacatcaagtcgtttccacgcgcatcgtactcaacccagatgtcagcgtcgaaatgactgccatttttcagtccgaccccctttcgcatggggtcgtgcgccttaagatttgccagcttcaggctcaccgacgagggagaccgtcccaatgcatccgccagcgcgataacatccttgttcgtcttgacctgctggttcgacggcaggcagaagtacagggcaaacgcggcaagcgtctcctccctgctccacttctccccagcagacatacagcacctcccgcttcatcacccgtccaggctagacgcgggaggtgcattcgtttccaatgatccggcgagaagtacggcaacccttggtagccggtcctactccacttccttggcaatctccttgccgatgcgatacggaataccagtcacgagcgcgttgcccatgcagaacgcccgatgaccatccgtcatgcccgtatcggtccatcccttggggaagcattgtagctgatcgagctcgtcgggaacgagcctgcgcatcctaccgtcttcgcacttgatgatgtgcttgaagcgcgacggacctgaaccgccctcgcccgtgagaatggttcgcgaaggattctctggcagatcggggtatgccattgatccctccgagtacgtgtactcgaatccagtcttcttgttcacgcgcttctcgcgctttgcgcccttgagatacttccacctgggaagctgctcctcaggcacgaagaactgctcaggcacctcggtctctggcacgagcacgtcacccaggcagccaagcttgccctcataggtttcccgcacgtcacaggtgaggaccttcctccccaccatcacgccacggtcgtggaacggagacctcttgagcctttcctcattgaagtgaagagtggtctcatacggatcatccggtatcgcaacctcgtacgtctcttcctgcgttgcgatggggaatgccctcgcaatcacgccattgaagagcctgccctcgacatcccagtccgcctcgcgctcagcaaatatgtaaacgcgcttcctcctctgcgggaagccatacgcgccggagttgatgacctgccactccaccgagtagcccagcgtagcaagacagctgaggatgattgcgaagtcgcgcccacgctgagatgcgggtgactttaacaacctatcgacgttctcgaacaggcaatactgtgcgttgtcatgcgacttggagagctgaatctgcaggaagcgatagatgtcccaccaaaggacacccttcttcccttcaataccgcccgcctggctcagcggccgtgcgacgctgtagtcttggcacggaaagcctcccacaaccatgcggaccgaagggacatcacgcttcccctcgtcaacttcattaagaactttattaatatcctcgttcacgatggaaccagcaccaaagcgttcctcatagcaccttgcagcgaactgcttggtcgcggttcctggtggctcccagttgtttgcccatattgtcttgaaggggccagaagcgggcatgtcaaactcgggatgctcgtcgctgtggtagccatcgagccccagtctgaaaccgccgacccccgcaaagagctcggcaatcgtaatctcttcggacacgtttctccaatcgctgctgtgtccaataatgcgggatcaatcttaaccgatcgacaggacatttgatagcgaccagcaccgccatcttggctcgtcagcaagcaggacgtttcgcccttctcgccttcgcgatttcctcagccacatagcccgcgttcaaccagaagcacttcttcacgacgggaggtccgtaaggctgcggctttgtgtcacttgaatcacgaccatgaggacgcacgtggcagcagtgattctccgtactcttaactgagatgtcagccctaccgttcctgacgttccgcctcatctggtcgtagcagctttttgcttcgggaaagtctgactctggcatctgccacatgattacgtccctcaggcggtactcgccaccgtccttctcgtacaacacgaagagatacttctgctgcaggtagccgtaaaagtcagatgcatcgaagtctgtgtctagaagcttgtagtagtcaaatgcaggaaatgagactgattcctttggtcttccgttagcctggaggcgtatggtcttgggtttggcgccagccttgacgagctcgtcgatctccgtcccatcgtccccgcccaggatgcggttggtaatgcgcgcgcagagattcttcgacttggagaggccgaacctcgcccgaagttcttcctcggtaagaccaaagtacggcttgaaacgctcgcgcacgagctcgacaaggtccatgtcacgctcggccgccgacctttcaatccgctgcctgcgttggatgaggccgttctcgatagccgtcatgtaggatgccttgagcgcccaggcgcgcggctttgccctcacgctggagtagggctgatccgttctatcggttccatgtgccgccttggtgcatgcctcaaggtactgcgtatccgagccagagatgtcctccgcatggccagaccgcaccttgtttacgacggtctcccagtcatgtcgaatctgcggcaggtcctccttgggaatgcgccagagctcggtcgagagaatcttgtagtcgagctggtctacgcccttctcccataggtacgtgatcagaaggacgttcttcatcttctgcatcatgtgactgtgctcgaagtcctcgttcaccacggtcatatagtcaatctttgatatgacgaggcgctccttggcgacaagcttgttgccacgtaccttcttcatcggtgtgaccttgagctcgaggtcagcttcgctgaagtcaggctcagggttgctgtttggcttgtacttgaagtagtactcctcgatggcgttgccgtagatgccccgctgaacctttgtgctcctgagctcgccggcgtccgtcatctcgcgaagcgtgtgcccgcgaagcttacccgcgtattcgacaatcgagtcgatgctgtacttgtcgtatggcagagaatcctcgctcattgcgcaactcccgaatgctcgtgttcaatgtctgatcgtgcagacaactgcaataacgatacgacacaacgcccgcggctttccttttacacccgggagcggctaggccgcggcatcgcaggtagtccttctcgcccgtgcggagctgatagataattgaaaggagaagaacgaggtcctctgggaggcagcgttggcggtaagacggcacaaaggcgtggtgcgcgggcgcgggacggccgtgctcctggcgctggtgctggctgttgggccgatggccgtggcgacgggctgcaaggcaagtggcagcgcggacggatccgggtcggatgccagcacgtcgagcgtggccaagggcagctcgtccgcggccaagctgccggcagacatcggcaagcacctgccgtacaagggcatgccagaatccgccatgaacaagacggggcttggcccgtacacggacatgatgaccacgccgcatcggggcgaccaccgtcccatgaacacgtaccgctggtttgcccacaacggcaccggtgacctggtgttctttacgtactgcctggacggcaaggtgctggacgccatcaagaacccgccgagcgtgttccagaactactgggtggaggggcaggagcttcccaacctggacgcgagcggcgcgtacccggacgggaccatcgggcagacaattgacatgagcctgccctcgggctcgggctctggcagcggcggcaactcgggcggcggctctgggagcaactccggatctggcagccagacgcaagcccagccgcaaacgcagggccagagccagaaccagggcacgggccacctggacccgcagcagtacgacacgccggaggactacgcggacgcggagcaccagcacagcgggatggactgggacgaggcctacaaccgctggctcgactacaacgagtagctttgccaacgctgcacgagcgccacggcgcggcaggctacagccaggtggaaagcctggtcgcgacctcatcagggtagtcgcgcggggcgttgtggccgccgggcagccgcatgaggtccgcccccatgccacgtgcaagaaagtcctggttgcgggcgtggtaggtggacgcgctccgctcgctcatgcacaggagcacgggcacgccctgcgcgcggatgcgcgcgaggtcgggcttgtaggcgagcatccagccggcctcgtggtccgcgtgggtctggacgtcgcgctcgcgaaaggccagctcgtcctgggtaaagggacggatggcgtcgcccatgttctcgcgctcgagggcgagcatgaagagcgtgctcgtgtggcccttggcaagggcctggcccgcgcgcacgaggttctggaacacggggtcggccgggtcgagccccacaaagagcggcggctctatcagcaccaggcgacgcatcaagccaggcgcaagctccagcgcccgcatcgccacgagcgagcccaggctgtgcgccaccacgtccgccggggcgcctgccttgcggatgattgccgcaaggtccgccgcctgcgcgtcgagcgaccagtcgccgtcgagcgcgtccgagctcacgccgcagccgcggcggtcgtacgtcaccacgcgtcggccggcaaacgcggacgcgagcccaccaaagaagctgccgtccaccccggccccgtgcaccaggacgagggcgcgcccttctcccccgcgggacgtgacgtgaatgcgcgcggagggacgtccgtcgcgcgtgacgtccagcatgccgtccctggctgccgccgggctgcccagtgcgtccaaagccatgtgcaagacttcccctctgccggcgccgctacgcgggatagtggttgatgaagagcacctttgccacgcagtctcccacgtttctgtactcgtggcggcgggatgagtcaaagcccaccatgtcccccgcctccagcgtaaaggactcgtcgcccagcacaagctgcagccgcccctcaaaaaggtacacgtactcgcgggagtctgcgcggtggccctcgctcacgtggtcgcagcctggatcgaactcgccctcaaacagctcaaagtcgcggttgtctgccacgttaaagtacccgtggatgcagtagtggccgtcgtcgtccggctggacgctggtctgggagcgccgcaccaccgtggcctcgggctggcgctgctccagcagggtggaatacggcacgcccagcccggtggatatcttcatgagtgtgttgatggtggggttggcgtcgcccttctcgatctgcgagagcatcaccttgctcacgtcgcacagcgccgcaagcttgccgagcgaaagcccccgctccgtcctgagctccctcaggttctgggctatcacgtcgccgatctccatgctcttctcccccacctgccgcgacgcacgcccgcgtccgtggcctaagtgttaattatctttttcggtcgttaactatacttgaatttctggttaacgttcgtaagctatatcttacacgtacctttagcggtggagaaggacaggcatgccaagggaaaccaagaacacaatcgcgcgcgccttcagggcggcgttccccctcacgctgcccgtgcttgcgggctacttcttcctgggcatgtcgtacgggctgtacatgcactcccttggctttagctggctgtggcccacgctcacggcggcctttgtgtacggcggctcgctcgagtttgtgctggggtccatgctgtgcgcgcagttcaaccccgtgaccaccgccgtgatggccgtggccgtgcagctgcgccacacgttctacgccatcacgcagctgggtcgctaccgcggcaacggctggaagacgttcttcctggtgtttggcatgagcgacgagacgtttgccatcaccagctccaccccggcgccggagggcgtggacgagggctggttcatgctgtggatcacctggctcgaccaggcatactggatcgtgggctccgccgccggcggcatctttggccagctgatggccttccccacaaaggggctctcgttcgtgatgacggcgctctttgtggtcatcttcctgggcgcatgggacaaggcgcaggaccgccgacccgcccacattgggcttgtctgctccgtcgtgtgcctgatcgtgctgggacccagcaacttcatggtgcccgccatggcctgcatgactgcggccctgctggtcatgagggagcttgacgcccgcgccgcgcgcgcccaggccccggagggaggcgacgcccagtgacgctcgtgcaaaagctcataaccgtggcgatctgcgtcgcggggaccatgttcacgcgctttctgccgtttgccgtcttccacggcaagagcgagctcccctcctgggtggactacctgggcaaggtgctgccgctcgcgctgtttgccttcctggtggtgtactgcctcaaggacgtgacgccgcttgcgggctcgcacggcatcccggaggccatcagcatcgtggtggtggcggcgctgtacgagtggcgcggcaacacgctcgtgtccatggcggccggcaccgcgctctacatggtgctggtgcagctcgtgtttgtgtaggctcaggcgagaagaccgaccagcctgtcccgtacctccttcgccacggcaagcttgtacatgagccgcgtaggctggggctctatctgcacgtggaagctgtggaccttctcgcccgtctgcgtggcgtccttggaaaggcagatggcaaagtagacgttgccgggctccgacgccgccgcgttggctgggtccacgttgcccatggtgcccgtgacgccgatgcctatgtttgcctggtaggacctgcggcaggccgtcgccatggcctcggccgtctggagcgaatacacggtgtgggtcgctatgacctccgccggcacgccgttcttgattttggcttcgttgcagtaggtgacgtaggcgcccttgagcaccgcggaggcgccctccgtgtccgttatgagcgaggcgatctggccgctcgtggcgctctccatggtcgtgatctggagcccccgcgctatgaggagcctcgtgaggtccgcgtactccgcccggatctgcgcctcgtcgtacaccttgcccgtagctgcgcctgccatataggcccctttcgacggcatcctgcaaacgcttccaagggtagtcccaagccagccgccgcgcgagccacaaaatgccaggtaagacgcctgtacgctgtatttggtatgttttctacaattcatctacaacatatagtgcctagctggtagcaaatgccaatatatggccgcgggcggttgtcaagctcaggcaagtggagattgtccgtctttcgcaaaatgtatcaaagaaatttttttgaagcaccttccgaatgagcgttgaatcacgcaaatttctgacctgcgtctacagaggttttcatcatgactttcgacacctttgaaacgctagggaaccatatctggtgttttcaacacggacgcggcccaaccagttgtggcatagtgtgttcacgacatcaaacgcagcagcaaaccacgagacagacgcgtctgctggcgcgccttttttagggccaagctgcacgtttacgatacggagccgcgcccagcgcggtggcaggaagacgagaggcgagggcatgaagatcatcaagaggaacggttcagaggtcgagttcgacgttcagaagatcgtaaacgccatcaaggccgcaaacgccgaggcccccactgaggagcagctgtccgaccgcgaggtcaagttcgcctccctcaacgtgcaggacgagtgcgccgacgccggtcacaccgtcaccgtcgaggaggtccaggacctggtcgaggaccagctcatggcgctcgaccgcttcaccgtggcccgcaagtacatcatctaccgctacgtgcagagccagaagcgccagaagaacacgacggacgacaagatcctgagcctcatcgaagccaacaacgaggaggtcaagcaggagaactccaacaagaaccccaccgtcgtctccgtgcagcgcgactacatggccggcgaggtctccaaggacctcaccatgcgccagctgctcccgcaggacgtggtcgaggcccacgaggagggcatcatccacttccacgacgcggactactacgcgcagcacatgcacaactgcgacctcgtgaacctggacgacatgctgcagaacggaacggtcatcagcggcaccatgatcgagaagccccacagcttcagcaccgcgtgcaacatcgccacgcagatcatcgcgcaggtggcctcctgccagtacggcggccagtccatctcgctgtaccacctcgccaagttcgtggacgtgtcccgcaagaagatccgccgccaggtctacgccgagatggaggccatcgacgcgcaccccggcacggacaagatcaaccagatcgtggagaagcgcctgcacgacgagatcgcccgcggcgtccagaccatccagtaccaggtcgtcaccctcatgaccaccaacggccaggcgccgttcatcaccgtgttcatgtacctcaacgaggcccagaacgcgcaggagaagcacgacctcgccctctgcatcgaggagatgctcaagcagcgctaccaaggcgtcaagaacgaggccggcgtctggatcacccccgccttccccaagctcatctacgtgctcgaggacgacaacatccacgaggacgacgagtacttctacctcacgaagctcgccgcaaagtgcacggccaagcgcatggtgcccgactacatctccgagaagaagatgaaggagtacaagctctccaagggcgagaccgagggcaacggcgacgtgtacacctgcatgggctgccgctccttcctcacccccgaccgcaccggcaacggctacgacaacgtggcccgcgccaagaactacgacggcaagcccaagtactacggccgcttcaaccagggcgtcgtcaccatcaacctgcccgacgtggcgctgtccgccgaccgtgacgtcgacaagttctggaagctcttcgacgagcgcctggagctctgccacaaggccctgcgctgccgccacgaccgtctttgcggcacgctgtccgacgccgcgccgatcctgtggcagtatggcgccctcgcgcgcctggacaagggcgagaagatcgacaagctcctgtacggcggctactccaccatcagcctcggctacgccggcctgtacgagtgcgtaaaggcgctcacgggccacagccacaccgaccccgagggcgagaccatcggcctgcagatcatgcagcacatgaacgacaagtgcgccgagtggaaggcagccgagaacatcgactactccctctatggcacgccgctcgagtccaccacctacaagttcgccaagtgcctgcagaagcgcttcggcgtcatccccggcatcaccgaccacggctacatcaccaactcgtaccacgtgaacgtgcgcgagaagatcgacgcattcagcaagctcgccttcgagtccaagttccagcgcctctcccccggcggcgccatcagctacgtcgaggtgcccaacatgcaggacaacctcgaggccgtggtcaaggtcatgcagttcatctacgacaacatcatgtacgccgagctcaacaccaagagcgactactgccaggtctgcggctacgacggcgagatccgcatcgtggaggacgacggcaagctcgtctgggagtgccccaactgcggcaaccgcgaccagtccaagatgaacgtcgcgcgtcgcacctgcggctacattggcacccagttctggaaccagggccgcacgcaggagattcgcgaccgcgtgcttcacctctagcaccacgcacggggcgagaagtaccaaccacgcggcgggcccccacacggaggcccgcctcctttttgcgccacggcggtggcggccagacgacgcctggtctaccatggacaggtttggcccgccgcggcaccagcgacatgccagacggaacaacggacgcgaccacgaacgaggacagaggcccacatgaactacgccaacatcaagtactgcgacatcgccaacggtatcggagtgcgcaccaccctcttcgtgtccggctgccgcctgcactgcaagggctgcttcaacgcggaggcgtggtccttctcgtccggcaagccctttgacgaggccgtggaggagaagatcatcgacagcctgcgtccgggctacatgaacggcctctccgtcctgggcggcgagcccttcgagcccgagaaccaggccgggctcgtggacttcatcgagcgcgtgaggctcgagctgcccgagaaggacatctggatgtactccggccacacctgggaggagctcacggcgggcaagtggcacctgccggagaccgaccgcatcctgcgctgcatcgacgtgctggtggacggcccgtggcagcaggccaactacgacatcagcctgcgctttaggggatcctccaaccagcgcctgatcgacgtgcccaagacgctcgaggcgcgcaaggccggcaagctggccgggccaaacgacgtggtcctgtgggaggacgacccggttttcgccacccacgacatgtagggactggcacacaacacgagcgtatgacacgggcgggggcgtcggctattgccgcgctcccgctcaacctttaggctctcttgcgctacatttagacgaacatgaacccacgcgagggagcacacgatgttctgcaaaaactgtggtgccgaactcaagccgggaacgcgcttctgcccctactgcggcgtagcggtcggcgcggacgcggacacccccgacgcggacggcgcggccgacgccgatgacggccgtggcgacgacggcctgagcgacggcctggataatgatgacggcctcggcggcggctcgtacgaccccaacctgacgcagcccatgcccctgggcagcggctatggcgcacaggcaccgcggccggtcccgcaggagccgcacgaggctcccccgcagcagccgtacatcccaggcgcccgtcgcaaccgcgactacggcgactatggcgaccgcggcaatcgcggtcacggcggcgccaaggcggcgctcgtggcgctgctggtggtggcgctctgcgcggcggcggccgcgctcgtggtgttctacgtgctgcctagctttggccagggtgggaacgccaccatcgccaagtcggacgactcgagctcgtcagacagcagcaagacgatcacgctgggacagtcctccggtgacgactccagctcgtcggactcggagcacgttgggttcaagggcatcaccaaggccgaggccacctcgaccctgcccacggaccagtacgacagctacggcacggaccacctgatcgacggcgacaacaccacgtgctggtccgagggcgtcagcgggctgggcgtgggcgaatccgtgacgctttccggcgacggcgtgcagaccttctcgtcctttaccatcgcgaacggcttccaaaaaagcgaaagcatctattacaagaacccgcgtccgaccaagctcggcgtgtttgtggacggcaacaaggtgatgtccgtggaccttgcggatagctttggctcaacgcagagcttcacgctgcccaagcccgtggacggcaccaacatcacgttccagatcgaggccgcgacgcctggcagcaagtacgaggacacgagcatttccgagatcacggtccagtagcgtgggcgcgcaggccagggaggcagcatgccggaggagaaggacaacatctgggccatggagcaccgccactccgtgcggcgctacacggaggagccgctctcccccgccgaggtggaggcgctgtcgctggccatcgcgcgggccaacgacgcctccggcctggccctgcgcctggtgacggacgagccgcgcgccttcgactcgctgctcgcgcactacggcaagttccagaacgtgcgcaactacgtggtggtggccggtcccaagggccgcgacctgcaggagcttgcgggttactttggcgagaagatcgtgctcctggccacgaggctgggccttggcagctgctgggtgggcgggacgttccgccgcaggtccgtggcgggccaggtggctcccggccacaagctggcgtgcgtgatcgcgttggggcacggcgcggagccggggcggccgcatcgctccaagtcgatcgaggagctgagcaacacgcacggcctggtgatgccggactggttccagcacggcatgcaggccgcggctcttgcacccacggccctcaaccagcagcacttcctgttcacgctcgggcgcgaccgacagaccgtcacggcgcagtccaccggcggccccatgagcatgatcgacctgggcatcgcggagctgcacttcgagctcgcgagcgggcacgcagtgagcggcagcgcgccggcgcgcgctactgggccagcagccccagcctcacgcacgcgttgaggatgccgtcgtggtcaacgtcgtcggtcacgaagtcggcctgctccttcacctcgtcgttggcgttgcccatggccaccgtcgtgccgcacacgccaaacatgcccaggtcattgccgccgtcgccaaaggccacggcctcctctggcgcgatgccgtacatgtcgagcaccttgcgcacggcacggtccttaccgccgtccttggggaacacgtccacaaactcgctggtccagcgcgtcatctttatgtggctgcatgcgttcctgacgatgtccgtcttgccgggctccaggaagacgttgagctggtagatgtcttcctgcagggccttgtggatgtcgtcctcgggatagtaaaggcccaccttgtgctcgatggcctccacgagcgggtcgtgcccgctcacaaacatgcgcttgtctgacatgaacatgcagttgtacaggccggcctccacctgccccacgatggtcgcgaggtcatccttgtcgagcgtctcctggtacaggatgcggtcgcggttgaggatgaactgcccgttaaagaggatgaacgcctcaaggctgtccagcgggatctcctccaccgtgtagggcgcgcgacccgtcgcgaggaagcacttgatgccggcgcgcttgagcccagatagcgcgagcagcgcggactccggcaccttgtgcgtcgagaaggacaggagcgtcccgtccgcgtcgaagaacgctgccttgatcttgtggtcgacggtccattgtggcatggttgctcttctcccctggtcgtgggttggtgtgactggttgcgattgttatgactggccctcatggccgccacgcggcgcgcgggccttggactgccgcggcgggcgggcgtttgcgaggtagagcaggtgcaggccgcgcagcgtgagcgtggggtccaccacgcactcgtgcgcaagcaggtgcgagaaggacgcggcgtcgtcgccggtgagcaccacgggggccagggcgcccagctcgcgctcgatgcgcgcgacgagcccgtccacgcggatggcctcgcccagcaccacgccggaaagcatcgcctcgcgcgtggactttcctatcacgtggcttggcgccgccagctcgatgcgcggcaggcgtgcggcggactgcgcgagcgcgctcgcccccagcgccaggcccggcgctatgacgccgccggcaaagtggccggccgcgtcgatcacctctatgttgaccgtcgtgcccatgtccacggcgatcgcgggcgcgccgagcagggcccgcgccgccaccgcgtccgcgatgcggtccggccccacctcggaggggtcgtggtagtccatgcggatgcccgtcttgaggcccggccccaccacgagcgcgcgccgctcgcacacggcgtcgagcgcgcggcgccacggctccacaagtgacggcaccacgcaggaaaggatgcagcccgcaatcttgcggctggcttccggcgcgttggccacggccgccgccacgggcgcgggcgagaaggacgcgaactgcgtgacctgcagccgcgcctcgtccgcggtcaggcgccccggcgtcgtgagctcgaaggtgtccagcggctcgtcccccgccgcgccgtcctgcgcaaagatccccaggcgcgtggtcgtgttgcccacgtccacggcaagcacgcggcctgccgaggccgccgcagcatcgtgcgccgcacttctcccctggctcatgggcacctgtttgctcccaacgctccgttgccgacgtctcacctgtatactctaaccgtttgcccggctcgtccggcttggcaaacggtccggtaacccgactccccacgcgggggagcggatatacgcaaaggagctacatatggacaacggcaaggcacgcgcctcgtggcgcggccagctgacgctgcgcggcgccgtcatcggcaccatcggctgcgtcatcatcacggcatcgtcggcctacacggcgctcaagctcggggcactgccctggcccatcgtattcgcggcggtcatctcgctcttcttcctgcggctgcttgggcacgccagcctgaacgaggccaacgtgacccacaccatcatgtccgcgggcgccatggtcgcgggcgggctcgccttcacgctgcctggcgcctggatgctgggcctcgcggaccagtttggctgggtgcagatcttcctggtggccctctgcggcaccgtgctcggcctcatctgcacggccctcatacaccaccacttcatcgtggacacggagctcgagttccccacgggcaccgcggcggccgagacgctcctggcaacggaggcgggcggcaagacgggactcaggctcttctcgtccatgggcatcgccggcctgtacagcgtcctgcgtgacgccctgggcatcctgcccacgctcctgctgcagcttcccattcccggcgtgagctttggcatctacaactcgcccatgatgctctccgtcggcttccttgtgggcctggtgccgctcgcgttctggtttggcggcgcgctgttcgcaaactttggcctcatcgtgggcggaagcgcggccggcctctggtccacggcgaccgcgcagggcatcgtgtccagcctgggcatgggcctcatgatgggctccggcatcgccaccgtggtcaaggacatcctgccgcaggtgggcggcttcctgcgcgatgcccggggcgagaaggacgacggccaggactcgcgctccctcgtgagcggcagcctgcgcacggacgccggcatctttggcctgggcaccgccgccgtggtcgtgctcgtctgcatggggctggggctgagcccgctcgcctccgtcgtcgtggtggcgctcacctttgtcgcaacgatcatgagcgcgcagtcctgcggccagaccggaatcgacccgatggagatcttcggcctcatcgtgctgctcgccgtggccgccatgggcgagaacgtgcaggtcaggctgttcttcgtggcgggcgtggtcgcggtcgcctgcgggcttgcgggcgacgtgatgaacgacttccgcgccggccacatcctgggaaccgacccgcgcgcgcagtggctgggccaggcgctgggcggcatcgtgggcgccgtggtggccgcggccgtcatgtgcgcgctgctggccgcgtacggcccggacgcctttggcccgggcaagaccttcgtggccgcgcaggcctccgtcgtggcgaccatggtctccggcatcccgagcgtgcccgccttcgtgatcggactcgcggcgggcatcgccctctactggacaaagcttcccgccatgatggtgggcctcggcgtctacctgccgttctacatgtcgttcacggcgtttctgggcgccatcgccaaggtcgtgtacgaccgcgccaccgccggcaggcgcgccgcgctcccgcaggaccagcaggccgaggccacggccgagcacgaccgcgccggcctcgtggtcgcatccggcatcctgggcggcgagtccatcgtgggcgtgatcatcgcgttcgtgtcagtcttcgcgagcctggctgggtagcgaccgggcatcgcgcaactcgcgcgtagcttgcaggagcgccgacggccccaacgggtcgccggcgctcttctcatatgtatgtgtccgttggccagcacgtacagtcggcgggagtcgtccttctccccctaggcctcctgcgacgcgacccggctcgcccaccccgccgcgcagtcgcccgtccacgtagcgacctggaacaccgtatgggattgattccacatcgttcggaaacggttccacatcgctcgcggcggtttcactaccgctcaccgtttcattagcggaattccgtgcaaaaacttcccttcgggtccatcctacaggtatgagaacgttcccacatatgggaacaggctcgtgaggtactcggaaagggaggaagaatggctctggactacgcacaggccgcaaaggaggcgctcgaggctgtcggcggttccgacaacatcgtgtccgccgcgcactgcgcaacgaggctgcgtctcgtgatcgcggacgactccaaggtcgacaaggacaagctcgagaacgccgtcggcgcaaagggcaacttctccgcatccggccagctgcagatcatctacggcaccggcaccgtggacaaggtgtacgacgagttcatcaagcagggcggcatctccgccgccaccaaggccgaggccaaggaggccgctgccaaccagggcaacgcgttccagcgcgccatcaaggtcctgtccgacgtcttcgtccccatcatccccgccatcgtcgcgtccggcatgctcatgggcatcatgggcgccctctcgtacatgggctccgccggcatgatcgcgctcgacaccaagagcgtctggtggcgcatcgcgagcctcatcaacgcctgcgcactcggcaacctgcagatcctcctgggcttctccgccgcgacggtcttcggtggcaacccctacctcggcgcgtcgctcggcgcacttctcatcagctccgacttcatcaacgcctacagcgccagcaccgccatcgccgagggcaagatgatcaccctctccgtcatccccggcctctacagcatcgactgggtcggctaccagggtcacgtcatccccatcctcgtcggcgtctggatcctctgcttcttcgagaagcgcctccacaaggccgtgcccgagatgttcgatctgttcgtgaccccgctcgtctccgtctccctcgccgcctacatcacgatcctcttcatcggcccgatcttcgtctggctcgagaactccatcctcggcctgctcatgttcctcctcaaggtgcccctgggtatcggctacatcatcatcggcctcatctacagcccgtccgtcgtcaccggcctgcaccagatgtacaccgccatcgacgtctccatgctcgcgaagtacggcgtgacctactggctgcccatcgcgtccgcggccaacatcgcccagggtggcgcctgcctcgccgtggcgcttcgcaccaagtccgagaagacgaagtccctcgcggttccctccggcatctcctgcctgctcggcatcaccgagcccgcaatcttcggcgtcaacctgcctaagatcaagccgttcgtcgccggcatgatcggctccgcgtgcggcgccctctgctgcttcgtcttccacctggccgccaccggcaccggcgtcaccggcatcttcggcatcctcctgtgcatcgcgcagccgctccagtacatcatcatgttcgccgtcgcctttggcgtggccttcggcatcacgtcctcgatctacaaggacgaggaggccaaggcggggcccgccaagctcgcggcagaggccaaggccgccgctgacgaggaggccgccctctccaaggaggaggcagccgaggccggcgcccccgcagccgccaagcccgagacgctcgtctctcccctctccggcacgaccatgccgatgaccgaggtccccgaccccgtcttcgcgtccgaggccatgggcaagggcatcgccatcacgccctccgagggcaagatcttctcgcccgtcgacggcaccgtgaccgtgctggccgagaccggccacgccgtgggcctgctgtccgactccggcgccgaggtgctcatccacatcggcatcgacaccgtgacgctcaagggcgagccgttcagcgcgcacaccaccgtgggtgcccacgtgagcaagggcgacctgctcatggacgtcgacctcaagaagatcgaggacgccggcctgagcaccgtgacccccgtcatcatcaccaacacggcggactacgccgaggtcaccccgcacgagggtaccgtgaacgcgggagacgcgctcatcgacctcaagtagcagccagacgcacaccgtgggcgggggcggtcgcatgcggccgtccccgccttcagacgaaagggacgttatgaacgagaagagcgtggacacgcgctggcggatggcctaccacctcatgccccccacgggctggctcaacgaccccaacggactctgccagttcaagggcacctatcacgtcttccaccagtactcgcccgagtggcccacgggcagggagcgcggctggggccacttcacgagcccggacctggtgcactgggagcaccacggcatggccatccaccaggacatccccgaggacgcatccggcgcctactccggcggggcgctggtggagcgcgacgcggagggccacgacgcgctcctccggctctactacacgggcaacgtgaaggagccgggcgactacgactacatccacgccggccgccaggccaacgagatcgaggtcacgagcgaggacggctacaccctttcgcccaagcgcgtgctgctgagaaacgcggactatccggacttcctctcgtgccacgtgcgcgaccccaagctctggcgcgaggactccgccgagggcagctaccacatgctcctgggcgcgcgcgacctggacgaccacggccgcctgctgctgtttgactcccacgacggggagaagtggacgtaccgctcctgccccacgagcatggagcccttcggctacatgtgggagtgcccggaccgcgtggtactcgacgggcgggagtacgcgggcttctcgccccaggggcttcccgacgaggagtggcgctggcagaacgagtccaactgcggctacatcgagctgcccgagggcgtgcgcctgctcgacgtggaccggctggaccagcgcgagtttgtggagtgggaccgcggcttcgacttctatgcgccgcagacgtttgtggacgagtccggccgcaccatcctgtttggctggatggccgtgcccgacgttgactacgagtccgcgcccgagggcctgagctggatccactgtctgacggtgccgcgcgagctttcccgcgcgcgcgacgggcgcatcctgcagcggcccgtggccgaggtcgcgtccctgcgcaaggacacctatgggctcgacgcgcgcggcaccacgacgctgccgcgtcaccgcgcggacgtggagcttgcgggcatcacgggcgacgtgcggctcacgctggacgacgcgctggagctcgtgtgcgaggacggcgccgcctacctgcgctttctggacggcgccgtgggcgcgggccgcacggagcgccgcgtgaggatcgatggcgtggcgagcctgagggccctggtggacgagtcggccgtggaggtctacctcaacggagggcgcgaggtcttctccaccaggtggttccccaggagggacgacctgggcgtcacgctcgcgtgcgactgcgcgtccgcccgcgcctggaccatgcgcgacgtgatggccaacacctacactcgatagcagggcggaaagcagagggattacgaacaggaggaggaagccatggcagaagtcactgctctgggagaggtactgatcgacttcacggacgcgggaacctcggagggcgggcagaagctcttcgagcgcaaccccggcggggccccggcaaacgtgctcgtggcgcttgagcgcctgggccacaagacggccttcatcggcaaggtgggagacgacatgcacggccgcttcctcaagcaggtgatggacgacaacggcgtcgacacctccaacctggtgattgaccccaacttctttaccacgctggcctttgtggcgctgtcccccaccggcgagcgcacgttctcgttcgcgcgcaagcccggcgcggacacgcagctggccccgtcggagctggaccgcgacctcatcgcgggctcgcgcgtcttccacgtggggtcgctcagcctgacgaacgagccagcgcgctccgcgaccatgacggcgctcagggtcgccaaggacgccggcgtcgtggtgtcctacgaccccaactaccgcgacaccctgtgggacggccccgaggtcgcggccgggcagatgcgcaccgtcatcccctacgtggacgtcatgaagctttccgacgaggagtgcgagctcgtgaccggcaggctcgagcccgcgatggcggccgagtggctgctggagcagggcgtcaaggtgtgcgttgtgacgctgggagcggacggcgcctttgtggcgacgcacgacgggtccgccgtggtgccgggctacgcggccgacgtggtggacaccacgggcgccggcgactcgttctggggcggcttcctggccggcatgctggagagcggcctcgcccccgcggacgtggacatcgcggccgcgcagggcttcgtgcgcctgggcaacgccgtcgcgtcgctcacggtgcgcggacgcggcggcatcccctccatcccggagcgcaaggacgtggaggcgcttctcgccaagtagcgcacgcgcaaggcaagcgcaggggagaaggacgcgcggcaccggtcgtggcgtccttctcccccatcaccacgacgggctgcccgcggaatccccgcaggcagcccgtcctgtttcgtatcgcatgctgttaccgcagccggcgccgctgcatcggcccggccgcgtgccgtcaggcgctagcgctgcgcgcgctcctggaaggccgcgatgatcttgtcgcccatctgggacgtgcccacgcgcttctcgtccggcgtgtcctcgtccgccaggtcgggcgtgcgccaaccggcgttgaggacgtcctccacggcgccggcgacggcgtccgccgcctcgtccatctggaagctgtagcggagcatcagctccacggagaggatctgcgcgatggggttcgcgatgcccttgcccgcgatgtccggcgcggagccgtggctgggctcgtacagtgcggtgcccgagccgagcgacgcggaggcgagcatgccgagcgaacccgtgagcatggaggcttcgtcggacaggatgtcgccaaacgtgttctcggtcaccaggacgtcgaactgcgacgggttggccacgagctgcatggcgcagttgtccacgagcatgtcctcgccctcgacgtcgggatactccgcgttcatgcggtggttgacctcgcgccacaggcgggaggtctcgagcacgttggccttgtcgacggaggtgaccacgccgttgcggcggccggcagcctcgtaggcccagcgaatcacgcgctcgatctcgtactcggagtactccatcgtgtccgtggccttgtcgcccgcggtgccgtccgcgcccgcgccctcgacgccgtgctcgcgcctgtgctcgccaaagtacaggccgcccgtgagctcgcgcacgatcagcaggtcgacgccgtcaagacggtcctcgcgcagcggcgaggcgtcgcgcagcgcctggtagatgtggacggggcgcaggttgaggtacagccccaggttcttgcggatggcgagcaggccctgctccgggcgcaccgcgccgggggtcgtgtcgttccacttggggccacccaccgcggccaggaggacggcgtccgaggcctcggccgccgccagggtcgcgggcggcagcgcgctcacgggctcgcccgcctcgcgcgtggcgtcgatcgcggcgccgccgatgagctggtcctcgcagcggaactccacgtcgtaggcgacgccgatcgcctcgagcagacgcttggcctcggccatgatctcgggaccgatgccgtcgcccggcagtgtgcagaccttgtacgtacgagccgccatgctatgcctccgcgttcttctgggccatgaggcgcttggtgcgcgccacgaggccgccctcgttgatgatctcctggatgaagggcgggaacggctgcgcctggaacgtggcgcccgtcgtctcgtccgtgatgacgccggtgtcggcgtccacgtccaccacgtcgccctcgtggatcgcgtccacggcctcggggcactccatgatcggcaggccgatgttgatggcgttgcgatagaagatgcgcgcgaagctcttggcgatcacgacggagacgccggcggccttgatggccacgggcgcgtgctcacgcgaggacccgcagccaaagttctcctcggccacgatgatgtcgccgggcttgacgcgcttgacgaacgtggtgtcgaggtcctccaggcagtgcttggccagctcggccgggtcggacgtgttgaggtagcgggcggggatgatcacgtcggtgtcgatgtccctgccatagcggaagacggttccgttgaacttcatggcttcactcccttgtggttagaggtcggacggcagcgcgatgtggccggccacggcgctcgccgcgcagaccgcggggctcgcgaggtagacctcggacgtggggtcgcccatgcgcccgacgaagtttctgttcgtggagctcacgcacttctcgcccgccgcgaggatgcccatgtagccgcccaggcaggggccgcacgtgggggttgataccacgcagtgcgcgttgatgaacacgtccatgaggccctcgtgcacgcactggagccagacgccctgggtcgcgggaatcacgatgcagcggacgttggggtcgacggtgcggccgcgcaggacctccgcggcggcgcgcatgtcctcgatgcgaccattggtgcaggagccgatgaccgcctggtcgatcttgacggagcggctctcggccacgggatgcgtgttgctgggcaggtgcggccaggagacctgcggcacgatgtccgccgcgtcgatcttgatgacctgcttgtacgtggcgtcgggatcggagtggtactccctgtacgggcgctccgtgcggccctcgagccacttgcgcgccacgtcgtcaacctcgaagagacccgccttgccgccggcctcgatcgccatgttcgcgatagtgaggcgaccctcgacggagaggttgcggatggtcgagcccgcgaactccatggcgcagtacagggcgccgtccacgccgatcttgccgatcacgtagaggatgatgtccttggccgatgcgccggcgggcagctcgccctcgacctcgaagcggatggtctcgggcaccttgaaccaggcgcggcccgtcgccatgcccacgccggcgtccgtggagcccacgccggtgctgaacgcgccgatgccgccgtaggtgcaggtgtgggagtcggcgccgattatgaggtcgccggggccgacgatgcccttctcggggagaagggcgtgctcgattcccatgcagccctgctcgaagtagtgggtgatccccatctcgtgggcaaagtcgcgcgtgaccttggtctgctcagcgctcttgatgtccttgttggggctgtagtggtcgggcacgaggaagatcttcgtggggtcgaacaccccggcgccgatctcgcgcaccgtcttgatggcgatgggcgccgtgatgtcgttggcgagcacgccgtcgaggtcgcactcgatcagctggccggggacgacctccgtaaggccggcgtggtccgccaggatcttctccgccatggtcatgggacgtgccatatggtcctcctatctctccttggccgaggccacaagggagtcaacaaactgtcgcgcgccgcgggccgacctgccgccgcgcctcgtggcgaagcgctccgcggcaaggtcgagctccgcgttgtccatctggatgccggcgtccgccgcgagcttgtggacgatgtcgaggtagaccctcttgtccggcttgtagaacgtgaggtggatgccaaagcggtcggacagcgacacgacctcctggatggtgtcgcgctcgtgcacctcgtcgccgtcgcggtcgctgaagcgctcgcgcaccagatggcggcggttgctcgtggcatagatcaccacgttgtcggacttggccgagaccgagccctccaggatcgccttcagcgccgcgaagttgtcgtcgtcggtcgagaaggacaggtcgtcgatgaagatgacgaacttgagcgggttcctcgtgagctggtccaggattgcggggatgtcgcgcagctgctccttgcggacctccaggatgcgcaggccctcgggcgcgagcgcgttggccacggccttgaccgtggagctcttgcccgtgccggcgtcacccgtgagcaggatgttcgctgcgggcaggccgcgcaggagcgcccgcgtgttgtccaggatgacctgacgctggcgctcgtagtccacgaggtcctccaggcgctgcgggtcggggtagcgcacgggcacgatctggtcgcgctccacgcggaatacatggtagcgcgcgtacatgccccagccggtcctgccgatgttctgcacgcggtccgcgtaggccgcgggcaggtcgacgggctcgttcgtgaagcgcggcaggagctcgcgctcgtcgtcctcgctcacgggcgcaagcagctcgtcggccgtgaggttggcgagcatgtccagcgtctcgagctccctggcggccgccgcggcaagctcggcgggaacggcaccgcccgcgccgagctggcgcaggtaggcgttctcgtcgtccagcaccacgttgcgcacgtgggcggaaaggcagccgtcctcggcctcgatcaggctcgacacgaagcgcgcgtacgcctcggcgtacttgcgccccagacgggggttgtcctcgtcgtactccacgatcttctcgcccaggcgaacgcagcgcgcgagggcggacacgaccgggtcgtccagcacgccgcggaacaccgcgagcgacaggaggcccaggtcgaccctgcggagcccgagcgcggtctcctccgtcggcattactcctccccctcgccgagcacggcgccgttggcgccggagcccacgagctgcgcgtagcgcttgaggtagccgtggagctccttcttcttgggcgagaaggacgccatcctgcggttgtactcctcctcggggatcttgagctcgatgcggctgttggggatgtcgatcaggatggtgtcgccctcctcgacgatgccgatcgggccgccggacgccgcctcgggcgagacgtggcccacgcaggcgccgcgcgtggcgccggagaagcggccgtccgtgatgagcgcgacggaatcgcccaggccgcggcccatgatggccgaggtggggttgagcatctcgcgcatgccggggccgcccttggggccctcgtagcggatgacgacgacgtcgcccgggttgatcctgccctcgtcgatggcgtgctgcgcgtcctcctcgctctcgaacacgcgggcgggaccctcgtggacgagcatcttggggtcgacggcggagcgcttgacgacggagccatcgggcgcgaggttgccgcgcaggacggcaatgccgcccgtctgggagtacgggttgtcgacggagcggatgacgtcgtagtcgagcacggggtggttcgcgatgttctcgcccacggtgtggcccgtgaccgtcatgcagtcgaggttgagcaggtccttcttggagagctcgttcatgaccgcgtagatgccgccggcctcgttgaggtcctccatgtaggtgcggccggccggcgcgaggtggcagatgttgggcgtgcgggcggacatcgcgttcgcgttgtcgaggttgagctcgatgccgcactcgtgcgcgatggccgggaggtgcagcatggtgttggtggagcagccgagcgccatgtcgacggtgagggcgtttgcgaaggcctcgcgcgtcatgatgtcacgcggacggatgttcttgcggagcatgtccatgacggccatgccggcgtgcttggcgagctcgaggcgcgcggagtagacggcggggatggtgccgttgccggagaggcccatgccgatgacctcggtcaggcagttcatggagttggcagtgtacatgccggagcaggagccgcaggtcgggcagaccttgcaggcgtagtcctccaggtcctccgcgctcatcttgccggcggagtagctgccctgcgcctcgaacatggacgagaggctcgtcttcttgccgtggacgtggcccgcgagcatgggaccgccggacacgatgacggtcggcacgttgacgcgcgccgcggccatgagcaggccaggaacgttcttgtcgcagttggggaccatgacgagcgcgtcaaagccgtgcgcacgggccatgcactccgtggagtccgcgatgaggtctcgggtgaccaggctgtacttcatgccggtgtggcccatggcgatgccgtcgcacacggcgatcgcggggaagaccacgggcatgccgccggccatggcgacgcccatcttgacggcctcgacgatcttgtcgatgttcatgtggccgggaacgatctcgttctgggagctcacgatgcccacgaggggacgacgcatctcctcctgcgtccagccgagggcgtggaagagggagcggtgagcggcgttgttcgcgccgaactttatcgcatcgctggcgaagtgctcggtctgctgggtgttgtccattggtggcttccttccttttgcgcgcgggcctgccacgcgcggatggtgtccttctcgaccgtctgcctgggccgactagtccgcgagcgagaagcccgcatcctgcaggtgctggcggatgaggtcgatctgcgcctggtcgcgggtctccatgcccacgcgcaggatgcagctcgagatgggcaggtcggggtccgtgaggtcgtagtcgacggagacgacgtttgcgccgagctccgcgatgatgtggctgacctgctcgagctggcccggcttgtccgtgagcctgagcgagagcgtgaccttgcggccgctcatcgcgaggccgcggttgatgacgcgggacaggatgttgacgtcgatgttgccgccgctgaccacgcagacgacgcgcttgccctggacgggcagatggccgaacatgcaggccgcgaccggcgtggcacctgcgccctccgccacgagcttctgcttctccatcagcgcgaggatcgcggcggcgatctcgtcgtccgagacggtcacgatgtcgtcgacgtacttcttcaccagctcgaagttgaggttgccggggaccttgacctggatgccgtcggcaaacgtgttggcctggtcggacgccgcccacttgccctcgtggaacgcgtccgcgaaggcggaggcaccctgggcctggacgccgtagaccttgcactcggggcgcaggctcttgacggcgcacgcgacgcccgagatgagcccgccgccaccgacgggaacgaccacggcgtcgacgtcatcgagctggtcgaggatctcgagaccgatggtgccctggcccgcgatcacgtcctcgtcgtcgtacgggtggatgaaggtggcgccggtctcctcctgcaggcggacggcctcgtcgtgggcgtcgtcataggtgcccttgaccaggcgcacctcggcgccgaggcgacgggtgttctcgaccttcatgatgggcgcgccgtccggcatgcacacgacgctcttgacgcccagcctcgtggccgcgagcgcgacgccctgcgcgtggttgccggcgctgcacgcgatgatgccgcgagagagctcgtccttgctgaggcggttgatcttgtagtatgcgccgcggatcttgaacgagcccgtcacctgcaggttctcggtcttcaggtgcaggtcgaggccgtcgaccagcgtcggcgccgcgatgaggtccgtcttcctcgcgaccccgcgcagggtgtaggcggcgttgtagatcttgtctagtgagagcgtcatgggtttcctttcctggccgcgggcgcgaccgtcaggggcgttgtcttgctataccgcaaggaagttcgtgatgtgctggccgccaggcaccatgggcctgaccatctcgtcgcggtcgagcaccacgtcgatcacgtagccgtggccgcagtcgagcgcctcgcgcagcgccgcctcgaagtccgcgacggtcgagacgcgcctgccgtcgagcccataggcgcgggccaggtccggccatgagggcggacggtcgaggttggtctgggagtagtggccgttgtagatgagcgtctgccactggtgcaccatgcccagaacctcgttgtcataaatgatcgtgatgatgggcagcttgtagtgctcctcggtcgcaagctcgatgcagttcatgcggaacgatccgtcgcccgtcacgtggatgacgcgcctcgtggggttgcccacctgcgcgccgatggccgcgccgaggccgaagcccatcgtgccgaagccgcccgaggtgatgagctggccggggtagtcgtagtggaagtgctggatggcccacatctggtgctgacccacgtccgtcgagacgatcgtgtcctgcgggcagatgcgcgcgatcgcgtcgttcacctgcttgggggtgaggtggccctcctcctcgtcgtacacggtctcggtaggataggagaagacgaactccttccattcggagtggtcgagctggccctccggctcgaggcgcttgagcaggagctggagcacctggcgcacgtcgcccatgatggcctgctcgcagtggacgttcttgccgatctcggccgggtcgatgtcgacctggacgatcttggccttggaggcgaaggtgtccggctggagcgcgatcctgtccgagaacctgcagccaaacgcgagcagcaggtcgcagttgtcgacggccatgttggacgcctgggagccgtgcatgccgatcatgcccgtggtcagggggtcacgacccctgaagccgccgccacccatgaccgtgatggccaccggcgcgtcgacctggttggcgaacttgttgagctcgccgttggccctgctgcggaccacgccgccgccgcagatgatcatcgggcgcttggactccagaatcatctgggcgaccttctcgatgtcatcgggatcgaccgccggcggctcgagcgaggcgcgcaggtcgtcgggaagcaggcccggcttcagcctggcgaggtgctcggagaggtgcacgggcgcgtaggaggtcatctcctgcgtgacgtccttcgtgatgtccaaaaagaccgggccggggcggccggagcgcgccaccaggaaggcggccctcacgacgtcggcaagctcgctcacgtcggacacctggtgcgtccacttggtgatggggcgcatgacggcagtgctgtcgacctcctggaacgagttcttgcccaggagcttcttcgtcacgttgcaactgatcgcgacgatgggcgagctgtccgccatggccgtcgcgatgcccgtcgtcatgttggtggcgccggggcccgacgtcgagaagcacacgcccacacgcccggtcgacctcgcgtagccgtcggccgcgtgcgtcgcgccctgctcgtggctcacaagatagtggttgatgccgctcgtctggtacagcgcgtcgtacacgtccaggatcgtgccgccaggatagccaaagatggtgtcgacgccctgctccttcaggcactcgagcagaatctgcgctcccgtaagctgaagctccatcggtccctctcccctcgtccttctcacctttgttcgcttggtttgccttgccgatgcctaataaaaagagtccccgcccaaagcgaagacccacatgcgttgcaacccctggtaaaagaggttgcaactagataatagctagaatttcggaggagaaggacacgcatccgcgagtgcaagcatcggctaccatcatcggacgtcctcccccaaaccactcatgcccgacatcgagcgcaacgtttcgtgattgcatatgatggcacgaagcgcggggccgaaacgccgcgtggcggcgctcgtaacaaagtggttgcatagcggacggaaaccttaaggttgggtcagagcctgacggcatccgccctcgcgtgctccctggccaaaaaaggcgaccccaggaaatcccggggtcgccacaaagccgcgttggcgggaactagttgttgaggagcttgtcctcgtcgttccaggcatacagagcgcggatcttcttgccggtctgctccatcagggtctcggcctgctgacgacgcatagccttgaagtggacctggtgggactcgtcggacatgtcaagcaggaactccttggcgaactcgccgttctggatgcgcttcaggttgtagcgcatgccctccttggcggcctcggtgatcacgtgcgggccggcggtgtagtcgccatactcggcggtgttggagatggaggaacgcatgccggagaagccgctctcgtagatcaggtcgacgatgagcttcatctcgtggatgcactcgaagtaggcgttgcgaggatcgtagccagcctcgaccagcgtgttgaagccagcctccatcaggtcggtcacgccgccgcagaggacgttctgctcgccaaagaggtcggtctcggtctcggtcttgaagtcggtctcgagaagggcagcgcgggctccgccgatggcagcgccgtaggccagggcgaggtcgaaggcgtcgccggtggcgtcctggtgagcgcagaccaggcacggggtgcccttgccctcgaggtacgtggagcggacggtgtggccgggggccttgggggcgaccatgatgacgttgcagtcgggacggacctcgatgcagccgtagtggatgttgaagccgtgcgcgaaggcgatcgtcttgcccggggtcaggttgggctcgatgtccttcttgtacatggcggcctgatactcgtcgttgatcaggatcatgatgatgtctgcccacttggcagcctctgcgttggagacgacctcgaggccctgcttctcggccttggccttggacttggagccctcacgcaggccgaccttgacgtccacgccggagtccttgaggttcagcgcatgggcatggccctgggagccataaccaataattgcgaccttcttgccgtccagcttgctgacgtcgcagtcctgctcgtggaacatcctgaatgccatctgacttctccctttcgctagtcggttgatggtgctggtaactctatgcatcacaggcccgcgcacgggtctgggattgcctttgttaacacgctcgctatctggtcacatttcctacaaaatgggaccgctagacgctcgcaacgttgcgcatgacgctcggtccgcgctccaggctcacgactcccgtgcggcagacctccaggatctcgaagtcgcgcatgaggtcgatgaagttgtcgatgcgccgggatccgccggcgatcctaaacacgatggagtcgcgcgtgtagtccacaatcttggccctaaaggcctcggccgcgtccagtacctgcgatcgcgtcgcctcgttgtttgccatcttgatgaggagcaactcgcagctgatggagtcctcggggtcgaactccttccacgagatcacgtccggcagcttggccagctgcgccacgagctggcgcttggagcgctcctcgccctcgtactgcaccgtgatgcggctcagctgctccgtctcggtctcggaaacggttagactcgtgatgttgaactgccgccgcctgaacatgctggtcacgcggttgaggacgccgtactcgttccggaccatgatggcgatgttgtatgaggtcatctgctacctgcccatcctggaacgcacgtcgtccatgttcacaatcagctcgtccatagaggcgccgatctggagcaccggcgtcacgaactcgtcctcgcctatggggacctcgatcagccgaggccccgcggtcttctcgtccctttgggcgagaagggcatcctccagggcctgcgtcagctcctcgggcgtcgagaccctcgtggcctgggcccccatgccctccgcgaccttgcagaagtcgagcccgcggtgcctgagcgtggtcatcgcgtagcgctgccgcttgaagagcgactgcatctgtcgcaccatgcccaggaccccgttgttcagcagcacgatgaccacgggaatctggttgtccgccgccgtgaccatctcggccatgtccatctcgaaggacccgtcgccggtcaccaggatcgacggcccgcccgtcgcgagcgctaccccgttggcggcgcccatgccaaagcccatcgtgccgagcccgcccgacgtcacaaaggtccgcggcttcgtgaaccgcaggaactgcgcggcccacatctggtgctgccccacgtccgtcaccacgggcacgtcctgcggacggaccgcgttgatggcctccatcacgttcttgggggtcagcccctctcgatagtccgcgtagccccgctcctgggcgcgcagctccctcacgtgacgctgccagtcctcgtgggtgttgggctccacgtactgctccacgtcgcgcaggaaggtccgcacgtcgcttctgacctcgaccaggtcctccaggctcttgctgaactccgaggagtccacgtccacgtggacgaccttgccgttgggcgcgtacttggtgcggtcgcccgtggaccggtcgttgaagcgggcccccagcgcgatgaggcagtcgctctcgtacatggccttcgtgctcgcgtagtggccgtgcatgccctccatccccaggaagccgggggtgtccgtcgggatggcggatatgcccatgagcgagcaccccatgggcgcgccgatcttgctggcgaggtcgacgatctcctgcgaggcgcccgaggccagcgctcccccgccaaagtagacgaagggccgccttgcccggttgatggcctccgcggccgccatgagctccgcctctggcgcacgcagtggagaagggattggcgccggggtcagcggcccctcctccaccacggccttctgcacgtccgcgggcacgtccaccaggacggggccgcgcctgccggtgttggcgagctcgaacgcctcgcgcagcacctcctgcagcctgctcgcgtcgcgcacaaagtagttgtgcttcgtgatgggcagcgtcacgcccgtgatgtccagctcctggaacgcgtccgtgccaatcatcttgttggatacgttgcccgttatcgccaccagggggacggagtcgaggtatgcggtcgcgatgcccgttaccaggttcgttgcgcccggtcccgacgtcgcgatcaccacgcccgtcttgcccgtcgccctggcgtagccgtcggcggcgtggcagccgtgctgctcgtgagtcggctcgatcacgcgtatcttgtccgtcgcgtcgtaaagtgcgtcgaacaggtcgatcaccgtgcctccgggatacccaaagacggtgtcgatcccctccgcgacgagggtgtcgactatgacctgcgcccccgtggtggctcccatgtgctacttcccttcgttcgcgcgctgggtctggatcattcggttgagtgcgttcacgtaggccttcgcggacgagacgatgatgtcgttgtccgagccgcggcccgtgaacacgcgtccgtcctctgcctggatgcgtacggtcacctcgcccagggcgtcgatgccgcgcgtaaccgccttgacggcgaactcctgcaggtcgccgtggacggccacgacctggtcgatggccttgtaggctgcgtccaccggaccggtgcccgtcgcgcagaccacgtgcttcttcccctgctcgtcgctgatcgtggcggtcgccgtgggtaccagcgggtcgccgcaggacacctgcagcgcgtcgagcgtgtagatggcggtcgcgtcgcgctggcgctcctgcaccatggactcgaggtcctcgtcgtagacctccttcttctggtccgcgatctcgaggaagcgcttgtagatgtcgtcgtactcctcgggcgagaacgtgtagcccagctccgcgaggcggtgcttcagggccgcgtggccgctgcgcgcggagaggatgatctcggagccggcggcgcccacgtcctcggggttgatgatctcgtaggtgtcacgggccttgaggacgccgtcctggtggatgccggaggagtgcgcaaaggcgttggctcccacgatggccttgttggcctggacgttcatgcccgtgatgcggctgaccaggcggctggcgcgcgtgagctcctgcgtgaccacgtcggtgtgcgcgtcgagctcgtcgccgtgcatcttgatagccatgacgacctcctcgagcgcggtgttgccggcgcgctcgcccaggccgttgatggtgcactcgatctgcgtcgcgccgttcttgacgcccgcgagcgccagcgccgtcgccatgcccaggtcgttgtgggtgtggacgctgatggtcacgttctcgatgccgcgcacgttgtcacacagccccttgatgcgcgcgccaaagtcatccggcagctggtagcccgtggtgtccgggatgttgacgacggtggcgccggcgtcgacggccgcctggatcacgcgctcgaggaacttctggtcggcacggcccgcatcctcggcatagaactcgacgtcgtccacgtacttcttggcgtacttgacgcagtggatcgcgcgctcgatgcactcgtcctcgctgatgcggagcttctcgcgcaggtgctggggagaaacgccgagtcccgtgtggatgcggggacgcttcgcggtcttgagggcctcggccgcacggtcgatgtccttgtccacggcgcgcgtgaggcctactactacggcgtcgtcacctgcgaggcggccgatctcctgtacggagcggaagtcgccgggcgaggagatcgggaagccagcctcgatgacgtccacgtgcatgcggagcagctcctgggcgataacgagcttctcctcggtgttcatggaagcgccgggggactgctccccgtcgcgcagggtggtatcgaagatgttgatcttgcgggtcatgcgttggctcctctcgaatggtgatgactcgtaacggtacaagcaaccatccgccgaagaatccgacgccgcatatatatgtgagaatgactatgcgagcgccagaccccgagtagctcggcgggtcgaacctacgcgctagccaacaatgtagtgtggcctagcgcacgctcgctagtaggagcccatgtacggcaccaagtaccacgcggctggccgcgaggtcggtgtcaaccatgttcgaaacgatgaagttggtcatcgcttgggctcctttgaacgacacgcccacttggacgcggtgagggtactatcgcacttcccgagcgaccgggaggccaaaattcccggtcattctctaagccgaaacaattggtcgaaaaaggacgtctcacccacttcccttcgtcatcttcattatcttgcagatatctttcatttaactttattattgcttttaacatgcttttaagttactattgtttcacgaacagttgttctacagattggaggcggctatgggtatggacgaagcaacgttggtgcagcaggtgaacgcgcgctggaggaatctgaccattgcggacgatttcgtcttcggcaaggtgatgcagaatccggacgtctgcaaggacgtgctagaggcaattctcggaactccgatagaccatatcgactacatcggtaggcaggatgatcttgacgtctcgcctttcggtcatggcgtacgcctcgatgtctatgtgagagacaaccttggaaccgtgtataacgtggagatgcaggccactaatacccatgagcttccccagcgtgcacgctactatcactcgatgttgacgttctctcagttggagcgcggggagcgctatcgtgcgctcaaggactcgtacgtgatcttcatctgcgggttcgatctgtttggcatgggacgcagggtatactcattccaaagccagtgcgtggacgatccagatctctcgctccatgacggcctgcacacgatattccttgcggctagctcacctgcggagccagacgaaggccgtcagataaacgagctgttggactatgtctcgactggtaaagtgacgggcacactctcgtccaagcttgaccatgccgtctcccaggtcatggagaacaaggaatggaggctcgagttcatgatgcaggttattaaggaccagctcaatgtagataagggccatgagcttggcctaaaggagggcctggagcttggtcgccagaagggcctcgaggagggccggcagatcggcgaggccgagggcaagaaggccgggctcgaggagggccggcagatcggcgaggccgagggaaggcaaaccggaatcgcggaaggcgaagaccggtttgccagactcgtgtcccagctcgacaaggacgggcgatctaaagacatcatcctcgtagcgaaagacaaggaagccagggaccgactgtacgcggagtacggaatctcataaaggcatcaggacattcgccgtacgacaataagaagcacattcgccccgcgcttccccattagatgagaaaatcgcccgcaccatgaatcaaatcaggggtcgttcttctcgttcgaaataccgcatcgaacagcgatacgagagaagaacggcctcgtggttttaaattcctactacatttgtagtaatttgctgttcatgttgcagttgcaacaatctttagcaataggtcccgatagcgtatgcggtgtgaaaaggcttcgcaccaccaaccaaatcggaggctcgcatggcaaagtatctcgatctcaacaagagtgtccacgacctcgtggagcaatatccggaaatcgtggacgtgatggtctcgctgggcttcacggagatggccaagcctgtggcgctcaactccgtcggccgcgtcatgaccatccccaagggtgcccaggtcaagggcatctccctcgacaaggtgctcgacaccctgaaggataacggcttcactgtcgataacgagagcgccggcacggactcccagcccggcgttcccgcacagctggcccccacaagcagccaggcgcccgtcgcaaagcctgccgcggaagacggcagcgcggaccagggggtgcacggaaggcagcagctgctccagagctacgtggcgcgcctctccgcgggtgagccgctcgaggacgtgcgcaccgacttcgttgcgaacttcgagaacgtagatgcggcggagatcgcacgcgccgagcagaccctcatcgagggcggcgccaagatcgaggacgtccagaggctctgcgacgttcactccgccctcttccacggtgccacgaaggaggagaagatcgcgaacgccgagaaggcggtcatggactccctcgcgaccaacatgggcacgggatcggacttccagacgaaggtcctcacgaacatccccggacacccggtccgcgtcttctccctcgagaacgacgccattggcgcagccgtcgctgcagccaggaaggcgctgggtacggatgcggagcgcgagcagatctccaagctccagcaggtggggatccactactccaagaagggcgaccttctctaccccatcctcaaggtcaatcacggctacagcggacccgcagacgtgatgtggggcgtcgacgacgagatccgcggagagctccactacctcgccggggcatccaataccgacgacgcctggagggagcgcgcggaggccgtgctcacccgcgcggaggagatggtctacaaggaggccaacatcctgcttcccctctgtaccgacaacttcaccgacgacgagtggctgaggatgtacttcgacctgaagggctacgacctctgcatggtcgacgaggagaccgtcggcgtttggaagacgggcgagaagtacatcctcaccaacatgaaggcctcgtccagcgtctcggggaccgacggcgaagacaaggaccttggctccctcatcaacctgccgtccggcaacttcacgcccgagcagcttgacgccatgctcaacaccatccccctcgagatcaccttcatcgacgacgaggaggtcaaccgctactggaacgacgacggggagaagaagctcttcaagcgccccgcctccgccctcgggcgcaaggtgtggaactgccacccgcccaaggtccagcagatggtcaaaggcgtgatcaacacgctcaagaccacctcccagaagtccgtggacatctggatggagaagggcggggagcccgtgctcgtgcgctacatggccgtgcgcgaccgcgagggcaactacgtcggcaccatggagtgcgtacagcgcatgggcttcgccaaggagcacttcctcggctagtccgcgctccccttggcgcgggtcgcgcgctccatgcagagcagcggcaccaccatcaccacggccagcacgaggtacgcggacctggtgcccagcatcgtcgcatgtgcgacgttgctggcgccggcctgcgccgcattgacgatggcgcttgcgacgctcgtgcccaacgcacccgcaagctgctgcagcgtgttgatgacggcgttgccatccgcgcgggtctccgcaggcagctgctccagcgacgtggtcatggtgttgccaaccatgaggctctggccaaaggcgaagcacacgtatatggccgtggccgctgccgtgtgaaggttaccgctgaacagctcgagcaggatgacgccgagaagcgcacaggacgcacccgtgaggatgggcctcctcgcccccagcttgtccaggatctggcccgagagcggtgccatcagcgcaccgacgaagcatccgagcagcaggatcgagcccgcctcggtttgccccgtccccatcacgagctgcgagtagttggggaggaggaacgagagtcccagcaccgtgaactgcagggtcaccagcgcgacgacgcccagcacgaagcggcgcttgccgaacaccgagaggtgcacgagcggcacgtccacgttcttctcgtgcctgacgaagagcgcgagcaggcagacaaagccggcaaacagggcaagttgggcgggactcccccatcccagcctcgagccaaagtcgaccgcgaacacgaggcacacgaaggaaagcgacaggagcacccacccgagcgcatcaaacttgcgcttctccacgggatggctctggcggatcgagaagatgccgagcacgaacgcgacgatcagcacggggagaagtgcggcgaagatcgctcgccagccaaagttctccgcgagccagccaccgaccgagggaccgaccgccggcgccatcgcggtcacgagcgtgccgatgcccatcatgacgcccatgttctttgtcggggcctgctcggtgatgatgttgaacatgagcgggagcgcgatgcccgtgccgatgccctcgaggatgcggccgcagagcagcatggggaagctcaccgccgtgaggcccgtcacgatgccggcgatgtagaagcacatcgacaccgtgaacacggtctttgtcttgaacctgcggttgaggtaggacgaggttgggacgatggacgcaaggacgagcaggtaggacgtggtcatccactgcacggtggctgtgtcgatcttgaactccgacatgagcgtgggaaacgtcacgttcatggcggtctctacgcacacgcccgagaacgacatgatgcccgccgcgatgaccgaaaggacgagccgcgcgtcgagccttctctcgaaactggttggtgcttcctctgacatgcaattctccaatgttcggattcgtgccgcggagatgtcttggttccgctcgcacaaaaggagactgtagtcagacccttagagtgatgttttcagtttcggcgtcgctcgcgtatctctcggacttcttcacgattccgagaatctcaatcgcgacccgcgcactttttgccgcgtcagagcgtgttgttgctgacgatcctctggaaccgctccgccttcacgggcatgcacgtgagctcgaagtcaccgtccacggcgaccacgagcgcgattcccgcattgggcacgcgcatcgtggtgctcgtgatcctgcgcgagaacgccgtcatcttcgcaaactcctgtacgacgtagcgcacgtaggcaccgtgccccaccacgagcacgttgtccccgtccgagctctccttgtacatcttcttgaacgcacggcgcacgcgctcgcgcacctgggcgccgctctcgcctcccacggacgagaagtcctgcctgaggaagcacctcgcgaacgcaaggcggttgcccttgtagggcttgccgtcgatgccgccaaagtcgaactccctcagtccctcgagcgtgcgcctctcgacgtcacgcccctcgagcagcacgtcggccgtctgctgcgcgcgccccagcggcgacacgaagcaccgcgcgaagtcgacgtccgccaggaccttcgcactctcgcgaatggtggggacgctctcctccacgagcggcgagtccacgcggccaccctggatgatgccgtcgcggttgaactcggtcctgccgtggcgaacgtagtagaaagttactctcttcatgaaacccagcccctcgcgccatgccggccggcggcgcattgcggaccctgtaccagcccactcagtatgattgatgcccctaccctggaaagtccgtggcggagaagagcaccaagaccataccaaactcacccacggcggcagcgggcacaaatcgttgtgggcttggtgtgtactcgcggtcccgaaaacgggcggctcgtaccatagaggggtcgaagggaaggccgatggacatcacggaaatcgcccgcatggcaggcgtgtctcgctcaaccgtttctcgctacctcaacgatggctacgtgtccacggagaagcgcgaggccatcaagcgcgtgatcgaggagacgggctacaccccctcccaacaggccaagaccctgcgcaccggcaagacggacgtaatcggcgtcatcctccccaagatcaactccgcatccgtcagccgcatcgtcggcggcatcacgagcgtgctgaacgaccgcggttaccgcctgctgctggccaacaccaacaacaacggcagcgccgaggtcgactacctccggctcttctcggagggaaacgaggtcgacggcatcatcctgatcgccacctacttcgacgacgcgcacctcaaggccatggcaaacctcagcgtccccatcgtgatcatcgaccaggagctcggcggctactcgtgcgtctaccaggacgactaccacgcacttctcgaccttacgcagatcgtgctcaggcatgccgagcacccggcctacgtgggcgtgttggagaaggacgtctctgccgggcacaaccgtcgccaggggttcctggacgcctgcgccaaggccggcgtggaggtgcccgagcgcgcgtgcgagctggcggacttcacggtcgactccggctacgaggccacggagcgcctgctcgacgcctaccccgagctcgacgccgtggtgtgcgcgacggactccatcgcgtacggcgccatgacctgcctgcacgagtttggccatgccgtgccagacgaggtgcaggtgtgcggcgtgggcgactccgacctgtcgcagatcgtgacgcccacgctcacgaccgtccacttcttctactggacgtccggcacggaggcagcacgcatgctgctcgagcgcatcgcggaccgcaccaccgtcgcacggcagctgcgcatgggatacgaggttcgcgtgcgcaactccacgctgtaagctccgcgcggtaggccggccgcaccgcctcgctggcgcccctacgagagcccgttcgccacggtcgaggggtcgccgcccgactccaccacctgcatcatggtggccagctcctgcgtgttggcgaccacgtatgagacccctcctatggtctgcgtggtcgaggggatcgacgcggagtagatggtgggcgtgcccaccgcgagccgcgcgagcagcgggatgatgttgtagcagcgcatcgtggtggaaaggagccctcccatggccttgcccaccgtggggagcgccagcgggttggagagcgccttcttcatgatggcctcaatcaggatccgctggtcctgctggcgctggtagtcgccgttggcaaagccgtgcctcacgcgcgagaagagcagcgccgtcttgccgtccatcgtgtacgtgccggccgacatcacgaggcccgtgtagttgggttcgtttatgtccacggggacgttcacggtcacgccgcccagtgcgtccaccagcgtctgcacgccgtcaaagtggatcagcgccacgtggttgatgctcacgcccaagaggctcttcacggcggcagcggcacccgccgccccgccatatgcgtaggccgcgttgatcttctgcgtgccgtggccctctatcgtcaccatcgtgtcacgcgggatcgagaccatggtcaccttggcctgaatcgggtcgatgcggcacaggatcatcgtgtccgtgcggctcacggtgtcgccctcgcgcgcgtccgagccgagcagcagcacgtagtacggcgtgagcgggatgtgcgcggacgtctggccggaaaggctctgcgcctcggagtcggaaaacgcgatgccctggtcgatgggcacgcagatcagcacgtacagcgccacgaggatgcccaggatcaggaggaccacgttccttgccctatgggggtgctcacgccgcggctccatcgcccttctcgcccggcgctcgcgaagccgttcgcgcaggctgccgccaccgccctcggagggctggccgtagccgccatactggtcgccgtagccgtcctgatagccgtagccgtcgccgtactgctggccgtactcgtcgtactgttgcccccggtagggctggccgtactcgtaggcgttgccgcttgcgtcgcgcgagaagcgcgagccctgctgggccgcaccacgcccgtgagcggcgtcgcgcagcgcgctcgaaagtcgcgagcgcctgctcaccaccgcgccgccgccggacggcgcgccggagctcgcggcgggcgccttgccctgccgccgcgccgtgtagcgccgggggtcgtcgtagtcgtactgcgtgtcctcgccctggtcgccgtcacccggccgatactcgcccatgcgcacctcctagcgcgcgtccccacgcggctcctcgccgcgcgcgaagacctctatcatctcgttcgtgaggctcgacgtgtcctcgtgcgaggtcggcaggtcctcgcgccggacccagcgcgccacggagagctccacgtggtcggggtgtgccgccgtcgggtcgccgtccacgtccgcgaagaaccccatcagcagcgagtcggaaaacggccacggctggctcttgtagaagcggaggttgctgaccctcaggctcacctcctccatcacctcgcgctcgatggtctggcccagggtctcccccacctcgcagaagccgctcacgagcgcatagtgcttgatgcgcccctgcgcaaactttgtgagcagcagcctgtcgccccagcagatgcccacgatgatgcagggattgatgcgcgggtacaccacgttgccgcacgaggggcacacgagctcgcggctcgtggcaacgtgtcccagctccgccccgcagcgcccgcagtagcggttgttgcggtaccaccgccacagctgcatgccggccgtcgccgcgtacgcgagccagcgcggctcgtagaagcgcatcgtctggattgaggcaaacacgaagcccgccgggcactccacggcgcccgtgtcgatggcggcgtcgtccaccaggaagaaccgcgcatcgcccacgctaaagaggtagcgcaggcagaggctctccacggtttgcgagcccgcggccgagccgcccgtccagtcccgaacgcgcggcagcaccaggcggccgtccttctccgccagaagcgtgcccgagccctggtacgcgagggcgtagtcccccggctcgggctccacggcccggtaggtgatgtcaaagcagcgctcgccgatgtcctgaatcacgtctgcccccttatgtgcactgcaagcagggtaccacggcgcccccgtacgcgcggagggaccccgctggcgcggagtccctccatcaaggtgctatgttgctgcaggcgtcgcgcaggcgcgtgtggcattcgccgggcgagaaggactactcgtcgttgtcgccaccggtcgaggacatggcggccgcggagttgtcctggcccacgacgtcgcgccagctccactccgtgaagcgcgggtggtcgtagccgttgtcgaccgcgaactggaaggcctcgtcgcggaagtcgcggtactcgcggatcttgtcggcgtacttcttggcgtccaggagctcaagcgcgtgcgcggtgagggcgtagcggtccatctcgttgaggcgcagcatgtcgaacggcgtcgtggttgagccctcctccatgtagccgtggacgtggaagttgtcgtggttggggcggccgtggatgaggccgtagatcgtgtgggcgtaggcgtggaacgcgaagagcacgggcacgtcctcgccgaacatggccttgaactcgtcgtccgtgagggaggcgtcgttctcctcgtggtcctggatcgcaaggagcttgaccacgttcacgaagcgcaccctgatgcccaggtcctgcagggcgtcggaggtcgcgagcatctcgagcgtggggacgtcgccgcagcagccgagcacgatgtcgggcttctcgccgtcacgcacgttgcctgcccagtcccacacggcggcaccgcggtcgagctcggcctgggcctcgtcgatgctctggaacgtaggggcgggctgcttgcccgcgaagatcgcgttgatcttgttggtggacttgtaggcctcctgcgcaacgcagagcagcatgttggcgtcggccgggtagtagatctgggtcacgtggtcgttgtggaagttcttgttgagcagcaggtccacgaagcccgggtcctggtggctgaagccgttgtggtcctggcgccagacgtggctggacagcaggatgttgagggaggcgatgggcttgcgccaggggatgtggcgcacggtcgcctcgagccacttggcgtgctggttgatcatggagtcgaccacgtggatgaacgactcgtacgagctccagacgccgtggcggccggtgaggatgaagccctcgagcaggccctcgcactggtgctcggacagctgctcaatcacgccacccgtcgtgctgaggtaggtgtcgttctcggggtcggcgttgaagccagcgtcccactgcttgtccgtgagcttgtaggcagcctgcaggcggttggaggccgtctcgtcaggaccgaagacgcggaacttcgtgaggttgagcttgagcacgtcggccgtgtagttgccgaacacgcgggaggcctcggtggttccgtagccatggcccttctcggccaccggaatctcgtagtcgtggatgtcgggaagctcgaggtcctcgcggatcaggccgccgtttgcgttggggttggcgcccaggcgcaggtcgcccttgggcatgaactccgtgacctccggacgcagggtgccgttctcgtcccagagctcggccggcttgtaggagcggagccacccgcgcaggacgcggaagtgctcgtgggtgtccttggcagaggtcaggggcacctggtgggcacgccagctgccctcggtcttcttgccgtcgatgtacttggggcaggtccagcccttgggggtcttgaagatgatcatcgggtaggcggggcgggccgtctcaccggcgagcgcgcgccacttgatgtcgcaaatctcgttgaagacctgctcgagcagtgcggcgaagcgacggtggatcgagatgtgggactcgtcgtcgaagccggccacgaacgtgtaggggtggtagcccatgccgcggaagaactcgtcgcgctcctcgtcggagatgcgggccaggatcgtggggttggcgatcttgtagccgttgaggtgcagcacgggcaggacgatgccgtccgtgagcgggttcacgagcttgttggtctgccaggacgtggcgagcgggccagtctcggcctcgccgtcacccacgacggcaaaggcaagcaggctcgggttgttgaggacggcgccgtaggcgtgcgagagcgtgtagccaagctcgccaccctcgtggatggagccgggggtctcgggcgcgaagtggctggggatgccgccggggtagctgaactggcggaagaacttctcgaggccggcctcgtcgtccgtgatgtccggacggatctcgcggtacgtgccgtcgagcagcgactgcgaggtgccggcgggtccgccgtggcccggccccatgaagaacacgacgctctggccgtggtcgtggatgaggcggttgacgtgacccatgaggaagttgatgccgggggtcgttccccagtgaccgacaaggcggtgcttcacgtccgcgcggccgaagtcgcgggtctcaccggtcttctcgtccacccagtccgagcgcatgagcgggttgctgcgcaggtagatctggccgacggacatgtagttggcggcgcgccagtacctgtcgacccacgcgagctcctcctcggcgacgggtgcgtcgagcttcttccaaggggtaccaaggtccatgtggacttcctttcgaatgtgccccgcgagggggctggattagctgggaaaagcgcctaggcgagctcgcccttggacttgaggaagccctccaggccggccttgatctcgtccgcgtcaacgatgttgcggacgctcaccacgtagggaaggtccttcttgccctcgtcctcgaggatgaggccgaggtcggacatggtgatgatgaggtcgccgtcgaagtccttgatctggtcgacggagccgtgctgcgtgctgatgggccaaccctcgttagccacgacctgctgaaccctggtctcgaggattgcgctggaaccaacgccggcgcggcagcacacaagcgccctgtacttagccattgcccgctcccttctggcgcgccttcgcgccacgtgcgcggcgacgcgccggaatccatccgaccgccgggccgcgcgtccgtcaaatctctctcacagccgaaatgtgacatatggtgaatctaaagtcaatcagaaattaatactattcagccgtttacttgtgattttcaaacgtccgaccccaggggaatgccgtgcgcacgcgcgggcaacgcgggcgagaagaacatacaccgtgcttgttacctgctattttgaagcaatttctacttatatgaacgttctgaatccgcaatcgaccacaaggagcctaaatgttaacaaatgcatatattataattgttatgcgcaatggaacaccagataggaaagaacgctctcccataacgttcactccgttcataaaatggtagggaacggaatgccgcggggcggcaatcggaaggcttacgggacggggcggtcgacgcatgaggcgaagcgagacgttcgtgacgaggcgcaggcaggccatcgtgaggctgctcgaggagcgcgagagcgccagcgtggcggagctcgcggaacgctttgacgtgtcgtccctcaccatcaggcgcgacctggacagcctggagggccagggcatggtcacgcgccagtacggccgcgtgagcctggtggacgagctggggcggccctccggctcgcgccgcgtgctcgccaagaaggccatcgccgcggaggccgcgcaccacgtggccaacggcgacgcgatctttgtgaacgcgagctccaccgcgctggagatcatcgagagcatcacggcgcaggacgtgtccatcatcaccaacaacagtaaagtcatgctgctcaaggggccgctcagccagaccgtgctcctgaccggcggcaacgccatgccgccgcgcacgtcgctcacgggcgagctcaccatggacgtgatcgggcgctaccacgccgcgaagtgcttcatgggctgcagcggcatcagcgcggagggcggcctcacttccaacaccatgcccgagtgcgccgtggacgcgctcatgctcgcccactcccgcgagcacttcgtgcttctggactcgtccaagctcgggcaggtgtacacctaccccatcgcgggcattgccgaggcgcacaccgtgatcacggacgacggcgccacggacgagcaggtcagggctctgcgcgaggcgggcgtgcgcgaggtcatccgggtcgcgacgtcgatgcccgaggtggtctagccgctcgtccacccgtgcggcaccggggcccgtggctcgggtagcatggtgacagtcgccctttgcggcgtttggcacaagggttggaggagccatgagccatgagtccatcgcgtttggcaccatgccggacggtcgtgacgtgcacctacacctgcttcgcaacgcacacggcctcgaggccggcatcagcgagctgggcgcgtgccttgtgagcatgcgcgtgccggacggccacggcgcaaggccggacgtctgcctgggctacgacggcgtggccggctacctggacaacccccactgcatgggtgccatcctgggcaggaacgccaaccgcatcgcgggcgcgcgctttgacctgggcggcacgacgcaccgccttgcggcaaacgatggcgagaacaacctccattccggcccgcacctctactcccaccgcctgtggcaggccagccgcacgacggaggactcagtcacgctcaacctccacagccgccccggcgaccagggatttcccggtgcggtggacgtgaacgtcacctacaccctgaccgaggacgacacgctgcgcgtcgactacgacgcgatgccggacgacaccacgatcgtcaacctcacgtgccacgcgtactggaacctcaacgggcacgcctcgggcagcgcgcttgggcacacgctccaggtggaggcggactcctacacgcccacggacgagcaccacatacccacgggcgaggtcgccccggtagaggggacgccgttcgacctcaggcaggcgcgcccgatcgaggagggcgtgcgcgcactggacggctacgacgtcaactacgtcctccacaacgacgagcacctggagcgcgcctgcacgctcacgggcgacgtcacgggcatcagcatggacgtgctgaccgactcgcccggcctgcaggtgtacagtgccggcgcgctcgaggctcgcggtaaggacggcgcacactacggcccaggatacggcatcgcactggaaacccaattcttcccggatttcattcaccacaagaacttcccccaggccgtgtacgcggcggggcacgccttccgcttcaccacggccttccggttccgcacgcaggcctaggcaacggcgcggcgcacggtggcggcgcgttgcggccgaaggcgcgcgttcttctcgcccaacgcagggcgagttcgtaaacatttgggagagcgggcgcccacgcacgtcgcgaggcgctatggttgcatactgttcccaacattaacacccgcgccacgcgggccaggcacgaccgaggagtattcatggcaatcaccccagaagaggtagccgagaccctgagcatggtctcccagcagaatcttgacctcaggaccatcaccatgggcatctcgctctttggctgcgccgacgaggacatgcaccgcatgtgcaccaagatctacgaccgcatcaccaccaccgcgcaggacctcgtgcccacggccgagcagctcgagcgcgagtacggcatccccatcgccaacaagcgcgtgtccgtcacgcccatcgcgcagatcgcggccgcctgcaaggacgaggacctgacgcccatcgcccaggccatgaaccgcgccgcggagaccctggggatcgacttcatgggcggcttctcggcgctggtccagaagggcatgggctcggcggacaggcgcctcatcgcgtccatcccctccgcgctcgcgtcgacggaccgcatctgctcctcgctcaacatcgcctcgacccgagcgggcatcaacatggacgccgtgctcctctcggcccagaccatgatcgactgcgcgcaggccaccacggacatcgactgctacggcgccgcaaagttcgtcgtgttctgcaacatggtggaggactcgccgttcatggcgggcgccacgcacggctccggcgaggccgacgcggtcatcaacgtgggcgtctccggccccggcgtcatggcggcggcgctcgagcagctgcccgaggacgccagcctcatggaggtggccgagatgatcaagaagaccgccttcaagatcacccgtgccggcgagctcatgagccgcgaggcctcgcgccgcctgggcgtcgagaagggcatcgtggacctgtcgctcgcccccacgcccgcggcgggcgactccgtggccaagatcctcgagatcatcggcgtgggcgagtgcggcggccctggcacgacggccgccctcgcgctgctgaacgactgcgtcaagaagggcggcgtcatggcgagctccagcgtgggtgggctctccggcgcgttcatccccgtgtccgaggacgccggcatgatccgcgcggccgaggacggcgccctctccatcgagaagcttgaggccatgacctgcgtctgctccgtgggcctcgacatgatcgccatcccgggcgacaccccggtcgaggcgatcgccggcatcatcgcggacgagatggccatcggcgtcatcaacaccaagacgacggccgtgcgcctcatccccgccatcggcaagaaggagggcgagatgctcgagttcggcggcctgtttggctccgcgcccgtgcagcacgtcaacccgtatgccggcaaggtcttcgcgcaccgcggtggccgcttccccgcaccgatcaactcgctcaagaactagggtcagaccggcacttgacaccaacgcaccacaacgcacgacatcacgcgcgccgcggccttcccttctgctttgcagaggtggccgtggcgtcgctccttatcggcacgctctacacgggcgtctaccaggcgacgctcgcccccacgcccgctcgccaggcgaccgtcgcgcgcacgtccggcacggcgcgaaaggccgcgcaccatgcgcatcgctccgccgcgtcccgcgacgcagagtcctcgccctcaacccaccgggtgagcggcgcctccctcggcgcgagccaggacctccagttcacgggcgcgggttcctttgcaggcggcacggcgtgcacgcagctgctccagacggctgccgcgttcgaggagaagggctaccacctcggcatatacgccatcgacctcggcacgggggacacgctcgcctacgacccggacgccgcgttctacaccgcgagcgcgataaagggcccgtacgtgacctcgctcttctcgctcgaggtcgagaagggcacgctctcgctcgacgacgcgctcgcgtccgccacgcccatcatcctgaactccgacaacgacgcctacgtcgcgctctccgacgcgcgcggccgccaggacttcctcgcgtggctgcagtcggcggacgtctccacgggcgcgtacctctcgctcgacgactacgcgaggccccactacccgctcagcacggcgcgccagctcgcgcaggagtggcaggcgtcctacgcgtacctcacgtcgggcaccgcggcggccaaggcgctgcagtcgctcttcgccaaccgcgtcacctcgcccataagggacgcgctcggcgcatcccaccagacctggtcaaaggccggctggtaccccacggcagaaggcgacgcccgccccgccacaaacgacgcgggcgtcgtgtgggggacggccggtccctacgtggtcgcgatcctctcggacgcgccggaggacttctcttccgttcaggcggtcgccacgagcgtcgacgccgccatggcggacctcgcctcgcgcggatccgcctcttagggggccgctaggggcgcggctcctcgtccttctcccccggctcctcgcccaggaagcgcacctcgggctcgaggcgcacgccaaactggcggtcaacctcgtcctgcacgtgcgcgatcacggcacgcacgtcggccgcggtcgcatgccccaggttcaccacgaacccggcgtgcttcttcgagaccgccgcgtcgccaacctggtagcccttcagccccgcgtcggtaatgagcttgcccgcaaagaagccctcgggccgcttgaacgtggagcccgcgctcgcgagctcgagcggctgcttctcctcgcggcgcctcgtgaagtcgtccatgcgcgcgcggatctcctcgggcttgtcctcgtgcagcttgaacgtcgctgagagcacgacgagcccctcgtccttcacgcggctcttgcgataccccatcgcaaggtcgtcgatgtcgatgctctgcacggacccgtccggcatgagggcgcgcacgctctcgagcacgtcggacgtgcagccaccgtaggcacccgcgttcatgaagcacgcgccaccgacggagccgggaatgccgcaggcaaactcgaggccggaaagccccagctcacaggccatctcggacgcctccttgagcgtgacgcccgcctggcaggtcatctcctcgccgttcacgctcacattggtgaggtcgtccgccagcgctatcaccacgccgcggtatccgtcgtcgctcacgagcaggtcgctgccgcagccgagcacaaagtagggcgcgccctcctcgcggcaggcggcaaccacgtcgccaacctcctcggggtcgtccgggaccacgtagaagtcggccgggcccccgatcctgaacgtcgtgtgctcgctcatcggctcggactcgagcacgttctcctcgccgacgatggcgcgcaggcgccaggccaacgtatccaagtggtaggcactgtcagacatgcccgtatcacactccctcaagccgcctctgcgcggccgtcgcatgccattgcatccatacgagtatagcagccatcccgtggcacgaaggcgcctcggccgtcgccccaggcccccgcacggactgcccacacgtgcggaaatgttacgaattgccaccgcacgtccttctccccttcaccatctgggcgagaaatgctattgtcgtgccgtcagtttcagggcggggtgagattccccactggcggtatgggcaggtgcccgagtccgcgcgccgcacagaaaagagcggctgacctggtgagatgccaggaccaacggtcacagtccggatgggagaaacgaggtcatcatggcacaagactccacctttgcacggcacgacacccactccaccacggagcagggctcgggctggagcaccaagcgcatcgccgtcaccgcgctcttctgcgcgctcgcggccatctgcacgctcttcatcgagttcccgatccttcccgcggtgccctggctcaagtacgacccgtccgcgatcatctgcctcatggcgggcttcgccttcggtcccgccacgggagtcgccgtgtccgtcatcagctacctcccccacatcgccacggcttcgggcttctggggcatgctgatggccatcatcgcgacgctcgccatggtgcttcccgcgtcgctcgtgtacaagcatgacaccaccatgcgcggcgccatcatcggcatggtgatcggggccgtggtgagcgtccttctctgcatcgtcgcaaacatcatcgtgacgcccatctacgcgcacatgtccacccaggcggtcatcgcgctcatcgtcccggcgctcctgccgttcaacgcgctcaaggtcgtcatcaacgccgtcgtgaccacgctcgtctacaagccggtcaccaaggcgctgggaaactagcaccttgcagccaagcccaagcatagcccgcggcgcctccgcggtcagcctttcgcacgtcagcctcagcttcgagactgacgtgcaggctcttgtcgacgtgagcctcgaggtcgcgcctggcgagcgcctctgcgtgctcggccccaacggctcgggcaagtccacgctcgcctcggtcatctgcgggctcctcgcgccggacgccggctcggtcacgctcgtgggagagccggtcatgcgcgagggcacggtcgacttcgcggcgtaccgcagggcgcggcgcagcctcggcctcgtcttccagaacccggacgaccagctcgtcaccaccgtcgtggaggaggacgtcgccttcgggcccgagaacctgggcgtcgaccccgcgcagataggcgagcgcgtccgccgcgagctccaccgcgtcgcgatgcaggactttgccaaggcggacccaaccaggctctccggcggccagaagcagcgcgtcgccatcgccggggccctggccatggagccctccgtcatcgtcttcgacgagccgggcgccctcctggacgtccgcggccgccgctcgatcatgcgcgtgatggacgccctcgcgcgcgacggcatcacgcaggtgcacgtcacgcacttcatggaggaggccttcgcggccgaccgcgtgatcgtgctcgaccacggccgcatcgcgctctccggcacgcccgacgaggtcttctcgcacgagcgcgagctgcgcgccctcggcctcgagccgcccttcgcggcgcgcctgtccgagctcctgcgcgaccgcggcgtcgacgtcccctggacctgtgacgtcgcaacgctcaagtcagccgtcgcctccgtctgcgccgcaccgctcgacagccgcgtgtcccggccccaggcggcgcgcgccaccacgggcgagaaggacgcagcccccgcggccggggccaaggcgccggctgcgcccgaggacgtcgccgtcagcgtggagggcgtgaccttctcctatgcggaatcctccgcaacgcgcggcgacgccggcaccaggggcgcgctcgagggcgtgagcctgaccgtgcagcgcggctcgctcacctccatcgtggggcagacaggctcaggaaagtcgaccctcgcgcgcctcatgtgcgcgctcgacacgcccgacgcgggccgcatcgtggtcggcggcgtcgatacgcagccgcgcaggaaccgccgcctcgtccaccagcgcatcggctacgtgatgcagcaccccgagcggcagctcttcgcagagaccgtgtggcaggacgtgtgctacgggccgcgcaacctcggcctggacgatgccgaggtcagccgtcgcgccagccgcgcgctcgagctcgtgggcctctcgggaagggagcaggtctcccccttcgagctctccggcggccagcagcggctctgcgccatcgcaggcatcctcgcgatgcgccccggcgccatcgtgctggacgagcccacggccgggctcgacccgcgcgggcgagcggagctccgccgcatcctgggcagcctccacgcgcacggcgtcaccatcatccaggtcacgcactccatggaggacgccgcccgctccgaccaggtcgtcgtcctcaacaacgcgcgcctcctcatggcgggcacgccgcgggaggtcttcacgccggcaaacgccgtgctgctgcgcgagtgcgggctcgggcttcccgccccgctcgcgtgggcgatcgagcttcgcgaggcgggcgtcaccctggacctgagccagggcctggcaccgctcacgacggaggcgctggcagatgccctggcagaggctatcgcgcgcgccgcgcgcggcccacacgacgcgcatgactcgcacgaccggggaggcgactgatggccctgcgcatatccatgggacagtacgtcccccgcaactcctgcatccaccgcctcgacccgcgcgccaaggtgggcgccgcgctcgcggtcatgatcacggtcttcttcgtgcagacgccggcgcagctcgcgttcgcgctcgcgttcgccgccgccgtgctcgccctctccaaggtgcccgctcgtcaggcgctgcgctccgtgaggccgctcgtggtcatgctgttcctgctcggcctcttcaacctcctctacgtgcgagaaggacatgtgctcctcgcgctgggggcccttcgcatcaccacgggcggcctctggtacgcgatctgctacccgcttcgcttcacggtggcggtgctcatgggtgcgctcatgctcttcaccacgacgcccacacagctgacggacgccgtggacgcctgcctggcaccgctttcctccatggggctgcctggacacgagcttgcgatggtcttctcgctcatgctgcgcttcatccccacgatcgcggacgaggcccaggccatcgtcgacgcgcaggcggcccgtggcggtgccgtgggagagggctcgctcgcccatcgcgtgcgtgccataggtcccgtggtcgtggcgctgctggcaagctccgcccaccatgccgagggcctgtcacgcgcgcttgacgcccgctgctacgagggtggctccgcgcgcagtcactggcatccgctgcacatggccgggcgagattggcttgcgctggccatctgcgcggcgtacgtggtggtccttctcttcctgggcacgctctagcgccgccggcgcggtggcctcaaaccccgcgccggcgcacgcctacgcgaactggctcctgtagagctccgcgtacatgccgcccttggccagcagctcgcgatggttgcccttctccacgatgctgccgtggtccatcaccaggatgaggtccgcgtccacgatcgtcgagagcctgtgcgcgatcacgaagctcgtgcggtcctccatgatggcctccatcgcgcgcgtgatgtactgctccgtgcgggtgtccacgctcgacgtcgcctcgtccaggatgaggatggccgggtccatgagcatggcccgcgcgatcgtgagcagctggcgctggccctggctgatgttctccgcgtcgttggagagcacggtgtcgtagccgtcgggcagcgtgcggacgaagtagtccacgtgcgccgcgcgagccgccgcctcgacgtcctcgcgggtggcgtcgctcttgccgtaggcgatgttctgggcaatggttccctcgaacagccacgcgtcctgcagcaccatgccaaactggcggcgcaggtcggcgcgggcgaggcgcctcgtgtcgatgccgtcgagcgtgatgcgcccgccgtccacctcgtagaagcgcatgagcaggttgatgagggtcgtcttgccggcacccgtctggcccacgatcgcgaccttctgtccgggctccgccacgaagctgacgtccgacatgaggggcttgtcaggcgagtagccaaagcgtacgtgctcgaaggcgacgcggccgcgcacgtgctcgggaaggcgggccggctgctccgggtcgggaacgacctcctcctcgtccagcaggcggaagacgcgctccgccgccgcgagggcgccctgcagcatgttcaccgtgagcgagagctgcgtgacgggctcggacgccttgaagacgtactggaagaacgcctggaacgtgccgatggtaaggcggcccgccacgagcatgccgcccgcgaggacgccacagatgacctgcgagagcctcgtaaggaagcggatggcgggagagatggcgttggtgaggaagtccgcacgggcgctcacgagcgcaagctcctgtgcgtccgcctcgatctgctcgaggctcgcccgctcgcggccgaacgccttcacgacggtgcgaccgctgtatgcctcctccaccctgccggtgaggcgtcccaggacctcctggcgcctgccggccaccacgagcgtcctccccgccaccacgcgggtgagcaggagcgaggccgcgatgaacacggtgaagatcgaggcgagaaggacgtccatgcggaacatgatgatgagtgcgcccacgagggtgactgccgagatgatgatttgcaggagtccgcgctggagcacctcgctcaccttgtccaggtcgttcgtcgcgcggctgatcgtgtcgcccggcttgtgcgcgtcaaagtaacgcagcgggaggcgccccaccttcgcggagatgtccttgcgcaacctcaggttgagccgctcggcgaagctcgccatgacgagcgactgcgtgctgtagaagacccaggcgagcatccagatgccgaggtagacgaggagctctcggccgccgtcgtcgagcgtgaccacgaacggctcgcccttcgcgaacgccgcctggatgttcttccacaggaggtctatcaggtgtgccgagtacagcggcgtgatgaggtcgcacgtcacgtagaggatggcggcaatcgtcgccacgaccacgcgccagcgcaggccacgcgccgaggcccaaagcctgcgtgcagtcagcagaccgttctcaggcacctcaagctcgtccttctcgtcccgtgcgtccttcttgtccctatcggccatcttccacacctcccctttcctgcgaccttgcgattgcctgatacgtcgggcaaatcctcatgagctcgtcgtgggtgccgaggcccacgaccctgccctcgtcaagcacgacgatctgcgctgcgtcgcgaatggtgctcacgcgctgcgcgatgatcacgacggcggcgtccgcgagctcgtcctttagcgcgtgccgcaagagggcgtccgtcttgaagtcgagcgcgctgaacgagtcgtcgaacacgtagaggtccgccttgcgcacgagcgccctcgcgatggcgaggcgctggcgctggccgccgctgaagttcgaccctccctgcgccaccggagcggctagcccctcgggaaggtcgcgcacgaacccgccttgggcgacgtcaagcgcatgccagagccgctcctcgtccgccgagtcgtcaccatcacgaaggttcgaggcaacggtgccggagaagagccaggccttctgcggcacgtagccgatgcgggcacgaaggtccgcccgcctgaccccccgcacgtcggcccccatgaacgagaggctgcccgacgtcacgtcatggaagcgaaggagaagcttcgcgatggttgacttacccgagccggtgttgccgatcacggccgtgacctcgccgcgcctcacacggaagtcgacgtcgtgcagggtctcctcgtcggcatcggcgtagcggaaacccacgtggtcgaagctcgcgacgacgtcgccgcgcgtggcggcacccgtcccgatggccttcggctcctctgggtcagccaccgacgggaccgcctcgaggacctccgtcgcacgggtgaggcacgccatcgcccttggcagctgcagaatcgcgaactgccccatcatcatgaagaacatgatgatcatggcgtactcgaccagcgccgatatcgacccgatctgcatggcgtgcgcgccgacgcggtcggcgccaagccatatcacgaggacctcgaccaggttcatgaggaagaacgtggcgcagtccgccgtggcgaacaccatgttcacgcggatggcgttcctggcatagtcctcgaaggtctggtcgaggccacgccttgcgtcctcctccttcccgaaggcgcggatgacgcgcacgccggtgatgtgctcgcgcaggcgggtgttcatgcggtcgacgaacccctgcatgatgaggaagatcggggcggacttccgcacggcggcaaccatgatcaggctcatgaccacgctgatggagagaagcagccatcccatctggtagtcgaccccaaacgcgagaacaacggagaccacgcagatgatgggaaccggcgcgagcatgatgaacgtcatgaggaacgtctgttgcaccacgttggcgtcggacagggtgcgcgtgatcatcgatcccgtgccgaactgcccaaagtcgaagccgctgagctcgagcgacttgcgatacacggcgacgcgcatgtcgcggccgatgttcgccgccagacgcgacgccaggtagaacgatatgatgcaaccgcccgacccgatgaccgacgctgcgagcatcctcagcccgtgcgagaggatctccggagagcccttggtggagattgcggcattgatgagcgccgagagctcggtcggcacgtacagcgttccgacaatgtcgcacagcagcatgagcagggtgacaacgcacatgcccttgtagggagagaggagcctgagcaggagccttgccgactgcgacttgctgtagtcgcgctccacgcccttctcgcccgctttgttcttcttcatctcttgtctcccccctgctcccgcgtttcttctggactcgccgcgctatcttcgccgcggcttcgtatgatctggcccatctcgaagtcgatcgcatcgacgtacttccggacgagccggacgaactccaaacgctcgtccttgccgagcgacgcgaacgcacgctcctcggcctccatggcggggctcacgttgtcatcgcagaagagcctcccgagctccgtgagcttgacaagctttgcatgacggccgtcgtcggtcgggacgagtcgcacgtagccgcgcctctcgagcgacttgacggccgagttcaccgtctgtcgcgacatcgtcatgtcgtccgcgatctgcgcctgggtggcaccgccgtgcgtgacgacggagacgagcgaccaatatgccgccatggacagcccacacccccgcgacacctcgtagtagaggcgatcggactcgcggaacaaggcatctatggaacgggcgctcagcgagtcacccgtgtcgctcccacaactcgctccgtcgcgtcggcgctcgccggccacaccgttcgtaagacccatggtcgaaccctcataaaatccgaattcggataattccgcttgatgataatccgaattcggacaatatgcaaggctgcacgagaggctggattacgaccacaccgccatcgccacggtcgcgacggtgatgatcgcaaggcccaggagcgaccgcttggtgtatcgctcgtggaacacgacggccgcaaacgccatggacaccagaatcgagagcttgtcgattggcacgacgacgctcacctggccgttctggatcgcaaagtagtagcagagccaacttgctcccgtagcgattcccgagaggcagatgaagccaagctccttggcatccaggacgcgcgggtttacctggtcgagctttccgcgcatgccaaccacaagccatgccatcacgagcacgaagcaggtcctgattgcggtcgcgaggttggagggaacccccgcgatgcccaccttcgcgaggatggaggtcaacgccgcgaagacggctgaggctacggcataggccaggtacgtgtgaccctttgcggtcgtggcgtcatcctcggcaccagccttgtgctggaccatgaggagcgttcccacgagaatcgccgcggagccaaccagcttgacgggaaggttgctgtcctcgccaaacagcacgatcgcaaggagaatcgtgagcacggaagacgtcttgtcgatggggacgaccttgttcacgtcgcccattgagagtgccttgaagtagcagatccagctcgcgcccgtggcgatgcccgagagggcgagaaatgcccaggactccgccgtcacgccgacaatggccccgatctgtcccgtgatggccgccatgagccacgagaacacgagcacgactatggtacgtatcgccgtcgcgacgtccgaatcggtcttgttgattccaagctttgcgagaatcgacgtcacgccggcaaagaacgccgagccaatcgctgcgacaatccacatgggtttcctcctgaaatcagctatcgaccgtaggaccagcccgctccgaggacgccctcctcctgcgcggtcagctcgtcgctcaccttgagcgtgtgcctgttcacgagcgactgcttccaaccataggagagctggccaacacttacgtcgaacaccacgtgcccaaatgcgttcacgaccttcgttcccgtctccatggtacgcaccctacggaaatccgaggtgtatcccttgtgcacgtgaccgtgcacaaggtactgcgggtgccacctctcagccatctctcccaggctctcgaagccctgatggggaatgtcatccaggtcgccaacgcccctcacgggagcgtggcagagcatgaggtcgactccgccgagcattctcacctgcctggagaccttgcggatgcgtcggctcatctggcgctcggtgtacatgtacgttccctctcgatagcgcctcgacccgccgagacccacaatccggagtccgcgatacacataggcagcatcatccacgcagatgcagcccagcggggggttgcgcacgtacttctcgtcgtggttgccatgtacgtacaggagcggcttgttgatgatggtgacgagaaattcgaggtagtccgcgtccaaatcacccgcggcaagaatgaggtcgacgtcggagaatcgctcggctacgtttccgctccagagcgccctctcctcgacgtctgcgacggcaaggattctcaggctcgaatcactcatcggcctcgtctcccctcatgccgctcacgtcgtaaagcgtagtaaggtccgacggcagctcgccatcgacattttcggccagccagtccatagagacgatctggttgctcgtcaacgatgccgctccctcggagctcacgattccgttcttgctcacgagctcccccgtgaacggcccgagggatccagacttgattccacgctttagcaaatcgaccagcttcctcgcgccatgcggaaggtccttcgagagcttgaggtcgatcacgcccgaagacatgccataccagtacgtgacggcgcgcatgtcccgatcagcctcggcgggttcggaagacgtcacgctcggaagcccgcccgccagcatgctccccacgatgagctggtagtacctcccccaattccatgtcggcacggcaaggttgcgcacccgcccgtccaccaccttgtaaagcccgtaggcaagcgggtcgtcgaacggcggcgtcacgtccgaaccgcaaatcgtcgtgatcccacgcgagacgagacggtcgatgtcgctgtcctcacgtctccgtgcccagtcgagcacgacgcgcgcacgcgggtcacagatggcgacgccctccgcaaacgcattgatctccgcaatcgagccataaaggggaaggtgggccctgtacgcgacgacgtggtcgtccgccatgctcgccgcaagtgcaccggcaatgaacttcgcctcgtacatgcgcccatagtacgagcgcacaaggccgtgcggcaggttcaccgagcagttgagaaagtgcatctgcgggaattctgccgcagccctgaccgtcatgtccatgagctcgggcgagcaggagaagaacacgaccgcgccctttgtctgcgcatcggagaccgcggacacgaaggtctcctcttcggcacagccctcgtaggcgagggtcctgacgaccccgccgtagcgctcctcgagaacgcgcctgccatcgtcgtgggcgcgcgaccagtaggagtcggccagactcccagggtacgcgaatgccaccagaagtggttgctgagttgtatattgcctccgggcgacgaacggggacgttccggaaacgcctgtggtaggttcgctcacaagcagcgtctcgctccccgagctgctggcagctagttccgcccagaccttcagaagcctgtcacgcatcacggaggctggggtctcgcgaaggttgctcgaaccgaagatgtccatgtagatgagaaacgcgtccccagccgtgatgtcgagatgagagccgcccgccttcatgtagatggacttgaagaagaggtaggacgactgcaggttgcggacgacgtcctcgggccacggttctccgagacgctggccgaggtggcgcgcaagtctctcgtacgacccaggatgcgagaactctatctcgtaggtcggtgcggaccgccagaactcgaggaactcgtcgtattggtcaatttccagagactggtctacaccggcttcgtcacgatgaccggcaccgcttgccttggctggagcgtttgagtccgtccgcaccgcagaggggagaatcctcgtgacgtccgcctctatggacggagactcgaggtacttgagtaccgacgttcgcttgtttccctcctcgacataaaagcgatgcaggtactcgtagaccttgattgggtcacggaacccttcctccatctgcgcgtcatagaggtgggaccatttggtcgcaaactcggtcttgggaccgagcacgggcatgaaggaccgcgagaacgcatcccgtcgaccggcggtgcgcgtccctatgaccatctccagcggaatctgcattacgccgagatggacttgggagagcgtctgcacgtttggcacgagctcctcgagaacgggaggatggggatacctgccagacgacacgtcgcgcttgctgtcgcggacgccaagcttctgcgccttcttgtagtcctcgatcatggtcgacaccctccatcctaccgtcacccgaacacgggaccgccactcatacggggcgcatatacgatagcgcacgccctgccgtaggcgaacgagtccaggcgcttccttacctagccaagctcgatatgggcacgagagccattgcgcgttgactccacgacaatctttctttcgattgactcctgcagctcttcgacgtgactgatgattcccacgagcttgttggaccctgacaggtcggacagcgttcgcaccgctaggccaagcgactcctcgtccagcgtaccgaagccctcgtccacgaacatggcgtccaggcggactccgccggcgctcgcctgcacgacgtcagacagaccaagggccagcgacagcgacgccttgaacgactccccgccggacagcgtcgaagccggtcgaggcttgcccgtaaaggtgtcacgcacgtcgaggtcaagccccgactgcgccgcgccgacccgctgccccttgtggcgctcgagctcgaacctgccgttcgtcatcacgtcgagccttcggtttgccgcagctatcacccgatcgaaccatcgtgcctgtaggtacgtctcgaagctgatccgctccttgcccgcgagcttcccaagggccgtgttggcaagggcgcttacctccccatagctctcggacacctccccatagctcgcctggaggtcttcgagcctcctcccaacctcgcggttggacttgcgcctggcctctgccgccgaagtcctttcctgcagtccccctcgttccccttcgagctcggaggccttggacgcgagttcctcggaattcgcgctcagtccgtcgctgagcgtggcgagttgctgctcgagcgtcttcaatgtggcacgcttcgcctcggtatccctctttgcggactcaagcgccgcctgcgccgcagccgttcccgagacgatcttcgagtgcgcatcgtcgagttcccttgccttgagctctgcgtcgcgtctgcttctcaggcttagtccctgcgcgaacgcctgtgcctttgcctcgagcctcgagaggttgttccccgccgcggactcctcggacctggctgtctccaggcgtgtctcggcatccttggcggctgcggtaagcccctgcacccctctgtcgagttcctcgcattcctccaccatggtctggaggcgcttctcctccatctcctccctggccagggtcctcttggcagagtcgagcctcgccctcgcctccgaagcgtcctcgacctcgacggtccgcctgaactcccgcagcgagacgctcgcctgccccaggtgcgcgtccgcctcagacttggccgattgcgcgacatcaatggccttccgcgcatcctcgagctctgcgcgtgcgactttcagagcctttctggcgctctcgagcgacttggaatcatcgtcggccgagatgcgttcagcctcggcgtcaactctcctggcttccaaatctgagattctgcttgagacggcttcggcatccccctccgtctgcgtcaggcgttcaagctctgccttcgcagatgacaggagcgctcccgccttcgatgtggacgaggacgtctcctcgagttgctttcgcgcggcttccgctgcctcgcggctggacctcacctcgtcctgcgtcgggacgtcccctgcgaggcgcgcaagggacggatgcactgtcgacccgcacacggggcatgcctgtccatcggcaagcccactcgccataattccagcctgaccgtcgaagaaggcccgctccatgtgtgcatagatctgctgagcatcgttgaacgcatcgcccgcatttctctgctcatgactcgcagtctcccacgcctgccttgcgctctcgacgtcctcctccctcgacctgatcttcgagagcgtctgcgcctcctgccgcacgagtcgcttcagctccgcaagcgatgcctctgcgcgggctagtcgctccggcgcatcagagagcctcgtcacacttgaatcaagatcacgaacggttcgctcgacctcactgagttcctcgtccctggcctcgagtcgcctggcggcaccgttcgcgaggtccgtcgccacggcaacctctccctcgcgacgctcgagctcctggcagtcggataccgcctttttcgccagctcaagggagcgctgcgcctccgccctcgcggtacggacacgctcgagctccgctgccgcaccagagagctgttccctgcggtctctggccgcctcgagccttgacgttgcctcgtcgcgctctcgctgcgccttgtcacgcgaggacgacgcctcgtcaagagcgcggcgcccgctggtaacccggtcgcgcaactggtcaagctccgcatagcgcggcagctcgcccctgatcacggcgaccctggcggcaagagactgggcctctggctcgcgcgcctcccattccgcaagctcgcgcctcctcttgccggcaagcccctccgcgacggcgagcgcgtccctctgcgccttgatgtccctgcgcgtcacatcgacctgtcgcgcacgctcgatcaggacgtttaccttgtcctgctctgctcgcacctcgcccagcttcgcttcaagcgaggaaaggaggtttccgtcgtattcgtcctgggccgcgagaagtgacaggagcgagtcgacgtccggcacttccgagtcctgggcatgggcgagagcctcggcgcgaccctcgtccccctcgaccgcaatcacgcccatcacgccgcgcacgttctcgagaatggagcggctcttctcctccagcttcttgcggcgtccctcgagggcgcgctcgaagctgaggtagggagccgtgccaaagagcttgcgcaggatctcggagcgctccttggtgtccgccgcaagcaggcggcggaagtcgccctgggcaatcatcacgatctgcgagaactggttgcggtcgatgccaaggagctcgcggacccgatcgttcacggcggtgggtcggttcacgggcttcttgtccggatgggagaggtcctcgagggtcgcgtcagggctctccgtcgtgacgccctcgccgcgcagcttcgggcgctcgtaggcggggttgcgacggacgcggtagcggttcccgttgtgctcgaactccagctcgacgaaggtcttcacgtccggcgcggcaaagtcgctcctgaggttccttgactgtcggtactcgccgctcggcctgtcgaacagcgcgaacgatatcgcgtcgaagatcgtggtcttgccggcaccggtgtcgccgcagatcaggtagatgcccgacgtcccgagctgcgagaagtcgatcgtcacctcgtcggcgtaggggccgaaggcggacatggtcagcttgagcggtctcatctacatcgcctcgattcccttgagctcctcgcggacgatcttttgctgcgcctcgctgagtggcataccgttctgctcctcgtagaagcgcgagaagagctcgagcggcgaggcctcggcgggtgcgtccacgacgtccgtgcgcacgccggcggcgcgcgtgcgggcgttgtcgtaggtgatgctcatgacgttttggtaggcgtcacgcaggcgcgccatcgcgttaacctccacattctcgtccgtgaggacgacgtgcaggtagtcgctcgcatcctgagcgcccacgaccgcaggtgagaggagcttgtctatgggaccgcgaatcctccgcaggtcgtgcagcggctggaccggcaggagctcgatcgtcggctcatcccccttccgcccgagcgtgaccaggggcatggacttgtcgtagtcagcctccgagagcgagtacttgaggagcgaccccgcgtagcgcacggagtcgcgaccgacgcgctgcggccggtggatgtggccgagggccacgtagtcgaaggggtcgaacacgctcgcgtccacgttgtcgagcccgccgaccgagacctcggagtcgctgcgctccaccgtgcagccggcagccgtcacgaattggtggacgacggcgacgttcctggcgccctcatccagcggcagggactccacgagcgagcggaacgcatccgtgtagccgtccgtcttggcatcgggcaggaagtgcctgatggtggccgggtggaggtaggggatgggccatatgcagacgggaccgaactcgtcctcgagcacgacgggctcgatgtggccgtcgaacgccggcgccatgtgcacgccctcccgcgcgaggaggctccccgcgtaggcgacgcgctccgcggagtcgtggttgccgggaatgacgacggccggcacgcccgtggcggcgacgcccgagaggaaccagtccacgagggccaccgcctcggagcttggctgggacttgtcgtacaggtcccccgcgacgagcagcgcgtcgaccgtgccgccagacagcaggtcgagcacctgcgagagcgcatggcgctggtcctcgagcatggggaagtcgcacacgcgcttgcccacgtgaaggtccgcaagatgaagcagcctcaacggcaccacccccgactccggcgcccgcgcgccgcgcgggcgatttggctgtctgacgattctatcatgccatgcgtacgtttgttcgataaagttggcacgttcttctcgcccgaaaggcagccgcaagactggcggccggggcgattctgctcgtaacgagggatttaccgcagcggcaggtcagaggcggcgggcgggggctatcattgggggcgcaacccccacacgtcccaagagaagggcaagcaatggtctcacgtgtgtacgtagagaagaagccgggctttgacgtcgaggcgcagcagctcgggcacgagctccgccacaccctcggaatcaagggcctgaaggacctccggatcgtgaaccgctacgacgtagagggaatctcgaagtccctcttcgagcagtgcatccccaccgtgttcagcgagccgcagtccgacgtcgcgacgacgcgccgtcccgccgcgaagggagcgaaggtctttgccgtggagttcctgcccggccagtttgaccagcgcgccaactccgcaagcgagtgcatccagctcatcagccagggcgagcgcccgcaggtggcctccgcaaagctctactacctgggcggcaagctgtccgacgccgacgtcgaggccatcaagcactacgtgatcaacccggtcgaggcgcgcgaggcgtcgctcgcgacccgcaagaccctcaaggtcgactaccccaagcccgagatggtcgagacgctgaccggctttggcaagctcaccaagaagcagctgcaggactttatcgacgagcgcggcctggccatggaccttgccgacatcaagttctgccaggactacttcaagggcgagaagcgcgaccccacgatcaccgagatcaggatgatcgacacctactggtccgaccactgccgccacaccacctttggcacgcagctcgagaacgtgaagatcgacgacgccgtggtcgaggcggccttcaagcgctacctcgaggtgcgtcacgagctcggccgcgacaagaagcccgtctgccttatggacatgggcaccatcggcgcgaagtacctcaagagcaagggcatcctcaagaacctggacgagtccgaggagatcaacgcctgcaccgtcaaggtgaaggtggacgtcaacggcaaggacgaggactggctcttcctcttcaagaacgagacgcacaaccacccgaccgagatcgagccgtttggcggcgcggccacgtgcatcggcggcgccatccgcgacccgctgtccggccgcagctacgtgtaccaggccatgcgcgtgaccggcgccggcgaccccaccgtccccgtgagccagacgctcaagggcaagctgccgcagcgcaagatcgtgcgcacggccgccgcgggctacagctcctacggcaaccagatcggcctcgcgaccggccaggtgaacgagctctaccacccgggctacgtcgccaagcgcatggagatcggcgccgttgtgggcgcgacccccgcgagccacgtgcgccgcgagtgccccgcgccgggcgacaagatcatcctgctgggcggacgcaccggccgtgacggcatcggcggcgccaccggcagctccaaggcgcacaacgtggagtcgctcgagaaggacggggccgaggtgcagaagggcaacgccccgaccgagcgcaagctccagcgcctgttccgccgcgaggacgcctgccgcctgatcaagcgctgcaacgactttggcgccggcggcgtgtccgtcgccatcggcgagctggccgacggcctctacatcgacctcaacaaggtccccaagaagtacgaggggctcgacggcacggagctcgccatcagtgagtcccaggagcgcatggccgtggccctcgcacccgaggacgtggacgagttcatgcgctacgcgcatgaggagaacctcgaggcgaccgtcgtggccgaggtgaccaaggagccgcgactgcgcatggtgtgggacggcgagacgatctgcgacgtgagccgtgagttcctctcgtccaacggagcgcccaagcaccaggacgtccacgtcgaggcgcagggcagctaccagccggacttcaagggcgatgacctttcccagaagatgcactcgctcgtgaccgacctcaacgtggcctccaacaaggggctttccgagcgctttgactccaccatcggcgcggcgacggtcctcatgccgtttggcggaaagtaccagctcacgccgtccatggcgatggtcgcgaagctgcccgtgtttggcgagaccaccacggtgtccggcatggcgtggggcttcaacccctacctcatgagcgagaaccagttcacgggcgcctacctttccgtcgtggagtccgtctgcaagctcgccgcggccggcatcgaccgcaaggccatgtacctcacgttccaggagtacttcgagaagctccgcgacgtgcccgagcgctggggcaagcccaccgcggccgtcctgggcgcgctcatggcgcagctcgacctgggcatcggctccatcggcggcaaggactccatgtccggctcgttcgagaacctcgacgtgccgcccaccctggtctccttcgccacgggcctcggcaagctcgaccgcatcgtgtcgcccgagttcaagcacaccaacagcttcctgtggctcgtgagccccaagtaccagtccgacggcgtcacgcccgagccgcagagcctgctcaaggtgctcgacttcatccaggagcacatcggctacggcgtgatcctttccgcctcgacccccggctacggctgcctggccgagcagctcttcaagagcgccgtgggcaaccgcatcggctttggcctcgtgaacgagttcccgctcgagaggctcttcagcctcgcgtacggcagcttcgtgatcgaggtggacgacggcacgttcatccccacggaccgcgagggatttgacgtacagtaccttggcggcacctccgccgagtacaagatgtgggccgcgggccaggagctcgacctcgcagagctgcaggaggcctgggaggagggcatcgagtccgtcttcccgtaccgccagaagggcgacgccgtcaaggccgagaccttcgacgtggccgagaagggcgtctctcgcccggcgccgctcgtcaaggtcccgaggccgcgcgtggtgatccccgtgttcccgggcaacaactgcgagtacgactccgcagccgccttcgagcgcgtgggcgccgaggccaagaccttcatcatcaacaacctcacgcccgaggccgtcgccgagagcaccaaggcctttgtggaggaggtcaacaagagccagatcatcatgatccccggcggcttcagcggcggcgacgagcccgacggctcggccaagttcatcacggcgttcttccgcgcgccgcaggtgaccgaggccgtgcgcgacctgctccagaagcgcgacggcctgatgctgggcatctgcaacggcttccaggcgctggt
